United States Patent 8,067,671 (METHODS FOR GENETIC CONTROL OF PLANT PEST INFESTATION AND COMPOSITIONS THEREOF) - sequence listing, part 41

SEQ ID NO: 81233 - DNA, 223 bp, Heterodera glycines
  Genomic contig location: Contig_ID=SeqID_16819; Location=551..773; Strand=+
  SCN-specific regions: Sequence locations=1-6,38-75,97-223
ttaagcattatttatcaatttttatttaaaaaataatcggcaataaaacagtggcccgacagtttggcacaaaatttattctttcattcattccttcgtttgtgccattattctctttgctctcaaaacgtgattccctagcgatgcccatcgacgctgctgctttgtgcttttccattgcgcggcattaatccttcccttttgacagttggcacaaatcgaa

SEQ ID NO: 81234 - DNA, 143 bp, Heterodera glycines
  Genomic contig location: Contig_ID=SeqID_16820; Location=431..573; Strand=+
  SCN-specific regions: Sequence locations=1-143
caatgtccaatcgcctgtgacgactccgtccagaggtcaacaaacgctgtctttgtcggctgctttggttcaacagcagcaacaatcgggcacgtacacaccgaacgtaccgcagggggatggagcagcaactgcaacagacc

SEQ ID NO: 81235 - DNA, 488 bp, Heterodera glycines
  Genomic contig location: Contig_ID=SeqID_2717; Location=495..982; Strand=+
  SCN-specific regions: Sequence locations=1-88,121-392,420-488
atgggcattgtggcgcggcgtctgctcaaaaaccgggccattcaaaagcagttggaccgtcgacaaaaaagtcggttgaattatgtggaaaaatttaaaaagataatatttttttttaaagatatgaaaacgcttcgccgtcaacaggcggcagctggtcggtcgcccattgttgtgcattcggcgggcattggtttgccaaggaccgagccggttcatcaagtaaaaagttttacacattcttttttgtttattgaaaacactttttttttttagcgccaggaaatctgcacagtgcccgcccatgaagtcatctacgacgtgccttttgatgggcaaagagaggaagaagacgaggactcattctgatggccttttgaatttaatcccataatcatttaactcatttttcatttgccttttaaatttaactcaataatcatttaactttttttcatttggcttttaattacatacttatatggaaa

SEQ ID NO: 81236 - DNA, 442 bp, Heterodera glycines
  Genomic contig location: Contig_ID=SeqID_2717; Location=1730..2171; Strand=+
  SCN-specific regions: Sequence locations=1-171,194-287,309-442
atgtctacatcggaatcaaaaaatggtaaaaatctcaattcctcccttaacattaacaatctttcacctacagcaccggacgaaggcgactgcgaaatgcccgatgaacgtgttctacacctcgagtgctttgagagcggtgattatgatgtaaataattgttgaaaattccatttgtttccctcaattttaatcatttcagatgatggaattgtacggactggaccgtgctaaagaaatgctgatcgacttgcgcgactatgcagaggcgcacggaatggcatgtaaacatgtgaagatgctgttgtacaaactggacaaaggactgatcaaatggaagggaaccaagccatgaaatggatgatgagtgatcagatattttggtgacaggacgaaggggggatgattgaactcattggtgatggatgtgatttaaaaaaaa

SEQ ID NO: 81237 - DNA, 726 bp, Heterodera glycines
  Genomic contig location: Contig_ID=SeqID_2717; Location=2380..3105; Strand=+
  SCN-specific regions: Sequence locations=1-726
atggcgatcaacatctccgacaaaaaatcgttgtgcaaccaaatcctcggccaaacggacctcaccgtgacctcgagtggtataaccatcagcggtccccgcctctcgacaccccgtttcattccttttgatgaagcgggtcgttgtaggtgttgtaagggaacggagtccgaaattgacactgtgatcacgaaagaaggcatcacgctttggtgcacccgcatagagaagacccaattcattccattcgatgttgtgtatgatttgccagggcattgttttttccgtctgaaaaataagtctcgtgtgttcaacataccctatggcgacataccctcttctgacacgcacaccactaaacgacggacacacaccaatgaccatcagcatgaactgaagcgcaaagcaaaggtagctcttgacttagtggaggccggactaatggcagatgccatgcaggacggcgcacgttggaagaaggcgaaaacagcaatcaatgtgctcggcaacctccttttggcggaatcgctggacaacacttccgctaatgacactccgctgaaaaatgataccgtagacatcaaaaaagaagaagcaaatgtggaggaagaaaaggtgcaggaagagcccaaagaaaaagaggaaaacaaggaggaccttggagacattgacaaaacgctcgatgagttcttcaacagtattaaagcatccacttcaaacatgtag

SEQ ID NO: 81238 - DNA, 2096 bp, Heterodera glycines
  Genomic contig location: Contig_ID=SeqID_2718; Location=45..2140; Strand=+
  SCN-specific regions: Sequence locations=1-76,98-451,473-643,676 -1504,1526-1913,1935-2096
atggacactgctcagcagaggattgccatcagaagaaaattaaaaaaggacgaagcatatgatgatgattcggaacacaaaaaatacagggttcattacccaccttcacctccccggcttccgctcccgcctcgtgcgaaagcaaaaattgaaccaccaccatcgcgtcctaccgccaagagagagcctaaacaacaaaagccaacaaagtttgaactaaaaccatcaaaatttgactccgatttacgaccaaaagtcgcaccgccgcctcggccgaaaaaagaacctgaattcccgcttgaccctcggccatccacatccaggcaggctggacacttgcctcccccagcacccaaaattataccaaaacctgaaccgacaaagaggcctgtaccataccgtatcccgaaaagagagccaaaaatagttgaacaacagccacagccgctgcaacaaccccttcctgcttctgccgtcgaagaagaaatgcccaccgttcctccgcctaggcgggggaccaaacgccactaccccgtaaatggtgagaatgatggtgaggtgcgcattagaaaacgcgtgaggcaagcgcgaagggtgagagtacagtactcgcccgaactgggcccatcaacttctgcacaaagtgatgaacaacagcaacaacaacaacgtgaactgtttgccattccatcaaatcagctgaccatgactcagcgggtggaacgactgtacatcaaatgcaaccgttacgctgatcgtatgggcgttcgaggaaatacaattaacacagcaaacggcaaaccgttggcgcatagcaatttgcgaatggccctcaagtatataatagaccggagagcgggccgccccaccattaagccacctggagcggccatattggaagagaggcttaggcaagacccaattttgtattcatggacggctccgtcaaagaggccatcccaaagcaaaacaacccggacgccgcagacaatcaagaaggaatttcgcccgaaaaagtggagttgatcaacaccacacttgacaaactgtacaatgacccatcctccccagcagcattcgccggtgttaccgcactgtggaaagaggcgcgaaaaaagttgaaaaatttacggaaaagggatgtgcagcactatttggagggacaccgcacgtacactctgatgcgcccccgcagggtgcactttccaagggcccgaaccgttgcggcggggttcatgaccgatgttcaagtggatttggctgactttcaggcgctttcgcgccacaatcggggtcaccgatacctgctcgttgcggttgacgtgctctcaaaacgcttgtttgttgttccgctgaaaaacaagagagccgaggagatgttggaggcattcaagcaactcatcgaccaaatgcccatggtcccgcatcgcattttttcagacaagggcaccgaattcaagaacagattgctgaaggaattcttcgatgagcaggaaattaagaaacatgagccagtgcattcatctgtcaaggcatccgttgctgagcgggccatccgcaatattaagcagagattgtaccgctattttgcggaaaaggagacgctgaattgggtggatgcagtacagaaaattgtggatggaattaacagcgctccgtctcgtgttcacggaatgcgccccaacgatgtcaacttttcaaatgcgcaaaaggtgtggaagcgactgtacggacaccctgctcttcaaaagcggacgccacgcttccgtaacgaccagtttgtacgcatgagcagagagaaggggcaatttgagaagggatatttgccaaattacggggacgaaatcctggagattgacgaggtgttgaaagcggtgcgcccgattcggtacaaactgagggatgaacacggggagaaattcaagggcagcttctatgagcaggagctggcgcgcgtcagaaaggatgcagagacgagctaccgcatcgagaaggtttacagaaagagaaaactgtcggatgggtccaccgagatgcttgtgaaatttataggatatcccaatcgggaatggattaatgagtctcagcttgtataa

SEQ ID NO: 81239 - DNA, 307 bp, Heterodera glycines
  Genomic contig location: Contig_ID=SeqID_2718; Location=1..307; Strand=-
  SCN-specific regions: Sequence locations=1-166,188-307
ggtgcgacttttggtcgtaaatcggagtcaaattttgatggttttagttcaaactttgttggcttttgttgtttaggctctctcttggcggtaggacgcgatggtggtggttcaatttttgctttcgcacgaggcgggagcggaagccggggaggtgaaggtgggtaatgaaccctgtattttttgtgttccgaatcatcatcatatgcttcgtccttttttaattttcttctgatggcaatcctctgctgagcagtgtccatctgctcaatttcacgttgagcattgtagggcagctataggcaag

SEQ ID NO: 81240 - DNA, 961 bp, Heterodera glycines
  Genomic contig location: Contig_ID=SeqID_16824; Location=1084..2044; Strand=+
  SCN-specific regions: Sequence locations=1-237,259-414,437-444,471 -611,647-961
atgaacgtcatgttgaaaaccgaaggctacaaaaatcgtgaaaacccgcttgcggccagtcctagggaacgtgcagcaacaaagaaacagctcaggtgcaaattatatctcgtaataccacaatttcaccccacccctttggttacttctgaaatttattttatatagttctttttaccggtaaaccggcttccagacgtcttgtactattctatacttctttgcctagtctttcattaaatttatatacagaattaagctaaatcaaattataggacacatttacatttgaatttaaaatttcattgcctaaggtgttactcaggaattgtgagacacatttatgatatttaacattaacggagacacaatatcctatttccccaatactgcacctatttgctggaaggatagtgttcacagatcatctttatattaaaatgggacacatatgtatatataggttaataattagtcaactttttgtgctgccaggcaaacgcatcactcataccactctcgcagacggaacagatgtccagcttgctgaacctatttttcagcattcaaacacttctcctgtctcttacacgtaattacttaattgcctgttatttttttaagtgtataaaaataattattttttgtcagtttggcctttggggcgttggcaacgtttctcaagtgcgatggcctgaacacttctgccgattccgcggctccactttctctctactacacgttcaaccgaacgaagaagaatatcctgaatgcagctggacaatttaaagacaagatcaccaagagagatgtcactcctccgttaaaattctacagcgacttgtgctttgcattgacaaccgggttcaacacaaacatacgtgaacttaacaacctggcacatctgccacttacatcggctaaaatggctttctacttcgagcagttactcgacagttag

SEQ ID NO: 81241 - DNA, 489 bp, Heterodera glycines
  Genomic contig location: Contig_ID=SeqID_16824; Location=2312..2800; Strand=+
  SCN-specific regions: Sequence locations=1-167,189-448,470-489
atggacaaggaattctaccctcctctggcacaacttgttgactacaagttaccagtgtacggagacccttccaaactcaaacatatcggccatgcacttgcttccaaaagagatggaccggagaaggtaattaatgtccatgtgtaaaaaagtgatttcgcctatacttttataattttgttgttgtttcagcagcaattgttatttttcttgtccgttctgatcgcggtcactggcattgatatttctgccgttatggcttctttgggtgatgacgatttaaacctttctggcggtacagctatggacatctctagtgcggacattacgcttggcgcctccaacgttagaaagaaaactcgtcttgacatccttgtgaagcaactcttcaagacgatcagttgcccctggcttatttcatcatggagcagatcgagatggaagaagtcaaccagctattcaaaaataactatctcattaagcttgtga

SEQ ID NO: 81242 - DNA, 2412 bp, Heterodera glycines
  Genomic contig location: Contig_ID=SeqID_16826; Location=1147..3558; Strand=-
  SCN-specific regions: Sequence locations=1-66,88-1158,1180-1276,1298 -1474,1496-1541,1563-1707,1729-1748,1770-1801,1824-1863,1896 -2038,2060-2259,2301-2412
ttgctatttaaccaataactttttttcactgctgcgtatcaacaacaccatgtgtcttttccgtctctcctccttttacttttaaaaactactttcagaattcgacgagaggctgcccactgtcttgtccaaatttacaacagtctccccgaaagccgtcttggcgagtctcccccactcatcgattactttcgccagaattttgggagtaaaacttcgcctgacattccattaccaaataattacgcggccacttcctccaaccttcagaacaatttgcttggacaagttcactcattaacttagttcacgccgaaaacacttcatcttaggctttgcccgctgctattggcttaattcgaggccaagacggaagagagtgtccggaatacgtgttggaattcatcatcaacctgattaggctcaatgacaacagcactaaccggtcatttttcgctttctaaaattcatccgtttttgctttagttattctgacgattactacagaggagcactgatccacgcacttggtaaaagaagggttagggttttttaatttgagaacaaaaggcaaaactttgacaatgtctgaacggactgttgaacaacccgattgtttgtcggttcatgcgcgtggtgtgctgagggaagttacgcatgcgcttaacatggacacgatgaggccaagcttcggccgaattatcagcattcactgcatccaagtgctttacgaagtaaataattgaatcgttgccaaaaagaaattcgattaatcattatttttttaatcaagttgcaaaaacttcgccatctcccaatcgacacggatattttctggaagtttggccagtgcaaaggcatttatgcaccggtgagcaataattatttagtctttttgtatgttgttggtttgttaagttgcggctcactgcgttggcgtgccttgtggcaatgatcagacgaagtcgaaatcaatcattcatcggcacgattcttcggtgagtcgatcgttgggtgcgattacccaaattagcatttagcctcgtcgaattggttgcaaatgatcccgatccctttgttcgtaattctgtggctcaacggctttgtgttaacccgccttttgaatggaccgaaaagtgataacaccttccttaataattattttaatttggctgtatagcactttatatccattgaatacaaaacgtttggccgaccttttgtgggggataatctcggatgttcggactgtgagttgcataataattaattcttcgtgcatttttgtttttcatctgataggaaacacgaattcgaacttctcttaccgatctctactttactctttacgggtctggaataccgagcaatttttcttctttttaaatttatttttgttattgtacatttttttgaataaatattttcttgcatatgaaccgatgatggttggaatcttgtatgtagcaccaaacccaaattaaaattttttgaaactaagtaaattaccaatgaaaggcagtggtaaagaattgtggtccctaatttaactttattattttcggctcaaaatcagtttcccggggttttcgagggtgttgattacgcatttgaacttggatttgcccaattccgaaccccggacccgaattcgaacaaaaagttggaaatttttttttcaaaatataagttaaaactggtcaaattttaaatcttgataaaatttaacgctttaatttattttcattagggaccaaattctttaccattgcccaatgaaaaaatcgcaacaatgcactgcaaattataattatatataattagtgcagtcttaaattttacgataattaatgaaattcactgaaataaaaaataacaattttttttataaaaaagcaaattttgaaaattgcactcatttttcttaattcataaatccacaaattctcgatggcatcgtcaataatctttgcaccactggccctcaaaatttcactaaaatttgcaaaaatagacaattttggtaaagtaggtacctatattaaaaaatattgcaaaaatttacattttttcaccgtcagacatttatagataccgccagaccaaaaactttttcttaaaaattggctgaaaccgggattcccggaaaaacgggagcctcgtcccgggttccatcccgatccattttcaaagtccccttcatttcaaaatttcggtctctagatcaaatagtatcctgtctcacaattggaacgtttcataaatttttaaatgatctttaatttatatttattattaaagcaaaagatttgcccgattttattaatggatgatcacgaatttatggaggggatggagcaggaagatgaggatgagtttatcgaagagccaatgtctgctgatttcgactta

SEQ ID NO: 81243 - DNA, 3243 bp, Heterodera glycines; identical to SEQ ID NO: 16828
  Genomic contig location: Contig_ID=SeqID_16828; Location=1..3243; Strand=+
  SCN-specific regions: Sequence locations=1-426,449-705,727-806,828 -910,942-1019,1041-1171,1193-1431,1453-1540,1568-1883,1906-3038,3075 -3243
  Gene Ontology: Mol. function=sodium:hydrogen antiporter activity; Cellular component=integral to membrane; Biological process=sodium ion transport

SEQ ID NO: 81244 - DNA, 179 bp, Heterodera glycines
  Genomic contig location: Contig_ID=SeqID_16828; Location=2961..3139; Strand=-
  SCN-specific regions: Sequence locations=1-65,102-179
aggaagaaatgcgtttgtattacgtgtgcactaactcacagtgtactcatcggtggaccgactgaacgaacggaaaagaaaaaagggacagcggacggtctgagtcctttttctgtttcgatctcagcgaattgcgacggcggaacatttctattcaccaaataaacttaaagccgaca

SEQ ID NO: 81245 - DNA, 146 bp, Heterodera glycines; identical to SEQ ID NO: 56264
  Genomic contig location: Contig_ID=SeqID_16829; Location=33..178; Strand=-
  SCN-specific regions: Sequence locations=1-79,113-146

SEQ ID NO: 81246 - DNA, 146 bp, Heterodera glycines; identical to SEQ ID NO: 56264
  Genomic contig location: Contig_ID=SeqID_16829; Location=285..430; Strand=-
  SCN-specific regions: Sequence locations=1-79,113-146

SEQ ID NO: 81247 - DNA, 146 bp, Heterodera glycines; identical to SEQ ID NO: 56264
  Genomic contig location: Contig_ID=SeqID_16829; Location=537..682; Strand=-
  SCN-specific regions: Sequence locations=1-79,113-146

SEQ ID NO: 81248 - DNA, 146 bp, Heterodera glycines; identical to SEQ ID NO: 56264
  Genomic contig location: Contig_ID=SeqID_16829; Location=789..934; Strand=-
  SCN-specific regions: Sequence locations=1-79,113-146

SEQ ID NO: 81249 - DNA, 1258 bp, Heterodera glycines
  Genomic contig location: Contig_ID=SeqID_16830; Location=40..1297; Strand=-
  SCN-specific regions: Sequence locations=1-564,586-967,989-995,1017 -1102,1124-1224,1246-1258
  Gene Ontology: Mol. function=ubiquitin-specific protease activity; Cellular component=nucleus; Biological process=pathogenesis
gattttgctcttcgctgcttggattatattgatcaaaatgccgaaactttattcgaatcagaagaatttttgcaaattgatcaaaatttgttgtgcgaaattttcgaacgtgaccaattgaaaatcgacgacgaactcaccatttggaaagctgtactaattaattaattattcgattaaaaataactaatttcatttgttttttcaggccattcgttgggcagacgaaaagtgccgtcaaaatgccgtcgaatgttccgctgaaaatcgtcgttctgcgcttggtccggcacttttcaaaatacgtttcccactgatcacaaagaggaaattttcgctaaatattggtagttttttgtgttaatcctgtttattgttggttgggatcgagactcccgacgcggacatgtcccctgaagatcggtttttggattccgacttttttaaagcacgccaaatttgttatgtataaatgccgaccgccttaacaccctttgttttaaattcataacgtgcccatccatattaaagggatagattaataaatgaataaaaaaatagaaattttttcttaacaaattcagtaaaaagtccgcaaaactgtttaaaagttttaattctcgagtcgaggaatttcgcgtttttatcacagtatcttcctgcgttctgacagtggaagaactgctcgccgtcttacagtaccattgccacccgaatctccgcggtgcgcccggacaatacccaatggcatttccgtgccatggacgcatttctgatcagaaagaaggcacactttcgatggaaattgagaaattgtcggaatttgtgcgagaggaagtgaacagcaggcgattaagcaaatgcatttacacaaaaggattgccgtggaaaatttgggcacaaataagaaccaaagaaaatagtactgagaaatggctgggcttttaccttttctgcaccgctccaaaagaaagtaaattataaaatgctaaatcaaataatttttatttaattaagatggagattggagctgcaaatgttctgccacttttcgaattgtttcacaaaagaaaggaacggaggattttactaaaaaatttgaccattcttttaacaacaaatcgacttgctggggacttataatgattacttttacagtgagtggcagtcaaaatagctttttgtgcttaataaaattgcaaaaattaaggaattgatggatccgaccaaaggattttatgacagtgaagtggacata

SEQ ID NO: 81250 - DNA, 492 bp, Heterodera glycines
  Genomic contig location: Contig_ID=SeqID_16830; Location=1155..1646; Strand=+
  SCN-specific regions: Sequence locations=1-138,168-492
atggtgagttcgtcgtcgattttcaattggtcacgttcgaaaatttcgcacaacaaattttgatcaatttgcaaaaattcttctgattcgaataaagtttcggcattttgatcaatataatccaagcagcgaagagcaaaatccttaaaataaaataaatccaaaatttttattgacgagataaacttgttttaggggtttttattgtctggaaaaccgattctggcatctattttggcccaattcgaacataacccggattcgaacaaaaaaaaatcgaaaattcaatttttttttaacgtaaattcacatttattgcacaaaatcacggctcttatgcagtttaagtcccatatttttttcatttccaagaaaaaaacatacaaaatatagggtttttcgggagcgctgatcacgctctgtcatctaattcgaccaatttcgaatctcggacccgaattagaacaaatgtggataattcgaaatttttaa

SEQ ID NO: 81251 - DNA, 1228 bp, Heterodera glycines
  Genomic contig location: Contig_ID=SeqID_16831; Location=117..1344; Strand=-
  SCN-specific regions: Sequence locations=1-72,95-365,448-727,750 -1040,1085-1228
atgtccagcaagttgcaggaccgtttcaagctgatgttgagcactggcgaaggggcggacgttcactttttggttgggaaggaaaaggaggtgagttgaacccacaaatgttgattaggtaatacatagttctcaacaggtcaataaccagaaaaaattccgaattgggtagtcagaatttgccagtgttttttttttaattttcaacggctgagaaaaagcagggatttgtagccgttttttgtccccggtcaccctccctgaatttttgtttttaacaattttttagggtaattttatgcgctgaacacgaacctaacaccagttttgacgaatttttaaacccgaattcgaataaaaagtcgaaatttatatttttaatattattatctgattaattttatttgttttaatcattttttttgcaaaagataaatttttttttttgataagtttgagtttttgattttttgttcgattcgcgttcagggttcggaattcatagaaatggatgtcagattcgtgcatacatatacaagggttgtctcgacacccccccccccccccccctcgtcgtaaggggggccggtgtaaaaacgcataagagctaaaaacaaacatcatattcgtgttagggcataaatttgcccttgaaaaaaatattacaaaattttgcaggatagggttaaggacaccggataatttttagcatttttggcccgataaaaccccatccttccatttctattccgagtttatttagcttttgaaagcacacaaatgcgtgatgatgttcgcttctgatgtgtttgggtcgatgttccgttttgatgacaaaaactcaaagactaaaagtaaaaaaaaataccgaaaatatttctaaaaataatttttcatcattttttttgccgactgtcctcacgtaattgaggtgaccgatgttgaagcataagcgttcagagtgatgttgagcttcttttacgcggaagatttgagcgaattgaacggacaaaatgccatggcagtgctttacgcgggtgaaaaatttaaaaaataaataaataattatatttaaacatttttagccaataaatataacgtttctttgctggtcaaagccttgttggattttccgattaatgagttgccaaatgtttttcttgcctttgtcgaagctcgtcttctcaaccaaaatgtgcaaatcgaaatttatacaaaatatttttaa

SEQ ID NO: 81252 - DNA, 74 bp, Heterodera glycines
  Genomic contig location: Contig_ID=SeqID_16831; Location=1486..1559; Strand=+
  SCN-specific regions: Sequence locations=1-74
atggccaaatatggaccaaaatatggactaaaaactgccaaaagccagggccggcacttggaaaatgggcccgg

SEQ ID NO: 81253 - DNA, 518 bp, Heterodera glycines
  Genomic contig location: Contig_ID=SeqID_16833; Location=64..581; Strand=+
  SCN-specific regions: Sequence locations=1-22,44-417,439-518
atggtaacggaattccgacatttctgactttttgcagataaatgtgtcattatttctatcgctcgtttatggtccttaactgtatgtgacaagagatggcattttgtcaggacagagatttttatccgttggacctaatccgagaaatttcaaaaaaataatttgggatctccgagaatcagcggcagcggcatctctccacttataaaatggcattgcactgtttatgttcagatcactcgcgagtcgttgcgcgtcagtctgccgaactgcgacttggaaaaggcattggaacaaccgcagcagcaggagaaacaaagcggagctaatattgataatgataatgaagctgttcaaaaacgtcctcagaaatcgatcaatcactttgaagggatcgactaatggaacaaaagccaaaaattgaatttacaaaattataaaaagtgtgatcagagacagcgattgtttggtgggtgctgttttggttgaaacggttactgatcagctgctgcgcaaaa

SEQ ID NO: 81254 - DNA, 526 bp, Heterodera glycines
  Genomic contig location: Contig_ID=SeqID_16833; Location=1072..1597; Strand=-
  SCN-specific regions: Sequence locations=1-368,393-441,466-487
atgatcacctcgtccccagccgcctccccatcgaccgccccacgggccgccccatccgccgccccagcggtttccgccccagcgaccgccgccccacgggccccactgcgcggatgcgtgctcgaccaaagcgcaagcgcagaacagcgcaaccaaaagaagcagcaaaatgagacgagacattgcaaaatcaaatttagaaaattgttttttgatgctgaaatccatcgcgagaatgagcaaacttttatggtgattattgaattaaattaataattttgtctaacgattactttacgcctgtttttgtctgttttcgacttttttgtgtctaattcaagcgcataatctatgcctatttcgcacatgttttaaggatgttcaaaaaattgataatgcaatgataacgaaaaatgcacacttaagaaacgaaccgaaaattttagaaaccccaattttaaattgaatttttactcaaaattatccctaaaatttaattttttttttcctttaaattttaaataaa

SEQ ID NO: 81255 - DNA, 831 bp, Heterodera glycines
  Genomic contig location: Contig_ID=SeqID_16836; Location=1434..2264; Strand=-
  SCN-specific regions: Sequence locations=1-92,249-295,327-331,353 -491,513-597,619-629,651-831
atgtggggagagattttctcaaaagaaataccttcacaatgtgcaacagatagagaattttgtacacaatcaaatgtcaagggttcaagatgaaaaattgaaaattatttaaagaaatttagagaatactttaatttaaaaattttttgattaaaattaaattttaaaagataagattcataaaactttttaaaatattccataatattaaaatatcaaaagaaaaattatcaaaaaagaataaatatggaagagttcaatgaataaaatgaaacttgcgacaattcatctgaacatattttattatttttttaaaataaatttttggtcatttaaaaaacaaatcttaaaatagctaatacggctacgccatgtgacacttcttaatcacatttttacgaaaaacttgcgcaaaaaatagcatgtcagaagaaaacgaaggtgccaatgccacaactaataaatgaaaaattgtagggagagtttcattattctaaaaagaatatttatcatcggttttgaattttgtaaaaatattaaagttgtgaagtaatttttagcaaatcccgtcaaaaaatgatttatcttgaaaaaagcttcaaaataattttttaagtgtaagtcaaatgaaaagcaataaacaattattgcagggctcggattcgtacttcgatgccaagtacatacttagatttcggcttttgtgcttggaaaattttaactgtacttatttccaagattgtacttggaatcgggatttttgcatatgaatgtaaaaaatatacattttatgaaaaaaatttcaaatttttggcattttgtcaaaataaa

SEQ ID NO: 81256 - DNA, 305 bp, Heterodera glycines
  Genomic contig location: Contig_ID=SeqID_16836; Location=2680..2984; Strand=+
  SCN-specific regions: Sequence locations=1-99,151-305
atgaaagtcaacaaatgcgaattacagaaatggaacggatgcaaaaaatgtctttacatggcggatacggtagaaaattctttgcttgtacatttggagattatattagaattttcaaattattattatttatttttttcatattaatttgttcaaatttttcgctgtagacagtggacacaaaatgggcatggcaaagccggacaccttggcggatcgaatgaaattgttgctgagcacggccaaaggtgtcgatgcgcattttttagttgggcaaagtgacaaaaaagaggcaagtgaaatta

SEQ ID NO: 81257 - DNA, 927 bp, Heterodera glycines
  Genomic contig location: Contig_ID=SeqID_2719; Location=275..1201; Strand=-
  SCN-specific regions: Sequence locations=1-22,44-52,82-160,214 -291,314-367,406-530,560-927
atgaatcgaaaatttacacaaaatttgttggtgctctcatttgcattagcattggcaaattttttcagcatttttggccatcccgtggaacacgacaatgaagaagacaatgaaccaaactcacaaaacggtaaccaattaaataaacatttcgggcagcattttttaaatttaaaattttaaaataaataaatttattttacaaatttttaagtggacaaagtgacaaggaattacgttcacaaattggtgaaggatgagaatcatttgagttcaatgcgggaatttgctgttgaatgggcacataataatgcgctgattttcagaaataaagaaagccctaaacggtaattgggtaattaataccaataataaaaataaattaatatataaataaaattaaatgctttctttttttgcagtagcgatgtgtcagtgtttgcgcccgtttcacttttcccgtcgccgtttccacgacatccttttgagcatgcactttccatacaaaaggtgaaaattggccaaaaaacaattaaataatttaattgaaaaattaaaaggaattaattgggcaatttctagcaattaaattattgcaatagcttatttcaacgacctttacaaggccaattaatagccctcattatctttttgacgcctcgaaaaaattatattttacttggaaatgtggagaaaatatgggcttatgatggtgttgctaaaagacatgggagaaatttgttgttaaaatttgctttgccaccaaaagccctccgcccagctccacttgcattggcactttggctgggtcagagggaatcgccacgggccaggcccgaaatcttagtaaaaatcaatgatttttcaaaagttttactttccaaattaaaaggcgctgaacgagctgtactttcgcgttggcactga

SEQ ID NO: 81258 - DNA, 774 bp, Heterodera glycines
  Genomic contig location: Contig_ID=SeqID_2720; Location=602..1375; Strand=-
  SCN-specific regions: Sequence locations=1-774
atgaaaatttcgaaaaagccattgggtatttttgaccttttgttcttatccacctcttttctaagaaatgttagcctaaaaaatcataatcaaaatttttatttgcatattttgatatatttcaaagatatttgtacatatttccgtatttgttttttaatattttatgtgcaaactgtctgtatgatgattttcattgcttttaacagtttcgtggttttactttatcctccagtccatcagtgcacgagttattttcaatcaaaatgcaatttttatgaattttcagtctaaaaccattttgtatttaaggaaacgtagacccactttccttatgggaattatttcgtcatttttcattaaattaagcatgggataataatgatgagaagaagacgaatttcttcaatattttgacatatttaaggatttccacagcataaccaggggtgccattttacctggaaaacccggcatttgccgggttttgggggtccttgccgggtttttgaagttgccgggtttttgccgggtttttggtgggtttttgaaaatttttgccgggtttttgccgggtttttcaactggtttgccgggtttttgagttttggcgatggcacccctgagcataactaattagcaataatctgttaaacatttattttgaattgataattgggaaaaaaacaaaacaataatctggaagttataatgaaacttattaattgaatagataaatgataaaaaagttaattatttcacagttgaaataaa

SEQ ID NO: 81259 - DNA, 466 bp, Heterodera glycines
  Genomic contig location: Contig_ID=SeqID_2720; Location=1458..1923; Strand=-
  SCN-specific regions: Sequence locations=1-5,30-85,139-311,339 -398,431-466
atggccaataaaattatttttggtgctaagttgaacctaaaaagtatcaatgtggcgaacctaaaaatgttcatcaaagtaatagttaaattcatttattatttttattttattttcagattaataaatcataatttagctcaaactttattataattaagcaatcttgaaatctttagcgatagctcctctctatgtgtcctctactatcttattgttttaaaaaatttagcaaaaattttaccaaaacttttaaaaccaaaaattctaaaaatccgactaaataatttgtcccgaatttgttagaaaacttaataataatttttttaattaaaaatcttttgtctatataaacatataaagggtatttgttatttaatttgaagttttggcaattctaaatttaaaaattaaattcaaatattattttcattgatatttcttgttattattcactgggaataaa

SEQ ID NO: 81260 - DNA, 1657 bp, Heterodera glycines
  Genomic contig location: Contig_ID=SeqID_2720; Location=2018..3674; Strand=-
  SCN-specific regions: Sequence locations=1-474,496-531,591-695,718 -745,767-952,1015-1134,1156-1328,1373-1521,1551-1616,1638-1657
atggattctaatagtgaggaaggctcacggaaaatacgccagtgaaaattttaatgtcataaaaacaagttcattgggttttcgaggtcactctgattacggatccggtatacatttcacccaattccgatttcccagacctgaattcgttcaaaaagtcgaaagtccaaattttcgaatttgcaattttggtttaaaagcggcataaatgatcttttattgatgggttgatgctttcagtttatttccgtgtatttaaattgatttttaaccaaaaaggctaatttcgaaaattggaatttcgattttctgttcgaattcgggtgcgggggggggggggggggttcgctattcaaaatgattttcatttggaattttacttttatacttgcacagtgcttttttttaaatatttgtatcactgacgcattttccactcacgcatttcccggtaacggtgagaaagaatatcacttttcaatcccttttttaaaatcaaacaaagtcgttatttttgagaaaaatttcaacaaaattttaattatcaatttttgtatgttaatttaaaaagaaaaaaaataatataaaaagactcgagaccgagattctactccgagaccaaaaacccgtattagaagataattttacatacagtcatggtcatatgtttaacaacactcaaaattttctaccaaatttgatttaaattgattataaaatctcaatatgactatattgtgtatatatgttttatatttcttgtagcattttttgtgggctttataatgataccattcactatcccctgtcaaatgttattattagttacaaaccattttaccaactgcactcccttttggggtggtcataaaggtagcaacaccaagttgatcagatcactccttcatggtgatctgatcagcccattttggctgggaacgagggtaatttcaaaaaaaattaattaaatattatatatttgacattttgttttttaaataattaattttttaagaatatcatggtccaaccagacaaagtgtcgaaaattgacacaatggccagcgagttgggcgtgtacggagttttgatgggcaacatgcgcaccggagaggtgattatttgggttgggatagggtgactaaatggatagaattcaaatttcaaataatttttttttttgtacctgagggtttttcattgccaaagattttttggacattgaaaattttaaaaaaattcataattcgaattcaaagtattgctttgggctaccaatttccaattttcactgtaaacctacgcaaatgaagctttagcgaaactactaaaattcaattttaaaaaaattagaatttttaaatttaaaattccgttttcttcaggtgagccacaatgtgcagcagggccatttgctgaagaccaaattggccacttcggacgagggcggcatttcggcgggatttgcggtgcacgactcgccaattcttttctgataattaacaattggatgatgaaacagtggcatttttagaaaaaataattgatgtaaattttcaatttgctttttattttatggctttcgcttctttaaagcagtgataattcgattttatgcatttttatgtgtttttatgatttaacctttcaaaataaa

SEQ ID NO: 81261 - DNA, 1212 bp, Heterodera glycines
  Genomic contig location: Contig_ID=SeqID_2721; Location=454..1665; Strand=-
  SCN-specific regions: Sequence locations=1-818,840-870,915-1066,1095 -1212
atgtgtaatttcgtaacaggtgaacgctggtggctttccaaagcttgtccctgtctctgtgggaatgaaaaatgcaaatatgacggagattggtgggctaatttggtgcaaaatggcaaaaatttggcacggggtcatggcaaacaaatggcgtgcaaaacagcagcaccattgccattacaacgccaacgacacacggcacggaagtcagttgtcactttgccaatggcactgtcacgcatcgaagtgggcccatcacttggcaatttgccgtgcgtggacatgaagctgaccggggaccagctggcacaactgctcaaaatgaagtaatggcaccaacaaattaacatccaatgaatactaaaaaattaagtgaaaattttattttttgccctagtgataacaaaagaattcagaacaccaaatttgtgaaacttattgaaaatattatgagtaataatgttttttattttgaagcttttttaaaacaaaagattgaaattttgaaatgaacgagaccttgagggacttgaagcggcattgggactaaaatccgttttgggactcacggtgtcggtcaaattttagggtcgagagtcccgtacaagaccgagattttttcaaaaattatcaaaattggaaaggaaggacccgccgccggaagtggcacctttttgcaaatatttgtctgtttacaactcaaaacttttctttctttttttttgctttgcttttcaaagatacttatgcttagcactttatccagaaaaatagttgaaattttttacagaatttatcaaaaatgatcaatttttaggattttggggttcagttttgctctcatagtgagacttggctaaaagatttcgtacaaaaaatgtcctttttgtgcattttttaaaaatttggattctgttatttattagcccgtctgctcggtccggtattctggcaaaaaccctgacgaggccccggtcccgtccgtctctagtgaaaacaaatatcctatattttcatagagtgaagctccgaggaattttttaacctcaatggggggagattttagaaaattatttaaaaaatggaaacccaaaatttatttggcatattcaaatcgatcatagaatagttttattcatttccgtttgcgcaataattttcaataacaatatatgataaaaacaagtgccacaccatttctaaatgaataaa

SEQ ID NO: 81262 - DNA, 482 bp, Heterodera glycines
  Genomic contig location: Contig_ID=SeqID_2721; Location=4247..4728; Strand=+
  SCN-specific regions: Sequence locations=1-23,46-368,391-457,479-482
atgtcgtttagctttgttttgctaattttctgcttgttttatggaggtttgtcatagggatttttaaattaattagtgtttttgttcaattatttgcgcattcatttcttcccagtcgaagtttttgggagtcgaaatggtgggaaatgatctaatgactccttttttaaagattaattaacttggcgaatataaattaaatattttcagttggagaaatgactgatttagcaaaggaaggccaaacgcccaattttgacttttcacaaccgcagccaatggcacaaatggcacaaattgccaatgcaatggcagcgaatggaaacggaaattacggaatgggcaataaattcaacagcgaaggcgaagaaaacatctgtaaaaccagttaattacatagtaaaaatagttgttacttttttagatgaagaaaataatggccaagagaggtaaattaaaacaaaattatactaaaatattaa

SEQ ID NO: 81263 - DNA, 520 bp, Heterodera glycines
  Genomic contig location: Contig_ID=SeqID_2722; Location=9..528; Strand=-
  SCN-specific regions: Sequence locations=1-498
atggcggatctggcaaacaaggtatcggaatttaaattcgaaaaaaattttttgtttttttattggccaaaagatggaatttctccatccgttacagacctaaacaaaaaggcaataattgcttcttctttttttgcagaatggccaacaatatcagttggatgcgcttcgaaaagttaatttggcccgctttgtcaaccattcgtgccagccaaactgttgcgctgttttgatcaccactgccgtccgaatcgctagcactgctactgctggtgatcaataccatcagcgtggacagcaagtgccgtccgtgttgatttttgccctccggcgtatttttgctggcgaagaaataacggtggattacggtaatggcttaacactattactgtctgggaccgttggagcgccataatttgggcggagaaacttttctatggtgacttctagaggatggaggactattatcaattattattattttgcatcttggaattcattttaattatttaaaaataaa

SEQ ID NO: 81264 - DNA, 336 bp, Heterodera glycines
  Genomic contig location: Contig_ID=SeqID_2722; Location=1644..1979; Strand=-
  SCN-specific regions: Sequence locations=1-164,197-213,275-336
tgaaattcccactactgccgactttgtcgtggacaatgacttgagtaaaggcaaagaattgaacaaattgcgagtgatcaacacggagaacaaagacaaaataagcccatataaaatggcgaaaatgtggtgagaattatgagttcagctaacgattttcgaagttaaattataaaattaaaaaaatatatatatagaaacggaatttcccactaattatttctttaattatttttcattaaagataacatattattttaattttaattttaatgttccaggatataccatgcaaagttgttccgattgtgcgtcccgctgcgcgatttcaagtaa

SEQ ID NO: 81265 - DNA, 884 bp, Heterodera glycines
  Genomic contig location: Contig_ID=SeqID_16838; Location=155..1038; Strand=-
  SCN-specific regions: Sequence locations=1-217,239-635,671-729,754-820
agcgccttgcctccaactggtgccgcctcaacaacagctacagtatcatcacccattggtacagtaatcgcctcaccacatcaccgtacccctttggctggcagtgaaaattgccttctcatcgcttccacttcattacatcaaccaagcggtgggacacctgcagaatcaacaacaataccagcaacagccaaaatgcatcgtcaatacagtaaggctgtctgttttattaggtctaggtactgtaacacagttgtcaatcaatttgcaagactttttttttaagtttcgtgcttaagtatagcagggaggtgtcggaatgccgttttctgtttgccgatttctgacattctttggctcggaattccgattgccgaaattttttcagcagtgggaatgccgatttccgaaactttttgtgggtgtcggcacacatccctgatgttctagttaccttaacaattatttgaattttttttcaaaaatttagggtgatcaaattttcaaggacgtgcttgattctaaggacgaatatttttccattataatgcattattgtcaatgttttaatgaaatttggcaattttttagctggctcctctgctggcgacgatgacctgacagttgaggcatggaaatatatttttttaattttttaaatcaaaattttcaaggaaatccaagagttcgcaacggcattccgaatgttcgacaaggacgggaatgggacaatgagcatcaaagaattgggtgtcgcaatgcgaacattgggactcaatccaacagaggacgaactgttgaacatggtcaacgaagtgcgttttaataataataatttatttttatttatttaatttaaaattataatttatttaattaataaa

SEQ ID NO: 81266 - DNA, 1991 bp, Heterodera glycines
  Genomic contig location: Contig_ID=SeqID_16840; Location=149..2139; Strand=+
  SCN-specific regions: Sequence locations=1-432,454-490,514-590,617 -747,772-840,862-900,922-962,985-1306,1328-1412,1434-1440,1483 -1539,1561-1609,1642-1719,1745-1928,1950-1991
atgtctaatttgttttacgttcttctcccaagtgatacccctggctataggaataagccaaataaatttagggttcatctccctcgtagtttaactttttccgggcaatggttgtgtgggcttcatagtataatatatacaaattcatggcccgctgttggaactactgaaaatcaatgggtaaaggtgcattttcgaaacgggaaaacaataaaaattgatattcccactggttcctaccaaaatgaagaagaattggaaaatgctataaatgatgtgataattactggaacggaaaaatcgtttgtggcggctcgatttaagaggcaacaaaatttggcggaagatggtgtcgatttgtttttccattataatcctgatgattactgggaaagaattgaggaagaaagacaaaaatataatgaaatgatgaaatctatagagaaaaaatcatccgagcgtgctaatgaaatggacaacgatagaaaaagaaaaatagaggaggaggaaattgaccctcttcaaaaacaatctttgattaagagggctcggttggacgcgctagaggcagaagccagacaaagggacgaaggaaaagaggagaaagagaatagaacaggacaagaatttctcaaaatgtatcctgataactataaggagaaattaaatgaagttcgactagaattaataagagatttattcaagatccaagaccatatgaaaaaatatcagggcattgccgacggtagaaaaattcaagaacttaataaagaggcattacgaatgagaacagcaatgaaacatagaaggaaaaatttaaatgcttttagcaaggctgtctttaataaagacttacaaatatcagccgaagaattcgaaagaacaaattatgaacagaacaaagactatgttgaatcgttttttgatagttacccaactgattactgggagcatattcataaaaaatatcaagggcttcaagaagattatagaaaaattcgcgaatatcgggagcagcaacaatttacaaccgaagaacagaagataaagtcaatacagagtgagattgaccaactccggcgtcttatcgactatagaagaaagagattcgcagcgttagagtatgaagctaaaaagagagattcgcaacaacaaccggtagcactagcactaacacacggcgaagtgctgaaggagcgaataagtcaagtgatcggaaacagaccgcatgatgatcgtggtgatgatcaaacgacaaaaactaatggtcaatcattagtcagtttaatagaacaattgcagaaagaaagagatgagagcaatgctgtaagtgaaaaggaaacccaaggggacaaattaaccgttaaatcgaagagtgacgtcaaaggggaaggaaagacgcatggagatgtattaaaaaataagctagaagagattggggataatgaagatggtggtgatgatgatgatgatgatgttgatactgaaaataaaaagacgagaggagaaattttagctgataaaatacgaaaccgttctgaaaacgaagaaaaaacagaaggaaagatatatggagatgtattaaaaaataagcttgaagagattgggtataatgatgatgatgatgatgatgataataataaaaagacgagaggagaaattttagctgataaaatacgaaaccatagtgaaaacgaagaaaaaattgaaggaaagacgcatggagaaattctaaaagaaaagctttatgcggctaatgatgatgatgtacaattagttgcgccaaagggtgaaatatttaaagaaagaattgaaagtatcaaaacaaccgataaaactgaaaataaaacccatggcgatttattacaaaatataattgcatcaaggcacgttgagcgaataagatttaaatatataaaagaacgacgaaaattttctgtgtattttaacgaacaaattattgcttatatcgaactgtcagcccagcttgg

SEQ ID NO: 81267 - DNA, 120 bp, Heterodera glycines
  Genomic contig location: Contig_ID=SeqID_16844; Location=1292..1411; Strand=-
  SCN-specific regions: Sequence locations=1-120
ttggacattttgtgggagccgaaattcattccaaccgttccaactatcgaccaacaacaccgatctttctccaggtcgcaacactggacacaagacggtgttgaccaattcgaccattaa

SEQ ID NO: 81268 - DNA, 732 bp, Heterodera glycines
  Genomic contig location: Contig_ID=SeqID_16846; Location=1572..2303; Strand=-
  SCN-specific regions: Sequence locations=1-104,127-297,319-583,606-732
  Gene Ontology: Cellular component=Golgi vesicle; Biological process =protein-nucleus import
atgacacatattcaacttgaagaaatcacagctcaaattgtggcatttatgtacgcccgcaatataattttaagcctagtctttgcaattctgtgcgacctatgatatttatttttaaattaaaatctaggccccaaaaccgaaaagtacccgatttttttgctcaaaaataaaaaacgctacataatttttaagtttattcgaatttgggatttgtgatatccctaataatgcataatttttcattcacctttcgtgacttaaactgaacattactaaattttgaatttcattgggggacggcgtcacaatatgccagaggattaacaaactttcttaattcatttgcagaaaagtgatcgtatggagggaagtgaacggaaaatggcagaaatcggtgctcaattttgccacactttgaattgctttttgtttattcattgagtgattccatttcagtacgaatacaaccaacacgaggccagcatcaacagcatcagttgggctgcccccgagtacggactgatcttcgcctgttgctccaccgactgctcaatttccataatccaattcatgggcgatgtgtggtccccggtgaaaattgccaacgcccacgacgaggttgtgccattcaattcgaatctggcacatgactcggaaatgtttttagggatgcaacgcggtgagttgggcacccgccaaacgactgcagtcggccttggatgtcagtga

SEQ ID NO: 81269 - DNA, 217 bp, Heterodera glycines
  Genomic contig location: Contig_ID=SeqID_16847; Location=60..276; Strand=+
  SCN-specific regions: Sequence locations=1-127,149-217
atgcgcgaattcgtaaccagaaatgctagtcttatgaagcgaaaagtacagttatatttttctgatagtgttagtgagaattgcaattgaaacattatttatcatatattcaagcattttttaggaattaaaatatttaggaattcttgtagcatcctattcctacatgttgaaattgagtcgaatacattgtgacatttatgcattattgtaaaaa

SEQ ID NO: 81270 - DNA, 217 bp, Heterodera glycines; identical to SEQ ID NO: 81269
  Genomic contig location: Contig_ID=SeqID_16847; Location=445..661; Strand=+
  SCN-specific regions: Sequence locations=1-127,149-217

SEQ ID NO: 81271 - DNA, 387 bp, Heterodera glycines
  Genomic contig location: Contig_ID=SeqID_16848; Location=47..433; Strand=-
  SCN-specific regions: Sequence locations=1-41,106-107,202-276,309-387
atggaaaaaattcccagacattcgtccgaagttttaagtgcttttataaaaagtaaaaaaataaaaaataaatattaacgaaaatataattaatttgaaaaattagtaataaaatagcaaaaaaaaaataaataaaaaaaaataaaatagtaaaaaataatttaaattaatttaaataataattgaaaaataataataaatggcattttagccgatttcacaccatttttcgactacacctctgacatttggatggatggcatagggtccgaaggagaggagaaggaaaaggaggaggaggagggggacaaagaaaatgcccaattggagattgtgccaaattggcacaaccaaagtgcgcgaaagagcgaaggcggaaatatatga

SEQ ID NO: 81272 - DNA, 1204 bp, Heterodera glycines
  Genomic contig location: Contig_ID=SeqID_16849; Location=344..1547; Strand=-
  SCN-specific regions: Sequence locations=1-224,307-397,450-530,552 -648,748-856,923-1020,1076-1149,1171-1204
atgggtgtatttattggcacaattgtgtgcctgctggttgtcgcattggtacggtgtgccgttgcgcaatttccccaaaatccggtgcccattggcacggtgattgttgctgaacaacattttgccaccacaacacaaatgccgataaatcctgctagtgaactggttgatcaggtggttcttctaatccacaatcaatcaacgatttaaaattctttgaagtcttattttaaattaaataaaaaatatattttttaatttactatttaatttataaaaaagaaatgatgaaatttaaattaataaggtggaaagcattgatgtgtcctcaacccaaatgattatcaccaccacacggcaggggccaccggacactgcgcgagtggcggtaagacgcaaaaataaatttgtaaatttaaaatatttttaaattaaatatatttttttaagatttcgattgttgacactgtgacaggcgaagagcttccaccgatgaatttgaccggtgttttgttggttttgactaggggtgaggaaaatttcagaaaatcattttgatttttttgataattattttcaggccgatacactgtgaattggcttcagcccaatcggtggtatggtgtcaatttccgcgctgaacagcagtaattaaaaaaatatatataatattttaaaaaatttaaaagaattcgctttaattaaatttaaaaattgtttggaaaaaattgtatttaaaatttattagttatgccggtgggtcggcaatttatacaaatgaggaggcccatttggtgaaaacacgtcgtgtcgacggctcacacgacgagggcaattcggtggttagcgtaaggtgaaaatttttaaaattcaaaaaattttaattttaaaaattcagaaaaataaaaacttttttttttttggtgattagagcagaaagatatggtgaacatggaagatcattggaaaatttggttctcacaatgcgatgggaacagcacccggacgaaaggcaagcggaaaaaatataaaaaatttattatatttttttcaaaaaaaaaattacaattttttagttttcctaaaattttccaatgattaagaaaaaattctcatttaaattgtaaaattttttgaatttttttcttaggccaaatttggatgcattggccaacatcacattgttttgcgatgatcaaataaa

SEQ ID NO: 81273 - DNA, 1376 bp, Heterodera glycines
  Genomic contig location: Contig_ID=SeqID_16849; Location=1647..3022; Strand=+
  SCN-specific regions: Sequence locations=1-710,761-1056,1078 -1095,1124-1376
atgccaattgcaaaatgtgtaaacattgtaatatccgatggaatttgtgctgttggctggcaagacacacattcattccgctcggttggccaaattgtggcccctggcgatttgtcgagcaccgtttggcctttaaaaagcattcttggccaagagacataattgtgggccaatttttggttggtcgcagaagtgtgtgccatggaaacgaagttgggaaaaacgaaaaatgctagaagaatttttttttttttttgcggtggggacacggcgtagaaaatatttttgagaatgcgagtgtgaaggatgggaattttacgaaattttatgggattttttttttaaatcactgcaggggcacagctaggggggagggctgaagtggctggctatatatagcccacccttgtcgaaattgaaatgaaaatttttatgaaaaatgaaaaataaagtgaaaaaatagaaaggtcgtcgctcggaggggcttatagtcccccccccccatccctcgaaacctaagggtctggttttcgtataattcgaaatatccccaattccgaatacttttcagattggctcctggtcctatcaatctgaatatcttcggcttgttgttgatgagcgtgacgtgttccttggtgatttctacgataaccaggaatggctgctggtaaaacatttttatccaagaaaattgtaggcatactttgtaaaaaaaaaaattttaaatttttcatagaaaatttcaaataaaaaaattgtcgtataaaaatttcaaagataaattttctctcatttttttttgtatattaacatcataaaatgtagagagcttcgaattctatgctaacattcggctttgaaaaatcttaatctaagttttgatcggacacttagaatggaagaggccttaaaattttcaaaaattgaccccctcgcccattccctccgttcaaaggtcgatgcaatgatttccaacgggtccatgctgtacttgcgcaacgaatccttctccactgtgcaaattcagctgctgcttcggcgtcaatcattctactacgtgttcaacttggttttccccaccactttggtcagtttttaaaaattttgaaatttaatttatgcaaattgtcaaatttaaatttgcaaaaaaaaaatagggtgcctttaggcatcattgaacagggttttttaaaataagtttttacaggtttcattggttgctgtgatcggtttccatgcgccgatcaatgcgactgggaggcgtgaaagcaaatttcgacttggcgttatgacattggtaaaattgaaaatcacacacgaatggtgtcattaaatctgattttttttttggattttttaagaaaaattcagga

SEQ ID NO: 81274 - DNA, 2155 bp, Heterodera glycines
  Genomic contig location: Contig_ID=SeqID_16850; Location=159..2313; Strand=+
  SCN-specific regions: Sequence locations=1-506,529-828,858-1161,1183 -1741,1763-2155
atgtttatacccatatcttgcgattttctatcccgtatatttgtaattccatttgctattaataagtttttgtttatccatccaattcaaattgcccctagtttaggcgtcgatgtgcaagaagtgtcctcgagttccgccgggcccaccagtgataagtgaaagaagaagaagtgatcatttgaggaaggaaatgaaatgattattttaggcaatgctttatccgctaattatttgctctttgagctttatccttttgttttggctatttattgtttgcttttttaggttgatttttgcttccgaatatgcttggatacataaatattttctgcttataaatttatataaatttctgtttttgattagtcaaatcttttttaacatccgaattcgtgctctgcaccttaaaatagccctagaaaattttttccaagattttcaaaaaaaaaacgggaccagtaaactccatgattgccgttattgccacccaaaaagttataaagcattgaacatgctatggctttgttgtacaagcctttgctcggctccattaatccttaacacaccgagtcaaaaacgagacatgtgtcaataaagagagagtgcagagaaactttttttctctaacttttctctccttttggcatactatctaatattttcattattaggaaaaataacattcacttcatcctgtttaacttttttcctgcttgttaaatccacaccaaattttgcaaatcgatagagaaaagaaaaatgagcaaactttcagtgttttgagtaaaaattttggcctagaaagttattcaattcgcatttatctgaaatgtttttaattttttaggatttatggctaaaaaaattattgcttacgcttcaaggcagaagaggtgctgaacaactgaaaaaaaggcgagaagctcagacggagaaggcgaggcaagcctatttggccaagagaagtaagttttttcagcattttttactcaaaaaaatcaattttttaaatttcagccactcaacagccgaaccccaatgccgaaatgccacagcaggacgaaccagggccgtcaacatctgctgcatccgtcgaagaagcgatggagccaccaccaccaactccagcaccagtgccaacgccggagatgtacgaggaaattttggaatttggcttttcgctgccatcgacatctgtcacaccaatcggcgatttggtgccgttttcgacaacaccaactgcgtcaatggacaccggagagacgacctcgccaccgctggccattgacgagcgatcagagcgcatcgaacagctggaaaagcaactgaaggaccgcgacgacaccatcaaatttctgcgcgagcaggtgcgaaaccgagaagcgctgatcagtgatctgcgtcgtcagctggagcaatgtgcggcaccaccaacggcgaaaaaatgttgatcatttgcaacgcacctcacgccgcaaattggctgaagaaatcgccactgtaataaaccgggacagatcatgttcggccagccgggcgtccctcgaacgaatcaatcgggaagttcggcacaaatttgcccattacaccccccagaaaagccaacgacaacaaagcgaagcaattgatgcagcagacggcctactgattctctgcctcgttggcacactgaaatcatacgaaagactgaagcgcacatttcgtctgatcaactcggaaattgatgttcttccaccgcttaaaaaagttagaaaaattagggaaattttgttcatttttttaggttttggttatcaagcaaaaaatttgtgcgccattacattatcaaaaaattgaaacaacagctggtgttggatttgtgtgtctcgatgtcaaggccgctttggaatttcggctcagttcggccaaggacaattcgatcagcttcgacgacgaattgttgatcaaactgagcggggaccacggccaaggctttaccaaattgaccatcagtttcggccaagcacttcgaaacaactctgcttccaacgatttcattgctgcagttttcccggccaaagacaccagggaaaatttggaacagtatggtgctcttctctggccccaaattgatcaaatgaatgcattgatcaacagaccgattaagtggtaa

SEQ ID NO: 81275 - DNA, 804 bp, Heterodera glycines
  Genomic contig location: Contig_ID=SeqID_16852; Location=28..831; Strand=-
  SCN-specific regions: Sequence locations=1-229,251-428,451-804
atgtcaatttcttatcgtccgcttctgttcattgctgcttttctcttcatcggttgtcatgctggcgttgagcacgtgcgtctggcgagcctcagttgtgccacggcgaaagacggtgaaatcaatggcttcagagcggttgacgatggtctgctgtgagttgtgcaaaacccgtttatttgtgaaacaatcaatcatcccaatatcccatttcagaattggttccgacgccactaatgccactggtgctatgatcctctttggtttccagacgaacaaaaaggaggatttgagcttcaaagtatttgcgccaacatcagcatcatgcctctcatcagtgaacaacttcgtcgtcagcggtcgattttgtgaactcggagcgttggagacagaggtgagtgaaaacactcaatttgtcacataaacaatcagttttttgtggtttcagactgaatcggctaactgtccggatggagggggcgctggctccggttgcaactcccgcagtgtcacctgccaaatcaaaaccgtcaaggaagtagcggaattgcctgacggtcgagtgttcaaagtcaacttgggaaatctcacacaagtgacggcactgtgcacgaagtggaaggcgtacttcgtgagtttgacgtttttacaggtgaatcatctatttctgctttgttgtttcagaccaatgttcgtcaagtgatggaatcagtcggaggcggagaaccgtgtgtgattggtgattcggcgagcggttttccagtttggctcatcgttctgatcgtcgttgtcgtgatttggtga

SEQ ID NO: 81276 - DNA, 1749 bp, Heterodera glycines
  Genomic contig location: Contig_ID=SeqID_2723; Location=69..1817; Strand=-
  SCN-specific regions: Sequence locations=1-194,230-652,674-957,997 -1270,1323-1445,1467-1553,1588-1749
atgcgcggactgcagttggatttgcaaaccggcaacgcagtgcaatggcgagatcccgcaggcggttatgaatacgcaaatcaaactcagctaaattggcaaccgaccgatttgaagttaatgaaacaaaacggaatgccagacggcacgctaatgtacccgacgaacttcgtgctgagacgtaatgaccgaccttttaaaaaatatatataaaataattaatttttttgcttttaaagccgttggtcaatcggaatttgtgatggacttgtttaaacatatttaccttcacaaaaaccctgaaatatacacttctacaacggaggatacggtagttgcgccccaattggccgcgattggcttggcaattgcctacaatggcgcacgagggaatacgaaagctcaaattggcaaagtgttgttggatgagggtaatatattttttgattgggatcgaatttttgggaaaaaaaccagtcccggttaatgggaaccgcccactttggcgccagccattttggcgacaaatgatgcaacttttttacttgtcattcatattaaataagcttagaggatttaaaagcgcttgaaagtccctaatagcctgcaaatgttcaaaaaatttagttgagacactaaaaagcgattaaatcccggccactgtgtacccaaaaatttattaattttggtgcatttagtaacattaaattaaataatttagattcgtctgaacaattaatgcacaataacaaccgtcaatttctccaagaaattcaattgcttccttctaatgatgtttttaaactgaaaatggaaagtaaaatgtttttgtcggattcattcgatgttttggaccaattcaacacgaaaacaaacacattttatgggaacaattttgagaagatcaactttcgtcaaggaaccgaggcggcaaatgtaaaataatattttgcatacaattaaaatatttcaaatttttattcttatatttataatcatggcggggacctttaaaattagagccaattaaaaaagcttaaattaatatatatgtgggcgtttggcaccttaaagcattttcggacttttgacacttttgttgggtaatttgcggaaaatttgttaagaaaattaacaatatatctcaagatttattcactatggcactgatccgaaccatcggagtccaaaaaatacctaattattcgaaattttaaaatttaactctggacctgatcaaaatttactacttaaagtagcaaaatctttgttttattacaaaaattaaataaataattttggtacataatttaaaatattttcaagaaaataaatgaatttgcgcgcaaaataacggcggaagggaatgtcagtgatgtgattcaaccgggagacattgtgccacatcagactaagttgaaaaaatcattaaaaattaattgacacaattttctaggattattattgttaatgtggcacatttccatacaaattgggggccgctaattggtcaattcatttacaagaatgaggaaaaagtaaaaaaaagaatcaaaattaatttaagtaaaaatttttttaaattttcagttccgatttatcggtgtgccaattggaagtgataatgatcaattgcatttggcaattgttgtgccaaataatcagattgatttatcagtggtaataaaggaatttaaaagctttaagctgtttgatttgctcacgaaatcaccaacgacagaagcaaaa

SEQ ID NO: 81277 - DNA, 532 bp, Heterodera glycines
  Genomic contig location: Contig_ID=SeqID_2724; Location=298..829; Strand=-
  SCN-specific regions: Sequence locations=1-148,179-180,220-264,306 -361,384-471,493-532
atgaaaattggcatttttagtgtcgaaataaaggaatggccaggcgatgatggaaatggtgaaaattggcattatttttaaaataaaattgtgatttttgttatttaacaaaattttctcaattttttgccactattttggcagaattgggaatttttgttttgtttattttgcccaaagaatttttttcaaaatttcttttatttaaaaaaaaattttgggtcactatcattttttatctctttttcagtaaaaaaatacctctattttttcaataaaaaaaattagttaaataaattattttagatggaggaggaattccgttcacttttcccattgaatttcgcaacagactctgctggaatttatttagttcacaaatacccgatgtgttcgttggcataacactcactttgagtggcaagtgcgtttttttggcatcaatttttattcatattggcagaaaaggagaattttattaattaaaaatatgtcagtaaagttttgggatcgagattttcattaaaataaa

SEQ ID NO: 81278 - DNA, 1238 bp, Heterodera glycines
  Genomic contig location: Contig_ID=SeqID_2724; Location=1321..2558; Strand=+
  SCN-specific regions: Sequence locations=1-62,114-178,200-219,241 -655,677-720,743-756,869-1070,1095-1141,1163-1238
atggttagtgtgttaacactaacacaacttttgtcgtgagttcgatcctggttgacttcttcttttttaattatttttttttgtaattaatagggttttttaaaataaaaatacccataaaaattggtcatcattggcataatttattgacaaattaaacccaattttcctttcgttgaaattaaaaaaatttaattttccttgactaaatcatgaaaagtaaatattttacaaaatataaagagaaattcataattttttggtgaaaactgttagaaaaaagagcttaaaatttaaaattcgcccggcgttgcctatcggcatcgccgaccccccaaaaacctgaaaattttgctcaaaatcaaaaaaatttataattttttggacaaaatctgttacagatccatccaaatttcaaaattttttccggcgctgcctatcggcaccgccggacccctttctcctaaaagtctttagaaacgcgccgcaaaaaaaatgattttaaaaacaaaaaacttttcgggaacaagggtccggcagtgtctataagcgcggccgcgaaaaatttttgaaaattagagaattagaatgcaatttattaactgatttcaccaaaaataaccaattttttcgactttgagccaaatttttttagaaaaaatttgtttttggggcctggcgccggaggaaaaatttgaaattttgactatttttacagattttcactaaaaattgttcattttaaatgccttatcgtttttaataattctatacaaaaataattatgaataaaaagaaataaaaaaatacacaaaattattattatgaataataaaactttaaagcaaaaataatataaaatttttttgactatatggcataaggcaaaaattgaaaaaccccgaccccgaaccatttggtcaaccctgaccccgaccccgacacttccaaccccgacgaccccgaaccccgacttttccaaccccgacggtcgggggcccaaccctaccttaaatttaaggatgaaatattggaaatttgttcaaaaataaacttccaaatttagcatttagattttttagaaaattctattttaatccaaaggtatttttcagttataataaaggaatcggcctaaccgaaaaccaagggtaccagttttctggttttaaaaccttaatcttctcaaaaaattaatttaaatcgcaaaatttggtcgtaaactcattaaaactata

SEQ ID NO: 81279 - DNA, 398 bp, Heterodera glycines
  Genomic contig location: Contig_ID=SeqID_2724; Location=2592..2989; Strand=-
  SCN-specific regions: Sequence locations=1-70,117-293,315-367,396-398
atgcgaatggaatttgttggtcaaaataagtcttcatcggcaactaaaagtttcttcccaatggtattacatatttaaaattagtaaatttcattaaatattttgtattttttattgttaggtgccaccctttcctttacgaatgaaccgagtccaaaacagtgacattttgccacagaaagcaaatgaaaatttcaaaaatctgcatgaaaataaaaacgactgctgcttattcggagatggtactcaaattgatgatttattcgcctaatttttagtgtttgtgatcaaaattcaaggacaaacaaaggacatttgttaccggaataatcatataaaaatagtgattttttgagaaaagctcgtgaaaaatttatttttattcatttctaattaaa

SEQ ID NO: 81280 - DNA, 187 bp, Heterodera glycines
  Genomic contig location: Contig_ID=SeqID_2725; Location=168..354; Strand=+
  SCN-specific regions: Sequence locations=1-187
tataagctatttctcagtgattaatcagctctcaaaaaagttgtcagttgaaaaccgcaaaaaaggcagaacttttgaagttttttatttctatctttttttatagttcgaaattttctgtaatttttagtaggctaatagagcctgtgaagagctttcgaatgatatcaagattgtttgattcgga

SEQ ID NO: 81281 - DNA, 806 bp, Heterodera glycines
  Genomic contig location: Contig_ID=SeqID_2727; Location=196..1001; Strand=-
  SCN-specific regions: Sequence locations=1-118,173-351,373-381,404-806
atggaaatctttgacgaatttattgttgttgacgaagaagcgatcggtcaattctctggccaattcactggaaagacttcatttcgggaaatgatccgatttgctgaactgtaatttcattttttttgaaattttaaaataataaaaaaatttaaaaaacaaaaaaaaatttgggtataaattaatcacttatatattttagtgaatttatgagaagcgattttcacgcattgcaaatcacggacgttggcaatgcttcttcttccaatccgtcgaattttgagccattggcacaaattgtccgttgggattgggacacaaatggggcacaacaaatcattagtgtaggtttaaagaaatgatcaaacttaaaaaatgcataaattaatcaattaaatcatttagacccatacactgaacaagggcagtgaagttaattacaacaacattgctaatgattcatcaattgttatccgaattctcaaaaagcgggagacaaaaaagaaaatgtgattgattaataataagatcgaaataactgatttttttaatttgagtcaattagaatttcatatgtatatttttgaaaaactaaatgcgactgacgcgctttttactaaggcatttttgggatggattcttccgatcactaattgatttcattttccattttttcttatttttcccccattttttaagtcagttcccggcgccttccagcagcttacccgacgacgatttgacgatgaaaattggtgaaaaacaggtgaagcatcaccatcaaacagcaacattaagcatcaccg

SEQ ID NO: 81282 - DNA, 331 bp, Heterodera glycines
  Genomic contig location: Contig_ID=SeqID_16853; Location=1555..1885; Strand=-
  SCN-specific regions: Sequence locations=1-76,99-331
gtatccaattacgcagcccccgtccgctgccaacaacacttgcctcagcggttcgatccaactcactaattgccataattagacaaatgttcaggagagattgacggacaacacggcgttacgattgcaagaacgaacagagggtcatcagcacttcccgttgtttcgttaattaaaaatgaaagtgttcagcatttctcgtcggagtgaccgaagggacggacacggacgtcggccgagtggaaacggtttcattggcccagcaattggccactcagtacggctggtgaacaacgcattgatgcggatgaatacaattgttctacactga

SEQ ID NO: 81283 - DNA, 320 bp, Heterodera glycines
  Genomic contig location: Contig_ID=SeqID_16856; Location=1338..1657; Strand=+
  SCN-specific regions: Sequence locations=1-136,158-320
ttttgggccccggggtcgtttgggccccaacccaaaaatagaaaaatgtgctttttaaaaaattaagattctaaaaactaagcctgagggatccctcgccacttggcataagttaagtttaattaacattcgctcattttttacaattttacttattccaaatcctattattttttaatagttaaccaatttgatgtacattctgatttggacatttttcaaaaatggctaacccaattgcaaccaaaaaacaaaaagtaaaattgtcttacgaacgccacctttacaccttcgctaaaatgagttctgatgggatgaca

SEQ ID NO: 81284 - DNA, 2480 bp, Heterodera glycines
  Genomic contig location: Contig_ID=SeqID_16857; Location=137..2616; Strand=-
  SCN-specific regions: Sequence locations=1-40,72-478,506-691,713 -885,907-2028,2050-2372,2394-2480
atgctcgatgaggcgctagccaggtaaaggggttttttttaaaatgtacaaattaaatttttctgtttcagttattgcacgaatgatgtcgagattctgatggctgcccttgtcgcattccgtcgggaattctttgagatttcgcgtcgccaggagtacgtggacgggatcgacgacagagagaaccatgatggcatcgacgtacttcgtgagtgcatgaccatcgccggcgcgtgcatgcgacactttcgcaccaaccacctgcctgacgaccatctggccatcgtcccagagcgcggttacgacaacgctcaaaatcaaagccttctcgccctacggttcttccactggtactcggaggagtacggtgtggaagtgcagaccgcccactctgccggaggagagaaacggatcggcccctactcgctggacgggtggattgaggcagaggggcgtgcaattgaagtgcacggtattgattattattgttattccataaaaaattaatattttaaggctgtacttggcacggatgcaagaaatgttatccaatcgataacatgttgttgcccaacggaaagacagcggggcaggtacgggagcgcgacgcaaagcggatggaatacatccgggcccgagtgaatcgtgtggacgtgtattgggagtgcaaaatcacgtccatgctagagcggagcaaagccatgaggaaatccttcgcgaactacgtggatgacgggccactggtgatcagggacgcatttacgggaggacggaccgggccactgaaattgctgcgcaaggcggggcccggagagaagatctcctattacgacttcacgtcgttatacccttacataaagtcagttctttttctccatttgacaaataaattttaaatcttaagcttcaccactcgctatcctgttggacacccgaaagtgcacgtgctgaaccaacaagtgcagtggacaagcgcagcggacaatcctttcccgctggcgctgctcaaagtctgggttgtgccgccccgtaaaattgacgttgcggtgttaccggtcaaagtggacgaccgactgtgctttcctctgtgcatcgcctgtgccaaagaatatccaactggaggcgtggacaacgactaccactgtcagcacactgatcaacaacgcggatgggtcagcacctgcacatcgattgagctcaacgcagcgctcgacgagggttaccgcgtcacgaaggtgttccgcgtgctagaatacgagcaaagcgacgacaagctattccgcccctacattgcggaattcatggctcaaaaaatccaggcaagcggatttgacagcagcataagaggggacgctgagaaggaagaacaatttgtacgagagtgtgctgagcagtttggcatcaacattgatcctgcaaaaatggtggtcaacaagggaaaacggtccctggcaaagctctgcctgaacaatttatgtgagctttgacatatgatttggacagaaaatgtaatttttaggggggcgtttttcgcttcgcaactttggcctgtgccagacactcatcactgacgacccggtgacgctggccgagtacttggacaacaaatcgatcgaagtcacatcgatcgatcagctggacgagacgcacatcctcatcacctacctccacaaaaaggactgggtcgatgagcacgcttgctcaaacatcggtgagaataaacttataaaattgtgctaaattgataaatttagtcatctctctgtggaccacttccgctgcgcggcttgttctgctcaaagccatgcagaaggtggttaggtcgccaggctctgagctactctacaccggtacatatgctctaaaaaattgcatgaaataaattgcaaatattttttagatacagacagtctcatcctcgtccacccggaggagcgatgtccgctcaaaattggtccacatctgggccagttcactgacgagtacccggaccacgacattgtggagttttgcagtgggggtgcaaaacaggtaaattttaagttaaattcatcaatctgtattgattatttcacattttagtatggtctgtgtttgcgacgaaagggagctggggcggatgccgaaaaggaatacgtgctcaaggtgcgcggattgacgctgaactacgacgtgatcaacaaccaaggcatgcgttacgagacgttcaaagaagaagtggtgcggtacgcaacaacgggtgattatgagccaatcattgtcacttatcctaacttcctccgaccgaacattcgggagggagggagggtcgtatccatgcccctacagaaatgttaccgaccatatgttgggaagggaattataggcagcgatttcaatgtgaagaattttggccacactttgtaatgtttttgttttctgatgtatctgtctttctcatcaatacaccataaattgtatttaactcatttttcaataaa

SEQ ID NO: 81285 - DNA, 1748 bp, Heterodera glycines
  Genomic contig location: Contig_ID=SeqID_16858; Location=565..2312; Strand=+
  SCN-specific regions: Sequence locations=1-136,158-775,835-1009,1093 -1318,1361-1409,1447-1498,1521-1578,1600-1748
  Gene Ontology: Biological process=sulfur amino acid metabolism
atgtcatcgtgtcgggggattgtaatgggcggcacgaaaaattatttcgacaaaatttgtgtgccgcatcatggcttggagctgagttttgtggatttgacgcgattggaaaacttggagaatgaatttaagcccaacacaaaagtacaaaaccataaaaaaccatttgaattaatttaattaaatgggcagatggttttgtttgaaacaccctcaaatccgcttctaaaaatcgtcgacattgaagcggtgtgccgtatggttcgagcacgctcaaaagattgtgtcgtcgttgttgataatacggtaatgatacgagaggcattactatacgtgagggatactgtagccaattacagttcatgacaccgtactttcaacgcccgttggaacttggcgccgatgttacggttcaatcgctcaccaaatacatcaacggacacaccgatgtgctgatgggcaccgtagttaccaacaaggagcagcttgatcagcacatatacgcccagcaaatttgtagagtgattttgattgaaagatggctttcctagcgtatgtatttttgccagcccaaaaaaatcgacaaaattttgaaaaaaaatgataaaagggagtttttaaatatttttcagatgctggcgccgttccgtccgcctttgatgcctttttggtgcttcgtggcatcaaaacgctcccattgcgaatgcgccagcacatggaaaatgcgctggcaattggacgatggcttgagaaggacccgcgtgtggaaaaggtgaaaaattagaaaataaattaaaaagtatttaaaattacctaaaatatttaaaataatttgtcaattaaattgttgttaggtgctttatcccgagctcgagtcgcatccgcaacaccaaatccacaagaaacagagcagcggaatgtccggcatgctctccttttacattcgcacagattttgacggggcactgaaattcctggccaatttaaaggtgttgcttaaattctaagcattttttaatcataaatttttcatttaaatattttattaatttgttatttttaaatattttttatacatatttatattttttaggtgtttttggtcgcccgatcactcggcggtttcgaatcattggcctcactgccggcggccatgtcgcgtgattccgtgccagcgaaggttcgcgctcagaccggcatcagtgataatctgatcagactgtcaattggctgtgaggacaaagctgatctgatcaacgacttggatatggcaatgcgagtggcgacggaatagcaaattccttttttttggtttttcgaaatttaagaaatgttgattgatgatttacaccttttatgatgttactaataatgagatatattcacatttgccttgtcttttattccgattttttataaaatgtttttaccaaggataaagccaaacttaatgcttaaaagacttggggacatgacaatgcgaatggcgacggaatagaaaattcccttttttggttttcgaaatttaaaaatgctttgatgttaattatgccttttgtgttgtaaatgctgttacacaaaaaacaacaaaatgataaatttgttcataactttgtcaaaagatttttggtatcattaataattataagtgtttttatgagcctccaaaatttcgtttaatcttaaaaaagaccagctttttttgtacttctgcccatatttttcttttcgtcaaaaatcatgaaaaa

SEQ ID NO: 81286 - DNA, 738 bp, Heterodera glycines
  Genomic contig location: Contig_ID=SeqID_16859; Location=63..800; Strand=+
  SCN-specific regions: Sequence locations=1-112,136-321,343-462,497-738
atgccggaaatgggggtgaaaaacgaattcgtaaccacaagctggacggctggattcaatcacaaaataagtgtattgaagtgctcggatggtacgttaaataagggtgctgctataataataataacaataaatgttccaagctattggcacggttgcgagcggtgttttgaccctcaggataagctggtcgatggcaaaacatgtcgagagcttaatgaggccacccaagatcgactacaccagctccgagaatcggattgcacgggagagtgcatgacggttgaagagatttgggtatgttgtgatggttgatgacccaacaatatcaattctaataatgattcatttcaccgtgtgcaaaccaaaaaaaaagtgaattaaggagtgtgaaattaacgccttgctgtctgatgcagccttggaggtaggtgtggtacacatttgctgaggtgctctcatgtcgatcggtcggtcagtgggtcggtcgtttgatgttcacaaaacaattcaggtcggacaggaccgttgaagctgtttgccgaaccaaaagaggatgaaaagatatcggtatacgatattgtcagtctttatccgtgggtaggttgtcatccgaatcagcattatgatatgctttttctgaatgttctgttttaggtaaactacgataccgagtatccaatcggagtacctaaaattatatacccgtctgctgtacagatgttggttaattggtaa

SEQ ID NO: 81287 - DNA, 1268 bp, Heterodera glycines
  Genomic contig location: Contig_ID=SeqID_16859; Location=944..2211; Strand=+
  SCN-specific regions: Sequence locations=1-312,342-656,696-1268
atgaagttggatgaacgtctattgttcagctgctgtcatcgttgtgcgtctcagttccgtacgctgaacacgcgatgccagcacgtgtgcgcacattcggatgctcagcgagcatacaccggcaattacactcacattgagctggcaatggcccttcggtacggctaccgtgtggaccgtttctggagagcgtggcactatgagcagtggtctaccttaatgagcaattcttctcaaattggaaacaaaaactgtgcttttcaggagcgaccaaatcttcaaggaatacgtacgtctcttactcaagcttaaggttggttggttggttggttggttggctgcaggtttcttgttctttcgcgttttcacccgtttcccgaaccattatccaaacaagcacattgcacatacatatatgttacgcagattgaggctagcggcttcccagatgggattacaactgaggcacaaaggcaccaatttattgatgcatatgccaccgtgtatgccgtcactctggacgtggaccgtgtgcataagaatccagggcttcgcttcatcgctaaactaatgttgaacagtctttggtaagcaaaaaaaaaattatgcaaacagtcgcctcattctttttttggccgctatgatcgcatccatctcccatcaatcaatcaatcaatctgttttcaggggcaaatttagcatgagaaatgaactaggaacaaacaaggtcatcacaagaccgcaggaattctactcattggtgctcgaccataaagtcgaaatttctgccatcattccgctatccgacacagccattcgagtgatgtaccggcacaaaaaaagtttcgtggaggagcattcgtcaagcaacatagtgctcagcttatggacaacaagtaaattgtcaattcattcagcaaccaggattctgtataacaaacaaaaaaaaatgtttgtttgtttttttctactccaggtcgtgctcgattgaagctgtttgagtacatgatgcaagtgcagaatacggatggagccgagcttctttatacagtcagttatcgtaggcgaacatatgcatttgtcacagtggttggcataagagttaccttttcccgttgtgtctccaggataccgacagcgtgattgttttgcacaaacgtgatcgggtgccaatcctcacgggcgaatatcttggacaaatgtccgaagagtacgcgggatttgaaatacaaaccttcatatgcggaggtatgcgctatgccaattag

SEQ ID NO: 81288 - DNA, 744 bp, Heterodera glycines
  Genomic contig location: Contig_ID=SeqID_16860; Location=502..1245; Strand=+
  SCN-specific regions: Sequence locations=1-175,203-205,227-415,437 -595,623-723
acataattcggttgccattgagaaagtgaaggaccagcgatttgacgcattggcacaatgccatgtcattaatgggacggacgaagccacaaagaagccttgcggaattgaatttcgccttccacatggaggaggaaattgcgatgacgggttgaaataaaattagaaacatttgaaaataaaattaaaataatatttataacaaatagaaatgccatttaaaattgcttttttagtttttggatctgctaccagcctgttcttcaacgtggtcgcactttggatacaagcaccaattacaaagcgaaaagaacattcgcaattgatactgaaaaggtaaatagtatttaattaataatgtaattagttaattgcttgcttaaatgattgtttgtggtccaggaccattcaattacaaaagaatgtgctcaaagaatgccgaaggatagtggtaaaagtggcacaatgctttggcgtggcattaaactgcgcacagtgccagtgccatcggacaaaaacaaaggcaaacactcatcatcatcgactgataatgatgatgaagtcaccattttggagacaacatttaacgattcactgaaaatgtttgtttttaaaataaattcgaacgtggtcgcgactgcaccatggaggccagggttagcaaatcagtgccaaattgagaatgataattttgaattgcatcattttgatcacttcctaataattttatattctttttgttaa

SEQ ID NO: 81289 - DNA, 172 bp, Heterodera glycines
  Genomic contig location: Contig_ID=SeqID_16860; Location=2378..2549; Strand=+
  SCN-specific regions: Sequence locations=1-132,154-172
atgttgctttttgctgatccgcttgtgaagcaaattgatgacaaaacatttgtgccaaatgaggtgcgactttaagcaatgccaacatgaataattcgcatattttcaggaaaattcaaaattttcatcgggaattattaacactgaaacagatgaatgtgttggagaaaat

SEQ ID NO: 81290 - DNA, 687 bp, Heterodera glycines
  Genomic contig location: Contig_ID=SeqID_16861; Location=41..727; Strand=+
  SCN-specific regions: Sequence locations=1-35,57-104,180-249,351-687
  Gene Ontology: Mol. function=protein binding; Cellular component =axoneme; Biological process=eye photoreceptor cell development
atggaaccgaaattcccttttatttgccagagacccatcactgttgtggaggaagatgagagagcacaggtgacagactcggaatatgaagacggaaagggagtggaagaagaaggggaggaggaggacggagaagaaaaagtgaaggaggaagtggaagaggagggggaggaggaggacatggacgacccgagcggagagagggccattttacgagcaattttggagaaaaataaaccgaaacaaagcgaagaaggggaaatagtggacaaaaaggaggaagagcgggacgagacgaaggaagacaaaggcaaagagagggaagaggagggggaagaagacgaggaagacggcacatccagtgtggtgacggactttgaatttcaggcatattgaaaccgaaaaattcggaaatacgttgctcaattacagttcagcacaacggatgatgacgcggaaatggagagcattggttccgatttggagggaaatgggatcggaaaggaggaaacgcggcggaaaacgattgggggcaaaagggcgagggggaaacggggtggcacaaaaaatgccaacaaaaaacaaccgcaaaacagcggacggaccgggagagcggcagcgattttgggggcaacgaatgccgaaaaagtaggagaaagcatcgaatggcatggcaaattgagatga

SEQ ID NO: 81291 - DNA, 1279 bp, Heterodera glycines
  Genomic contig location: Contig_ID=SeqID_16864; Location=15..1293; Strand=+
  SCN-specific regions: Sequence locations=1-196,218-410,432-591,615 -684,707-794,821-1279
atgtgcaatttgtccacttttttgtcaatatttttgctaccatctaccgtatacagcaccggtgatgacagagtattccaccataaccgtatgaatgttgtcagacgacaattgcttcaactaccacattttttgaatggttgcgctgtgggtggtggcggtggttcatcaggcaaaaaacaaaaacaatacaaccaacaattacagcaacagggccaaaatggcatatgggacagcaacgaggtagagcaataccgtaatgactaccaactgaacagcatacggtatgtcttacaaatttattctgtatttggtatggtttaacttacaaattatactgtatttgttatgtcgtaccaatttattctgtattttctggtcaattcatatgttacagtattttgaaagcgattaagaaacaaactttaaaaacacttactaatcgcaagtcttgaatccacctgggaatttccataaattttatgaatttaactgaaatttatgatggataattaaacgtttgagggcctttcaaatgttaacaaatttgtcaaaaaattgaaaattatatagccgtcctaagaatcggattattcaaaaaataataaaagaatggcccacatattttttgaatttcctaaaatttagtccctaaaaaatgaccagaaaacttagcccaattcgaaaaaataaattaaaaaattttctgcaggccctgctatttctctcccgttcaatgccttttggtcacaccaggccaacatcgggcattcgttaaccacccaaagttcaaccagcaacagaagcagcagcagcagcacaattttgagcaacaaattaaagtagcaggcgaaaaaggcactgcagtcaaggccatcaaaggaagcagcaaaatttggcatcgacaaagtccaaaggaaagtgccaaagatggagcgcaacccagacatgaacaatatgatgccggcgatgtacaagttgttcatcaagacgaagctgttcagcaccaacagcacctcaaccatcacaaccgtagacggcatagattattgaccagcggccaaacattgtgccaacacaggcatggcggcattggtggtgatgccaatgccaatacgacagatggtggacgaataaagcagtggaggaggaagtatggcgaacgcaaactaagacggcatccaatttttggcaatccattccgaattggactatgaccatagcctaattagcatcataaagatatttttgtataaaaatttatcattttttctttaaa

SEQ ID NO: 81292 - DNA, 77 bp, Heterodera glycines
  Genomic contig location: Contig_ID=SeqID_16865; Location=1884..1960; Strand=+
  SCN-specific regions: Sequence locations=1-77
atggccttaaatctgatctatcttttaaccaggagcttgtctgctccagctccatgcatgaagcgcgagaaggacag

SEQ ID NO: 81293 - DNA, 3393 bp, Heterodera glycines
  Genomic contig location: Contig_ID=SeqID_2728; Location=258..3650; Strand=-
  SCN-specific regions: Sequence locations=1-214,237-276,299-365,387 -689,711-1352,1375-1794,1819-1992,2015-2091,2113-2717,2739-3393
tttttgaggcggtcccaatacttcaaaagaatggcacaaccgccgacaaacattggcacagcgatgagactaaaaaaaatgagatggaaaagagtaaatgttgagaagaaatgcgaaaaacgtacagaatcatttttgaagacattgtcagggagaaaaagtcagagagagagagagacgaaaataatggcgaatgaataataatggaaggtagaggaagagcagcaaccacttttatacgaatttattggttcatttgtacggtttcccattttctaaatttttattaatttataaagctctctcccctcccccattttcttccattcactcacttttccttaaaaaacatgaaattttactacgcaaatggtgtggcgggggttgggacagcaaaatgggaaaaagtatttgcaaagtttttaatcacgaatctgacatgtattttgactaatttctaatccctaacccgaactcgaataaaaatcgaaatttttaatttttcaaattatgattttttgttcaaatttagattaggaaatcggaattgatcaaaataattgaaagattcgtgatcggggtctccaaaaaccccagagaatacatttttatgactatcacaaaaaaattttgcaaaacaaaagggtccccccttttgaaaaaattttcaaaatatgtcacttttcatatagcgccaaaatttcttttctcagaaaagttactcattctaaaaacgaaattacaattgtgtatttgtgatgaaaaataggtattggagtaggattctccgaccccaaaaaccctaacgatttaaacgtaaaaataatctgaattccagatggaaacttcggttgaaaatgaaggggctattgatccttcaaattcatcaaaacgttcaatcctatggaaattgaacacgacaattgatcttgtgacttcctcttctgctgattttgtggacaatcggattccggggttctttttgaatcaaattaagcattgggctaattgtaagtttccagtgaactgacacaagcattgtgcactgtcatcgaagctgttttcatacatggactcagagacgctttttttctcaagggttcacggcactcgaatcggccatccccagtaagaaaatggagaattggaattgtgtctcaaagataatttattgggtaaatcgagggataaattgaaatttatgcccactttggggaaatgacttttaacaaaaaaataaatgttaagaatttctggccctttgtctccaaatacacgcagcgaagcatcaaaacgcaaatttcaacgctcaaccaaattcacactgaaatcggccgagcaagggttataacatttggcattttccttttgatttttgtgggatttttgattcaggcatggattcgcattgttctcaacgaatattccctggatcattacataagcatgtttgtgaaggacacccgacagatgaagtaagtgctttcatttggctaatttatttctaaatattatgcaaaaattaaagacaattttatgccgacgatgcctttctccgtgactccgaatgcgttaactctttgggtgttcatttaaagcgaattaatgggctcaaaataacagctccgaccaactcgaggtcagcatttatcgtctttttgttggtgtgggctaatcgcaaccattttctaccctcctttgcccttttatccatttttagcttgttgaatacgtggactccgtctccgttgtctcttgctggtctcattaaaaccgctccgtcaattggaggtgcatttaaattttaaaaaatcgtataaaatatgatacgctacttgcaaaaagtgtttagacagtaaccagggtgggaacagttgccccctctacccaaatcaaaaaaagattttcttagaaaaaaatatctaatttgtttaaaatttacctaattttcttaacaaatttgccaaaatttctccgacgacccaatattcttgtatttttcccaaaaattttgtctcaaaacccccaaaatttggcgaaaatggctaaaaatattccatttttcccacagagccaaaaaattaggaaactacactaaaaaagagcaacaaaaaagctatccgattggttgcaaattttttgtgagacttagtagtcgtgaatgcccatcataagcacccatacccattaaacagattttatttgacctttttatgggtttttcatttgacagccttcgcctttcaatccgccgctgtgcctctccccgtgcctttctcttcgccctcttttaacggagtgttgcccaccggcaaaggctttaaggttgcgacaaatgtgaagccctcacaattaaaccgatgtcaatacgcactaagattggctcttcctcgccctccgcttcgtcctctgtcctccttgccgacgacgaagtggcaatcgcctcgggcgaacaacaaatggtggccgagttcggcatgaacgcggaccaactgctgttggacgaaggcgaacagtgcggggaagacgagagggcgagtcaaacagtttctgcggatgatcaaaggcaacaggcacacataatttcttacactcccttaattaaccattttcttgggagtcattttgtatacaattttaggtcaattcgtccgcttcaatggtaatggcggacgacttggagtccgtttactcccaccccatcgatgctggaggaacaccagcatccgcctctgttggcaaatgccggattgtttggtggcacttttgaccagccccatcattaccaacggcgtcaaaacatgcacaacagtttgttttcggccacgtatcagcacgccaacaacaaatggatgatggcagcgatgccggccgaggaactctccaccgaagtgtgttagaaacggaattctaactttttcaacatttaatcccaacattttattgaaataccacgccgattaggcattttaaatgcctaaaactctccggcatttaaccgaatccttttcctactcaattttggcaatgcaatctagtagatgttcaggtaattgtgcaccgtaaggctgcgcaaaggcatcgacgacggacggtgtcgaaaagcagcggcggggacagtgacaacggctcgtcctcccggtgccattccaacgccaatttgcacgcctttgaggagtcatcgctggagggcaaagaggtgagggagggagagaatgcgcaactgtttcaatagcgtagcaagagattcgtggtttaattaggcttttactccccctcaccaagcggacactatgtcaaaaaatattgaccaattccggcaatacaaaaaaaaattttaattgaaaattttgacttttttttgggttcgggattagaaattcgtcaaaaaag

SEQ ID NO: 81294 - DNA, 1016 bp, Heterodera glycines
  Genomic contig location: Contig_ID=SeqID_2728; Location=3506..4521; Strand=+
  SCN-specific regions: Sequence locations=1-203,243-976,998-1016
atgtcttcaaaaatgattctgtacgtttttcgcatttcttctcaacatttactcttttccatctcattttttttagtctcatcgctgtgccaatgtttgtcggcggttgtgccattcttttgaagtattgggaccgcctcaaaaaaccagcaaaaccacgagaaaatcacaaaaagaaaatgtaaaattaaaatgccaaattcaattttaaatttgttttcaatttaattttaaatttttttcctttttttcagtttcatctccgccgattgttggctttgtgtgttcgatttgctgccgccttcccaacttggcctcggaattgcaatgatcagtcaccgatttggcatttacgtggacgaacacttcaaaacacgcaaatgggcgctgaaatttattcaaattcacagcaaaatcagggagaatggcaccaaggaaatggaaattgtcaagaactatggaaaagaattgccaattccgcaaattcaattgccacgcaaagtcatcggattcgaatgcatcgagattttgtaaaattggcgattatataatagccaacacttcccatcttttttagtttcatcaaccaaaatgtcatcgcttttcttcaccgttttcgccaactcttcgccaaatgtccaattaatttgtccatccacacgaacaatgaccgcattttggacttcattttccacaacatttggccaatgttcggaaaaaacattaatcgcttggaattatccgccgcaactttccaccgtttgcgacatttcgtcccgtcaattctcaatgactgtccatcacttcgcattgtcaaattctgtgacgccgacaatttcttccccgaatttccggccgatgacagtgccatggcgtcgaatggacaaacgatggccaaatggcttttcactgcccttcctgacaatgtgccgaagatgttgaaatgctcgttggacaaagatgctgggaatttggtgcagaaatttgaagccttcaaaacggtgcttacgaattga

SEQ ID NO: 81295 - DNA, 722 bp, Heterodera glycines
  Genomic contig location: Contig_ID=SeqID_2729; Location=1827..2548; Strand=-
  SCN-specific regions: Sequence locations=1-61,166-240,262-315,358 -384,407-506,528-664,687-722
atgaatcatatgcacatgcttttcatctctttaaatgggtaaaaatgatttataggcagacatttttattttatttatgaatgtttttaatagaagatttaatttaaattgcttttaaaatatattttaatgttttaatatttatgtttttttgaatttaaaatagccatattaaattatttttcgatggtgaattttactcttttaaaagaagtaaaaaatgtatattccctcaatcagatttttaaatataaaaaaattgtattcatcacatttttcttactcttttgtgcgctatagataataggttatatcaaaattattaatctttaaaaataaatatttaaaattatttttctattgattcgtactacttttagaagaattattgattattttaaattcccttgcaatagatacgttcattcctatattttgtctacgacctccaatatgttttttatcctattgtaaaataattttaaaatatagcaaaataccaaatattgatttacaaatccataaaattaacaatatatgttatattcaaaattataagcagattaaaattggttgtttctgaaaaagaattactagcaaataagtaattaaagtgtcacatttttatggtcatttaaaaaatgtaaggtcgatgaaatacatgaaaattgtttaaatttcaattaattcataccacccctcatgttggactatccaataaa

SEQ ID NO: 81296 - DNA, 1364 bp, Heterodera glycines
  Genomic contig location: Contig_ID=SeqID_2730; Location=356..1719; Strand=+
  SCN-specific regions: Sequence locations=1-69,106-398,422-917,939 -1136,1158-1185,1207-1364
atgtcagacaatggaaatgaagcggaggacgaaatggcacaagcaatgtaaaattaaattaaaatgccaattttcaatttcaaattttgttttccttttcttcagtttcatcgccgccgactgttggctttcggtgttcgattggctctctccgcgtcaacttggcctcgaaattgcactgatcaaccaccaatttaacatctacgtagacgaacacttcaaaacgcggcgctgggcgctgaaatccatagaaattttgcgaaaaattggagaaaatggcacaaaggagatgaaaatagtcaattacgctggagaagaagtgccaattccgcaaaagccgttgccaaagagagtcgtcggattcaaagccatttcaatagggtaaaatggatgaattaattgttttcaaatgtaaacgatttcgatcatttcattttcacagatacatcgaccaaaatgtcatcgtgtttctccgccgttttcgtccgcttttcgccaaatgtcaaatcaatttgtccatcgatacgacgaattatcgcattttggacttaatttggtgcaacatttggccaatgttcggaaaaaacattcatggcattgaattgtccgccacatttttccgccatttgcgatattttgcgccgtcaattctcaacgaatgtccatctcttggcattgtctctttctatgctgaggatatgttccccgaatttccgcccgccgatgaaaatgccgcggcatcggatggacaagcggtggccaaatggcttttcacaccgcttcaaaacaatgtgccaaaggtgttgaaatgccagttgacgatggatggtgggaattggtcatcgagaattgcagcatttaaagtggtacttactaataatttgtttatttggcacttggcggtctttgggatttgttgataaattttttaacattttaggcatttgccaatgcttcatcgcccgtcaatttcatcgtttccatttggtttcgttcgtcttttgcttcatccgttgtgccatttgtgctgaccaacgaattgactcgtgaacaattggcattggaaaggattaacaatagccatcgttttctgctgatccgttgtccaattgtacgaaatgcgagccaatggacaaaatgggagaaggaagcatttaattggcgaatttatgatcagcggaacagaattaacattgaaatttttaatgaggatgacatcggcgattggtcagcgaagaatttttcaaatttattttttgcattttcaatttttaggcttatcgacgaaactcccgacccgagtgatctgcagtagaagtggatgaatgtattgttgagaagtgatcgatcaaattatggaatta

SEQ ID NO: 81297 - DNA, 1683 bp, Heterodera glycines
  misc_feature (736)..(736): n is a, c, g, or t
  misc_feature (743)..(743): n is a, c, g, or t
  Genomic contig location: Contig_ID=SeqID_16868; Location=145..1827; Strand=-
  SCN-specific regions: Sequence locations=1-37,59-62,111-260,320 -409,444-521,555-740,774-788,810-844,885-1031,1073-1126,1153 -1190,1326-1473,1534-1683
atggacgcgatggaaggcgatgaagtaaacaaaaccatttacaaattaattttagggatatcaaattaaatacaaaataaaatttctgatttaaaaaaaaatattattttcaaggctcaacaacaaaacttttcggccgatcagttggacaaattggaaagcggatttcagaagagcaaatattttagtgcttctgaacgtgaaattttagccaaggaaattggccttacggaaacgcaagtgaaagtgagaaattgcagtaattaattaaatttaaaaaaataaaacctaatcattaattaattaattatctaattaaggaatggttcgaatggcggcacaatcaatggagagaaagaattccttagtaattaaaaattataatgaacgatgactcaccaaaatttcgaaaattactataaaaaaaaattaaaaataaaattcagtgtccgacacgaaaaacagcaatcaccacaaaatgttaccaaaacggaggcgattgaacaaaaaactgtggtataaatgattcaatttttcaaaaatttaattgaataactccctaaaaaatgtttttcaatttactaaagccactgaaacaaaacttttcggccgatcaattggaaaaaatggatgacgaatttgcgaagacaaaattcccgagtttcgctgttattgaaaaatgtgccgagaagacgggcctaacgcataagcaagtcgatgtatgggtcttcaattntaagaanaataatttttaatacaatttttttaaattaggaatggtttgaagaacaacgcaaagaatggcaccgaaagttgatggaaagagtgatgaaaaatgtcattgaaatatatactatattaatatatatcaattttaatttttaggcacaaaaacaaaaatttccgattgaacaattgatcaaattggaatgcgaatttgagacgatacgatacccggacatttttatgcgaaaagaaatggccaaggaaacgggcccaacggagaagcaaatcaatgtaattagggacagttaaatttttaaatttaatttaattgcttaaaattaatttagaaatggttccattttcgacgtgtacagggtagtgaggaaaagcaacttgaagcaaaagccaaacagcagaacaatgtttggccaattaccaaagcaaaaataatgataattagttgcaattattaatttaataaaatacgaattcaaaaaattaaaaattattagtttaaaatatcaataaatattatttatttaaaaataattagaaattataatttaataaaatgcaaattctaaaaaatataattttaagatacaaccacaaatcatttcggctgatcaattggaaagattggagcgcagatttagcgaaacacgttatccatatccagttcaaatgggaaactgggccaagcaactgggccttgagatgcatcaagtcaatgtaattagggaaatgaatatttaaatgaatcaaatatttgaatatatattttaattatttaaaaataattaattagttctggttcctaaatcgacaagcacaacacagacaagaagaaaaaaaagccaaggaaaaatggttggaaggtcgacgagaccaatggaaactgcaaataccaacagaaggaacatattagttaattagtttatacaaaaaaaaattaaa

SEQ ID NO: 81298 - DNA, 867 bp, Heterodera glycines
  Genomic contig location: Contig_ID=SeqID_16868; Location=2097..2963; Strand=-
  SCN-specific regions: Sequence locations=1-121,144-358,382-515,537-867
atgtgttctgctgacccctcactctctctgtttgtgcttggaatgggcgttggttagtcagcaaaattattggtttgacctcaatcgagtcagaggcatttgggccccgtgcatttttggctaaaatgaacgcaaaaataatatagtccaactttttttattttttagatataatttcctcacgaacaccctctggcaaatcaatgaaatttccagagaatatgtattcgcaagttttaatgaatggcgaaaaacggagagacgggaaaacaaacaaaaattttttggcattttgaacaacaaacgaaaatcgcaaaaaataattttcaaattaatttactctcatcagtgtccatgcatatatataatatatatatatatgttattgtatttgccagttccaaattctttggcatctattttttgtttgaatggcgtcccttcagaaaatgtctttttttaggtcaaaccaatacattttttgctgagattaacacccattccagcaaagtcccaattgaggagactcagcacacattttgtggggttaataatggaagaaaatgagtggaggattagaaggagaagagaaagaatttgtgccacaaaaatacgcccaattttgccttaggaatttcggctccactttaaattaggctcttgagccccccgataccgggctccccaaccttactcgcctttgaggaacgagcaatttttacactgttaaggattggcttcccaaaaacttgagaaaacttttttttcgggtttaaagttatttttttggaaagaagcattgtcaggtttttaactaaaaattacactgaattttgttaaaaaatgttagtttttatagaaaataaa

SEQ ID NO: 81299 - DNA, 284 bp, Heterodera glycines
  Genomic contig location: Contig_ID=SeqID_16872; Location=991..1274; Strand=-
  SCN-specific regions: Sequence locations=1-226,253-284
atgacaacttgtacgagttctaaaaataaacttttctttatttagctttatagtaaagagtcaatcataatgcatttatagtgattccctgctcagtcacaagaaatactacaatgaaaaatgtgatgtagaataccccatgggaaagccaaaaatatatgaatgtttaagcacaaatgcaaggctaattaagtgaaaaaaataattatatttttcctagcgcattagtggaaaaactaaaacagaaaatattattacttaggcaggcattttttaagaataaa

SEQ ID NO: 81300 - DNA, 338 bp, Heterodera glycines
  misc_feature (8)..(8): n is a, c, g, or t
  Genomic contig location: Contig_ID=SeqID_16872; Location=1633..1970; Strand=-
  SCN-specific regions: Sequence locations=1-60,94-189,228-277,299-338
atgtttgnaagtgcaaatttgcaaagtttggcaccgctttcttcgacagcgacgatggcgaataataatgatgatgataatgatgggtttgccatggcaatgatgcgccgtcgtccgccatttgctggtgcgccgttttgtcatgttgcatcagcaacgagtacagttcctcctcacaaagggcaggcattttttaagaataaaaatattcatgaattcactcaagaacctattgttgctcaatgcaatttagtcaattatatagcgacctttatgcgataaatgaaataattaaaatcgattttcagatgacaacttgtacgagttctaaaaataaa

SEQ ID NO: 81301 - DNA, 250 bp, Heterodera glycines
  misc_feature (183)..(183): n is a, c, g, or t
  Genomic contig location: Contig_ID=SeqID_16872; Location=1781..2030; Strand=+
  SCN-specific regions: Sequence locations=1-97,131-250
atgcctgccctttgtgaggaggaactgtactcgttgctgatgcaacatgacaaaacggcgcaccagcaaatggcggacgacggcgcatcattgccatggcaaacccatcattatcatcatcattattattcgccatcgtcgctgtcgaagaaagcggtgccaaactttgcaaatttgcacttncaaacattccttgaactgatcgccacactttatgagcgtgaaacggaccaaattgttcgatgctcgc

SEQ ID NO: 81302 - DNA, 435 bp, Heterodera glycines
  Genomic contig location: Contig_ID=SeqID_16873; Location=1072..1506; Strand=+
  SCN-specific regions: Sequence locations=1-400,422-435
atggatccaatcaataatccgatcaaatccattcatttggcagccaaaaatgatggccggcgtgccgacggagcgcgtcaaccgaaaccaggagatcaccttccaaatgtgcaagtggatggtgatcctgtccgtgttcttcactgcgcacaactttgccatgatgttgtacgggaccaaggagaagccgttgtggccctacacgctgttcatgaagaagagtgacggagcataaagaagctctctcgacgacacatattgtttttgtgtgtattaggtgtaaacaaaattttcatgttttatggacggaaaatgttagtttggatgtttatgttccatggataaagaaagctgggctaactgtttgttgaattaaagcgctttgaatttttttcaattaggtatagactttctaaaatttcaaatcttaaatta

SEQ ID NO: 81303 - DNA, 1468 bp, Heterodera glycines
  Genomic contig location: Contig_ID=SeqID_16874; Location=1909..3376; Strand=+
  SCN-specific regions: Sequence locations=1-170,208-515,566-820,842 -898,920-938,961-1346,1372-1425,1449-1468
atggcccttaagaaatgggccgcaaatgtccgaaccgcaaatgtccgggccgcaaatgtccgatttggctggggccgcaaatgtccgagccgcaaatgtccgggccgcaaatgtccgggacgcaaaagtggggtaacccttcaaaaaatcaaaaagattggaattgaaggaaaaatttataattttttaactaactttttaaaaaatcggagttttaaggttaaaatcggcgatgaattgtcagaaagtttcaaaatattttcgggagtgccccagggaagtgtcttagggccattactctttttaatttttataaatgatctgccgtcttttatttcaaataaagcatcatcagttggcatataaatgtatgctgacgatgttaaattatattatgcccatgaaaacgatgaccattcaaatcagttggataaagcgattgaggctttggaaaaatggtcaaaaataaatgggttagaaatttcaactgaaaaatgttttgttctttatttagggaaaaataacaagaaaaaagaatattttattaactcaaaaaagatttcagaatcggaaagtgtacgtgacttgggaattataattgactcgaaacttaatttttcagaacatattagcaaaattatacgaaacgcatatcttagaattttccaaattttgagagtgttgaaaagcagggaaataaaaactctaacagcagcctataaaacttttgtacgacctcaattagaatacgctaccgaagtttggaacccaaatttaaaaaaagacattgacaaaattgaacgggttcaaaaattttcacaagaaaagcacttagaaaatgtggttttgtgtacaaaaaatatggggaaagactaaaaatcactgatttacacaaattagaagaaagaagaaaaatcaatgatttaacaacagcttttaaaataatcaaagggttcaccagcctcgacgctgggaaaagtttctttttctcagaaaggtccaggaggcctttacttttacgggtaaagcgccacacggccaaaactcaaaataattttttcaatagaatagtaaaaaactggaataatcttccactggtagcggtgcaaattaataaggcaaaggaattcagggatttactaaaagcaatgagttctgagtaggattttccatgttgccatatttacactatatttttatcacctgtgaatttttaacatttgattgatttatttttattcattttttattacggtattcactttgtattttttatttgaccaactttatttgttgttttctttttggcaccatataagagcactcacgtgcctttggtttgctcgataaattaaattaaattaaaaaaaacaattttcaagaattttggggtttttgtcaattgccaacaatttttttggcatgtgaattttttaaaaactatttttcaactatttttggcttgtca

SEQ ID NO: 81304 - DNA, 142 bp, Heterodera glycines
  Genomic contig location: Contig_ID=SeqID_16874; Location=3011..3152; Strand=-
  SCN-specific regions: Sequence locations=1-142
aatgaataaaaataaatcaatcaaatgttaaaaattcacaggtgataaaaatatagtgtaaatatggcaacatggaaaatcctactcagaactcattgcttttagtaaatccctgaattcctttgccttattaatttgcacc

SEQ ID NO: 81305 - DNA, 1369 bp, Heterodera glycines
  misc_feature (31)..(31): n is a, c, g, or t
  Genomic contig location: Contig_ID=SeqID_16875; Location=1..1369; Strand=-
  SCN-specific regions: Sequence locations=1-708,731-1113,1135-1369
aaagattcgtacccaataccgacatggaccnaaattttgatgtatttgggaaacaaacactattttactattttggattaatgccggggtattggcaggttcgagttaaggaagaagacatcgaaaaaacggcgtttacagtacctggtggtctgtatgaatttttagtccttccttttggtctaagtaacgccccagccacatttcaaagactcatgaacaaaattttgttcgaatatattaacgaatttgttttcgtttatctggatgacattttaattgcctctgaaacatttgaagatcatatggtccatctcagaaaggttttcggaaaactgaatgaaaacggaatgaaagtcaaggcagaaaaatgtggttttgctttagaccaaaccccatatttaggacatattcttacacgagaaggactcgcaaaagacccggaaaaatacaaacccatcaaagaatttccgatgccaaaaacaatcaaagaattacaaagatttttgggaatggtcaattggcaccgaaaatgtatcatgaattttgcaaaaattgcggcaccattaacaaaaatgttgaaaaaacaagatgctacggtgttaatttggtcggacgaagcaaaaaagagttttgaatctttaaaatctttaattgttgatgaagttgtactgaaatatccggactttaatttggcacagaacgatccaaaatttaaatttcatattttttcggatgcgtcaaagatgggctaggtgcagtgctttgtcaacgggatcaatctgggaaaatgagaccaatttgttacgcatcaagacgctgtaaacaaaccgagtcaaattacggaccaacagttttagaatgtttaggcataaaatttgccgtacaaaaatttaagcattttattgcatggcttccaacaatcgtatttaccgaccataaggcccttccccaaatgttcaaaagcaaaaattcggtcggaaattcaaaagtggacagatggatcatggaattaggtgctccattccaattagaagtaatttacaagcctggaaaagaaaatcacgttgctgacgcactttcacgagccgttaactcaaaaccccttaatttggaagaaaagggaaacgaaaattgcgcacacatttctgccgttttaacacccgaaattccgaaattgccatttagtgtttctaaggaagaatgggtcgaggaaatcaaaaattcagaattggcttttatttggaactttttggtcaaaaaagaattgctacaagtgttaaaaactcatcagaaacttttggaatcgcttggaaagtttacagttgatgaaaaaatcctttactatttgaattccgaccagtgaatc

SEQ ID NO: 81306 - DNA, 96 bp, Heterodera glycines
  Genomic contig location: Contig_ID=SeqID_16876; Location=1..96; Strand=+
  SCN-specific regions: Sequence locations=1-96
ctccgctagaacaattggcatctaacgaactgttgatgagcggcaaattcggcgacccgactccgctggtagcccaattcgctgagccggtgccat

SEQ ID NO: 81307 - DNA, 387 bp, Heterodera glycines
  Genomic contig location: Contig_ID=SeqID_16876; Location=1657..2043; Strand=+
  SCN-specific regions: Sequence locations=1-336,359-387
atgtgtctgagcgctcttttcatcaacggccttaaaaaagattcaattcgggccgagttgataaagatgggagtgaacgaaatgaagttcaaagatgccgttgaaacggcagtgcttctcgagcagtccgaattggacgcagagcaaatcggtgggcataagaaagccgaagtggctaaagtcttcgctccaaagggaggaagaaagagcagcgcaccgacgcaacagcaacaaatgcaatgccaccgatgtgggaggaatggccatcgcaacaatgagtgcccgaacaaggactcaaaatgccgaaagtgtggaaatgttggacactgggctgtgatgtgcaagacaaagcagggctccaattggccaaggaggcaagggaagcca

SEQ ID NO: 81308 - DNA, 211 bp, Heterodera glycines
  Genomic contig location: Contig_ID=SeqID_16877; Location=171..381; Strand=-
  SCN-specific regions: Sequence locations=1-44,66-82,104-211
atgggtccgacaaacgaaagcgacggaccgaagaagcaaaagaagggagggagacggagggacggaatgttaaagtcaacgccaaaaccaaaaggcatggcagcagcatcaacggcacttcgccatctgtcaccacttcacaaagttctgctcgtagttgtcgcactgctccaatggacagcgacggggggaagggccgttctgcttcaag

SEQ ID NO: 81309 - DNA, 428 bp, Heterodera glycines
  Genomic contig location: Contig_ID=SeqID_16878; Location=904..1331; Strand=-
  SCN-specific regions: Sequence locations=1-428
ctgttatttatggaccaaattgaggaggtttcctcggagttgcaacaggtgaagggcgagacggcaattgtggtgaaactgaaggaggggctgaaggagagcaaagtgatccttaccaatcaggtgcccccgaggacgcaaattggcggcactctttccaaaaaaaacattttcaggacgaaatttcgctcaaagaatggcacacttcgcttcgcactgtaaccaatcaaatgcattcgtttggaggctcaatggcacgcccttttcaggctcatcgcgtttcgcaagagttgcttcaacggatgggccgaaaagccatcaaaatctatggggtcaaccacgacccgatgctgcaggagaacgaacggccgggctccgtcacccgggcctttctcaacagggctgcttctgtcgactcgggcatttga

SEQ ID NO: 81310 - DNA, 1278 bp, Heterodera glycines
  Genomic contig location: Contig_ID=SeqID_16879; Location=1..1278; Strand=-
  SCN-specific regions: Sequence locations=1-328,350-1278
tttcgcttccgcgactcggtcggctctttcaacagtccccgctatccttccaacgttcgtcatccgttttgcctcccattccgtctgctcttccgtttcagtatccgcttgatgccgagtgcacttatcacatcgttggcccatccaatgcccaaattcttctctttttcaaagtttagccaaattcgtccccaattaccgccgcctttcccttcaattaagcaatttgcgcttttcgaggagaattccatggacgagtgcaacgattggttggaaatattcgatgtttttcgcgatgcgaacggcggagagactttgaaattgcagggtaaacaaagaaagtcaatttcattcctttccaattgcatttgccgctttctcttctttttctcagccaaacattgttggcacgtcttccccgggcccacagtgtccgcccatggctcccacgaaatgcgcgtcgttttccattccgacaatttcggcactgccaatggctttgacgcgcggtacgaaattcgcccggcggccacaaaaagtgaaattggcaattttctatttgccaatcagcggggtgattaattactaaagttcagaagtgtctgacaccaaagactgtaaagagggaaaaccatcggcgacgacaatcgaagcgaacgaacagcggacgacggggcattttggtcggaattggcaaagaatgaatgaattttgaaagaattcgaacaatttaaagcatcgcccggctttcccgtcaaatacacaaagaatttgacgtgcgatttggagattcgagttcgagaagggcaccaagtgctgctgaaggcgaacatgttcaacgtggagggacaaatgacagaagaaaaagtaaaaaagggatgggaggagaagccccttccctcctgctcaggtcgactgcatgaggtgacctctctttgccacccttccatctcttttcatggcatttcaattcgctctcagtgccgtcctccgagttcatttgggcacggacaaccgaagcagtgggtccgacttgcaattgtgtggcgaaagtgtcgcgatgattccggcggtttgtttgtttttttgctgtgagcgatgccatttcttcacattttaagattgtgtccagctccaattcaatccggctgaggtgaaaacattgccaaatattggcacactcccccaatttccctgttcagttttctcacttcgcccgaaaaggtcggccatttcgtccgtccctttgccttttctcttttcgttttaacttatttt

SEQ ID NO: 81311 - DNA, 90 bp, Heterodera glycines
  Genomic contig location: Contig_ID=SeqID_16879; Location=1135..1224; Strand=+
  SCN-specific regions: Sequence locations=1-90
atgggccaacgatgtgataagtgcactcggcatcaagcggatactgaaacggaagagcagacggaatgggaggcaaaacggatgacgaac

SEQ ID NO: 81312 - DNA, 558 bp, Heterodera glycines
  Genomic contig location: Contig_ID=SeqID_16880; Location=291..848; Strand=-
  SCN-specific regions: Sequence locations=1-417,439-558
atgccaattgcagcttttaccgattgcgatcacgtgttcgattcgccccgcagtggtcacttctctctgccagtgtttccccgggaggcaaatgccgactcttccgcccttttcgcttcatctgacgacgaaaatgccgaaaatgatgaagccccaaatggcaactacgaaagagtgccgagcagctcgtggcaaccctttgtcactgccacagcagcggcagaggaagcggaagaagcgggcaaaagggacgaggcgaacggaattgtgcggtaccaatcactgcccgaaaacatccaagtgagcgccagcggacgacaacgccaacagagcgctgctaggactgaaaatgattgtcccagggcattaattaataatcatcccaaatttgtaaaacaattagcacatttgcaggggtttttaatttttattcccaataaattttgtgttattttgcgtaactgttctttttcagtgtatatacacgtttgtcgcccaaccgcgggaacgagtgaagctgcaaattgagcagttccaactcgagggcaccaccaatca

SEQ ID NO: 81313 - DNA, 3061 bp, Heterodera glycines
  misc_feature (64)..(64): n is a, c, g, or t
  misc_feature (74)..(74): n is a, c, g, or t
  misc_feature (88)..(88): n is a, c, g, or t
  misc_feature (95)..(95): n is a, c, g, or t
  misc_feature (98)..(102): n is a, c, g, or t
  misc_feature (107)..(107): n is a, c, g, or t
  misc_feature (115)..(116): n is a, c, g, or t
  misc_feature (127)..(128): n is a, c, g, or t
  misc_feature (130)..(132): n is a, c, g, or t
  misc_feature (135)..(135): n is a, c, g, or t
  misc_feature (142)..(143): n is a, c, g, or t
  misc_feature (149)..(150): n is a, c, g, or t
  misc_feature (152)..(152): n is a, c, g, or t
  misc_feature (169)..(170): n is a, c, g, or t
  misc_feature (173)..(173): n is a, c, g, or t
  misc_feature (177)..(177): n is a, c, g, or t
  misc_feature (179)..(179): n is a, c, g, or t
  misc_feature (181)..(183): n is a, c, g, or t
  misc_feature (187)..(187): n is a, c, g, or t
  misc_feature (189)..(189): n is a, c, g, or t
  misc_feature (200)..(200): n is a, c, g, or t
  misc_feature (206)..(208): n is a, c, g, or t
  misc_feature (210)..(210): n is a, c, g, or t
  misc_feature (219)..(219): n is a, c, g, or t
  misc_feature (222)..(222): n is a, c, g, or t
  misc_feature (224)..(225): n is a, c, g, or t
  misc_feature (232)..(232): n is a, c, g, or t
  misc_feature (242)..(242): n is a, c, g, or t
  misc_feature (247)..(247): n is a, c, g, or t
  misc_feature (252)..(253): n is a, c, g, or t
  misc_feature (259)..(260): n is a, c, g, or t
  Genomic contig location: Contig_ID=SeqID_2731; Location=998..4058; Strand=-
  SCN-specific regions: Sequence locations=1-379,401-901,923-1410,1433 -1912,1935-2922,2944-3061
ttacggacaaatcggaaaaagtcattgaaccgccattagatacgcaacgacgcacagaaaaacnacagccaaancctaaaggaagcangggcccncgnnnnngcggnccagaaannccaccgaaggnnannnggnaggaaanncacgcnncncaaggaccacaagccanngcnggcnanannnggcncnaaaaagggaanaccgannnangcggcaagncgncnncagcgcngggcacggancaggnccaannacgaanncgacataaagtacatcaacacgtcatcctttggacaagccgatgtactgtcccgcttaatcgccaattatccccggccggaagaagacattttgatagcaaatatctgcacagagacagattgctacatcaacaccatcctccaaactgcaactgatcaattgccgatcacgaaagcagaaatttcagaatggacgccaaaagacgaagtcctccgaaaaatttctgatcacaccaaaaacggctggcctcaaaagtgcaccgaccccgatatctcaccttattttcctaagcgaaaggaaattttagagattgatggagttttgctctacggaaagcgagtgatcgttccgacccaacttcgtgaacgcatcatcaaggctctacacatggcacaccccggaattgtgcgcatgaaagccctcgcccgtcagcacgtgtactggccaggattggacttggaaatcgagcgtatggtcaggcaatgcgaagattgccagagcgcccaaaagagtccacccaaagcaccgctcgctccatggacgtcttgctcacgaccattccaacgcattcacattgatttcgccggtccctgttcagatggccactcctatttgattttgatcgactcattttcaaaatggccggaagtatacagaatggaccgaatttcgacaccagcaacgctccaagtcctccgatccattgtctaccgcctcggatttccagaagaaatcgtgtcagacaatggcactcaattccatgccgcagaatttaaggaattttgcagcgagtttggcatcaaacataccttcaccccgccgtatcacccgcaatccaatggccaagcggagagattcgttgatacgttcaaaagggccatgaagaaatgcgccaaagatggaaaattttgggcagaaaagatgcttctcgcctacaggacaaccccgaattcggcactcaacggactttcgcccgatcaattgttcttcggtcgaaggcttcgaactcagctgtctctcgtccatccgaaggaagaacaagccgaagtcatcgacccagccaaaatccgcaaatcacaagctgattatgcgcgaaaaatggcccgtcaatttgatcaacaccacggatcaaaatcggttgagtttttgccaaaagatcccgttttgcttttgaactttaatcgtggaaaacgattttggcttaatgggaccatcatcgaacgattggaaaaatccccgacgtatcgtgtccacgttccggcactcggaagagccgtacatcggcacgcaaaccaattgcgtcaccgttatcctcttgaagaggacggtaatgatacggtaaggatcccaccccaggctcaagaagagcaagaccgggacccatcgccgatccgcgagcctcctccgcaaccggcaccaattcgacggactcaggcaaagcgacgatctccgagtcctcctttggccccgcgtcgatcgcaacgccaacggaaagcgccgatccgcttctcgccaaacccctgagggttcagcttaaagaagggaggtgttggagtgttaaagaatttgaatttggcgcgcatcgattattgattaatgttgtgacgtgtcaatccctcccccttattcattttgtttatttaagcactccctccttccccacatggttccttctccattcattttgctattttacattttgtactgcatttgacctccgacataaattgtgtttattattttattgtgtgtccaaagttgagacacaacattggcgcagtcagcagccgtgcttcacccattcgaagacacaccgaactgcaacccaacctcaacaaaaccaatagtcccaagacgggtgaggtccgctaaatttagcggttaaattcgacaaaaaccaatagaccctaggcgggtgaggttccgcaagacgcggttttcttcaatttcgacatccaatagtccctaggcgggtgaggagccactctgcgtggttaattgctgatcatcggacgagtcaaagccaatggacgccacccaactgcagcaagtgcttgacgcagtttttgcacgatttgccggaaatgcggcacctgcaaacgcggcctcatcctcactggcacacgcgactctggccagctccttggacaaccggatcaccaaattccactacgattcggaatgcggcaacacatttgaccggtggtttaagcgatttggagtgctcatcgaagaggacggaaaggaactccccgaacagaccaaagttcggcttcttcttggcaaattgggggacgacgaatacaacaaatacagagacagcattagcccgtcccaaccggaccaggttaaatggggcgaatcgctgacaaagctcaaggatttgttcgccgaaacccgctcacttttcgtccgccgcttcgaatgctttcaaattcgacaaaagccgagccaagacatcacatccttggtggcacacatcaacgccgcttgtgaaaatgccgacctcagcttgacgaaggagcaacttaagtgcatcatcctcgtgattgcactacgcgacgagcaccacgatttgcgccaaaagtgcctaaaaatgctcgaagaagcacagaaaaacggcacgcaagtcacgctcaagcaaattgaagaggaattaaggaccattcagctggtgaaggacagcgcactcactttggcaaatcctcctgttgcaacccatgccattcacacccggccacaacagtggagggacccgaaaggcaaaacaccgcaacaacccaagagggccaacaatgca

SEQ ID NO: 81314 - DNA, 2556 bp, Heterodera glycines
  Genomic contig location: Contig_ID=SeqID_2732; Location=118..2673; Strand=-
  SCN-specific regions: Sequence locations=1-1334,1356-2401,2425-2556
atggcctcatcctcactggcacacgcgactctggccagctccttggacaaccggatcaccaaattccagtacgattcggaatgcggcaacacatttgaccggtggtttaagcgatttggagtgctcatcgaagaggacggaaaggaactccccgaacagaccaaagttcggcttattcttggcaaattgggggacgacgaatacaacaaatacagagacagcattagcccgtcccaaccggaccaggttaaatggggcgaatcgctgacaaagctcaaggatttgttcgccgaaacccgctcacttttcgtccgccgcttcgaatgctttcaaattcgacaaaagccgagccaagacatcacatccttggtggcacacatcaacgccgcttgtgaaaatgccgacctcagcttgaaaaaggagcagctaaagtgcatcatcctcgtgattacactacgcgacgagcaccacgatttgcgccaaaagtgcctaaaaatgctcgaagaagcacagaaaaacggcacgcaagtcacgctcaagcaaattgaagaggaattaaggaccatccaattggtaaaggacagcgcactcacattggcttcacctcctgttgcaacgcatgccattcacacccggccacaacagtggagggacccaaaaggcaaaccaccgcaacaacccaagaggaccaacaatgccaaggagcaacccgcgcgtccaccaaacaccaattacggcaaggcaagccgcggatcaccaactcatccgtgcggctcatgtggagaatcggatcattggcgtacggattgccgattcaaggacgccacatgccataaatgccaaggacaagggcacattgcaaaggcatgccgacgcagctccaaccaagcgaaaaatcgcagagagcgatccgtccacactgtcgttgtcaaatcccactgcatgggaattggaaccgcagcaggccgctggtggcgactcacgttcatcatcaatggaattaagattttgatgaacatcgacactggtgctcaggccaccattctcacactcaaaacgtggaaaaagctgggttctccaaaactcgacaaacccgacattgaaacgcggaactgtaatgaagttccattcaacgtcgaaggaaaatttgtctgcaccgtttgccaacccaatcaagcacccaaaaagcttgtggcatacgtcagttccgaaatcaattacgatcttttcggactgccctggattgaggctttggaagtcatcccgcgtgaaatcatgcaccccgacatccacccaaaagctcaaccagccccagcagaaatcaacgccatggccattcctcagccaacccacaaaattttggatttggaatcgctcacaaaggcactccaggctgatttttcggatgtttttggccccggattaggccattgcaccaaagccaaggcccatttgattctcaaacccgatgctcacccaacattctgcaaggcacgacccgtcccacacggcgccctcaatgcgtcaacgaagagttggaccgccttttgcagattggagccatcaaaccgattgagttcagccattgggcagcaccgattttggccgtaatgaaaaagaatggaaagacccgagtttgcatcgacttttccaccggcctcaacaattcgctcgagttgaatagacaccctttgccccggcctgaagacatttacacggccatcagcggctccgtctatttctccaatctcgacctccgagacgcgtatttgcagatggaattggatgaggaatccaaacacctttgtggaataaacacccaccgtggcctcttccaatgccagcgcctcccatttggcgtcaaatctgcgccgtctattttccaacatttgatggaccaaatcgtctcaggcatcccaggcgcgtttgcctacctcgacgacggcataatcgcctccaaaacgcttgaagagcacgtttgttccctttacaaactcttcaaacgaatccaggaatttggccttaaaatccaattggaaaagtgcaaattcctccagcccgaattgctatttctcggccacgtcatctctgcgaaaggaattcgccccgaccccggacgatcagaagtaattcgccaaatgccgccaccacatgacttgagcacacttcgctcattcctaggcgcattgaattattatggaaggtttataaagtccatgcgcgaaatccgcgaaccactggaccagcttctgcgaaaggacgtgaaatgggaatggaccgacgaacagcaaactgccttcaaaaaggccaaagaaatcatgctgtcggaccttttgctcacccatttcgacccgtttcttccaatcgtcgtggctgcagacgcctcaaaagacggaattggcaccacaatcagccacatttttccggacaaatcggaaaaagtcattgaacacgcgtcatgcacactcaacgacgcacagaaaaactacagccaaatcgaaaaggaagcattggccctcgtttttgcggtccataaattccaccgaatgttatttg

SEQ ID NO: 81315 - DNA, 651 bp, Heterodera glycines
  Genomic contig location: Contig_ID=SeqID_2732; Location=131..781; Strand=+
  SCN-specific regions: Sequence locations=1-119,143-651
gtggaatttatggaccgcaaaaacgagggccaatgcttccttttcgatttggctgtagtttttctgtgcgtcgttgagtgtgcatgacgcgtgttcaatgactttttccgatttgtccggaaaaatgtggctgattgtggtgccaattccgtcttttgaggcgtctgcagccacgacgattggaagaaacgggtcgaaatgggtgagcaaaaggtccgacagcatgatttctttggcctttttgaaggcagtttgctgttcgtcggtccattcccatttcacgtcctttcgcagaagctggtccagtggttcgcggatttcgcgcatggactttataaaccttccataataattcaatgcgcctaggaatgagcgaagtgtgctcaagtcatgtggtggcggcatttggcgaattacttctgatcgtccggggtcggggcgaattcctttcgcagagatgacgtggccgagaaatagcaattcgggctggaggaatttgcacttttccaattggattttaaggccaaattcctggattcgtttgaagagtttgtaaagggaacaaacgtgctcttcaagcgttttggaggcgattatgccgtcgtcgaggtaggcaaacgcgcctgggatgcctgagacgatttggtccat

SEQ ID NO: 81316 - DNA, 735 bp, Heterodera glycines
  Genomic contig location: Contig_ID=SeqID_16882; Location=61..795; Strand=-
  SCN-specific regions: Sequence locations=1-216,325-465,516-611,633-735
atggactggacaatccgtcagtggcatcaaggacaatccgtcagtaatggactggacaatccgtcagtggacatcaaggacaatccgtcagtggcaattcgtcagcattttttctttttacaagcaatgatcaaaaaattttgcgattgcgcttgttcggtttaataaaataaaaattggaggaggttttgtaacatttctcgttattagtaattcaattaaataatttttctatagaaatgttcttttaaatattcttaaaataaataaattattatttaattttttcaatttaaattcattttcacattattttatttaaatgttcctgccctgtgaagacgctaattgcccataattgactaatgccataataggcatataataatttaaaatacccacggggcgggggacgttacatatcaaatgaaaataagaatggaaattgaccaatctcacctcaacaaataattttaaatttaaaataaattaaattgcaataatttataataaatgagaaaattgcgcacggaaaacaatttgagacgatcttcaaaagaatattatgatgtatttgagcgatttgttgagaagggacgacggattttattggtgagggaaaaagagggggagaagcgcaaagcgaagggaaaattaacccaattcaaatggacaaacgaacgaatgaatgaggcggaggaattgggcgagggattggggcggggggatggataa

SEQ ID NO: 81317 - DNA, 928 bp, Heterodera glycines
  Genomic contig location: Contig_ID=SeqID_16885; Location=180..1107; Strand=-
  SCN-specific regions: Sequence locations=1-460,482-928
atggcacagcgcgtgggtttcacgcagataaagtacacgcgcactccagcggaattccatcaactcttggacgatccaacattagacaaactggactttgtccacgtctccgagcatatggaccgagttgttgtcaggaagcgtcccgagtttgcaaaggcacccctcacaaactgtcttccagtcgcaatatacgtcacatcgtacgcgagacttcatctctattcatacatggaaaaagtgattgcactggaaggggctgagcttctttattgtggtttgcgaatacaatagaaaaaaaaaatgttagataattttagacactgactcaatctactacgtgaacaagatgggtgggcggtgtgttccggaaggcgaggcacttggacaaatgaagcgtgagcatgttgatcgtcgaattgtggaatttgtagctggtggtccaaaaaattatggaattcggcacacagcacgagacggaactgatgagcgggccaacctaaaaatacgaagcttcagattatcgtacgccactcaacaattactgaattttgaagcaatgaaggatctgacactggctacatataacattgacggacctatgtcagttttttttatttttcacaactaataattttaaattttagtgatgatgtcatcgacaacgatgatctctacgtgtacggaggaggtggagcccatcgttgcatccgagtaactttcccgcaaattgaccgaaatgtccgttctgacgtatacacctgcgaggcccacaaagactacagacctttctacgccaagggccgtgttcgaccgggaatgcaaacacgaccatttggatatgtggaggatgtatcacatccaccaatacaacctacggctgaacgaagaaagagaacattgattgaccctgacccaactcgaccgg

SEQ ID NO: 81318 - DNA, 1526 bp, Heterodera glycines
  Genomic contig location: Contig_ID=SeqID_16888; Location=786..2311; Strand=+
  SCN-specific regions: Sequence locations=1-219,251-378,401-607,631 -763,785-1057,1089-1390,1442-1526
atgccaccgctgtctctagaggatgactctctcgcgactcactctcgactgaatgaatcgagaatttccaagggatgtatttccggaattaatcgccaagtgattaacaaaaaataatcgactattgtaaaagagcacataaatccacatttccctttcatcttgctgagttcttctccaaaattagacatcggaaaattggaaaaaaaatgtcttaagataaaaaaataatataatatatatattttttggcacttttctcaggaaattgattgctacaaaaaactagtcattttaataagccacacattttgatcataattttgaaattttttttccaatattcaactctcgaaaaaggccaaaggtttgccctggcatttgtaaattatgaatttttcggtaatggtgagggtcaactgggccttgggccaggttttttggtataactaactccgtccataattgaccgacaaaaaattttcaggcaaaatttaaacatagggcactcgaatgatatcaaattcatttaattcggacatcaatcatttggttggggctcagtcgttgccggtccgtgtggcaattcaaaccctttttcaaaaatgctttactaaaaatccaaaaaacatggttaaataaagaaatagtcgcttactgattttattttacccataattatttatcttattttgcgagttttcaaataagcttttttgtttgttagaatattgttgtattgttgtcctgaaaaaaaagattttattataatattttggctgaccaattcaaagtcccaaaatttgtgaaaacaatggtggaaaaatgacactaaagtttaattaatattgtttttttgttaattgatttttgagataaaaactttgcataatttattcccaccacaatgtttttttaaatttaactgacgatttttacagcaaaattagtacgattggactctcctctctattaaaatattaataacattcattaatttaattggattaggcaaaggccaactgatcattcatttgttaatcgcgtgaccacgtgcatttaaaatgataataataaaaaaataattacttttccatttgaaccacccaaaaacattccttatcactggtataattcaccaaattcgtccttcaaaatcaaaattttacattgtatcgtcatatcatgtcatcttcgttgaattggtatatccccccatatatcaaccagaacttttttttattttcatatacatatatttccagggtccggatttatacattttttatttttcacaaaatttgaaaatggatttttctattcatttcgtagttgtaagaatgacttgaatattgcaggaaaataccttgatatgaggactttctatatgtaaaatttaaaaaatttgttaatatacaaattaaaaaatatatttataaaacttgataaatcaaattcagacactgccttgaagagttttatctaacgaaacgaacagaaaaatcgcatttcaaatttggtataaa

SEQ ID NO: 81319 - DNA, 699 bp, Heterodera glycines
  Genomic contig location: Contig_ID=SeqID_16891; Location=875..1573; Strand=+
  SCN-specific regions: Sequence locations=1-500,523-699
atgataaaattgaataaagccgagctgatggaggtaattgagcactgttgtctgatggaccccgaactctgctgcaagttggcgctaactagaacacggatgctgctgaacgtgctgctccaagtcatccgaatcgagagcaggtggacgtccggagcggggttcatcttcgagctgctcattgccttcacgaaattttgtgaaccatcgcttaactgtagaaagagagagtgcatcattgccctcactttcacaaatatttcgaagagcttgggttggggtataattttttcggaattcgtaaagtaacagttgtcttagccgaattttgtccgttttttgaaaatcgttcgattttgcaaaagtaatggctatacaacaaatgcaaatggccagaagatggccaaccgtccgctgattcatcccaattgcctgcctccctttttcaatctctttagaattaaatatcattttttgcataatttgttttttcagagggtcagaactttttcatcaacccaatagaaaaggcaaatgaagacggttatggagaaacgctcaaataaatgatgataatcagggatggaattatatatgctaaaaaacgacaaatatgtgcatgtatatgtgccaaaaaccccccaaataagtgataaaaagttaaaaaagccatgccaaaaactgaaaaaaaattgttta

SEQ ID NO: 81320 - DNA, 73 bp, Heterodera glycines
  Genomic contig location: Contig_ID=SeqID_16894; Location=995..1067; Strand=+
  SCN-specific regions: Sequence locations=1-73
atggaccagagaaataatacagatgctgaggttcaaaaaatttcattaaacattcaacagctgagtcaaaagg

SEQ ID NO: 81321 - DNA, 503 bp, Heterodera glycines
  Genomic contig location: Contig_ID=SeqID_16895; Location=194..696; Strand=+
  SCN-specific regions: Sequence locations=1-15,37-211,233-456,478-503
  Gene Ontology: Mol. function=t-SNARE activity; Cellular component =integral to membrane; Biological process=exocytosis
atggctttccttaaggctctttctgctttggagcaggacatcggtgacattaatcagattttcaaagacttggcccatttggtgcacgaccaaggcgaaatggtggacagcattgaggttgttgtttaagctgtaggacaaagggagggcaatgggaagagcaacactttttaaatagtgccgaaatgcatttagaaaaggaaagggcaaatttaaaaaatgaataattattcaggcgaacattgagcacgccagcatccacgttcagcaagcaaacacaagcgtggcccaagcggtgcattaccaagcgaaggcacggcagaagaagctgatgatttatgtgagtgaaactgcgcaattgaaaaaaactatgccaatcaattaatttgctaattgccttccaccggtgatattttcagatttaatttatttactttcaggctttttgcatctttgtgctgctcgtcctgtttcttgtgctttacttgtggctaaagcactga

SEQ ID NO: 81322 - DNA, 436 bp, Heterodera glycines
  Genomic contig location: Contig_ID=SeqID_16895; Location=1045..1480; Strand=-
  SCN-specific regions: Sequence locations=1-7,47-125,160-183,206 -385,428-436
atggggagaggaggaagagaaggaggaggaagggagaaagaggaggggaaagaaagggcactgaatggtaagggacggacagaagtaaaagcaaagtcatcacaaaaataattcagaggaagcgatgagaagcaaaaagacagagggagagagtggaggagagacgaaaaagggagagccaaatgaaaacggacacatggaaaacgacgttttataggggggggggggggggatggcattgcccgtcattggcacgcactcatttcacttaaccgaccggtagcaataattcacaccccgggatttcgataacaatcacaaaaaatagaaaaaaacaacaaataatttaggttaatttatgtaaaaaaaattaacttttgcgaagataaaaaaagtttaatgaattatattataattgatataaaatgagaataaa

SEQ ID NO: 81323 - DNA, 81 bp, Heterodera glycines
  Genomic contig location: Contig_ID=SeqID_16895; Location=1554..1634; Strand=+
  SCN-specific regions: Sequence locations=1-81
gtaaatgtccaagtgctggagaactttctgctcgcgttggaattgggctactccaagcacaacaatccctaccacaacacg

SEQ ID NO: 81324 - DNA, 175 bp, Heterodera glycines
  Genomic contig location: Contig_ID=SeqID_16897; Location=661..835; Strand=-
  SCN-specific regions: Sequence locations=1-175
atgctcaacggcgaaagggattggtccccactcggcacggaccgtcgtcagcccgtccgattggtgcacatcaaacggccgaacaccgtgacagaaacagggccaatggacgtggcacaaaaggagacattttggcggaggctttccacgttgaaaggatacacagaagttgcgg

SEQ ID NO: 81325 - DNA, 7926 bp, Heterodera glycines
  Genomic contig location: Contig_ID=SeqID_286; Location=1..7926; Strand=-
  SCN-specific regions: Sequence locations=1-106,145-569,591-687,719 -949,971-992,1014-1119,1142-1175,1200-1484,1506-1572,1595-2755,2778 -3159,3181-3205,3228-3438,3471-3632,3666-3676,3698-4723,4746 -4837,4859-6701,6723-7608,7648-7926
  Gene Ontology: Mol. function=structural constituent of muscle; Cellular component=extracellular space; Biological process=cell proliferation
cagaccgaccaaagttgagctcaccaaagggataagtgtgctgatgagaagaggtggtgaagatgaaaatggtgaagttgtggatgctccacccagacctcccgctccaccaccaccaccaccaccaccaccaccaccaccacctccgcctgggagacgcccttggcgtggaccaagtcctccccctccacctccgccacccgggagacgtcctcggcccccaccaattcctccaattcccgctccttctccaccagggagtcctccacctcatcctaaacgtcctcccagaccgagtagagcagcgccttatcggagaggtggtcgtctggagcaatggcagaaaaggcgatacgatatacaacgacggcggccggttgtacgtgatcttcttgctgaagcagctgccgctcctttaccggaaagtgataatgatgatgattatatgttggagagtgggttcgctctgccagcgccatcacaatactatggcgatttacctgtgctgccagacaacgcggacgaaattgaggagatggacaccgcacagcataggattgccaccagaagaaaattaaaaaaggatgaggcaggtgaaaacaatttaagacacaaaaaacataggatctttcgcccttcgcctccacgacccacaccaatgccgcgtgctaaagcaaaaattgaaccaagacctcctccacctccacctccacagcgtccttctgtcaagatagaacaaaagccaaaactggaacttaaaccgtcgacaccaaaacaagccgatcatcccacaccagcacctaaatcgaaaagtggaccaaaatttgagcagctagattctcgcccatccacatcaaggcaagccggatacttccccccgccgacacccaaaattgaacccaaatatgagccgcaatcgacaaagagacccgtgccatatcagatcccgaaaaaagagccaaaaattaatgaaacgccaccgcaacagcaaccccctcctgctgctgtcgtcgaagaaatgccctatgttcctccgcctaggagggggaccaaacgccgccaccccgtgaatggtgagaatgatgatgaggtgcgcatacgaaaacgagttaggcaaccgaggagggtaagagtacagtactcgcccgagccgggtccatcaacatctgcgcagagtgatgaacaacagcaacaacaacgtgaactgtttgccattccgtcaaatcagctgaccatgactcagcggattgaacgactgtacatcaaatgcaaccgttatgcggatcgtatgggtgtccggggcaatacaattaacacagcaaatggcaagccgttggcgcatagcaatttgcgaatggccatcaggtatataattgacaggagagcgggccgccccaccattaaaccacctggagcggccctattggaagagcggcttagacaggacccaattttgtattcatggacggctcctccaaagagaccgtcaaagagcacaaccaccaagacggcgccgaaaatcaagaaggaattccgtccgaaaaaatggagttaatcaacaccactcttgacaagctgtacaataatccatcctccccggcagcgttcgccggagttaccgcactgtggaaggaagcgcgaaaaaaagctaaaacatttacggaaaagggatgtgcagcattatttggaggggcaccgcacctacactctgatgcgcccccggcgggtgcgctttccaagggccaaaactgtagcagcgggattcatgaccgatgtccaggtggatttggccgattttcaagctctttcgcgtcacaatcggggtcaccgctacctgctcgttgcggttgatgtcctatccaaacgcctgtttgttgttccactaaaaaataagcgagccgaggagatgttggaggcattcaagcaactcatcgatcaaatgcccatggtcccgcatcgcattttctcagacaagggcaccgaattcaagaacagattgatgaaggaattctttgaggagcaggaaattgagaagcatgagcccgttcattcgtccgtcaaggcgtcggttgctgagcgggccattcgtaatgttaagcagcgattgtatcggtattttgcggaaaaggagacgctgaactggctggatacagtacagaaaattgtggacgggattaacagttctccatctcgtgttcacgggatgcgccccattgacgttgacttttcaaatgctcagaaagtgtggaagcgaatgtaccaccgacaaccacgattgagcggacgtaaaagaccaccacgttttcacaatgatgaatttgtgcgcatgagtagagagaagggacaatttgagaaagggtatttgccaaattacggggacgaaatccttgagattgatgaggtgttgaaagcggtgcgcccaattcggtacaaattgcgggatgagcatggagagaaattcaagggcagcttttatgaacaggagctggcacgcgtaagaaaggacgcagagacaagctaccgtatcgagaaggtgtacaggaagagaaaactgacagacggaacaacggagatgcttgtgaaattcataggatatcccaatcgggaatggattcaggaatctcagcttgtataaaagcgatcacatttttcattatttgtgcagataaacaatcatgtcgaacagtttctttgtgtttttgcctagcaatgtaagtgattacccggacaatcagcccaacaaatttcgtgtccgcctcccaaaacctttacattttaatggctcgtgggtgtgcggactgcacagtatcagttacccctactcatggtcaaccattggcacattggatgagcagtggattgacattcacttcaccgaccgtagcgcctccgacgaggacagacaacgagtgatcagagtgccggtgcccagggcatcgcatagtagggttgaacagctgagagactttttggccgtcacattgcggaatcgtagtggtgcaaaattgttgccacttcccagtgaggtggaagcgaatcggaatcggacaaagcctctcggctcgccaccaccgttgaagagagagaaaagagctgagtcaccgccagtgtttgacgagagcggaaaacggcttgaatctcccccattgtataacgaaaatgatgatgctgatgacgaagggatgcttgaggagtcaccgcctcgttttgatgaagaagaagaagaatcgcaaacaaaagacactggaatagctcctgtcacacccaaagaaattgatgatgatgaagggttgcttgaagaatcaccgcctcgtattgaagaagaagaagcgcaaacaaaagatattggaattgctcctgtcacacccaaaaccaagtctccgccaccagcagcaactccaagtcctattaagccgtcaatcacaacaccatcggctccaactacaaaaccaacaacaacaacaacaacactgacctctcagccacccgcaaagcatctatcgcccgcaccacaaccgcaaaaaccgttaacgactacttctcaaccgcaaaagccatcggcagttcagccacaaacaaaaccatcaaaccctccgcctccaaaaccaagaatagcgacaacacctgccccgacaacaacaacaacaacaacaacaacaacaacaccatcaaaaacccaaccgccaccaccacaaacagtagcccctaagtctacaacaccagttcctccacctccgaagtctacaacaccagttcctccacctccgaagtcagcaacacctgtccctcaaccgccaaagacaataacgccaccaataacaaaagttcagagcccatcagttaaaccaacaatttcggcaccgccggcgcaactaaaaagttcggcaccgtctccaaaatcaacagcatccagtactacagctaagctgacagcttcaacttcccttcccgctaaatcgaggcctagcgctcaatcgccgccatcaccgccgtcaggctctccaccacgttttgaagaggaagaaaataaagcagaaaaattaaccgcaaaggcaacaacgcctgcaaaaccacaagtcacgagtccgtctgttaaaacaaccacaattacggcgcctccagcgcaactaaaaagctcggcacctcctcaacgaaaaccgcaactgccaactaaaccgctagctccaatttcgctttctgctaaatttccatcgtcagggtctccaccccgttatggagaaaccgaacatcagcagccttcacccgctccaatcgcagctgctttaacgcagccgtcacccgcgccaacctcagctgctctaaagttagcagacttaaatttaccagaaaatatcctcagcgttcaaattgaccctctaggatatgtgcccaactcagtctcaataccatatcacgatgacgcagaacgtttcaaagcggtgttcaatgaggaggtgatcagtcatttgtcgttttcgccgcaattgggctatgttcttggtttcgaaaaccctcaacacgtagggtcaaatgaactctcaaagtatccggtggatatgcgtggcggcatctcaagttttgctgtctactcaaaaggattgaccgagaacatgatcatcggcaattcattgagctctttgctccgagttgtgtctatcagcggtgccattcctaatgagtataacgagaaaatttacgattcgccaatatttgcgcgagtgctgccaagggagataaacgagattgaaattgagctgcgcacaatggacaaaggacgattggtgccgttcgcctatggaacaacgatggtcgtgttgatatttaagaaagtgataaatttttgattccattcattttacatttcatttataattaataataaatggttcatattgtatttgacccgagcatagcacagtatgacgagtatgtgcagtacggtagcggattagaaaaggacgatttcgactactttcgggggtccaaccccttccaacggggctacggtattcaacgcggggcgggcgttggggatgtgtttcgtggactgtggcgcttttttctaccaattcttcgccgcgttggcactacagtaggatcggaggcactgagcactggacaacgcgtgctggaacgagtcgggaatgaggggataccgtttaaagaggcacttgtcagtgagggaaagaaagggatcgacaccgtactcgacaaaggaggattaccaaaacagtttggaagcggaaaaaggggtataaaaagaaagaaagcacatctgcctggtcatcagacgctaattggacgacctattgtaaaacaggcaaaaaagcgtattcgatccgacgcctttggactatattaaataatggcgtttcataaaattgacaacgattctgtgaactcaatcaccaatgctttggactttttccgaattccccctacaaatgtgagcgtttcgtcatcaaaagtgttcgagcttctgcccagcaaccctctgactgacacaccgtaccactttaaacttcattccagtcaaaattacattgacctctctaaatgttatttgctcactgagttccgcattcgcaaggaaaacgcaaatggacaacttgttgatctcactgttgacgatgcacacattgcgccaattcaaatgatcggtcaaactttcatccgtaacataaaaatgagtatcaatgggcgcgaaattttcaatgccaacgctttaatggcttacaaaacatatttctcgcatgagctctcctattcaacgacagcaaaggactctcatctgaacgccgcaggctattatcgggatacgggtgatgtgcttgagacgggaaacggatgcatagcgcgacgtgatttgtttgctggtagcggtgtagctcaattcatcgccaaaattgacacagacctattcaaccaaccactgtatctgatcaatttttgtgaattggacattgaaattctgcccaatgacaatgagtttgtgttaattgcgccggccacgggtgcgccccggtaccgctttgaagttgttggactgaaattatatgtgaaaaaggtgtctctgatggatgggttggcgctggacattgcgcggaagctggaggtgaaacctgcccgttatgcagtgcggaagacaatgatgaagtcaatgttcatcagtcagggtcggtatgagtttacagccaacctgttcatggaccaaatcccccgtcgtgtgacaatgggtctggtggcgaatgctgattatgtcggctcaattcggcgcagtccattcaattttcaaccatttaatgtgcgcgaaatttccattgttgctaatgggcgctcgtacccacaagcaccctatgacttggactaccctaacggtaaatatgttcgaccattcaatgacatgaacgaagcggtgggattcgcaaattcttcggagagcaacgggataacttttgcccaatatgggaaaacgcattgcatttacgtgttcaatttgaccaacagtggggatgatcaagcggcactatttgatctgataaagaatgggaccactgccgtcagcatcaaatttaaccacccagtgcccgacggaggaataatgctggtggtgatgggagaatgtgactcactggtgatgttagacaaaaatcgatcaataagcacagacaccactatttaaagtccgtttgtcatttctctttgttccaataaaataaaaatgtattcaaaaaaatttgcccaaattttgttctttctccgagtttctcttcccgttgtttcatcaacattgcgacaacaacaacaaccggaaaatacctactctgcttacctaaaaaatttgactttgtctcgacaacaatatgaaccacactattcatactctgaatatttaaggagactgtctttattcaaacgtaccaccaacaccattctcagtacaacaactgtcccattaacaactacctcgaacataaacacccatccaaaaagcgacaagttaattgatgagcatgtttctgctgttcttccaccgcttatccaaatgtgtaaggagcagcctgaggaaagcagcatttttcatcaagctatttgctgggccctcttcactctctatttaatgcttatcatcagtcttgtgctacaccaactctgttcaattttttggttgaagaatggacagcgtgcaaataacaaagattttgaacgaaaattgtcggacagagcgagcatttcggggctgctacgccagtgaccaattgccacctccctccacactacagtactccgcagcgctcgttgtgaaccgggacccccaccataagaagggctctcattggtgcgctatttatgcaaagggattggatgcaccagtgttctattttgacagccttgctcagccaatcccagccgctgttacgtcaacttttttgtgtaaattcccggagggactgaggaagaattcttacccctaccaatcctctttattgtctacttgtggtgcccattgcattgttttcatttaccatatgtccgtgggatattcatttgagcaatttctcactacacttagcaattgtacaagtcctgatatgtacgcattagttgtatttaacaaaatattaaataaataaaaatgttttataacttgattgtttattcaattacgaaaaaaaaacttattcgattgaaaaattaaaatagtaggaaccagggtgttgagttgtttcaataatcattaaataaccaacatctcctttgtgatgcggattcatcaatcggtaaagttccatcccatcggcgcggaccagttgaccaaggccatgtgacgccatttctgttgccgggaattggagaagccgcgggaagtgttgacgcagcaaataaccgcctgcagtccgcttcttcatggtcagcgggtttgcg

SEQ ID NO: 81326 - DNA, 1550 bp, Heterodera glycines
  Genomic contig location: Contig_ID=SeqID_287; Location=103..1652; Strand=-
  SCN-specific regions: Sequence locations=1-134,156-306,330-754,776 -872,904-1134,1156-1176,1199-1301,1324-1357,1390-1550
  Gene Ontology: Mol. function=pre-mRNA splicing factor activity; Cellular component=nuclear matrix; Biological process=chromatin -mediated maintenance of transcription
atggcgaataaatttttacttgttcctcaagaaatttatcgtggtctcacctccatgtcggacacgggagacattaaccttgatgctgttcgatacgatttggaccgtgccagggccgaacgaacccacccgtctacaaaaaatgtccactacaaccaacagcttagacgctatttgaaaatgaggagggagcttaccgacagaccgaccaaagttgagctcaccaaagggataagtgtgctgatgagaagaggtggtgaagatgaaaatggtgaagttgtggatgctccacccagacctcccgctccaccaccaccaccaccaccacctccgcctgggagacgcccttggcgtggaccaagtcctccccctccacctccgccacccgggagacgtcctcggcccccaccaattcctccaattcccgctccttctccaccagggagtcctccacctcatcctaaacgtcctcccagaccgagtagagcagcgccttatcggagaggtggtcgtctggagcaatggcagaaaaggcgatacgatatacaacgacggcggccggttgtacgtgatcttcttgctgaagcagctgccgctcctttaccggaaagtgataatgatgatgattatatgttggagagtgggttcgctctgccagcgccatcacaatactatggcgatttacctgtgctgccagacaacgcggacgaaattgaggagatggacaccgcacagcataggattgccaccagaagaaaattaaaaaaggatgaggcaggtgaaaacaatttaagacacaaaaaacataggatctttcgcccttcgcctccacgacccacaccaatggcgcgtgctaaagcaaaaattgaaccaagacctcctccacctccacctccacagcgtccttctgtcaagatagaacaaaagccaaaactggaacttaaaccgtcgacaccaaaacaagccgatcatcccacaccagcacctaaatcgaaaagtggaccaaaatttgagcagctagattctcgcccatccacatcaaggcaagccggatacttccccccgccgacacccaaaattgaacccaaatatgagccgcaatcgacaaagagacccgtgccatatcagatcccgaaaaaagagccaaaaattaatgaaacgccaccgcaacagcaagcccctcctgctgctgtcgtcgaagaaatgccctatgttcctccgcctaggagggggaccaaacgccggcaccccgtgaatggtgagaatgatgaggtgcgcatacgaaaacgagttaggcaaccgaggagggtaagagtacagtactcgcccgagccgggtccatcaacatctgcgcagagtgatgaacaacagcaacaacaacaacgtgaactgtttgccattccgtcaaatcagctgaccatgactcagcggattgaacggatgtacatcaaatgcaaccgttatgcggatcgtatgggtgtccggggcaatacaattaacacagcaaatggcaagccgttggcgcatagcaatttgcgaatggccatcag

SEQ ID NO: 81327 - DNA, 504 bp, Heterodera glycines
  Genomic contig location: Contig_ID=SeqID_287; Location=2063..2566; Strand=-
  SCN-specific regions: Sequence locations=1-56,78-504
atgaactcagcggtgccggcgcttcaaaaggcgggagtagatgtgtatgcgggagtcccatctgaagaattgctcaaacgtctcccaaaacccctcttgctcattctcgacgacctgatgctgtccatcgacgagaaatatttgtccgatttgttcaccaaaaagtcacatcaccaccaatttgcggtggtgttcgtcactcaaaatttgtttgaacggaaaataaaagtggcccgcctgtccgctcagtatctggtgctgatgcgggcccctaattccctgttgtccattcgcaacattggtgtccaactttttccgcgtcagctcgacttttttcttgatgcttaccgcaaagcgaccgctcgtccctatggctatttgctgattgatatgcacgctgcatcagacccatcattgcggcttcgaaccaacatatttaaggacgagcaggagggtgaagacgaaggaacggttgtgtttattcccaaaaatggagcgacataa

SEQ ID NO: 81328 - DNA, 690 bp, Heterodera glycines
  Genomic contig location: Contig_ID=SeqID_287; Location=2761..3450; Strand=-
  SCN-specific regions: Sequence locations=1-690
atggcaatcaatatttccgacaaaaaggcgctcgtcaaccaaatccttgggcaggcagacattacggtgacaacaagcggcataaccgtgagcgggcctcgtctgtccaccccgcgatttataccgttcgaggagtgcggccgctgccgcgcatgcaaagctaccgaagtggaggtggacacaatggtgaccaaagaggggatcaccttgtggtgcagccggatcagcaaaccccaattcgtcccttttgacgttgtctatgacctgccgggccattgtttctttcgcgtgaaaaataaggcccgagtgttcaatgtgccctacggtgacctgccctcagacacgtgcatcactactactaccaccttctcaacccaagaaacgcaaaccgatcaggacctgaagcgcaaagcaaaggtagcacttgacttagtggaagccgggctaatggccgatgccatgcaggacggtgctcgttggaagaaggccaaaaccgcaatcaatgtactcggcaacctccttttagcggaatcgtttgacaccaaagtgacaaatagccctgtggaggaagagaatgtacaggaagagcccagacgagaagatgaacaaaacaaggaggaccttggcgacattgacaaaacgcttgacgagttctttgatagtattaaagcttcaaccgcaaacatgtaa

SEQ ID NO: 81329 - DNA, 1260 bp, Heterodera glycines
  Genomic contig location: Contig_ID=SeqID_287; Location=4428..5687; Strand=-
  SCN-specific regions: Sequence locations=1-147,169-495,518-706,741 -959,990-1068,1091-1140,1209-1260
atgcaaatgataaaagaagagaaggatgcatgggtaataatttgtagaaaacatttttgttatttgttgttgggccaaactgtgtgacaaagtttttgaaaggtaaagggaccccgtggggagggggtttccctagccaattgccctattcattttaaaaataataatgttgcagtggaaccgattcctctgtaattcctgcgattttggccttcattgttatagagcaggcaattacaaaaagccaattgtttgtgtgcatccggacatctcgaacttcacggactacctccagcgcgcgccccaaacaactgcaacgacaaccgactgtccccagcccaacaacgagccgctagcaactgtcaatgatggagtgcggaaggcgctgaactgcgctgaggtggcgactaccgtaagctacccgtcaaatgcccttctcctccttttggtcatcgtttgtactgtctttgtcttccttctcttcatgactcaggcatttttaattatataaaatcataatctcaataaaatttttcctttttttaaagctcagccaacatttgatcaagttggcccgttttctctctttgaggcgagagttgaagcgtcgtcaaaaggaacaggcagaacgccgtaagtcttcatatttattttttgcacaatcatataatgaaaaatttgtgtgtgttaaggcaagcaaattcgaagccgacagcggcagaaacaacagcagcagcagttcaaaccgagtccattgtacgtgccggcccgtcgcagtccgttgcgcgagcaggaggaacaatttaatgaggcaatttaatttgtaaaattttttcccaatttttaaaatttcaggcgaacacgggacagaaacaacaccagcagcagttcaagacgcgcccgttgtatgtgtcggctcgcagttcggtgcgcgaggaggaggaccaattttatgaggcaatttaatttatattaaaaaaaaatttttacccaatttttataatttcaggcgaatacgggccttgatcatgtgtatgacactccggcaaacgtgccgagcaatcagaatggtgaagaggaggaggatgagtgggacgatgagagcgaattttagaaattcataaaaataaccgattgatcaatttattttttaaaaatatatccatatatttttttaatatatccatttatatacattttttatatatccatctatatttttcttaaataatcaggataaattgtaggtataaaaataaa

SEQ ID NO: 81330 - DNA, 1729 bp, Heterodera glycines
  Genomic contig location: Contig_ID=SeqID_2733; Location=268..1996; Strand=+
  SCN-specific regions: Sequence locations=1-347,390-448,470-636,659 -1178,1200-1340,1362-1606,1628-1662,1686-1729
atgggaattctcgaaaaaggatccggcacggatcgacatcttttgtcctttgtgagttgggcatcgccattggaagccatcagtaggaaaacgtcaagcatgtcaaataaaggttttaaggaatatgcatttggaaattaatactttaaatttatatttgaaggtaaaatgcaaaaaaatgggccatttggagcaacacaatcaaacagcaaaacatatcaaaaattgtgatcgttttttgtcgtcaaaacaaaagcaaccattgatcagtcaaccgtttgttgttgataaatttgctgctgaattgtgttcaatgctgctttcagcgaatattcctctttttaaagtgaatacatatattcattttttaacaatttaactttatttaaggtaaataatccttcattcaaggcttttttggagaaatattgtggaagatccatcccacaccatgaaaccctcagaagcaattatgtgaaaaattgttttgaaggggtaaaatttgaaattttttgattgaccaatttttttcctttaggttttgtcaaaaatcaaggacgacattggcgaaaatggattcgtttggtgttcggttgatgaaacgacagacagaaatggacgctgtatggctaatttgcttattagacttctgaatgaacgttggaacgcgccgcatctgatttcggtgaagccactgttggacgaaaatggtgacccaaaagttgatcatcaaacggttgctcgttttgtggacgagggtttgggtgtgttagacatattaatgttttgattttatttattttagcggatttgctatctacaggagcaaagaaaaatcggcttctttttatggtgacggacggcgctgaatacatgaagaaggcggctcggaatctgcgtgttttctatcccaacatggtgcattttacttgcctcgctcatggactgcatcgaatcgctgaagagatccgcaatcagtttaaagacgtcgacgaattaatttcttctaccaaaatggtgtttcgcaaagcaccgtcacgtgttgctttctacagaaagaaattacctacagttcctctggttcccaaacccatttatcacacgatggggcacttggcttgatgccgtcaacttttactctcacaatttcgaagacattaatgaagtgaatgaattggtttaattaatttttttttaaagtttcaggtcgttgattcatttgaccctgaggaggcccagtgtattgccaaatctcagagatgcttttcgatgacaacagtgccccttgacattgcctacattgcggccaattttggttctctccccggagcaattactcgtttggagaaggaggggcttacgatacacgaatgtgccaacattctggtgtgaagtccgcgaagctgtcttttcgtcaacggggagaaattggagcgaaaatccgtcggaaattcgatagcgtcatcgcaaaaaaccccgggatttgatacaatttgcgatattggaaaaattctttctggtcaaaaatcaatttcggtatgccccccaatctgatttcactttacaaatacgctcccttgacttcatgtgatgttgaacgatcattttcaatttacaaatctattttgactgacaatcgctcacgtctatcgtccgaaaatcttgaaatgttacttatttgcaatgtgaatctcaataatgatttggcataatattttttgctttttga

SEQ ID NO: 81331 - DNA, 2964 bp, Heterodera glycines
  Genomic contig location: Contig_ID=SeqID_2733; Location=2427..5390; Strand=+
  SCN-specific regions: Sequence locations=1-107,138-152,186-267,317 -365,387-512,535-880,902-982,1023-1484,1525-1550,1584-1692,1714 -1749,1838-1904,1926-2248,2272-2827,2887-2964
atgggctattcaatggtcggtccgccgttcggcgacgacgacgaatttggcccactgtttgagatgaattgcaccggcgaaggtgtgaaatgcatcagcacaaattgcatttttggtatttttaatttcaataaaaacgacttgacaatttattatgattaggaattaaaaattggaaacaaaataaatggaagcccaaaaatattacaaaacatcccagtcgatttaagattatcaaaacttacaaaaatgggctggatttcgctttcacatcattcaccttttggccctttcacttttcatcttttattttgagtgaaaggcaacgatattatatttctatgaatggcattttgtggagaatggcaaaaatattattgaaaaattgaaagtcataaattgcaggcaattttggcataaggcaaaaattaatttgattttcatttaaaaaaaaagctttacccacaaaacactgaaattcatttgtttttggatcatattataatatcaacaccaaagttataaaataaataatgttgctgaaaaaaatttcacctttaaccgttcgccattttcatatttttgggcgatttctcctttcactttttattttcgatttggctcattcctagcctaaaataccaaggccctcggaaaacactgagcggggccctgtcctggccgggctctattaattaataattataatgccatcactggcaaatagacaacaagcacagcggcaccgcgctgcgttaccacagttgcagccgtgacgagatgctatggtgccgagcgcaccaattgcactgcgagaaaatgttcaacggaacggtgtccgaatgtgcgaattgtgccgaaaatctgtgcaatgccgaaaatgcaaatttggcattttcagataaaacggtggtcggcacagcgatcggaggtgggacaatgttagggagggggtggaattgatcgcaaaatgatcggagttatttttgaaaacattttaatttttcagttttatttcttctcggcactttgttttactgccttctgaggaacagaaaaacttggcaaattcacacgttgatccttttgttctgttccaccattttaaaactctgaattttgtccaacaatttgttaattcgaattaaattttgcattgtaaattaagttgatttttggcgcatttcgcacttattccttttattttaaattttttaactttttctttaacactaattgaacccttttgctccactaattacccatttttcaactttcattgctcaccacccagcgaattcattgcttctttctttgggatgataaatgtgtgctgattgattcgctcggatgaatgaatgtccgcctttggttggtcagtttttgagttgatccattgacctgcttctgtcgccgatgggttgcttaaaagggcacaatgccatcaaaagtgcacactttgtaaaatgcgaaaattattcaacataaattttaataatttaaataaaatagaaattaaaaaaagaagaaatgccgcttttttctaaagaaagtataaatatttcatattttttagagaattctacttaatcaaatgcttaacgcgcaaaaaaaatttgcaatttttgtttttctttttgagttttcatgtaatttccttacggcaaataatgtgaacaaagttggcgaaggaaaacaacagcaacaacagaacgcatatgtgtcagtagatttgtctaaaatggcatcaattaaattattaaaaataaaaaaatatataaaataataggttttttattttaaaaaataatgaaagatctaaaaataaattaaataagtttgacatattttaagcactgcgccaattggcgggcgtcaaagggcgtatgggtaaatgaattttcatattttattataatattaatcatggtaaactcattacagctcagttatccaacaacaaactcttagctcatcaagctcagctgccaatgataataaacaaattttcatcggagtgcctacgcctccgccagtgccaccgattccgtacggttacggtagtaaagggtaaattctttttaattgacttaattaaatcagtccaaagcaatattataaaaatttagcatttcgcaaaatcaaactgccaacgatgcaccatcaaatagcaaacaaatttaccttggtgtgccgacggcgccgccggtgccgcgcgtgccggtacagcacgatgaccgtagtaaaaggtttttgtggggtttttaaattgtttatgacataggattttagtatttctcaacaacaaaatgccgcaattgacaatgagcagtcaaatggtggtaacaataaacaaattttcatcggtgtgcctacgcctccgtcagttccgcgtgttccggtaccgtacggttacggtaataaagggtaatttttttaattggcttaatttaatcagtccaaatcaatattagacatttagtatttcgcaaaatcaaactgccaacgatgcaccatcaaatagcaaacaaatttaccttggtgtgcctacgcctccgccggtgccgcgcgtgccgtactcaaaccagcagagagcagtggccagagggtcattaaactctatttttaaattcatggaatgccctttttcgatctagagttgccctgaggccccagcaaagtgtcaattacgcgccgacgcctccgcctattccgccaatccccgcaattccgtattacccttaccatcaggcaaaacggagatccatttccgagaacgacgaacccttttcgatgagcaatggaccgcaagtaatgaatgagaaggaataaaattttaaatctaaatgtttttgtttaattttgttcattaattttaattattttcagcgaattttcccccgcggcggcaacaacaaatacgtctacgttcttcataatcaaaaagatgctttgttgcgttaa

SEQ ID NO: 81332 - DNA, 270 bp, Heterodera glycines
  Genomic contig location: Contig_ID=SeqID_2733; Location=6166..6435; Strand=+
  SCN-specific regions: Sequence locations=1-270
atgccctcctccgattacgcggacaatgaggcggacgatcgaatcaaagcgccgccgagtgaacgctttctgaactattcgctgtttcacaattactctccgtacggaatgcgttcgttggcctacgattatgccaaatacgcggagcggaccaaatggccggtgaagaatccgtgcggcaccatccaattcgaggacgagccgcgcacgccgcgctttcaattttggagtccgttgacggcacgatacgagtgcagttacacacagaac

SEQ ID NO: 81333 - DNA, 1207 bp, Heterodera glycines
  Genomic contig location: Contig_ID=SeqID_16898; Location=4..1210; Strand=-
  SCN-specific regions: Sequence locations=1-385,407-1079,1101 -1116,1151-1207
  Gene Ontology: Mol. function=ATP dependent RNA helicase activity; Cellular component=nucleolus; Biological process=nucleobase, nucleoside, nucleotide and nucleic acid metabolism
aattccattattcgcaagagcaatgggcctttttcgctggtcattgctccgactaaagaattggcctctcaaatttttgctttgctcgaacgactgagtgaatcgttggtgttcatccattcgcttaatttggcacaatatgcagaagcaaatgatgaaatgttggagaatgaagttgtagcaaatttcagcaatttttataatgctatttaattttcgatttttttagtcgttggacgttttggtgtcaacgcctggtcggcttttggctgctgttaaaaaagtgccaaaattgctgataaacgttgcccacgttgtgctggatgaggcagatttgctcttttcatacggttaccgcgatgaaattgggttagtttttactgggattaatttaataattataattctcattatattcagtcgtcttaaaagtgcgttgccgccccactttcaaactgtgatgacatcggcgacactcaacgaagacatgaccgaactgaagcgcacctttgttgtcggtcaaatactgtcattgaaacttaaggtgaaagaattattttatatttttcattttcttaaattgccattcctttatttttcaggaaagtgatctccccggcatagaccaacttcaacagtttcaaatccaatgtctaaatgatgaggaacgtttcaccattttgttggcactgataaagttgaaattgctggttgggaagacggtcattttcgtgtccggtgtgaaccgatgctataagtcagcgcaacttttaacattttgatttaatagtttgtttcctttttgttttccagactccatctgtttttccaagcctttaaaattgtctcttgcgttttaaatgctcaaatgccggccaactcacgctgtcgtgtgatccacgaatttaatgcgggccgttggccatatataatcgcatcggaatgcaacgacatctttgacggggacaacgagcaggagcaaaatggggaacaagaaacagcgaaaaacggagatgaagcaaaagaacagcaaggagacacgaccaaacagcaaaaggcataaattaattttgatgctgatattttaatatctttttaaaaataagattcgcaaacgaaaagaattgaaaaagaagagcaaacggcggcagttggacaaagagtcagacgaaggccgtggaatcggtggatacataaacaaaataaa

SEQ ID NO: 81334 - DNA, 1752 bp, Heterodera glycines
  Genomic contig location: Contig_ID=SeqID_16899; Location=662..2413; Strand=-
  SCN-specific regions: Sequence locations=1-829,851-1350,1372-1752
  Gene Ontology: Mol. function=signal transducer activity; Cellular component=secretory vesicle; Biological process=transport
atgaccaccactaccgctacggcctcgttgtttgggccaccgccaatgaccaccactaccgctatggcctcgttgtttgggccaccgccaatgaccaccactaccgctacggcctcgttgtttgggccaccgccaatgaccaccactaccattacggcctcgttgtttgggccaccgccaatgaccaccactaccactacggcctcgttgtttgggccaccgccaatgaccaccactaccgctatggcctcgttgtttgggccaccgccaatgaccaccactaccgctacggcctcgttgtttgggccaccgccaatgaccaccactaccgctacggcctcgttgtttgggccaccgccaatgaccaccactaccactacggcctcgttgtttgggccaccgccaatgaccaccactaccgctacggcctcgttgtttgggccaccgccaatgaccaccactaccactacggcctcgttgtttgggccaccgccaatgaccaccactaccgctacggcctcgttgtttgggccaccgccaatgaccaccactaccgctacggcctcgttgtttgggccaccgccaatgaccaccactaccgctacggcctcgttgtttggaccaccgccaatgaccaccactaccgctacggcctcgttgtttgtggcgccatcagctaccacaacctctgctcccctttttgggtatacattttgcagttgaattttatctttactattagtctgcctttttactaacatttttctctctcccaatgaatggtcttttagtttgccttcttccactgccacattttctgccgctgctgctccaaggatgaatttcaaagatcttcaacaaactctgctgaaattacgagtggatttcgagcgacaagaaaagcattttatggctgaactggatgatttaaatgcatttgacatcgttctacgccgtgctcaggataaggttgtcatttttaccggtttaattcagagagactttgaaggttttttcattgggtcaaaacattgacgagttggaacaagaacgtgaacgttttgtgtgcgagttggacattttatctcaacagcagactgaattggatgcactgattacgcaaatggagaaaacgatgggattgtctccgttggaccaacagcaattgtcaggacaaccgtcggtggtgatccgtgacatggcaaatgcaactccggcggatttgcaacgccaaaatatgtgggtggtgggtcaggtgtcgaatttgggagagggcaaaactgcattttaatgatttaatgccttgcttatttttgttagtctccaacttcaaatgactgtaaatgcgcaaatgaagcagttggatgatgagttgggtgatctttgtgaacaggttgaagctttatttttaaatgaaggtccatttgtgcttttagattacggaccttcagcgtttgtcaggtgacagtttgagcggtgacgacttgaaagagcacgagcatcatcgttcaatgcttgatcaaattcaccaaattttacgttcgcagttggacactttggtctgggtggacaaacagtcaggtaacatttattttcccttttattttttaaatttcaatcaaagtcgagaccgtctgagattctacggatcccgaccaattttcagggtccttgcttacttatgttactcttttagctattctgatggatcgagtcaaccgtgcgacatccgatgtgctcactttgcgttaa

SEQ ID NO: 81335 - DNA, 1191 bp, Heterodera glycines
  misc_feature (16)..(16): n is a, c, g, or t
  misc_feature (56)..(56): n is a, c, g, or t
  misc_feature (140)..(140): n is a, c, g, or t
  Genomic contig location: Contig_ID=SeqID_16902; Location=94..1284; Strand=+
  SCN-specific regions: Sequence locations=1-418,455-481,504-732,756 -952,981-1191
atgcaaaaaatttcgnattttataatttcaattatactttttttttttgttagatntggtctcaatgaagaaagttacaactcaaaaactcgggctgagccaaaacgactcggaccccttcattttcacccggtaatatntaatattgattgatccgtttgtttttgcataaatacccatcctttcctccttgcttcgttcattctattaaaaaattttttttctttcaccatatgttgcgttgaccctctcgcttctatgacccaattccaatcaatattttatgttcgccttgtccatttcattaattgagtaaatttattatttactgcgtatttttccgtaccaggtgttttcgacagtgattgatttcgacagtgattggtttcgacagtactttttaattaatttctacatgatttattgtatatttgaattaatattaattaatatacactttgcaaatacaaaatttataattgaagtaagtaataaaaataagacttgtatgatttttttgctaaaaatttatcgctttcactttttctatacaaatatctcttgctggaatgagtcaaaaatacaacaaatttcttagataagattctcaaatcgtgtgggaaaatctgctaactaatgccgggtttgagtgccaaaattcaaatctgcaggctcttaagcaagaattcgaaaatctcgaacccctctgcaagtataagagccatgttcttataattttaattgtcaaaatttaacgagacgtatgccctatagaacaatttttttttaaataagctttactgtcgaaatcaatcactgtcgaaaccaacactgtcgagatcaccattgtcgaaaactaacagcacctatttttaatgacgcatagtgacttcagaatcgaaaatttcaatgcagaaatgcttttttgagctcctttcttcaaaacaaaagcaaaaatatttttttatgaatttttaaatgtatgcatatttttagcgcccttttttggcaatattaataattggtgtcccgacgaaaatatgttaaaaatttgtcgggtattttttctaggcttaaaaatgagctgatcacgaatctgatctcagattttgaaaatcattgatttttatctaatatttcccggcgctgctcacctgccacacattgtgccaaacccatgggacattttaa

SEQ ID NO: 81336 - DNA, 663 bp, Heterodera glycines
  Genomic contig location: Contig_ID=SeqID_16903; Location=136..798; Strand=+
  SCN-specific regions: Sequence locations=1-598,620-663
atggcggacaaaaatttgtcagcaattgatggtaatgttttctttacattttcaatggtctataatttttttgttttctcagaagggtgtctgcgcattgacaccaattcgccaaatggagaagtgtccgcaccaccgctaccaacgatgatggcccgctgtttgcccggggccaatgcggaggacacatttgtcgtcgacgtcgaaagtatgaaacttcaaatttattattagaaaaaaagaaaaaaatttttgcagatacatcacactcaattaatctggtgaattattcggacaccagcagcaacgagacaacttttacctggtaagaatgggggggggagggaaaattttcattgaaaattataaaagctgttttgcatttcagcacaactgatcgtccaaaaagaaaagcggctgaaaaagccatgatgcttttgataaaaccgtaatggttttatcactcctttaattcggcttaatgtttttcctttcatttttgaagtcgatgtttccaccagccttatccccaaccgtccgctcttccctattgtgccattgcctaattgttaggggagactattcacccctatccagcccttccatctttctgccactgtgggttgggttttatacaaatattcttcaactgttccatattaa

SEQ ID NO: 81337 - DNA, 154 bp, Heterodera glycines
  Genomic contig location: Contig_ID=SeqID_16906; Location=13..166; Strand=-
  SCN-specific regions: Sequence locations=1-154
atggccaacaaaccggccgacgtcgactacaaaattgtgtgcattggggacaaggcgaagatgctgatgcagcgactctacgccaaagaatttctgttcaccgtcaacgacattggccgctctccgccgaccttccaagacgcatcaattgcag

SEQ ID NO: 81338 - DNA, 164 bp, Heterodera glycines
  Genomic contig location: Contig_ID=SeqID_16908; Location=134..297; Strand=+
  SCN-specific regions: Sequence locations=1-164
ggtggggatttttaggggcgaaaaattccaatttagggacctaaataggggcaaaaaattcgcgaaataggggcgaaaataggggggaaaaagtttcaaatgtaaaggtgaaatttattaaattgccgttttctctatgtaataagttaaaattaaggcaaaca

SEQ ID NO: 81339 - DNA, 314 bp, Heterodera glycines
  Genomic contig location: Contig_ID=SeqID_16909; Location=188..501; Strand=+
  SCN-specific regions: Sequence locations=1-314
actctgaaattcgtggcaaatgcaatgagttgaacgatgcactcaagcagttagacctcacggctacaccacacaaaattcgcacaactcccagcaaacggcgttcattcatcgacatgcacggtggccatggaaaaaaatcggaatttcgaggccttgaaatggcagggaatcggacgaaaaatgttcgaacccggaatttcgaggcctcgaaatggcagggaatcgggcggaaaaatgttcgaatccggaatttgagacctggaaatggcagcaaatcggaattctgagggcaaaaatgattggtaaacgga

SEQ ID NO: 81340 - DNA, 585 bp, Heterodera glycines
  Genomic contig location: Contig_ID=SeqID_16911; Location=1196..1780; Strand=+
  SCN-specific regions: Sequence locations=1-585
atgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagag

SEQ ID NO: 81341 - DNA, 846 bp, Heterodera glycines
  misc_feature (825)..(825): n is a, c, g, or t
  Genomic contig location: Contig_ID=SeqID_16912; Location=482..1327; Strand=+
  SCN-specific regions: Sequence locations=1-187,226-301,323-354,385 -385,551-693,724-846
  Gene Ontology: Biological process=N-linked glycosylation
atggaattggaaaaagaaagggaagaaaaacaatgggccgaaagtgtgaaaaaacaaaatgaaattgcggggccatacaaaatgatacagaaaatgcattttgaagagcttaagaaaagcataggaaagccgaaaaaggacgaggaattgcagggaatgatcacaactttggtgcagggtttgccacaataatttaatttaaataaaatttttaagaaattaaaacttaagatttacgggcaaacaaaaacaattgtagagaaaatcttttgagccttttactgattgaagacagaaacgaatttttaaaagaaataattaacgaaacgaaagaagaaattgatcaaacagaattagagaagaatttggaagaattattaaatggagaaaagaaaaagaagaaaagtaaaaagagtaaaaagaaaaaaatcggaaaagaaaaaagcgaaaaatcaatggaaaacacaaaagacacagacagagaaagagaagaagaaaaacggggcagagagcaagaggaagaaaaaagtgaaaatggaaaaagagaaaactgtgacaaaaacgaaaataaaaacagtactaaaacgacggatggagaaaaggcaaaagaaacggaccaaacgacgaaaatggcaataaatgagcaaatgttggcggaagaactgaacaaaattggcacatttaaaagtggggaaatatttaaaattaaaattttaaataaaaggcaaataattaatttaagaattgtgtgatgagttaacattgaatgagctgttcaaaacatttatttgctcaccttccgtggagagacttcttataattgancaagcagcaatcatttgttaa

SEQ ID NO: 81342 - DNA, 410 bp, Heterodera glycines
  Genomic contig location: Contig_ID=SeqID_16913; Location=318..727; Strand=-
  SCN-specific regions: Sequence locations=1-224,246-280,303-410
atgcagaacagtgacttttgcttttgcttctcctcgctgcatttgttcgctttacattccgtctccgctttcccgaaaaagtccgattgtcttacgctttttcccggcacaacgcaaatcaaatcgatgtccgagtcaaaagtttgggtgcccagcaaatgcgacccggtgagcagaagccgggcgccacgcttggcagacggaaattgaaaaggcgcaaaatttaaattaattaaacttaatttgacagacccatccatccacggcacaacggacagaatttataatggcatttgtttgttggtcaaagtgttcttccgaatgctctgccgatggaggcaaatttcgaacgataaattggcccaagaaaatttttaactgagaaatgaacaaataattaattaaataaa

SEQ ID NO: 81343 - DNA, 783 bp, Heterodera glycines
  Genomic contig location: Contig_ID=SeqID_16913; Location=1370..2152; Strand=+
  SCN-specific regions: Sequence locations=1-19,43-204,230-263,285 -414,436-531,560-762
  Gene Ontology: Mol. function=polynucleotide adenylyltransferase activity; Cellular component=cytoplasm; Biological process=mRNA polyadenylation
atgggtgcgctaataagcataaaaatatttctaatttgtttggggcttcgaagacccaatttttacatgcttaactttgtagagttcgaaagttttgctctaagtgagtctccccgttttttgcatatttttatcaaaatattttttctatcaaaaaattcacttttagttacataattaaaaaataatcattttaaggttattgttcaaatttatacataaaaaatttgttaatggaaggccacaaaactgaaaatcataatgaaaatgataatgaagaagaaaaatccgcaaaagtgctcaaaaatttacgtttaatggtaacgacattaaaattatgggccaaaagtaagggggaaaatgcatttccagtattatttgtactttttaggcaacttaatctattcaaataaatttggctttttgaatggggtcagtctgacgataatggccacgaaaatcattttgctttacccaaatgcgccaattttgtttttgctcgagaaattctatctaatttatgcgaaaaggtaaaataatttattattaattataaaaacaaaaacttagagaaacaaaagtgccaattaaactaaaattggtggcaaatgaatcagacaaaaaacattttgacgagaaaaaaattgccatggaagaagtgatgcgaatttacacgccatcatttccagaacaaaacacagcgaaaaatgtcactcactcgacggaaaaaattatccgtaaaaatatggacgaaggtggccaattaataaataatcattaaaa

SEQ ID NO: 81344 - DNA, 458 bp, Heterodera glycines
  Genomic contig location: Contig_ID=SeqID_16914; Location=1..458; Strand=+
  SCN-specific regions: Sequence locations=1-366,388-458
  Gene Ontology: Mol. function=pyrroline 5-carboxylate reductase activity; Biological process=proline biosynthesis
tgaatttaaatagcaaagaaataaaaacggtaaattaattgaccttcaaagggccttccgcgagaattgtccttaaagttggccgccatgtctctttacggcgctgcgaaaatgtttctcgagacgggggagcacccggccgtcctcaaagaggcggtgcagagcccgggtttgtgcctccgggcaattagcagatgattaatcacaattagtcaccggaaaacgggctgggggggggaggagccttttctgttgggtcgattaatccttcaagtttttctcggtcctttccattggtctctctccacaggtggttcgaccattttcggcatccacgaattggagaagggcggcatgcgcggtttgctgatcaacgcggtggaggcggcctctgagcgctcccggcgaacgggcgaagcggcgctgccgcccggcagaacgtccgtaatttatcgaag

SEQ ID NO: 81345 - DNA, 1211 bp, Heterodera glycines
  Genomic contig location: Contig_ID=SeqID_16915; Location=919..2129; Strand=+
  SCN-specific regions: Sequence locations=1-624,646-838,883-1211
atgctcccgtctcaatgcaaaaagcaaagtgacgcaccccggccaaacacttcgaatttgtcatcctgcaatttgcaactgctcagcgattacctggagtgggtgcacaacattcccgagctcaacatgctcaacgaagatgaccgggtgaaggaggacgagaagaaatgaagaactgtcagatgttccctcacatttaatcccaaattttcttcagaattttttggttttgtgccgtgcgcgtccgtccgcttggcttctgttggcccatcatcggatgcataacaccgaaaacagaccgaacattgaattggacaaattggagcttttgttgcacaatgaaatcgtcggtccgctgcgcgaattggaaattcattcagtcgaattcgaaatattgcgaaatgtctgctttttcagcactggtaatttcaaattttacaacccgatcattggcaattttcggatttggagagagaattttaaaggttccattaccaagtgatcagaatcatttctgagcagttgggatgagagtacggtgatcagttatcactttccaccaattacttccaactgtcgggtcgtttcactttggccccagcaaaaaataatagttttcacatgaaatttaaaaagaataagaagaaatttagatggagagctgttttattttctaagtgaaaaagttatcatattttcggaaaaaaattgttaaaatttaataaaagtgcgaaatatttgctaaaaactggacgaaaacgttagaaagttgttcaaaaacagaattttttttctccaaaaatgcttaaactgagcttcaaaatattcacttaaatgcaaaattaaaaactttaatttaaaattaaaagataaaaaaattttccagtgccccaactgagtgaggccgggcggcggttggtcacttcagtacaaaatgcccaactgagaacactcagtgaattttcgctcagtcggattaatctcattgaaaaagccaacgaaagtccgcttctgctcagttccgtgttcaggctgaataggatgatgaacactttgttgacaattgaggtgaaaaagccggggatttgacaattggcactcactttttcattttcagaaagtcgccaatttcaaagggtaaattacacgagtgattaacatttttgatcataattatagctaattaattacccttgcatttgattgattga

SEQ ID NO: 81346 - DNA, 1798 bp, Heterodera glycines
  Genomic contig location: Contig_ID=SeqID_2735; Location=166..1963; Strand=+
  SCN-specific regions: Sequence locations=1-336,366-1422,1445 -1718,1742-1798
atgcttaaaggttgccccaagtgttacgctaacgacagacaacaaaaattggcaggtggaaggacagccgaagacctgtatgaacgaaccaagaggcggctatttgaactgcagaatcagcatggctttgagctggaagttgtctggggatgcgaaatgaagcagcgtctgcgtgctgatccagaatttcgccgggtgtacaatgactcattcgttccaagaccgcttgatccaagagaggatgcactacgaggtggacgcactgaaccgtttatccttcagtacacttgcagtccagacgaagagataattctcattgacattgtaaaaaaaaagttaggagaaacaaaaaatattttttcattgttaaaggtgagcttatatccatatgtgatgaaggcattctcgtttccggttggtaacccacgcgttctcacgcgagagacacttctatgcgcaccgacatcaccgcttccctggtgttctgtcgacgcgaacacattcaaagggctgttgtttgttcgtgttctgcccccagatcccgctgtacacccgctaaaagttcctttgcttccctatcgaactaccgacgggcgcctaacttttccgctttgtgcacgctgtgctgacaaccgacaacaacgggcatgcaaacacattgatgcgtcaagggcatgggtttccgcgtaattttatgaaattaatccatgtcaatttactttttttgtcccggtgtttagatacacccatgttgaattgaacaaagcactggagcttggctataaagttattgatttatttgaggtaaaaataacgtatcgtttattagactaaactttaaaaaaaaaaggtatggcattatgaagaatgggataaccaactgtttcgtgactatatgaacacctttgtgggtcttaaagttcaagcaagcggttggccatccggttgtgataccgatgaacagcgcagagcctatgtagatgaatttaggcgggttgaaggcattcagttggaccacaacaaaatttcaaacaaccctggacttcggatggttgcggtaaaaaaaatacagaattacaatttttaaacttaaaaaaaaacacacacacagaaaattcttgcaaactccctctggggaaaacttgcgcaacgagtcggtggaacggaagttcgttatacccgaactccagctgagtttcatgcactgctcgagaatcgcaacatcgacattattgactttcatcacgtctctcaccatatggacagagtggtagtgaggaaaaaggctgaatttgcaaaagcaccgtcaaccaactgcttaccaattgcaatttttgtcacttcatatgctcgtctacacctttatgactatatggaacaagtgctgcgtcttggtcataagctcctttattgcggtgagccaaaaaaaaaaaattttttttttcacctttattgacctattattcaagataccgattcaatttattacgtgacacgcagcggtagacagcaggtgcctgaaggtgaagcgctgggacagatgaagagggaacattgctcgaggcgaatatacgaatttgtgtccggtggtccaaagaattatggttttcgccattgtgatcgcataaatggagaggatgagcgtgctgaattgaaagtccgaagttttcgtctctcatattctgcgcagcaactgctcaacttcgagtccatgaagcgcattgttttggaacattacaacattgatggacaaatgttaacacatttttctctcacataataatccagaaaaaataca

SEQ ID NO: 81347 - DNA, 895 bp, Heterodera glycines
  Genomic contig location: Contig_ID=SeqID_2735; Location=2926..3820; Strand=-
  SCN-specific regions: Sequence locations=1-94,160-191,214-233,255 -268,290-805,836-895
atggacgcgattcttgcgaccgattggctccacaatgcgtacccggaacaaaagatgacaacaggaaatgaagaagaagataaagcaacacaggtattttttttttatgaaaaaagtttataaataaaactatattagtaaaaaaataaaataaattttcaggaaggacaaatgagttggcttaaaatcatcgaggaggaggaggagcgggcgagggaattgcaaaatgatcaaatggaactggaacaagtgaaaggtttatttagttatttttagacattaaaaacagttttttaaatttagacaacattgagttgccaaagcacccgcaaccacaaaccaagtgcagttgcaatgaaaagcagaagagtgtgccgttgattgattttctctgcaaacactacaaatgttcaatgaatgagcttcacgttctgctgcagacgctgagcaaacgtagagaaatttcggaaatgttgcgttccaatcttcatttacgcaccaatcatctgcgccctgcctggaaaaacattcgcgtccattgcaacgaactgacaattcatccagctcaaactgcatatgctatgcgcggttatcttggcattacggtttgtctttgatttatttaaatttaaccaatctatgtgtacaatacactttaggtgcgcgtctactactatgtaaagcatggtataaagctggcttacccccaactgccatgtgttcttcaatttggtggtggtgatcatagctctctgttcccgcttgagtgtcttagtgttgttgttgttaaagaaccatgatttagtgatgtgatgatgatgatgatgcatgatgaacgggtgttttttttaattcaaatattgtcgttttttaatgtcagattaaaaaaaataaa

SEQ ID NO: 81348 - DNA, 1135 bp, Heterodera glycines
  Genomic contig location: Contig_ID=SeqID_2735; Location=3936..5070; Strand=+
  SCN-specific regions: Sequence locations=1-195,217-395,418-1135
atggcagacaattttcaaaaatttgatgaaaaacacttacaactcagacacccgtttacgctgacaatctcagggagcacggggagtggaaaatcggaatgggtgctacgaatgctgaggaatgtgaatgcgctagtttcggaacccatctcggagattttctactgttatggggagttgaatccaaatataatacagcttcagaaaagtggacacatcggcggttgtagggttattgtacatgctggaagcccaaccgaagagcaggttaatcggcgcgcaaaagagtgtgatggaaaactgttgatggtgttggatgatctcatggttggattgggccaacaatttcttgacactgtgttcacccggggatcgcacaattggggggtcagcgttgtgttggtcactcaacatttgttcgcaaaagaactgcgggttgcgcgcaacaactcccactatttggtgctgatgcgtaacccggcaggcgcgctccaagtgcggacgctcgcctctcagctatttccaacgaaaagcaactatttcacggaagcataccgggatgcaactgaaaagcaatttggctacctactaatcgacatgcaccccgagagtccggaattgttgcgcctgaaaacgaatatatatggagagcagggtggtcttcccccattggtttatgttgcaaaatgaagcatgtcaaaagaagaaaaagactaacagataaacatactatgaatgttagcccgctgatgttgaaaaatgctgacttcttacaccactttcgctcaaaatatcgctcaaaaagcagacagcgcaaaatgatagagaacgctttggatgagcagttgctctgttttgtggagatgggtttcaatgtgttgaagggtcgtgttccgttagggaagcgacaaattcaacggttggatgcattgaagcaccagttgaggcgcttagcacgcgcacgttgcgcaaaaaccgcgcgcagagtactattattgaatcgtcaagaccaacaacaacaacaacaccaaaccggtgctggctttccggtggtagccagtatgctgacaagcattctcttaccaatgttaatggacaaattactgccaaaaactaattgataaatagataaaaa

SEQ ID NO: 81349 - DNA, 750 bp, Heterodera glycines
  Genomic contig location: Contig_ID=SeqID_2735; Location=5139..5888; Strand=+
  SCN-specific regions: Sequence locations=1-60,91-289,311-452,473 -607,652-750
atgcgtcacgcaatgcgaatgtttctcgtcccggaggacgtctttcagtcggtatttgttcaaccccaagcagcaacagcagcagcagacggtgccgacggtacaccaattgggcttttgcgctcacgcatccaacaaattgagcgtagcagggagctgaacgaagagcagaaggccgcgcaataccatcaggaattcaaacggctcaacaaactggtgcgcgagcaggaggagcagccgatcaatgttcgacttcagcacgaaaaggagagagaaaaaaatgcagcaacgccgccgccgccgccgccgcaaacgatcgatcattcaacgccaaaaagattggagaaaaacattgtaccatcagcgtttgggttgaggaggcaaagacaccactacacacaaaaggcgggggcattatcaaatcgcagacctgcccaaaaacaacaaagaaaagcagcagcagcagcagcagaaacaccaaacagcagtggaaatggagaaacggaaaaagaagagggtgatgtagatgatggggaacagtgggacgacgcacaatcatcatcgtccacggtgtcaacaggtggtgccgcaccaaaaagagtgctcagagcaagagatggggaagcaggaaaaggaggaggaggaggagaaacggctgatcgccttcaaccaaaacacaactaccagatgacccaaaaatgcactgatcacacacattcgaaaaaaggggcacagtctgggagtcagtga

SEQ ID NO: 81350 - DNA, 696 bp, Heterodera glycines
  Genomic contig location: Contig_ID=SeqID_16916; Location=1818..2513; Strand=-
  SCN-specific regions: Sequence locations=1-30,68-102,124-128,151 -233,255-501,671-696
atggcccggctcattgccatgccgttcaaacgtgtattggtgctggtgctgctggtggcgctgttggggctggcgcaggatggattttggcggtgatggctaaacatttcaaatttgaatttggcgcccaattggcggaaatacacaaaagcaaattaatttaatattttgtccaataaacaaaaatttgatttgcgcaccaacgaagtgccggacgacaacgtgccatccgcaactgccgatggtgccaaatgctgtcgttgttgctgctccatttgcggttgcggcattgcgactgtcgcgtcgtggtcgctgcgcgttgatgaccactcgtgcaaatccgcgccgtaatcgcgcggcaccaacaaaaagtcgcggcgtcgccctagcggcggttgttgttgttggtgatgttgtggttgttctgcttgaacagctttgtcttcaacttggacttgctgttgtaggcgctcttttggcacggtcttatgctacataaagaataaaaaattaattaattaaatttatgtttttttattatttttttaaataaaattattatagagaaggtgttatttttaaatattaataaattaattttatttttgtaattattaaaaaaaaaaaaaaattaaaatacagtagtttttagatattaattattatttttggaaaagtgataaaaataataataaa

SEQ ID NO: 81351 - DNA, 1049 bp, Heterodera glycines
  Genomic contig location: Contig_ID=SeqID_16916; Location=3467..4515; Strand=+
  SCN-specific regions: Sequence locations=1-37,63-89,121-348,380 -560,595-627,649-975,997-1049
atgtcacctcgccgagctgccgcttcaggccgaacttccaacggcggcggcggcggcattgtaaaccatgcaaatgcaatggcaccggctccccctccaccaccccctccgccgcccaccggatgggcgccaccgcgtcatcttcaagaacatgtaattaattgcaattagagagtccaatgtccattagtggtgatgcccaagagtctcgagagttccattaactcaaaaatggaaatttgtcggtttctaagtcttgggaaatttgtaaaaaatgtatttcctctaattgagctttaatggcagcagggggggggggtactataatagaggaaatacggtttttacaaaattttaaaaaatatccaataaaaaattatcgcccaaagatattttttcaaattgaacgaattttctaagcttcgaaaaaatcgatcgtttaaaaaaagtcagttctatcgatttcaaatcatagtcaacttgactgatggtatctatctgtatgtgagtgatgatctgatccgtttcatcctccgcaacaaattgttccgaattttgataatttttatgcttttcaaaaattgaatttctccccatttaagcggcatgccgacgacgacggcaaagcccagcaacaacagcagcagaggggggacgaggatggcggtctcgttgttgtgtggcctccatttccagcaactgatcaggaggaccagcatgacattgatcaagcagctgatcagcaacaacaaaatcgcccgcctaaggcagaggcgccgacgccgaaaaatgtgcggcgcgactttccggaagagtacgcgcgccaggaacgtatgcaagcggaagcggagcggcaacgggcggaacggaacgcgcggctgcgcgaaaaacaggtggcacattggctgggcgaaatgtatggactagctgatcaggaaaatggttatatattgattgatcagcgcccaatatttttcgttgatagaagaaagagaattgtctgtctgattaaattcaaagcagacttcaattgtgatcagtctcagtga

SEQ ID NO: 81352 - DNA, 584 bp, Heterodera glycines
  Genomic contig location: Contig_ID=SeqID_16920; Location=443..1026; Strand=+
  SCN-specific regions: Sequence locations=1-584
aaatccgggccgttctgcttgactatgcacagcaaaaggttggagaacctggaaaaaacgtcaaacatcttatttattgcttatttttttcccttagaatttatgccgtggcgatggcaaacaaattgaacttgacgactctctgcaaacagttgtgcaacactttgtgtacgagaagttcgatgtcaacaaattggtacagaaagtagcatctacaatgacccaggcgctgctgatccataccaaagaaggcaaaaaaattgtgcaccgtggcaccaaaatgtcccatattgaactgaaggtgggcgagggccaatgctgggaaaattgtcaaaaattacaatgacttctggttcaagctataaataagcactgtttcacttttggcagattgagagacgggctggcaacaaagtggtcactttggtctccaatttggcttcttttggcattgacgcgagcgcgttggacagcgaaatccgcggcaccggcacatcgattctcgcaacggcacccgcctgtgaaggaccccaactgttggtccaaggcaacgaggtgtattcgagaatagtgttgtgcttcga

SEQ ID NO: 81353 - DNA, 523 bp, Heterodera glycines
  Genomic contig location: Contig_ID=SeqID_16920; Location=1212..1734; Strand=+
  SCN-specific regions: Sequence locations=1-134,156-299,321-523
attatttttaaaaccatttgtcaatgtttggtcttcacttttgggtctcaatacggctttggtcatttaaatccaacttttcatttatatcacttcagatcacctgaaggagtggtcaggtcttattggtgtatttgacttttttgatcagaattgaaagattataactagggataagaatttaagtattacttttaagtaatttttcaacggtaggggtcagtttcggttttatgaaaccaatgaatttaaaatagtctttttttgtgtaatttgtggcgctgatcacaaatatgacctttgtttttcaaaattcagaaccccaaactcgaacgaaaattcggaattcataaattacaatgaagacatatttttaggggttttcgaggtggctgaaaatggatatggcatccgttttgccctagaaaatacccgaactcgaacaaaaaaatcgattttttctcaacaaacactcggatgtaatgacaactcgtaagaaatgtaactcgtataattgcttgag

SEQ ID NO: 81354 - DNA, 1606 bp, Heterodera glycines
  Genomic contig location: Contig_ID=SeqID_16921; Location=84..1689; Strand=-
  SCN-specific regions: Sequence locations=1-431,453-534,557-771,794 -1080,1113-1116,1138-1139,1172-1216,1238-1265,1288-1317,1339-1606
cagagtgattagcgcaaatatatttatgattacatggattactgtctttaggttaacggatgctccgctgccggaaggctgggaaatgcgtatcacagagcaaggtgtgccattctttatcgatcacaacaacaagacgtccacctacaaccacccgcggactggtcggcctgttggtgtgttctttttgttcctacccaaagtgattgttcaatttcagggcctcttggtggtcccggcttacacatggctgccgacaaaacattcaaaaacaaagttactcagttccgttatggagtatgttccacgagtagcccccccccccccctgggggggcgtccctgtgtccatctcaggtacttttccgtctgtggcgtgccgggttaatgtggatgtatgaaagccacaatattttaaatattgtccatttcttaatttattttatcctttccattggcgttcgcgccgttgccttgaaaatgaggccccagaacagaaaagtaacccattctctgaaatgtgggcccggattttacaaaattccaaaaacgaaaagtgtctcccaattttttttatacaaaatccgttgatcgaccaacagatctttggccattcattaggcggttctttggcggcattggccgccgcgtgggtggccaaaagtgggatgacaacagccgagcaaatacgcttcatcagctttggtcagccaaggactggcaacctcgaatttgcgcgtcactttgattcgttggtacaatttataccaggaatataaaattattcaaaaaatgaaattttgctgaggcattttttgaaatttgaaaaaaaaaaaattttccgaaatcctttcgacagttaccccacaaatatcgagtggtacattcggaggacatcattccaaggcttccgtctaaattattgctgaatgatgaacactcgctgttccaccatcgttacgaagtgagtgatagttaccgtatttctatataattctaatccttcatgagatatttcaggaaagatacggtataaaaatcttttaccccctttattaaagcgggcattttgacctctaaaacctgaaaacttttttaaaaacttcaaatttttatattttctcgataataataaaactgtaaccttttaaaaattatttttccttctaaataattttccatatatttagttaaatttaagatttatatgtagctttacattaaagaattgatgaattttttggaaaatttaccctcaacttgggaaaatttatatgcatatttttcactttttatgcgcatattttacaatttttggtgcatatttttggtctccctaatgatgattattaatttaaagccctataaatttgtcttgaaatcatggttaggtttggtacaacaacgacatgaccacgggcagtgcctatgaagtgtgtgaaagtgctgacggtattcagtgcagcggagcgcttgagcccgctttgaagtcaccgcttccatttggacaacaacagacggacccactgggctcgtacatggcccatttgagctattacaatgttagcctgatcacttggcaccggtcgggctgcgcatccaaaggc

SEQ ID NO: 81355 - DNA, 377 bp, Heterodera glycines
  Genomic contig location: Contig_ID=SeqID_16925; Location=2403..2779; Strand=-
  SCN-specific regions: Sequence locations=1-377
atggaaatgagaataaatgtgagatcacttgctcctaagcattgttgccagttcatcatgttaatgatggctctaatgcactaagacaagtaccaaatccaatttcgcaaccaatttttgattattttcggaagttgattaataggcaaaagaaataattatttcgttctattttgttatttaaaggacttatgttattgtgaacaatggagaaccactgtttccaataattgaatggaaccaccatgcagcagtccttgcaaatttgacaagtactaataatgctcaagaaggataccatcttgcacaagactggcatttcagaatttacatcctcctctttcccggtcagaaaattaattaagttagaaaataaa

SEQ ID NO: 81356 - DNA, 263 bp, Heterodera glycines
  Genomic contig location: Contig_ID=SeqID_16926; Location=1903..2165; Strand=-
  SCN-specific regions: Sequence locations=1-54,115-263
atgagtgttttttattttattttgtctcttttttatatccaattcttttgtgagaataaaaatataatataattatttgttcttatcaatattcataaaaaaattgaataattacagctgaattggtattagtgaaaaagacagtgatatgattttctatatatttgtgtttgattgattgtcactatgaattatgcataaagtatttaaggaagtataatagggagttttctattcaacagaatcttcttcaacaaaataaa

SEQ ID NO: 81357 - DNA, 2276 bp, Heterodera glycines
  Genomic contig location: Contig_ID=SeqID_16927; Location=67..2342; Strand=-
  SCN-specific regions: Sequence locations=1-953,976-1903,1925 -2120,2142-2237,2259-2276
atgaagcacatacttgaatttttaaagaaaaaaatcttcccggacgatccaagacaggcgcaaaatttgaaggaaacgtgccacaaatacacgctgctcgacggactgctttatttatgtgaagataatggcaaattgcgacttttcgtcccatccgaatttcgtgaaaatttggtaaagcaacgacatgaaggaaaatgcgcagggcacatgagtgccaaaaaactctttcttcaattggcagaacagtatttctggccaaatatgctgaaagattgcatgaaaattcatcaacactgccgaatttgtgctcatacaaaggaggcgagagcaaatgaacctccactgaaagtcgttagaacgtcagaaccattcgaattgctatgcatcgacattttggacgttggccccagtaagtcagagttcaaatatatctgtgtgatggtcgaccatttttcgaaatatttaatcgcggagcccatccgaaataagtcagccgaagcagttgcgaaagtgttggttgagaaagctattttgatatacggcacaccgaaaaaaatccattctgacaaaggaaaggaatttgtcaattcaacgattgaagaaatcgtcaaaacttttggaattgaacgatctctcacagctgggtatgacccccaggcgaacgggcttgttgagagagtaaaccgaataataatcgctatgcttaaaaagtcgacggcaagctgctggacatgggatgaacgtttgccgtacattgtgttcgcttacaacattacaccgtctaaaacgacgaaattttcgccattttccctgatttttgggaaaatcgctcgatttccgatggatggggaagtgcccttacaagtcaacccagcatacacaattgacagcgatacatacctccaattatttcgtgaaaatgtgttgaatatgctgaacgaggcgagggaaaattctgaggaagaaagaatgagaagtaaaatttggtacgattcccagccgaaagtgacggctaacaaatttgaagcggggcaacgcgtaatggttgcctttcccggactgaatcgccgatctcggcacaagaaattgttgtggtctcatttcgggccttatcttatcctagaaattaacgaatcgtcggcatttttagtcccaattgacaacagaaatgctgagcacataaaagttccgattgagcgtctaattcgaattcctccaggaatcccggacatttcaacacttccaaaggggaaaaacccatttaaaaatgcgttaaaatcattaattgtcagcattttatcgagttttgaagtctgtgaatcagatggacaaatggcccattatgagcaattaggggcaattgctaatttaaagggtggcgaaggaatgattggaaaaacggaaaaggcggcgcaatcaagagaaatttctttttcagagatggaaattgacaacgaaggcgaagcagaggacatgttcggttggaatgccaagtgtgacgtcggtcaaggcgaacacgagttttgtgccattctccgtgttgcagaactggacccagcgcttggaaatgctgaattgggttcaatcacagtgaagactccacttcaggcacttttggcggtgttccttttgaaggccgggactgtcaaatcaatgacagccgcaagaagttttgtcaaatcgataattgaaggagcgccaaaagaggagctcagtctgttcgtgaccaaaaagggagactatgtggcgacaggacaatgcccaactgaagaagaccaaatgaaggcgctggagtgttggttcgaaaagtgctccgtggcaaagcatgctttggaagagagcggattcaaaaaaatcggcatggacgaacccgtcggactcaatcatttggccgattctgagaagaagaaatgggaagaagcgatgggagagacaccgtgggtgctggagaaattgagggccaaaatcattcacaaggccacaaaactgatcgccttgccacgtgtcataatcggagattcgacagcccaccaattggccgaaatcttggatcaaacggcggtgatcgggccaaaaaatggaacattggcggagacagtgcgaagcctgaagcccgtggtgctctccagcaaagtgaaggccgcactgatcattgtcggacgagattcactcttgggcggagaaaccattgaagtgatgatggagcaatacgagatgattgccaatttgtgccgccgattccagcaagtgaagttcttttggacatgcccacc

SEQ ID NO: 81358 - DNA, 1232 bp, Heterodera glycines
  Genomic contig location: Contig_ID=SeqID_16928; Location=161..1392; Strand=-
  SCN-specific regions: Sequence locations=1-62,84-331,353-523,545 -553,576-1232
atgccaactgttcgcgaaatacttgagagtctgcaaaagcgagtaaaaaagcctcgcattgctacaaatgaagacagcgtactgaatgttgagaggacagacgcagaacaacaaattgaaaggaacaattttgacgtcgcttcgagtgatgacgaagaaaattgtgagcccgttcaattcaaacgtggagaaacaatccggggagctctttgtctttggtatcaaggtgttaatagtttttttgatttttatttctttacaggctttcgatttatcaaaaacagaaaagatatcagttctttctttggcactcattccgccagtttacgtttggcatgctttttcaattattgtcaacgcggcaccgcttggagttcaaggatggctggcgtattttggcaaaacctacattggcacaactcaattcgagattgaccgtggagcggaggcatttggacccaatgctgatgtcggacgcttctttctacgtcgcactcaaagcacaactcgtaaatgcatatgctattttcatggtaattaatacaattttaaataatttagcgttcagtgtgtcccaggcgtccataatgacaggcagtggacgaatacaattcggactgcattcaccacaaccatcaactccgacgattacattgtccgaagaaagcagcttgcagcttattctacgctgggaacaagacatcgtctgtcctccacgcttcccgatctcgttttggaatgtgtacaccagggctcaaatggcaattgagcgaacgaacaacggcatggaagccgcgcatggacaatttgcagtaaaaatttgtccgttggaagacacttttttgttaatttagcgtgaacttaatcatcatccgtcactgagtgatttcatagcagcattcatcaaggacatcgacaagcaactggacattggacgagcagaacgtctccagaagagcagaaaacgaccgcaacggtacatcatcaaagaacaaagtgtggtgcggatccttgacgaggccgactttgaatctgaagaaggattgacgaacgccttgtatctgatcggcctcgtaatgcaaggctttgtggagggacttcacgtccgtggaaatgaagatagtaaggaagaaactgatgataccgatggaaattgaatttatgattttaacaatgtttacttttatgatttttaaccttttacttttattttttctttggaatttaataaa

SEQ ID NO: 81359 - DNA, 1350 bp, Heterodera glycines
  Genomic contig location: Contig_ID=SeqID_16929; Location=835..2184; Strand=-
  SCN-specific regions: Sequence locations=1-383,406-1030,1063 -1065,1087-1350
tcttattatctctgcacatccttcacgaacacaactgaaactacgcattgcgacacggaaattatgaatgtcacttatgcgataattgatactgaccggattaccagccaaatattccacgatgtccggctgttttgcatccaagacgagattgacgtcggaataacgtactgttgccgttttgcagtattttgaagctaaacacttttagaaggcggctagttgggtattgtgtaccgcttcaaagctatgagaaggaattcgaagcgtcgcccgaaccaacacggctaattattccgactgaagcatttgataaccaatttgtggacacttttacaaatcattataaggtggggagcaagcattgccgacttgaccaattgttgtctttttcagtttaaaatacggccgatgttcgttgtgccagcggatgcgaacgcgttccagcagatgttcaggtcggcgcctccactgttatgcgcccatcgcattttgaagtcatcaacaatttgcataaggactgacatggagccgagttcgacgcgaatggctctgccgtcgcaagtgtcgaagttggttcaggacaagttcaggctggactgcaaccctcacttggtgccgatacgtctgtcttgcgggtccgagtgtttcctgctgctcgacttggcagagcattgtacgtttttaagtttacggtgccttttttgcagtgcgtctttttgaggccgtgacacttacgacgcgaagaaggagcccgagttcggtcactatcgctttcgaggacaaccaattgaggaggccaaggcgctttcttcgcacacgacggaagaggaagggaaactttcctccgccaacttcggctcctgctcgccgccttccaactccgtgatggaatgctcaacaacgacggagcaacggccgggcaccagcgaacacattgacaacgacgaccactgctcatcgccgcccgttaaaccggtgggtgggtctgtttgacagtggacaataacttatttccatatttcgttagttttaaataagtttaaaattaaataaattattctgaaaaataaatctaaaacaataggatttatttagaaattaaactggccgttgtttttttacaatagaaggaaaccgtactttcaaaacattctgaaagagtttattttcctaagttttcgaatacccaaaactcttgtattgaccgacccccaaaaatgttgttgactgtaaaatggggttggcttacatcccccattaaatcataaaatgccgtttttttattgttttttttagatttttcagttgacatatgcccaagtcgccgccaatagaccgagaagaaag

SEQ ID NO: 81360 - DNA, 130 bp, Heterodera glycines; identical to SEQ ID NO: 75228
  Genomic contig location: Contig_ID=SeqID_2739; Location=471..600; Strand=+
  SCN-specific regions: Sequence locations=1-130

SEQ ID NO: 81361 - DNA, 156 bp, Heterodera glycines
  Genomic contig location: Contig_ID=SeqID_16931; Location=807..962; Strand=-
  SCN-specific regions: Sequence locations=1-156
atgatcaacactcaaccttgtttcgcatatattgataaatatgccgacactttgatcaaatcggaggaatttttgcaaattgatcaaaaattattgtgcaaaattttggagcgtgatcagttgcaaatcagaggagaaatttcaatttggaaagca

SEQ ID NO: 81362 - DNA, 1105 bp, Heterodera glycines
  misc_feature (256)..(256): n is a, c, g, or t
  Genomic contig location: Contig_ID=SeqID_16931; Location=1042..2146; Strand=-
  SCN-specific regions: Sequence locations=1-115,137-353,375-574,654 -792,843-939,961-1017,1067-1077,1099-1105
atgtctttttctcgtgattcaacaaatgatgaatttacagctgatcagggtaattgaaaaagaaataaaaacttaggcgctatatgaaaagcggcagtttttgaattttatcacaaacaaaaggggggagggacccttttgtttttcaaaatttttttatgataaaaaaccatgaaaattatgttatccgggattttagaggtcgctgatcacgaatctgacatctaattcgaggttatggaccccaagaaccccnagggaataaattttcatgactatatattaaaaaattttgcaaaccaaaagggtctccccttttgtttttactttttgataaaatatagcgccaaaacttaaataaaatttatttatttgttttgtttttttccaatggttagaaataatattttaggaacatttgaaaatgtgacaccaccatcagcagttgaagaattgcaatgtttgagaagtatggaaatggaatgggtgcaaaagatgccttcgcaagatgagaacggtagaaaaatttggtagtactgtaagattcttttgaaaatgccaaaattaagacaagaaaaattatacaatttttctatatttttttaatttttgataaaaatttaaatactttaaaaataaaattattatttttacagtctctggcaatgtccacaaaaatgaaatgaccaaatcggattatttggcaaaatttttcaagcgtttgtcgagcgtagaaaatttggcagatgctcatttatcatatgggcaaggaaacagcaagaataaggcgagaatttttatttatatattttttaaaagtaatttattatttaattaaaattgggatttgtgtcctcgaaagtcgggggattcgggaatgataatttcagggtcgggggaaaaagatgaaaaccccagcaacgtcctgattgtggaccagccatttaaattaattcattatatgctcataaggacattttattttgattattttaggattttatcggtacttgaaacttatttttaagaaacaatttttaatttaattttcgttttatttttatttggcatttcagagccaaatttcccatttattttggactga

SEQ ID NO: 81363 - DNA, 1827 bp, Heterodera glycines
  Genomic contig location: Contig_ID=SeqID_16932; Location=14..1840; Strand=+
  SCN-specific regions: Sequence locations=1-439,461-734,756-811,834 -834,856-981,1003-1424,1446-1517,1539-1678,1701-1735,1757-1827
cgcaagacacttctggcaattcttccaagggaagagagaagtgtctcccgggctgtttgtgatcaacacatcgtttggcccgctgataaatggcgagtccaacattggaccgccgaactcaaatcaaaaagttttctcaatgatggccatccacagcactaatctggaacaaatgccaaccatcaatgaggttgagcatttcttcaacctcgaatccttggggatccaggatgatcctgcccaggatgggctgtcatcggtgctaaccaagctccgacattctccagaaattctggagaagtacgatgccaccatccgcgatcaactgcaacagggcatcatcgagaaggcccaaagggctcctggacagcttgagcacttcctccctcaccatggagtgctcaccaaaaagctacgcgtcgtttatgacgcgagtgctcacacacgcggaacaccaagcctcaacagctgcctcttccgaggcccagtgcttctgccagatttggcaggcatgcttcttcggttccgttgcccgacttttccacttctcgcggacattcaagccgcatttctccaaatttcattggagccggaagaccgggaggtcacgaagttcctttggctaaaggacacttcaaagggactcccgacaacttggcaatatttagattttgccgagttgcgttcggggtcgacagctcgccattcattttggcggcgacactccgccatcacttgcaacacttcgactccccactgtccagggagatttcggagtccatttatgtggataatgtactcctcgagtgcgagactgtacaggaggccttggaaaaatacaaattttccaaggacatcctccaacaaggatgcttcaacctgagggaattcatctctaattcaaaagaggtgatgaaacaaatccctcaggaggatcagctggataagccgaaggccaaagtccttggccttttttgggacaccgagaaagacgagatcgtcttcaaatttccaacaactgatccattgaggccagtcacacgaagactggtcctcagccatctcgcatcgctctttgaccccttgggggtccttgggccatgcattttgccagctaaacgcctcttccaagaactttggaaggagggccactcttgggatgatgccctctcagaagaggactcaatccgctggaattccatccaaagacaatggaaagacgaggaaatcagagttcctcgccgagcaatgctcaatgacacacagtcaattgagctccacgcttttgtggacgcatcggtccactttattgaaaggctgaaagaaatccgagaatgtctcggatgtacctttcatttcgtccgtactggggacaacccagcggacctcgcaacacgcggagcaactccttcggagctccgcaaccatcatctctggtggaaaggtccaccttggctcgcacaagcgagtcaccattggcccagcgaactctgttttcaagtaacagagtcggatcaacagccagactcaacggagaatgttggtccgagtggtgcgtttctcgcacacactcactcaaaccagccaaatgagcaggtcttaattgacccctcacgcttcagctcatggaaacgccttatgcgaacaacaatgttcgtattaagattcctcgccttaatgtttaaaaggggcgaggaaacggttgcttcactcgcgaagcacagaaaggaaattcgccagatttccaagtctggggacttcaaggcggaagacttcgcactcgcggagcgagttctcatccgcctagaccagatggatgacgcttaa

SEQ ID NO: 81364 - DNA, 531 bp, Heterodera glycines
  Genomic contig location: Contig_ID=SeqID_16932; Location=467..997; Strand=-
  SCN-specific regions: Sequence locations=1-129,151-151,174-229,251-531
ggtgtcccaaaaaaggccaaggactttggccttcggcttatccagctgatcctcctgagggatttgtttcatcacctcttttgaattagagatgaattccctcaggttgaagcatccttgttggaggatgtccttggaaaatttgtatttttccaaggcctcctgtacagtctcgcactcgaggagtacattatccacataaatggactccgaaatctccctggacagtggggagtcgaagtgttgcaagtgatggcggagtgtcgccgccaaaatgaatggcgagctgtcgaccccgaacgcaactcggcaaaatctaaatattgccaagttgtcgggagtccctttgaagtgtcctttagccaaaggaacttcgtgacctcccggtcttccggctccaatgaaatttggagaaatgcggcttgaatgtccgcgagaagtggaaaagtcgggcaacggaaccgaagaagcatgcctgccaaatctggcagaagcactgggcctcggaagaggcagctgttgaggcttggt

SEQ ID NO: 81365 - DNA, 844 bp, Heterodera glycines
  Genomic contig location: Contig_ID=SeqID_16934; Location=1297..2140; Strand=-
  SCN-specific regions: Sequence locations=1-276,314-316,487-692,714 -816,838-844
  Gene Ontology: Mol. function=structural constituent of cytoskeleton
acatttctacttcttctgtcaccacactccaaccaccgaaccgcttcagtgcccaacgcaacgcaatggccacgtacctattcctcgctgctgctgccttcggagcgggaattgtaatgctgcgctttcttcatttttttcaaattgcatttcataacatttttgtccctttcagtactgttggaagacgtaccttggcccgatgctcgaccaaccgaagagcgacgacgaggagaagcccaagccggaaggaggcgaagaagcgacgaccgccggcgaggaggagaagaaggctggcagcaagggcgacaagcacaagaagaaggacaagaagggcgaaggcgcagcagcagcaccagcggcggacaaaaaggaggagaagcgcaaggacaaacacaaatccaaggagtcggggaagagcgacgacagcaaagcgggcaagaaggacaagcacgggaagaaggacaagaagggcaagaagaaggacaccaccgatgcatccaccgtggacgaagccctgggagaacagagcgcagcggagacgagccaagcagagcaatagccaggccgtgatgcgtgcaaatgactgtgttcgacgacgacgtctcgcgacacccacacatatcccttcgatcattcccgtcccttccgattgctgtgttttgtctgttccaatgcttcctaaatgttccccttgtgaacagtgatccttccttatgtgatctgaacatatatatgttgtatgcccattaatatattgtgcttcgcttattcgatatttgtgaaatctcattcatattcatcgtcgttgtattcatatatacacatttgatatattaataaa

SEQ ID NO: 81366 - DNA, 155 bp, Heterodera glycines
  Genomic contig location: Contig_ID=SeqID_16934; Location=393..547; Strand=-
  SCN-specific regions: Sequence locations=1-155
atgattgcacagaattgccgaaaaaattcgagaccaatttccgaatgttgaccgactaattgcaaaacgaaatccgtctttgtcaaagcgccttaccgagtcaaaaaatttggaaatatatctcatatgcaatttcaaccaataaatttgaagaa

SEQ ID NO: 81367 - DNA, 69 bp, Heterodera glycines
  Genomic contig location: Contig_ID=SeqID_16936; Location=705..773; Strand=+
  SCN-specific regions: Sequence locations=1-69
atgagctttacgcaggcaccaattctatggaatcatcgccaactccacacggagacgaaggcgtatatg

SEQ ID NO: 81368 - DNA, 3144 bp, Heterodera glycines
  Genomic contig location: Contig_ID=SeqID_16938; Location=129..3272; Strand=+
  SCN-specific regions: Sequence locations=1-178,229-256,292-395,453 -502,530-588,610-698,720-729,751-842,866-920,955-986,1008-1236,1287 -1324,1358-1688,1727-1789,1812-2437,2460-2912,2935-3144
gtggcattctacggtcgtgatggctataaatacgctgctgaaaagtacggtatcgaaaaagcggagccgccaaccaaaaacttcaacgacatggacgagttcgacaagttcgggttcatgcacggtgagttttgttggcattttaaaattggtttggcattcaaattcgaaaactagctaaattttaaaaaaaaattagtcatttttgtaatgtttttaaaaattttacgggcatggaatcaattttatgccaatgatatttttattttacaaaaaaaaaattaataatttctttttctcagacatggtgttgctattgtttgacggttgtgccgtatgcaatggcaacaaagtgccgaatgtaacgatttcactgctccaacacatgccaccagtaaaaaataattaaataattatttttggcatttttataattttttaaatttaattttcccagggattgttggttgacgagtgtaaagaatttgttaaccgatccgggtataaataaaataaatattaaatatttgtgttgaatttattgtttgtttttcaagggaagcattggctctacagatggaaatggttgaaaaacaacaaaaatccaaaggcacctttgcatacggtgtttcgctgaaggaacggtacgataactaaaaatgcgtactgtacagtgtactgtatgcaatgtaaaaagtcaaaattaatttaattatttacaatttggcaaaaaataattcctattttttagcctctgtgttgagaagaaacccggcaccgagaaagcagaatattacatgcaaaagctcaagtgggaaataattatcaagatttaattacgcgaaatttttaagggaaaataaattttttgactgaaaattttcgaaatttccgtgttcgttggtacccctctcttagacctctcccacccaaattttctcactaaatttttccaaaattcgcaaaaaatttgtcgaaattatgtgttaatcagctgattttctttctgtattagatacaaataccgagtggtgctggaagtgaagcacacctgcggcgccgacggagagcaaaaaacggtgcttttatttttgttaattgagacttatttttgtacaattaataaatataaatgtgagggtaaatccgatttcatgttttttcttcagcattacatttggttgccggaaatcgatgtctttgataaggaaacggtggtgggccgcgtgatgcaagtaaaaaatgaatatatttttttaatttttattaatttttattaaaaaattggagaaccgtaggggtctggctgtgccgacatttttttggaaaaatttagccaaaatttttgggaaatttgagtgcgtgagatcttggaggggataacaacaaggagaatcgaaattttcaatattgatgccgaaaaatcggcacttttacgcttttgcactttgctatttttcagatccgccaactccatttggatttcgccgacatggaagatactgttgatttgacattgatactgtccggaagcgactccgacaaaagcggccaattcgttaatgccacattgatcccctacaaacacgaacccgtggtgccaccaccatcggtagggtgccattcaacaaaaacaattaaaaggtttagaccaaataaataagctaacttttagggttatggtatacttaaattttttattgtatataaatttttattaattatagcccatcggcctctaataattttatattgtactgtaacatggacgggacggttttgattgtagaatatattaaaaatattaaaaagacaattactttttatttctaataacaaaaaagtggaaaaaataggaaaaaagctaagtgggcggcgggggttaattgagaaggcacaactacggtaacacttggagtaacaaaatggcaactgcatcttaatttaaatttttcttcatcagccaaatccgccaatcgcaacaaatgtggaccatttgggagccaattgcacacaaattgtcttttccgaattgatgccgcaattttttttgaacgtctccaatgatgcgtttgcaattgcgtgccaaaagttcgcggccccaatctatactggcaaaaatttttcggcagatgattattatgccaacacttgcgcgcaagtgccaacttcgctgaactgcaacaagtcagaaagggcattgaaaaattaggcttatgtattctgtattttctctgatacagcccccggtggctccgtttttttaaattgacaaccctctcggggggggggggggggggcattattagagggggctcataaaacagtaactctgacaaatcaaaatcatttaaaatgggaaatatgccgagcagtgatagcactaaaaacaaaaagcttaatgtataaaattctgctttcgatacactatacatcccgtagctcagttggttagagcaaggcacgattgctggggtcgtgggttcgagtctatagatacttctatgtatcgataatatttttttttatgcacaaatgattagaaaaccacctaaaattcagtgatcacgagctgatcggctgttacaaaacgaaaaaagtgaagcacgtggtcaacaatgaaattgccgaagtttgccaaaaacatcttggaaatgttgggcaacagcaggcgcacggatttcgcatccgtttttgtgcccagcgtaacgcgaaggagcagctgatcagtgtggaatccattctggatttctcattctcggacaaaatgtaattattgacataaaaagtgattgtttttccaggacaaaggtccttttttgaaaaggatttccaaggactgtccttggcgattcgagccatattttttgaggatttttgccatttatttttttgtaacctattttttcgtcttataaaaataaataaattaaactgtatcatcattgtcaattaattatgattctcattaataaattttgcgttttttatagatacaaaagagagcacagttactcatacaaaccgggtggacacatcgcaatgaaggagaagatgccgttttttttcattgagttcggcaatgcgaagcagcacagtatgcttcgtggcacgggagacagtagcgaactgtcagcagaattg

SEQ ID NO: 81369 - DNA, 338 bp, Heterodera glycines
  Genomic contig location: Contig_ID=SeqID_16939; Location=795..1132; Strand=-
  SCN-specific regions: Sequence locations=1-225,248-267,290-338
atggcaatggaagacaaacgaagaagaaaaacgacggtgggaagcgacgaaagaattagaagaaatgtgccgggaagagaggcgccggagggaacagccgacggcggagcaaaaaataaatgtgggaaaaaggacgggagacacactgatcagaggaatgacgatgttagcgatcacttgggcactcttagacaaaatgacgaaggcattggtcagagacggataaaaaagaaaagaccggaggaaatgatcaaagtcatcaaaccgggaataattgtcggataatgttaataacagtctttaagtttttatttaacaacaacgaacgaacaaataaa

SEQ ID NO: 81370 - DNA, 809 bp, Heterodera glycines
  Genomic contig location: Contig_ID=SeqID_16943; Location=155..963; Strand=+
  SCN-specific regions: Sequence locations=1-659,681-809
agatttgcaccttttccatgtcacagcttagtccgaaccatctcttcgagaatctcaaatattttgaaacccgttttgatggagatgggtgaattttcagttatttataaaaaaagacatttctctaaaggaccttcggtgttggattatcatcgacaccagttcaacaaaatgagttcattgggtggcacagtgggataggttttgactcagatggtgacattatcggtaggagtctattgaactctagctagaatttaattctgacatcattattataaaggactagagcaatatggaggaccctctgtattgaagacttggacctattcgagaggggatgttattggtgtaggaattgcaactgatgagcttttctttacaataaacggcgcaatcataggtagacataacactattcgcgattttaatatattttttttggagtaaaaaataaggccacagaagaattggaaactctcgcctctcgccgaactctcgctctagttttttttgggactctcgcctctcgccgaactctcgtctttttggggactctcgcctctcgcctaactctcactctcgtcttttcagaaacaagttacacccttggggtatgtgccctgcggcaaggaaagaattgggtatatgcccaatggggaggagtcattgtgtatatgcccaatgggaggagtcattgggtatatgcccaatgggagggagtcattgggtatatgcccaatgggaggagtcattgggtatatgcccaatgggagggagtcattggggatatgcccaatagggagtaa

SEQ ID NO: 81371 - DNA, 183 bp, Heterodera glycines
  Genomic contig location: Contig_ID=SeqID_16944; Location=902..1084; Strand=+
  SCN-specific regions: Sequence locations=1-14,37-122,145-183
gtcaaattgatacgaaaaaacaaaagcctaaaataacgcatgaaggccgagcttcggccggtgggctgatcgaatgaaagaatgtttcggaggcggcacattctcattggcacctccaatgttcaaataaattgtttccatttcttcattttgttaatttttatatttaacgaaaaatttaat

SEQ ID NO: 81372 - DNA, 1148 bp, Heterodera glycines
  Genomic contig location: Contig_ID=SeqID_2741; Location=2091..3238; Strand=+
  SCN-specific regions: Sequence locations=1-82,104-523,545-591,640 -654,676-769,806-949,971-1148
atggcttctcatctgtctgtcactgttcttacgtcaataattgctctttttgttcttcttctggcactccacggaactgctcccaatcagctcaaaattggagagaatggactttttgaggaatatttgcggtgagtggcggtacaattgaactttgaaaatgccattgaatttctaagcttttccatgttaagacaattggacaaacgaagtccgttgaaaaaatcggacggacttagcgattttgtcggctctctcaacggcgccgcgcgacttcgctacggcaaacgaagcgacggattaacggccgaagaaatcgagcaaattctttcgcttaatcggtaatagtgaagctgcagtccccgttttctaaaaacggtgcttttcttatcaccttcaaaatgattatttggttttaatttccgtatttcccagcattcgtcccgaaaaagagtgaaatttagcaagacaaacatttccaagtcgaagacaaaattggaaaatgaacttaaaatccataagggacatttggaataatttaatatactttcacaaaaattttaaaggtaaaatattcctgaaatatgggggatttataaaatatttaaaaatgaaaaaatattttttaattcatttattcgttcgttaatttactataaaaatttaaatttacatgcttttactatttgccatagaaagtggcacttttcgatgctttccatggaatcgtgtccaattattctgatcacattattgtttttggagtcataagctcaaaataaagatttttcttgtgaaataattaaacaaataaagctaatcggttgaattttacagatggaaaatgccaaaaagagttgccaattatgcagaagcattgcccatcggtttgctcgaccaactgaacggagcggaaaggttgcggtaatgagcggcgaaagtcacaccaaaaaatgccaatgaaaatttagatttgggcgaaaatgatttgttttgatgtgtcggctcttcaacgtcgaccacttcagccaaataattaataacccatgcagtgacaaaaataatattgacgaacatttaaatgattatcacgagaaatttatggcatggcactaaagtccgttaagaaaagatgacaaacttaggta

SEQ ID NO: 81373 - DNA, 1203 bp, Heterodera glycines
  Genomic contig location: Contig_ID=SeqID_2744; Location=541..1743; Strand=+
  SCN-specific regions: Sequence locations=1-194,224-1203
atgatggattttgaggacgatgaccaatcgctttcttcaaaatattctacgaaaatcggaacttcaaatggaatcagaaataggtcgtttttggacaagtcgaatttactgtccaagtccgcgtaagttgaattcattttccatacaatcccatagaactcggatttctgttttccatcagctacttgattctttcaataaattttaaaaatttgggtaaaaagccatgtttaggtgtagaaccatttagatatggaaaaagatattgctagtaaaaattgaagttcgaatttttagtttatgctttttgatttaattatttgtcagacagccaaacggtttttaacccaataccccgccaggcgcgtacgggttttacggactctgtaactctgttttttgggctgacaaggatttcacgggctggtttttattcccttagccgaaccccgtgttgtttccaaccccatagcctatgtatgtggaaaattccgatagtcatgtcgaatttacaccattctaaacatgcctttaccgccaacaaatgttaaaatttaaaaaaaaagtacgtgatgaaaaatgcaaaatccaagcgtgagttcgcattaaccttagaaaaagttataaagtaaaaaaatattttctcttttttaccgtcggattgattttatttcagtttcaaaaagtcttccgcgccttcccttcgttctttttccgtttgttcttctaccgttccttcgcattcttttggctggcgtgaaaaaagagaggaaactccgttaaaagaagtaaatcagctcatcgaccaactgatgttgtacagcaccgacgaagaaacggcagagaatgaattggacgacgaagcgattggaaggcaaagagaaatggccattggaacggcagcgaaaaacgaaggcaaaacgatgctgagcactcgagcgatttcgccaggaaggcagtgccgacacggcaaacagcagggaccattcgcatcgctcactttcaacccggccgtgcgtaaagtatgtcaccaaaacaatactttttagacttaaattcccttctcagattgccgctggccatgccttcccttttgaaggcggtttatttggctcaaaggctgtgtcactctcaagggcgggttcttcgtgctcctcactttcgatttccaacaacagttcttcaccatttcgtcatctttga

SEQ ID NO: 81374 - DNA, 1443 bp, Heterodera glycines
  Genomic contig location: Contig_ID=SeqID_16945; Location=683..2125; Strand=+
  SCN-specific regions: Sequence locations=1-102,124-518,541-1038,1062 -1194,1216-1223,1305-1443
atgggcccggaaacgccgaagtacggcgaactgatgaagaccacctgctcatcggaggaggacaccgggttggaggaccacggcgtggagacggaggacggagcggcggctgtggcggtgcgggtgaagcggcaggacgcgggtgacttgaccagcctgggcgtgtgtctgggcgacatcctgcccgcggtccgcgagcagtaccccaaccaattggtgtacgtcataatccacacaattcgtgcgccctcaattatactgagcagtcaaaacggaggtgagaagggcaattaatcaatcactgattggccttggcaggcgtcgctttgctgaatttcctcgtcgacgtcgacttttacattcagtcgacaaaccaaagagtgggcacaattcgaattgcttcggatgttcgcataaccattcgcacaaacggtgggtttaaatttaaatgcgaacaagtcactcactgatcagatcaattttatcgtggatggcatcgaaatttattccgcaaattccgtcccctttctcttcctcttcaggtgcccatgttaccggccatgccgatgtggtcagcatgcatttggaggacgtgggcaaccaactcggccttccgcaggacgcgttggacaatttggggacccttggcagggatttaatgcttaaggtggtcacttttgtgaacaaatcatatcgcacatttttcatttagtccatcaacgacaaattagagcagggcacttcgctgaatgtgcccccgggcactggcggaattccaatcgtaagcatttgggtgacccaaatcgaaatgcataaatgatggttgtttcttgccagaacattgtcgacccggtcccgcacattctcgaccatgccattctgatcgagtccgactttacgatggacaccagccaattgggcggatcagagccatgcgaatactgatcagatcaaccacacgcacgcactagtagcaccaccggcattcctttgatcgtttagtgatacgaaagtgacgggtaggagacatccgattggttttttggggagaaggggggcttaattcgatgaaagcggataattttacccgaaattaccaaaacagcgaaatcaaagcgcagtgagcgcgtaacccggtcttatcatccttatcagtctgtcctatcatttttatcatctctgtttttgcccatttgtcttgccttagcttttttgtgcaacccttctcttctcttcccttcctctctttctctgttcctccaattttgtttattatttgtttgtttttttcattttttttgtttatatttaataattaatcgcattttataggttaattttcttgttttccgcctttgtaattgcactttaaaagtcaaaagtatcattcccctttttctgccatttattattgtaatgatcttgccaaagtgaatgaattta

SEQ ID NO: 81375 - DNA, 657 bp, Heterodera glycines
  Genomic contig location: Contig_ID=SeqID_16946; Location=652..1308; Strand=+
  SCN-specific regions: Sequence locations=1-547,570-657
atgaaccagcagcaagtaattaaaacaaaactaaataatgataaattggtgcatgatggtgcacagaaaaagaagtatcgcgatgccgacgcacggattcttcgtctcgtccaacgctataacgatatcaataacaatattgtccctcaaaatgatcacaattatgccaatgccaatgtcaatcccgaaaaccttaacaattttctcgctggtattttccgaaattatgagatgcgacctattttgtcccggattttgttattattataaagttatgaattttctacaaaattttatgaatgggaaacaaaaaatgataaattttggttttattagttcttaagtttttctatttgaatctgacgcttgtacaagaactcgtacgaaaatgtcccccgtacgaaaatggcggtacgaaaacgaccctgaccgcaagattagcatgtatttgtcagataaatgtatgtccttattttgaaaacttataatcactttcatatgaacatatgaactattgataatctttataaaaaaaaaactaaggcaaaatgtgtaaaaattcaaacacaatatttttcaaggctaaaaatttctaagaaattaatttaggataaattaggggtcccgctatttaggaaattctttaggattctaaaa

SEQ ID NO: 81376 - DNA, 1041 bp, Heterodera glycines
  Genomic contig location: Contig_ID=SeqID_16947; Location=285..1325; Strand=+
  SCN-specific regions: Sequence locations=1-140,162-532,574-693,715 -1041
atggtatctacacgtaataaaactggaaaatttatgaagctaagcaattctgggactgaagcaaagcgaaagcagaaggaatggcgccaggagcatggtcgcagagtcggttcgacgccaaaaagtgacgaaaattgaccaaaattaattttattttaaaacactgcatttttcagcgctaaagcagaccgaagccgagacaacagcagacggagagggtacatcgacccaagccgccgaaagtggaccatcaacgtcagctatggaccttcgtaagtcaaaaaagtcactattttagaaaaattaaggcccgcattcaagcccaaggccattgtcagcgactccgatcaggcgccatgcgcgtgttcgtgcaaaaactaccgacaaagcaacgaacatggatcttacaactaccgacaatgcaacaaacacggatttgacaactgccgacaaagcaacacacatggatttgacaacgatggataaggcaacagacgtggatttggcttatgaggacgccgcgacacaaaccgagcagttggacaaacagctgaaagagcaggaacaagtgatcagctttcttcaacagcaggtccgcaacagagacgcactgatcgctgatctgcgccgtcaattggaacagcaggcgaaggaccagccaacaagtaaattttgcaaattttagggtgccatttatcattcaaattgtttttagcatccacacggcgcaaaaagaatgctgctacattggagcagacctcgcggcgaaatctggccaagaaaatcgctgatgtgatcgatcgagatcggtcgcggtcagtgagccgatgtttgctgcaatctctgcatcgtgaagtacgtcacaaatttggacactacacaccgatgaagaaggaacaactccgacaacaacaaacaatccatgaagaagatgggctgcttttgctgtcacagctcgggactcaaaaagcatatgagaggatgaaggcactcttgcgtcttatcggcggaaaatttgatgttttcccaccattgaaaaaa

SEQ ID NO: 81377 - DNA, 538 bp, Heterodera glycines
  Genomic contig location: Contig_ID=SeqID_16948; Location=419..956; Strand=+
  SCN-specific regions: Sequence locations=1-538
atgtcgccacgggatctggacgaattggaaatgtcgattgatcaatttcggacatttctcaacgatcagccacggatgcgcactttgctcgccctaaaaccaaaggtccatttgctgttgaaccattttgtgccgttcgccagacaacaccaatttttggcacttttggacgagcagggtcataaataattttgaaatttaatccatgaatttttttaggtgatgaagcactgcattcggtgtggaggcgattggaacagctgtggaaaacaatgcctgacgaagaacaaatgcgtcaattgttggaacaccattttgtgtcaaattggcttctcgacacaggaaaaattgacgaaatgaagcgggccagtttggtcaaagattgattcgagataaaattccatttttaaggaccgtgaagaacaacaagaagaaatcggaggccagaagagcgacggagaaagcaatggagaagaacaacaattcgattttgaataaaaacagttggatgaaaggtttttctttgtttttacagaaa

SEQ ID NO: 81378 - DNA, 666 bp, Heterodera glycines
  Genomic contig location: Contig_ID=SeqID_16949; Location=764..1429; Strand=-
  SCN-specific regions: Sequence locations=1-170,345-642,664-666
atgcccaaacattggccacaatcgaaaatgtgcagcgtgaccacatgctgcgctcgaaggcggccgaggcgcgggagggcggcgttcggattgccatgggtctacacgactcgccctatctgttctgatctgtgcctcgccctatctgttctgatcagtgccctcgccctatctgttctgatcagtgctctcgccctatctgttctgatcagtgctctcgccctatctgttctgatcagtgctctcgtcgtatctgttctgatcagtgctctcgccctatctgttctgatcagtgccctcgccctatctgttctgatctgtgcctcgccctatctgttctgatcagtgccctcgccctatctgttctgatcagtgccctcgccctatctgttctgatcagtgccctcgccctatctgttctgatcagtgccctcgccctatctgttctgatcagtgccctcgccctatctgttctgatcagtgccctcgccctatctgttctgatcagtgccctcgccctatctgttctcgccttagctgttttgaattaattttagtggctgatcgtccctcctcatattgtgcccatttctgtccgttttattctcgaatgtgtgataatcagtaacagtatcacattccaaaataagtatttttaaaaataaa

SEQ ID NO: 81379 - DNA, 212 bp, Heterodera glycines
  Genomic contig location: Contig_ID=SeqID_16949; Location=1525..1736; Strand=-
  SCN-specific regions: Sequence locations=1-212
atgacgaggacggaacgcgcgggactcattctgatggaaaagttggagatgctccaagtgacggtaaaacaatgcaaatgttaaatttaaatatcaaaaatccaagttaaatccaaatatgcaaatccaaattaaatcatcacttttattttcagaattattcaattcgcgcgagggaaaagccgaaaatgtattccatggtaactgattga

SEQ ID NO: 81380 - DNA, 1361 bp, Heterodera glycines
  Genomic contig location: Contig_ID=SeqID_16951; Location=383..1743; Strand=+
  SCN-specific regions: Sequence locations=1-997,1020-1043,1066 -1104,1126-1230,1252-1361
atgccaaaatgcgatggcaaacaacgtgatgacaacgccaataaaatggggcaatgccaatgccaaaaatttgactgtaaaaggagaggcccgtacaatgtccatggtgtttccgtcaaagaaagaactgttaactgtgcttgtccagcttttttccagcgagtaagtcacgtgaatcatggggaagagagttgggtgttggtctccgttcggtggaaagtagcattgtaaagcaaaactgttcattgttaagtcagcaaattccgctttgggagcatgaagaagtgagtccgttgtgttggaagccggacagtgtgaatcagttggagtgtttggtgcgtcttttggtcgcttaccttctcggctctatccccgatttggtgcttcattggaccaattttgccgtcgatttcgccatctccagcaacaatttgcatttggcaggtggactgttcgtgctcttgcttttccttttatttatttatttttcaggccgttctttccaaactgccggtgcccttggcctcagtccgagtccgtttttgcaccaaattctttcgaggcttaccgaaatggtcggcgatgtcagtgaggagtcccaaagttacatcaccgacttgttcatgtgcttacaaaatttggcccaaaatatcacaattgctgcacacctcgccaattcccctcaattacaatcatcctctatttcaactggtcacaaccgatcagtgagttatacccaacaaatttcgacacaaaatttgcaattcaaatcaccgtcacgaagaataacacagaaaaaaggtgacttggttatcgaatcaaatttatgtgtcgttgatttttgaggttcggacatgcgtcattctctgctcgttggtgccgaaattttattccccatcaaatcggatgccaaacctttgactcggagtcaaagtgcggcaacgcttaaattctctgaggatagcgccagcattttactcactgaaaatgacatggaaatcatttcgcaacttttgttcatcgctttggccatgacagaatccaatttggaaaacgaatttcttctcggactcagattcgttgacaaagtgaccaattttttggcaatttccattaaatcgcttttttagttgctgctcatttctgggaaagaacggctaaacattctcgagaaattggaggaactgatcgttcagcatgggtgggacgactttcccggcattatcgcacattgcttgaaaggtgccataaattgaaaattgtcagaatattttcctttccaggcactttgtattcgtccggttctgaatgtgccatttccgtcttttgcaattgtttgccgcacctcagcgaacaaatga

SEQ ID NO: 81381 - DNA, 828 bp, Heterodera glycines
  Genomic contig location: Contig_ID=SeqID_16952; Location=4..831; Strand=-
  SCN-specific regions: Sequence locations=1-828
atgtttggatggatattttccttttttgaccgtcttcaactcggcctcaaatttgcactcctttcgccacgtttcaatgctctggtggacaaatatttcgacggcaaaagtgaattgcgaatttaccaattcggcaagttttattttgatttttttctaaatgtgattggttttttgggttttgggtatttttcgcgaattgtgtttttaaggagtttatatgcaaaaagttttctcggttcgaaaaatggctcataaattagaaaatttttccaaattcgtaattcattataagcacccgtttttttgtggcacggtttttccaaaaaaatttttagggggcagggggtctgcggtgccgataagcgccgccgggaaaattttgcggttttaaatgcggtttgttaacagattttgtccaaaaaatgaccaaattttgagattttgagccatttttagcacattttcatcaaaaatgttgtaccttttctaatcactgctgtacctcttttgatcatcgttgtacctcttctaatcatcgttgtacctcttttaatcactgtcgcacctcttttaatcatcgttgtacctcttctaatcactgctgtacctcttttaatcactgttgcacctcttttaatcatcgttgtacctcttctgatcactgttgtacctcttttaatcacagttgtacctcttctgatcactgttgtacctcttttaatcactgttgtacctcttctgatcactgttgtacctcttttaatcatcgttgtatctcttctaatcactgttgtacctcttctaatcactgctgtacctctttaa

SEQ ID NO: 81382 - DNA, 701 bp, Heterodera glycines
  Genomic contig location: Contig_ID=SeqID_16953; Location=746..1446; Strand=-
  SCN-specific regions: Sequence locations=1-658,680-701
atgccggacggacccaaaagggcggacgaaggtgccattgtcggtttcactgaagggaaatgccaaagacagaacggcacaacaaacggagcaaagggagagacaaaaggcattaatgaaatgggatttgttaaagcaaaagaaaaatggcaaaagataaaaaggatgaacgaaaaacgaagggaatttggcaaaataaaaaagccaaaaagggaattggcacacgtttgggttgaggttgatcaatgatttattaattgcatcggatgatcggtgcccactcactgatcagctccacgtccaccccaaccgttgcgtttcccgccgaattttcggcatgacacgtgtaatggcccaagtgttcttttgagccgtttttcaacagcaaagacccatcggggagcacctttaatcgcaaacaataagagatagaaaagcattcggcaaaagtccaccgccgtgcgtttgtcgtcgccaccgatcagcggacgatcattctgaaaatgggcgaaggactgaaaggatcagcggacagtcggcactttaagccaacgaattttgggccgaggggtgccgagcagaacgatgcagttgatttgcatctctttgccctggatcagctccattcgcgcaggcagttccgctaacacgggcctcactagaaaaggaaaaattgcaaattgaaatgggaaagcaataaa

SEQ ID NO: 81383 - DNA, 1302 bp, Heterodera glycines
  Genomic contig location: Contig_ID=SeqID_16956; Location=72..1373; Strand=-
  SCN-specific regions: Sequence locations=1-570,592-676,698-973,1019 -1302
atgaaatcgctgccaagacctgcccaggacgaattcggcgagtgttcaaacgtcgccaattcggtgccacggcacgcccgctgtgtgtcgcgtctgttgcgcgcaggatttgatggacgaaaaatttatgcgaaagtgaattgggaaataacaaattgagggaatatttactcaaaatttccttgcccagacaaatgttttaggcctttgccaaatcctaccgtttcgaccgttaccgtatgaaaaagagggcacagatcagagagagccgacggaaaacggaacggaggcaaaagcgacttgtttggctgagcaaaaagagcacattcggaggacagaaagtgggggacaagtgggaaaatgccatagcacatagaacaaattattaaggccggtttttccgatccgaaaattctattgaaatttcaattttgatcaaccaaagcacagggaagggcaaccgataaatcgaaaagcctactccatagaaaatgggaggtaggattaacagataaaaagccaaaaatatcagctaaaatggggaaaattgaaaaaaaagtcccaaatttgtgggtttgtttttgaaaatttggcatatggaatttcatttttaaaatttaggtcagcccttttcagcgcagagaagccaaagtctatttcgaaaattaagaataattccctgggccctcctcgtcccttgggcctcgaattggccaatgcctacgcggcacaccgccgcgaacgtcggcacacatcgatagtgaagaagaactattacgaggttagcgttaattaggacccaattaaagactttcaacagtttttctgaaatgtttcagcttcacagtccttcccaggcgcggctcagtccgctgggaagcgtggccaaactgatgatggccgaagtgttgcgggtgaagggcaagcagcggaaggacgtgaagccgtgggaaattcaaaatttaaaaggattttaattaaaaaatgaattttaattaattaaattaattaattaatttggcccaatttttggcatccgacagatggcaacaaaccatcgaaagggtgcagaaaagtgcgctgaaacggaaggaaattcgtcggaagttggagcagccgacggacaacgacgacgaggagggaaacatggcattggaccaactcaaattcaggggcatgaaacgccaaatgggcctcgagcaggaggaggacgttagaaaaaaagggcggggggatttgtgaaatctcaaatttagcccaagccaatcaaatcaagcactttaccgtatctcttgaaataaa

SEQ ID NO: 81384 - DNA, 75 bp, Heterodera glycines; identical to SEQ ID NO: 69209
  Genomic contig location: Contig_ID=SeqID_16957; Location=178..252; Strand=+
  SCN-specific regions: Sequence locations=1-36,58-75

SEQ ID NO: 81385 - DNA, 602 bp, Heterodera glycines
  Genomic contig location: Contig_ID=SeqID_16958; Location=172..773; Strand=+
  SCN-specific regions: Sequence locations=1-602
atgcccaattggaataatgagtcagcatctccattatcagaatcagcagcagattatttggccattcttcgaccaccaccaaatcgcaaatgttttcatgcatttttggtttttacatttttgaaaaaatcgaatttcgtttgtcttctttcggttaaacaaatccgggccatattgatgataattgatattttaaagtgagtgactgagagtgaaatctaattgaatcgggccaagaaaaccgggaaattcaagttttaataaggcaaaatcaagagtcacgacttcggcaacgattaaaatgacaaggaaatgtcggctctaatcgatagtatggtgtcagaatgtgtgccgttcttaccagtcgcggctttcgcatcacttccacggggacgccgcgaaaagcggccaactatttaacatttttgaaaaaaaaaactcgaatttcgtttatttctggggccctaccctactgatgctaatttacgagtccaaactcaaattttcgctatccgaagaactgattcctacatatttgaacaaaaaaatcacaaaatttcaggagggctttctctgtacacattgaaaaacgaaaccattag

SEQ ID NO: 81386 - DNA, 573 bp, Heterodera glycines
  Genomic contig location: Contig_ID=SeqID_2747; Location=2463..3035; Strand=+
  SCN-specific regions: Sequence locations=1-573
atggagaaattccgatcaaaaatcgaatccagaaggagggagcgcttttttggtgctgaccttggcttagctaaagtcgaacagcatgcaagaaagtcattggaggaacaatttctggttttaagttgacgtccgccctgattaaacttattttttaggcattttacacgaccgttttggaatatttggacaagtggtttcgtgttgatcggttctctgagaaattgcgttgggtctcactgatgtcggacaaaatcccacaaaatgacgcgttggatttggccagacaaaaagccccggatctaacaaataatctctttgacgatgttagcgaagctaaccaaattctaaattcaatcccaaaggacgaattacagatgctcaacccagagcaaaagtggatgaagctatttgaagccgatttaccgcacttgtacaagttggtcagcattgtactttccgttccggtatcaaatgcatttgtcgagagttttttccctttgcggctcacaatggactgatgttcgaaattcgttaaaagtcgaaaccgtgaaggcgctggtccagacgaaa

SEQ ID NO: 81387 - DNA, 1573 bp, Heterodera glycines
  Genomic contig location: Contig_ID=SeqID_2748; Location=1850..3422; Strand=-
  SCN-specific regions: Sequence locations=1-302,324-422,452-903,999 -1029,1128-1173,1220-1347,1390-1491,1524-1527,1550-1573
atgccagacaaaacaaaaaattcaattgtatcaccaaattcatcgacagaaagtgaggacaaattttatagtccggaaaattttgaaattgacgaaacgccacaaaaacccattgttgccaacaccaacaaaaaaattggtggtcaaattcgaaaaaattatgaacctcaaatgccaaaagcaattaaaacaaatttgaaatcagagattgttgaagaaaattcgtcggaaaatgaggaacaattttatagcccaaaatttgttgcggatttgaagcacactaataagcgtgaaaatgtgcatggaattaattatttaaaaatgttcaaccaatttacaagcgaatttttggaagaaacaatgaaaaacgattggaaacaatgtaaattaatattaaattttgacttatttgctaatttacgaaaattttttaaatttcaataattttttagtgaaattttcaattcaaatagcggaccgatttcttgtttacctcacagaacaagttggcgaaaaaatattgaaacgaaaatggaaaattcttggccataaaaattggtgtaagcccattgaaaataaacaatttattgacttttttgaacaaaaaaatgtcttcaatgtacgaatttcgaatttacaacaaaaatggaaggacataatgccaaaaattaatgtgaactttttcaacgtaatgattttgtttggcatcaatttggctgaccatcgactggtcaaaatgggcgaaccaaaaaatcgggcagagaaaaaagtgaaaaagaaaatgttaaaaatgaaaacaatgctttcaaatgcatttcattgctttccaccaaatgaattggatttgaatgacaataatgatgttcatatcatacttcaatagttggttttaaaatatagcggaatataattttaattttaaatgagaaaaaatttcactaattgtgttttaaaattaatcaaaatttaataattcaataaatttctaattttaatatgaagataaataagaggttttatcatttatggaaatttaatttaaaattaaagaaaatcacttttattaatttgtaagaatcattgtaaacataattttttcatttaaattttgaaaataaagatttaatgttcacaaaatcttagtcaagtgctctaaaaacaatatacgttatcaaaaataatacatttttatttaaataaaaattaaattaaataatttcgaaataaatttagtgtaatgagtcggctgctttttgtcacaacaaaaaataaactatcgaatgaaattgtcatacacgtttttcaattagttgaaagagatggacaattgcacgccgaatcaaatgatgattgattgattgagtgattatattttgtgtatttttaattgcttaaatttaattttaatgcttattttggtgcaaaatttgattagtgaatatttgtgtagtttaaaaatatggcaccgttagataaatgaagagctattagtttttattaaatgataaaaaattaattaattacagtttgcaattacattattaaaacagaaatagtttcgttagcaaataaa

SEQ ID NO: 81388 - DNA, 624 bp, Heterodera glycines
  Genomic contig location: Contig_ID=SeqID_2748; Location=3744..4367; Strand=-
  SCN-specific regions: Sequence locations=1-130,152-156,223-241,351-624
atggcaagagctaattttggaaaaattcggaatctgcttgaaatttctgggcttttggagaccgactcagaatatgtgtatttagctaaaacattaaatgaagctaatttgaagaggaattttgatggtataattattctacaaattcacaattagtttttattctttttttaaaatatttctttataaagaaaataatcttttttcattttaattttatttcgtgccaagaaaataagtcattttaaaaacaatttcaatttcaattttttaaatacacatttgaaaatttctattattttatacatttaaatatttaattgattaaaattgaattttattaataaattcatttccttcaaagctgtgagccgaataattgggctccatgttggcacggatatgctaaaaattttggaaaaatttaacgctttgccaaaccgggcaagcattagcaagacaaagtttagtggcatgttccaagtggcgtacttggaaattttgaagaacacccaggacaagtgttatcaacaatttgttgaacctgtaaaaggaatagacatgtcgagcaaaggattggtaaatgcaattaatactgtttatttcatttaaatttttaataaa

SEQ ID NO: 81389 - DNA, 1585 bp, Heterodera glycines
  Genomic contig location: Contig_ID=SeqID_16960; Location=294..1878; Strand=+
  SCN-specific regions: Sequence locations=1-192,216-382,406-443,465 -1080,1102-1216,1238-1460,1482-1560,1582-1585
atgccagagggagggtatgagagagcagagaaccagagtaaaatagcggtgaaatattttgagtggcttgcccaaaaaaaaagagtaaaagtgcggcatgcgtgtaacggaggagaagtgcaatttggggggctgaaggtggactgtgtgattggggcagagaaaaaaataattgagtttcaggtaaaagaaaaattatttcctttttaaacaatacttaaggggtgtgcatttcacgggtgtccgagatgtttttttccttggactatagcgccaaacggacggacaatggaagagaataaaagtagaaccgaaattcgcatggaaattttgagggaaaagtgcaaaaatttttcaatcggagaagtttgggtagaataaaacatttagaaatatttattaattgttagttttaggagtgtgatgtcagagaggaattgaagaaaaataaggagatgaaaaagttctttgaaagtgtgccggacaagggaccgatcaatttgagggatgcttatgccggggggagaacgatgcccttttgtttgtacgcaaaggctacggaagaagttgagatatcaatgttcgacatcattagtttgtatccctttgtcaattatggtaaaaatctacagagtttttataattttttccgcgcttaagacactccataccccgttggggtcccaaaaattgtagtgagcagggattttaatgtgaattggacagtgcccgacgatattccttatgatggactgctgaaagtgaaggtcgtccccccgaaaaatctgttacatcccctcctccccgtgcacatcgatgaaatgctcctcttccctaattgttggtcttgtgcaagaagggccaagaatgaatttgtgatgacaaaagatgtgaaaaaatgtaaccatcgtccagcgcagagagcatttttggggacattcacatcaattgagttgcggaaggctttagagctaggatatagaattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtacaaggcaaagtatgacatcggtttggattatgataagattgggtttaatcccggactaagaatgattacaaaattggtgagaaattataaaaaatctttaaaaaatgttcgaatttaagggtttaaacagtttgtggggaaaattttcgatgcgcaacaccctttcaagtacggaaattgtggccagtatggaacgttggatggaattggggagagacaatacaattgagtttgggcgcccagtaaaaataagcgaagagatatcaagagtcgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaa

SEQ ID NO: 81390 - DNA, 345 bp, Heterodera glycines
  Genomic contig location: Contig_ID=SeqID_16960; Location=2006..2350; Strand=+
  SCN-specific regions: Sequence locations=1-184,206-345
atgactcgagagtatgcggacagcgaaattttggagtttgtgtccgcgggcccgaaacagtacgccttaaaactcagaagaaagaaggatggtgtgatttggcacaaaaccaaaatcagagggatgacactggatagacgaaacgaatttaaatatgaattgttcaaagagatggtgttggactacaaagaaggggtcaagaaagtttttcactacccggagaagatcgggccgacaaacgacttccgggttctctcaaaagatgtacaaaaagaatatacgccggtgcagaaaaaaggaattattgatcatcactttaatgttttgccttttggatattattaa

SEQ ID NO: 81391 - DNA, 463 bp, Heterodera glycines
  Genomic contig location: Contig_ID=SeqID_16960; Location=2430..2892; Strand=+
  SCN-specific regions: Sequence locations=1-115,139-270,292-463
atgtcaaagaaaaatttccaagaaacttcaaaagaattccgccgctcgaaaaatacaaaaaattatttcaaaaacagtcctaatttggaaaaatgtttcgaagaaatggagagtcacataaaggaaaataaaaaatttgggataaaagagcacgtgacaactttctattttaagtgccccgaaaatgaagatcccgaaaaaatgtttaaaaacatcctgaaaaaattaatgggggatgcaatgatccgtgaagctgagcctggctggaaaattgagaaaatttcagtggacctttattgcagcgccctgtcggaccccgtgatcctccctgcccgccccttccaacattcgaacccagacattgttttcaatgagttcatcacagacagcaatcatttggggaagtgaatttgttagaccagagaatttcaataattattgccacttattctttccctgttaa

SEQ ID NO: 81392 - DNA, 360 bp, Heterodera glycines
  Genomic contig location: Contig_ID=SeqID_16967; Location=489..848; Strand=+
  SCN-specific regions: Sequence locations=1-104,127-138,164-177,199-336
atgggaacaaattacaataaccccgattacagtacgctaatgggtgctaccgtatgttttttacgttgtttctatgagaatttgataaaaacatcggcacattcaaatagcccgccagtgttccaaaataaacgccgctggggaaaaattaaaaattttaagcgatttttttggcattattttcaattaaaagaacaaaaaatttgcataaaaatttcagagatgtggaattttagagataagcccatttgagagcaatggagaatatgagctaaaattattataaatcccaaaacttaaaagatataaaaaatcaccaaaaataataatcaggactttttattaatttaaaaaataata

SEQ ID NO: 81393 - DNA, 616 bp, Heterodera glycines
  Genomic contig location: Contig_ID=SeqID_16968; Location=621..1236; Strand=-
  SCN-specific regions: Sequence locations=1-72,95-103,126-236,258-616
atgtattcacatgaaccagccggaatccacggtttgcccgaagcaaactgcctcagggtcaaactgacccaaaaagtcatttttatttaaaaaatcactatgcttaatgaaaattgatatatgtgtgtagtaaaaataacgcatctttctcttattttcaatgtggtaaaattcagtggtactttggccgttggatagtgataaggccggtcgttcagtttatctcgggtggtcaattttcttgggaggtcattttgataagagaatttggagaggaattgttttggcattcccgaatgctgatggtcattctcgagttgtaattgctggtgttcatcatttgctgtttttccctctattccttttccaaattcattggttcatggctcttctccgattcgcagagactaaaacaaatcgcggaaaaattcttctatctcgtggtggatatcagggatggcacggaattccgacttccgagttccgacttccgacatttttggggcctcggaattccgacttccgaaatttttgatgaaaagtcggaatttttcggaatttttttgagtttttttttcaaaaaattagcaatttttgtacaatttatgttaataaa

SEQ ID NO: 81394 - DNA, 454 bp, Heterodera glycines
  Genomic contig location: Contig_ID=SeqID_16969; Location=553..1006; Strand=+
  SCN-specific regions: Sequence locations=1-36,63-71,115-289,312-454
atgccggcattgtacgtgatggactccattcttcgtcaggccaaaaaacaatacaaacacaaaggtttttcatatttttcatatattttattttttttatttatttaattttttctcagatgtttttgccccacgatttgccaccaatttgacgaataccattcaaaatgtgctcacctgcgagtcggctgacagagtttgttcaacttattaatgaaaattttaacggaaatttttatttttggtttttaagtgcccgtttatggctcataaatctccgtttttctacttatttttgaaaaatttatttttagctaaaagttgttcgggtggtgaatttgtggcaagcgcaccaagtcttcaccgaagacgcgcttgagcctgtgctgcaacatttccgggcgatgggactcggttggcatttttgttttaattggaattttataggattcaa

SEQ ID NO: 81395 - DNA, 1859 bp, Heterodera glycines
  Genomic contig location: Contig_ID=SeqID_16970; Location=858..2716; Strand=+
  SCN-specific regions: Sequence locations=1-360,384-1055,1077-1859
atgaaaataattttaagaggaaacatcctcaacaaaaagggagaggatccggcaaattggacaacaacaaaattccgggacgtgcttaacgaagcagtccgcaaagaagtccaaatccaagaagtgatgggcgaatatggacatcactacgttcaaccaaaggcagaagttgtctcagcagcacacgtccaatcgcccataacagcaaacaaaaggtcacgaaggcctaatcaaccaagcacacaacggcatgagtcattcatcgcctcaacactggatgagagtctaaggcagcaaggctataagaagcaacaggacatgcaactagcaaacagtcggcatccacaagcgcgagaccaagcacaaagcatcaacaggattccgccctatccttgcacgttctgcaacggcaatcattggcacgacgagtgccaaaaagtgaacacactcaacgaacggatcggcatcgtcagagaaaagaagttgtgcttcaaatgcctgaaggcaaaccatcaagcatcgaactgctctcgaccgtccaagtgctaccattgcaaacgtcggcatcccacagcactctgcagagatcagtgcaggtctgagaatgacatcaatatgccaagcaactcgtacagtgaaaagaagccaaacgaccagaacggcaggcgatcaacagcgatcgaacaacagcagatgtgcaatgccgtccaaagcagggacaccagagcattgctaatgacagcaagggccacgattttcaatccggcacaaccaggcctcagcatgatggcaacagtgttcattgacccgggaagccaccgatcgttcatctcaagcagtgcagccaagcagttggagctgaccaaccttggaacggaagaatgtttcctcacaagctttggcgaaagagagccaaagagatacttaagcgaccgcgtcgcaatcggcattctttgtcctgacaacgacagattcatcttcaacctgaacgcgttgaagttcctgttgaacgaaatgcccgtactacaactgaatgcgctggaccacgatgggcttcagcagaagaagcttaacctgccaaatgcgccacggcaaccagacatcttgcttggaatggatgtttggcacgagctaaagattcaaccaattgaacaattgccaagcggcttcacaatttgtcaatcaaaaattggcaatattatcagcggaaagggtcgaatcgaactcagccaaccatccaacgtctctttcgtgatgatggtcaccaacaaggaatcgacaggcagtaaaccgacacacatgcagaaagccaaacaacatcgagagagtaaaacattgagaaggcatcaaatcaacaagctcttgtccagcgctgcaacgttacgatcaagacgcaagcgagaatcggtgcccaacagcacaacaccaatcgtgattgatctttcttccgacagcgaaagaaactcatccgatgtcgagatcatacaagacccagtcgcgggtcaacaaatcagctcatcgaacaaacattcaactgctccattacccaaggcactgcgaaggccaacagcaacaaagcagagttcatcaattgccaaacgaccagcatcattccgcaagcaaacacgaaaagcagctccttccgcaggaataaaccgaacacacgaactcagcagtcaaatgaaagccctgccgccaacagcaaaagaaaagagcgtaaaccaacaatgcatcatggccctgaccagaagtgccgatccaacgacgagtcaggatgactggaagttagcgaaatttcccaagcatttgctcgacaacaatcaataacacccaaccaaacaccaagcttcgaaaagaca

SEQ ID NO: 81396 - DNA, 1080 bp, Heterodera glycines
  Genomic contig location: Contig_ID=SeqID_16972; Location=130..1209; Strand=+
  SCN-specific regions: Sequence locations=1-438,476-867,910-928,950 -1025,1047-1080
  Gene Ontology: Mol. function=UDP-N-acetylgalactosamine transporter activity; Cellular component=Golgi membrane; Biological process =galactose transport
atgttgaagagtcggagttcggtgtccatttggatccaaaatgtgcagttggccgcgttggcaatgccaatttcgttggcaatggtcgcatttcaagattggcacaaagtttggcacaacggcggactcaaccagggatttgacctggtcgtgtggggagtggtggcaactcaaagtaaaactccaatagtaaattttattcaatattattgcttttttagccatgagtggcctttgcattgcggtaaatttaattaattaactcattcatataagcaatagtcccatttggatgtgtttttttttgttattttaaaggcttttgttgtgcttttaaaaaaacaaataaacgcaaaaaaatctattaaaattttacataattttatgcaaaaattagccattttcatttctatattttctttgctttaggtggtgatcaaatatgcagacaacattttaaagacgtttgccaattccttctccatcattgtgatcagcatcgcctcaatttgggtgtttgccagcatgccgaagccgttgttcattgttggcgctgcgttgatcatcaccgccgcgctgatctatgccaaattcccgtatcgggccaagcccaaggctgatcagcgatcgaacagcaactcagcaacggacagcggcagtgctgactcggacagcagcaacatgagcaattgtggcacggcaccacccaccggccgaggaggcgacagaatgccaaaggaggaggacaaagtgtcacggctgaccaaactgttcaggatgggcagatcgccaaccatggccaaactgacgccgggccaattggacgccaatggagacggaaatggcgtgcagaaattttagagagagaaatattttatcaataattattattaattaatttttatttttgtgcattttatatcaaattttgctcctctcttctctgtgtacatctttttaataagtgtgaagagcatttgacaaaaagttatcatcaatcaatgggtcattttttgttaagtgataacttcgattttgaccatttgtgcgatcgatgtgccatcattttgatggtgacaa

SEQ ID NO: 81397 - DNA, 787 bp, Heterodera glycines
  Genomic contig location: Contig_ID=SeqID_16972; Location=1448..2234; Strand=-
  SCN-specific regions: Sequence locations=1-45,67-158,182-787
atgccaacgttttggtcaaagacagggaatgagaagggaattaattgcacaatatgtatgtatgtgagtttggaaatgtcagtattttacccaatcgatcggttgatcgatcaatggcaaacgccagttgatcaatcaataatttcgctacagcttctggaaaatttcctttattttttaaatcgactcaaaaaccgtgaatattctaagaagtataaaaatttacaaaatatattgctcaaaaagttaattatatttatttatcgaaaagggttggttggtctctagaaaatagagaccggcgcgggattttgcgggatccagtccgcaatcccgcattttttgaaaaatttccgatttcttgcaccgcaaaaaagtggttttgaaaagaaaaaaaaagtcaaatttatgaaccgttaataatttgatttccgatcaactttttaccgtcggatccaatcgaaaaatcttagtcgacccatcagccccttttaatgcatcccgacagcccctaaaatttattttcagcattttttgatttttggaaattttttgaatttaattgaaattttttcgaattttccaaaatcccgcaatcccgtacgggatcccgcaaattttaaatgcgggatttgcgggattgcgggatttgcgggattaatcccgcgggatcccgtcccgcaaaaaattttgagttccagtcccgcagcgggatccgcaaatttgaaatttccgggctctagccgagacctctttctaacagaacggggaaaattaaaaaaataaa

SEQ ID NO: 81398 - DNA, 675 bp, Heterodera glycines
  Genomic contig location: Contig_ID=SeqID_16973; Location=547..1221; Strand=-
  SCN-specific regions: Sequence locations=1-453,475-675
atggaaggtgagcagcagcggaagtggccaaattgttgtgctagcgagcgttttattcgcccatttcaggcaaaagtgcgcgggaattggcggaagagagcggaaatgccgaaatggtggacatttttcgtgcaaccgcgacggacaatgggcgggacgcggcggagggcaccgatgggtaaaaaatttggaatttgatcaataataattgttttttccattttcagacagcaaaacgatcaacagcagatgtgacagcacagagagagcgaatcaatggccaaaagcggcggatggatttcttcggaagacattaattgatcactagttgtattgtatttattatgctcatcattcccatttgatccgatttgtctgtaatatgttccaaatatctctgattgtacagtgagtcggtgtataaatgtcggatgaatttggaaaagtttcggaatttttgtaattgtatgttttgccaaaaagtgtgttatcagatttttaagaatttttttttgtggcgcatttttcagactttttggggaacaagcggggcggaaggccggcggtgtcggtaggcgccgccgggaaaaatttagaaaatttgtataattttaacagattttgcccaaaaattgtataaattttgtgattttgagtcatttttaagaaaataaa

SEQ ID NO: 81399 - DNA, 4252 bp, Heterodera glycines
  Genomic contig location: Contig_ID=SeqID_2749; Location=357..4608; Strand=+
  SCN-specific regions: Sequence locations=1-399,421-499,521-528,550 -625,647-969,991-1336,1359-1415,1438-1775,1797-1897,1922-2324,2346 -3713,3735-4252
caactgcgcaacaatgtttgggcgtttccctcttttgaccatgctcaactcggcctcaaattggcacagatttcgcccagttttgaacatttggtcgacaaacatttcggtggcaaaaaggtgaattgttttttagtgtttttttaaaaggattttgtgccaaaagggtgcctccaatttcaaagaatttttgcctaaaaaccaaattcggttttttggtgtaaaaacactcttttttagtgtttttgcttcttttttttgagattttgtattcttatattcttgacattttcagcaaccgctcaacaatgtttgatggacatttcccctcttttgaacatgctcatctcgacctcaaattggcactgctttcgctccgtttcgatgcgctggtgtgcaaatttttcaaggacaaaaagcggattgttgcgcaagtttcatttttttcaaataagccggtcaaacctttctaagctcgaaaattatagattgaattcgagttcaaaaatagaaaaatggaaacatttttccttgaattgaagaaaatttttatttatgaaattgtatatttcaaacaagaaatcattattgtaattttttaaaaaaatgataccatttccatcccaaaattttccaaacttaaaaaattctctcaggcaatctctgtgtttggccggttaaaatctttaaaattcatcaatttgaccatgaatagaataaaataaccaaaaatttttagatgcccatatatacaaaattatggcaaggtgtacactaagcaaatagttttactaacccaaatctgaggttagttaggaattaagtttcgtacactttggcacgcataagcccctaaatagaatttaagaagtctttactcttgacagaaatttaaatttgtacttaaaattattttacaaagaataccgaagtcaattgtaaagatttctgtccttattcccttttgagattcacattttttatttgtttccaaatcttgtcggtctgctttgcgaccatgatgagatttgtgcacatgccggtctgcattgcgaccatggcaaatatcggtctgcttagcgaccatgatatttagtgcacacgccggtctgctttgcgaccatggcgaggctggtccgctttgcgaccatagccaatagtgtcggtctgctttgcgaccatgacacagtgccggtctgcttagcgaccatggcaacatatcggtctgcttagcgaccatgatatttaatgcacacgccggtctgctcagcgaccatggcgaggctgtccgatttgcgactatagttcgctgacggaacctgctccttctgggagatgtgtgttccagacttggttcagttctttttccccatcgttaccggccaacatcctgggcgaaactggtcccgcactttgccaagaccagtggactggtgagaggtgacgttaggataaacaactgacccgttttccaaataactggaacctgctcctccgggagacgtgtgttcaggccaacaaattggaacctgctcctccgggagatgtgtgttcaggtaaataaattggaacctgctcctccgtgagatgtgtgttcagaccataaattggaacctgctccttcgggagatgtgtgttcaggcttgtatctatctgcactcgctgccctttggcaaaatgggacatgtgagcgtcctgcctgatagatttcggcagcgacatcactgtgacactggacaagagatgatcattattttacgcaatcctacacattatttgcttgataaatgtttatttttgtgtgcaataattggtcaatttttctactataccttttgccacattcgtattatcccattaattttgtttttcagatgccttctaagcaagaaatgctaaagaagagaaagaaagaagagcacctgcggcggacggagaaatctgttagtccaggtcgctcacctatcccaaattgccctcctaagggcaatccaaactgttcgattttggacaacccattgagtgcagatgggaatggggcggcatcgcccaggggctttaacaccccaaatttaagtgctttgcaattgagcacgccggcttcttcaattggaagcaaaagacgggctagacccccgaaagccggagatgaggcaatcacggcttcgcaaaataatgtgtcttcagttgacacacaatttacatcggccactcaaaatattgaaacgccgttcagcaaaaaatggaaggtcgacgatgttaaccgacccagctctgctattgaagaaattgcttcaacgcctattttcacgcaaagaagccgtggagggcggccggccaagaaaagacgcggcccaggcaggagcaaagctaatgattccatgagcgagagctcgtcaatggaccagagctctgaagctaccacatcagttgcccttttgccaactgtgcctgaaaagataaacttcagcacagtgcaaattaatttcgctacatcgcgaaattttacctgtaaaatttggaaatgggcagcaatcggcctttacgaacgtgatggcgaaacaccgattgccccaagatctggcccaagatacattgagacctgttggaatgatatgacccagtttctcaatgacggctttgctgccacatacttggcatacttggcaaccatatcacaacgaaaagtggtcgttgttgacccaatggtatggagcaatggcctggacagagtcatgccttacaaaaatatgacatttgggtacgaccctaatgttccggcagaagttatacttttgccagtacatttccctggacattggactctcattgtccatgatgtgcaatttggcactcattttgccgattctttgcctactacatatggcaggttggatccgcaactgacggataaaattaaaaatatcatttcggatattttgccgtcagcagtgttggcagggattgttgatgtcgaaaatctgacggtccaacacgatggtaatagttgtgggtacttcgtgtgcctgtatgctgagtcatggcttatgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaacatgaagatataatgatcatcgaaccacagacaagtggacaggcagttgatgcaattctcacccaagttcaagtggccggtgaaaaccaagctgacacgcttggtttggtgtcggagtcttgcatcccgcaagagccaattgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgctgggagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaccatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgctagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaagcatataagcaggcgcgtgagcagctcactgagcttctccaacaacaaactccggaagagcttcgcttcttccgcatgactttgttgaatgagcgcagggcccccacaag

SEQ ID NO: 81400 - DNA, 799 bp, Heterodera glycines
  Genomic contig location: Contig_ID=SeqID_16975; Location=1773..2571; Strand=+
  SCN-specific regions: Sequence locations=1-109,132-170,199-652,679 -707,728-768,794-799
atgaattctcttaaacgctttcaactcccggagcaaggaacacgacagcaagaggagttggattcagttgaaccgaaacacatcagcgatgtggtcaacttcaattcggccggcgttttttatgttttgggaaaagtgacaaatatgcagtaccgtgtttacaaagtccaaattaattaattaattaaattattaatttttctgtttttaggcatgcccattccgttccaaggggctcatttgtcgccgaaaattgtccgatgataacatgtgtgaggcttgcggccaaaaagcgattgcccccatccacacggtgtttgtccgtcttctgctgcaggatgttgaacaagcagacattgctcaacgtgtcaccatgttttcgagtgttgccgaagagtttttgggaatgaaagctgctgaattgctcgccaaggagaaggagccggagagccttgcgaaacatttggacgatttgattgctgtgaagataattgcgaaagtcaacattaaggttgtttttttttgcaatttattacatatttgacaaaccacaacataggcgaacagtcagacttacactggatttgattggattgtcaatttgttcaagaagtgccctggaaaaaatgacagtgatgtgccaaaagaaaaagatgatgatgatgatgacgttgatgagattgctaccaaaaaaacaaagaaaaattgagagagagagagagagagataacggattcattttgttgtgagcttcaaaaaaaaaaggatttaatgtgtcctttacttttttaaaaatcca

SEQ ID NO: 81401 - DNA, 3317 bp, Heterodera glycines; identical to SEQ ID NO: 16976
  Genomic contig location: Contig_ID=SeqID_16976; Location=1..3317; Strand=+
  SCN-specific regions: Sequence locations=1-26,53-228,250-285,307 -537,559-598,621-1711,1733-2272,2294-3168,3190-3317
  Gene Ontology: Mol. function=ATP-binding cassette (ABC) transporter activity; Cellular component=integral to plasma membrane; Biological process=transport

SEQ ID NO: 81402 - DNA, 995 bp, Heterodera glycines
  Genomic contig location: Contig_ID=SeqID_16978; Location=1206..2200; Strand=+
  SCN-specific regions: Sequence locations=1-52,74-323,358-400,424 -659,681-807,834-995
  Gene Ontology: Mol. function=peptide alpha-N-acetyltransferase activity; Cellular component=cytoplasm; Biological process =chromosome organization and biogenesis (sensu Eukarya)
atgtaccactttgtgagttttttggcatttttatggatggcatggaccgaatttgcattttttggacttgaaaaccatgtaaaaatacgaaattttcaacttttattcgaattctgaattgtacatccatttggtttgaagccgacctcgaattcatagacccaaaaaaaaccttaaaattttacggatttcccaaaatggcttaattgttgatccatcatcctatattacctatctataaaataccaatttttcaatttatttacacttttttttcagctttcatggcctcatctttcatatatcgcggaagacacaaaggcaaaaataaattaattaaaatttttcattttttttgccaaaaattttcagggcaatattgttggctatgttttggccaaaatggaagaagaaatggaagacgacgagccccatggacacatcacttcgttggctgtcaagcgaacctttcgtcgactcggcttggcccaaaaattgatgaaccaaacggcacggtcgatggtcgaagtgtaagtgtgcaaattcaaaatttgtgaaattattgccacttttttttgaaattttgtcacacattttgccgcatttttgtattttgatctgaattgaattggtacaatgaatgagaaaggttgaccgagaaatttttgaattggctaaaagtcagaggggttttcttcggtcgatgcctggaaatttcttttgggaattttttcgaattttgaaaaaaatgcttggacctggacctggttccatatttgaccagggcatgcattacaagggccaaaattcaagaaaattcaacaattttttcctgcttttccagttacaacgcgcgttatgtgtcgctgcatgtgcggaagagcaaccgcgcggcgttgaacctgtacgcgcacacgttgaaattcgacatttgcgacatggagcccaaatactatgcggacggcgaagacgcatacatgatgaagcgccgattg

SEQ ID NO: 81403 - DNA, 274 bp, Heterodera glycines
  Genomic contig location: Contig_ID=SeqID_16978; Location=35..308; Strand=-
  SCN-specific regions: Sequence locations=1-3,25-89,111-274
atgtccacatcactgaagcacagggattttgtgggtgaaccgatgggcgacaaggaaatcaccgctgtcgccggaatcggcccggtttatggcaaaaagttggaggacaaagtaaaaaaattcacggagttttcgggatcgttaatctcgaattttcaaccaattcaaatccctgaaaaagggtccatccctttttggattttttcgggtcccaaaaaagtaaaagtgcctccaattgttaatttttgtttttttttcagggtttcgacaaggc

SEQ ID NO: 81404 - DNA, 506 bp, Heterodera glycines
  Genomic contig location: Contig_ID=SeqID_16979; Location=441..946; Strand=-
  SCN-specific regions: Sequence locations=1-79,101-224,263-398,420-506
atgactaagcaaagtgttttcaacttgaataaaaatttctggcagaacgaagtggccaagaaatgtgctgcgaagcgacaggaggagtgccaaggagaccaaaagggtgacaaattaatgtgccgtcgaagcagtgaatggcacggcattcgagtgagcagaccgaaaagtgcgcgcaaagagtttctgctggaattatccattacaaacaaaaggtgtaattgaaaaataaaataatatattataaataaaatcaaattatccctccgaagttatccgtttgtgtgcggaaatgacttttctatcgttttcggcaaccggtcaaatttgttgacgcaattggtgaacgaaaaaggtgaattatattttcttaaccggaaaatcggtcagtgatacagtatttaaaaaataaaatttatggcatagcgtattgtagaataattggtcaaattgttggatggtttttgcgttagattggaatctaattctgttttagacgcaataaa

SEQ ID NO: 81405 - DNA, 2642 bp, Heterodera glycines
  Genomic contig location: Contig_ID=SeqID_16983; Location=202..2843; Strand=+
  SCN-specific regions: Sequence locations=1-724,782-1019,1041 -1638,1671-2049,2072-2157,2180-2398,2422-2642
tttgcatgggtttgccctttcagtggggaatggccatttgcacaatcgatggccaacagttttctttgggcgattcgctggcaccgttctgttttcagtccgtctcaaaggtgacagagacttgtaaaaggcaattaacaaaatgacagtttaatcaaaagagaaatgcatgaaatgttgtcaattttcggcactttttccatttggtcgactcaatttgggcttaaattcaaaaataaaatgcgataaaccctcgaagagattccggcaaaatgaattatttcgccagaattagccgttattttctacgaccctcgagcttctatcattttgtaaggcgttcaattacgccatcgttgcctccgatttgggtgattatgtgcactctttcgtcggccacgaaccgtccggtcgattgttcaacgaaatttgtttggacccaaacggtaaaaaacggcatataattaatgaaaaattatgccaattttgtttggcatttattttgcccatttgccccaaggaaaaccgcacaatccaatgataaattcgggtgcaattattgtcacttcactgctgaaaaagggcgtcgcaatggccgaccgatacgattttgtgagagactttatattggtggtgatgatttggaacactttccattttaaaggctttcaaggagtacaaaaagcttgccgggggcggttacatcggttttaacaatgccacgtaaatattttttaattgttgaatatttttaaattaatgattaaattttaatttatttgtaatcaaatgccccaatttggcacaatttggaattgctgatcacttttgattgattgggcttttgccccactttttgattgcattcccttctccagctttttgtctgaaaagaagacggctgatcggaattacgctttgtcctattatatgaaggtcagtcggtgccgaccgatgctttaaattggtcataaattcgcattttggcacgcgaaacaaaacaatcaaaacatttttgcacaggagaacaaatgttttccgcccgactgcgcgacacttcgcgaggaattggacttttatttccaactttgctcattggagacgcactgcgaatcggccgccgttatggcggcgacaatggccaacggcggtgggtaaaaagaggggggggggcagtaaaagaggtgaaaagggggtgccatttgcatgaaaaatttggcaaaaatggagaactattggagcgattcttacagcaggacaaattaccgtaatcctctaattgaatccatttgccatcctaatactgtagccgtctcacatagatgcaggtgtttgtccgttgacggaagaacgctgcattcagagtcgaccttgtcgagacgtactttcactgatgtattcgtgtgggtaagaaaattagaaaaattgaaaattgttgcaaaaaccgacaaaatcaaatggcaaatttgcgcagaatgtacgactattcgggtcaattcgcatttgatgttggtctcccggccaagtcgggcgtgtccggcggaatggtcgttgtggtgcctaatttgatgggcatttgtctgttctcgccacggctcgacagaatgggcaattcgacgaggcacgcgaaaattggggaaattttaaatttatttttttaatattttattgttagaggcgtcttgttctgccagaagctgatcgacactttcaacttccataattacgattcgctgttgcacgccgactccaaaaagatcgatccccggcgacggctgggcaataccgagactgacttggtggaacagagcatttaaagctaattaacgaaaattgatcagggattttggggcttgactctgatcagcacagagcccgagacccgccccgactttctcttttttatccgatcacggattcctgaatttaaactgttttttcagattgtcaatttgctttacgcgtccaaaaacggtgatttggaaaccgtaagaaggtaaaactaatttattccttgtaattagacttcctctggcttttttgaccactttcccattcccattccccaggttgtatttgcagggcgtcaatttgaacatttgcgactacgacgggcgcacgcctttgcatttggccgcgtgtgagggccatgcgctgctgctgaagtttttgttgaacatcgcccgcgtcgactacacaattaaagtgggacggggatgaaatgccgagcagaaatgccaaagtctaatactgaaaaatcaaacatccaacctaattggaccataatccaataaaatgcaaaaacaaaaagttatggtccaaaaaatcgctggcgacgtttcggcctgtttattttgtcctcctccgatactattcgagaacgaattcatagcgaaagaatttaattttaaaaataattttctcctctaattttggtcttgcccagtctcgagttcctttctgggtttcggtctcgaaatggtcttttcctcctctgccgttcttcaaacggttcaatgcttctcattttgaggaccgctggggccgttcggcgttggacgacgcgcggacctttcaccgcaccacttgcgttgcgctgctgttaaagacggcacagcgacggcgccgctcatacgaacagc

SEQ ID NO: 81406 - DNA, 1343 bp, Heterodera glycines
  Genomic contig location: Contig_ID=SeqID_16984; Location=149..1491; Strand=-
  SCN-specific regions: Sequence locations=1-540,562-907,930-1343
atgttcgatgacctgagccgcaacatcgaagcgtttgaaaagtcaatggtaataaaaaatatgttgtagttcgattcgtggttgattaggaatgcatcaaattcaaaactcatacaaaaatttcggattttggcactttttgcattttctgcccgatttacgaactaaccaaagggcaaccttttaattatatttctttattagcgtatggttcaggttgttgcgtttgataagtggcacagcagcagcgaattggccgaacaacaggtcgattctctgagaaatgcggtggctaaactggagacttgtgacgctgatgctgttgcccgattgtctgcctcggtcgcgcgtttcgaaactggaaactttgcaaaattgaaggagtcaggtcagaggatcattcgtccactgagtcttgaacggaagcgacagattgaagtgaaggtaagcggaaattgatagcgttatgtgaggagtttatgtgttttgttgcataaattgacgttcctcagtttagctgcatttaggaaaatcgtaaatctgttttcaacttgtgttttccgttttagcaaagagcattaagtcttaatttaagactatttaaaaaaaagaaatttcaatcatatgaaccgctgtgaatctcaggtggccgcgatcgaacgagagctgtgctttaacaaatcctcaattcaacatcactccaaaaactctttgcaaatcattgacaaagaagttcttggggtgagggaatggatcgaagaaagagacgaagatgcagatctcattggcactttgttgaaacacggtgagaagaagcatattgacgagattgacgcactcatggcgcgttccaaggtcagctgggaagtggacggtcaccgattgatgtcaatgctaataaatttccggataaataagaaatttaatatctttttgggaatcaaaaattctgattgtttggtctgaaaatcttggcactaaatattaccgcctctaatgttgccaatttttttccaaaaatgatttggaaatggaaattgccgtcggtttcccgggtttaacataaaaataccaccagacacattgctatttgattatatttccatttttttcagaagaaccaggctcgagtcgcggagtatcataagaattggcagttgttcaatgaaaaggtcaaagagatagcgcatcaggcgaacgacgaagagaagggcgaagatatcgtgggccgtgttggggcttcggttgagcgactccgtcagttggaggagcgtttcaaaaaatttgtcgaagaattggagaaactgcgcaccacggcggcgaatgacgagacggagcagtaa

SEQ ID NO: 81407 - DNA, 615 bp, Heterodera glycines
  Genomic contig location: Contig_ID=SeqID_16987; Location=372..986; Strand=+
  SCN-specific regions: Sequence locations=1-581,613-615
atggccacgcgaaaacggccacgcgaaaacgtcctggcccgcccaaacgcgtgggtcccagttgacccatagtgagcattaagcataaaacaaaatgccaactatgtacataaattttaaaattttagtggagaataatttgctttgccaaattttttggattccttcaaatttggaaaagggttcggaattgattgaaagtattatccgcgaaaaattgttacatttcaagaaaaaaattatgaaaatttcgctcaatttggaaaattttaatgcagtttttgagtataattggaagcatataaacattaaaaaaaagtgctaaacagttaaatctaaaaaattaatgctcaaaatcctttatttttctcaaaaaaatattttaatcgacgatcaattcaccgaagatactttaattaaaacagtgcaagagcattgattggaaacgcgataacaaacgaatactcaattcacaaccatcttaatgtttgtccacgtgaaagaaaaaagatacaaaggaaaaaatggttccaccataaaaaggctatctaatttaagtctacccggccaaacattctcccaaaatttaaaatatttaaagatttttaatttcta

SEQ ID NO: 81408 - DNA, 695 bp, Heterodera glycines
  Genomic contig location: Contig_ID=SeqID_16989; Location=74..768; Strand=+
  SCN-specific regions: Sequence locations=1-246,268-476,498-532,554-695
  Gene Ontology: Mol. function=endopeptidase activity; Cellular component=nucleus; Biological process=proteolysis and peptidolysis
ggacaagacgaacggctgaccatcgacgggcttctctgcttatgcgatggacaatggttgaacgcggacatcattgactgctatttggacctcatctgccgctgctcgccccgtgctcatttcatcccaacgtacgccattttgagctacgggcgcaagggcacagtgccgtcggaatggtactggcagctggccgagacggacaccattttcgcacctgcccatctctacaacaatcactgggccatggccattttggacatgagggagcggacgttgaggctgatggactccatgaaccacggatatacagacacggaaaaaaaagagtttatggagacaattatgtgagaccgatgactaaccattctcgagtttgtttatattcccttttcaggaatattctccgggacgtcgccatattacaaaaggtggacatcggtgacagaagcgcgtgggacgtgcaggagcggttgtcagtcccccagcagagaaacggaactgactgcggcatttttgcgctgcttttcgcacaatattcgctggagaggcgccaattggaattcggacagtgccatattccgtactttcgacgacggatatgccacgacataatctctgtgattctccatgatcaaaagtctccggttaacagaagcgacgaaactgtcgtacagtgcccatttgctttgtga

SEQ ID NO: 81409 - DNA, 1079 bp, Heterodera glycines
  Genomic contig location: Contig_ID=SeqID_16990; Location=117..1195; Strand=+
  SCN-specific regions: Sequence locations=1-58,80-449,470-502,524-1079
atggcacgactcagccacaatttgtccattgcactgctgcagagcggcagaacacagctgagcaaaaggaacaacaacgacggaccaagccaacggaccatcaaacacacaaagtaacgcaaaacgggggggggggtggttaaggacttgagaaagcgggaaggtcaacggcttgaggggggaacggtaaagccccttcttttaccgtatatgctctaattatagcccagtctctattaatcccgcagtctccaattatcccccagtctacgaggtgttttgaaaaataatccctctatcataatcccccagtctctaattatccccccttttctgaggaggttgaaaaataatcccccatgagctataatttgagcaatacggtattcccccaccccacccgaatttttttaaagaatatttcaagaccaatttcttttagtttaaagttgtttttgtttttgttttttctcaaatgtttatgatgaattacttagttttttcaaatttatccaaacaaaatcgctgtgaaaattttctaaaaatttttttgaaaaattcctaattgtggatagggcttgtctaaatcttctgtgtaatgttaagaaaactatcgtttcagggcgctgatcaaagaagtgcctgaagcgatattttgccgaagttttctcctctccaatggctcgctgaaaattgcttcttcaattctgaacgcaaaaaaggccgtttctgcttcttctgatgatgatccgtccttcatttcggagttcgttttgtgcggcgaggcgccgcgcctttgggcaaaagtgaaacaattggagggccaaaaacgctttttggaggcggcgcaacttttggacggtgtcgaagtggagaatttgcggttgatccatcaattcttggccaatcaaatgacagattccctcagacttctactggaccaagcccgtctctaccgaattgcgggaaacacaaaaaaggcgttgagctgttaccaacgagcgcacactttggactgcacaaatgccgaaggaatggacgcatttgcggcacttctcggcacagttagcgaaagttaa

SEQ ID NO: 81410 - DNA, 93 bp, Heterodera glycines
  Genomic contig location: Contig_ID=SeqID_16990; Location=317..409; Strand=-
  SCN-specific regions: Sequence locations=1-93
ggattatttttcaaaacacctcgtagactgggggataattggagactgcgggattaatagagactgggctataattagagcatatacggtaaa

SEQ ID NO: 81411 - DNA, 985 bp, Heterodera glycines
  Genomic contig location: Contig_ID=SeqID_2750; Location=2971..3955; Strand=+
  SCN-specific regions: Sequence locations=1-321,345-409,431-798,820-985
atggacacaacgacgataaatcggattctagcgggaaacacaaagaccagagaacactacttgggatgcttcccttgcgacaaactcccaaacataatcaacaagtacccttcaacattcgtggcgaataatgacccatcgaataaggaaggaacgcattggatagcaatgttcatcgttgacgataggaccgtctactattttgatagttttggtaggaaaccgaacagatgtatcagccagtttttacggaattatgaaaaagtgatttcgaataagccagctattcagtcagtgtttagtgagaattgcggctactattgcatttattttgttcattttatgtgctcatttggaggaagaaattatgagagtaattttgaaaaaatgagaaaaaagttgataggagaagataatccagatttgtttgtcgtgaattttgttaaaaaactgataaaaagtatttaaggaatttttcattaactcatttataaaaatggaccgtttagacacaataattgcttctcttctgaattgtcccgcacgtaacttgtgcgaccgcttaaatcacccggatgagatacaaaaagtagaaaaatacctcaaaggaaaaactctacagacaacatacaaaaatcaactagatgaatacaaagattttgagtacggtggaattacaaaagaatgtgcccgtaagcagatggcatacaatgggtttaaaaatgtgaccgtcgaccagcacttttatgtacggcaccgcatttgtcttcgctacgctaataacccatgtgtgatcgaaaaacacaagaatggcaatgaacgattctacccacttgaacttgtaagagtgaaggacaaaaacgatatttatttagggcaaaatttccctaaaccaataccttcaatttgtaatgataatgattttattgatgatcaaccttgttatcattggtgaatttcaatatttgaaattacataataatga

SEQ ID NO: 81412 - DNA, 717 bp, Heterodera glycines
  Genomic contig location: Contig_ID=SeqID_2751; Location=931..1647; Strand=-
  SCN-specific regions: Sequence locations=1-717
attttaacatcatcagcatataatttaatattcactcctgatggtatgacatcaggaaggttttgggatgtttttgttcgtgaattatggccaattttttcgacaaacattcgctgtttgggctttttccgtggtgatcatttggacaatttgcttcgtcaaatttcaccgacaattctcactgatctcaacaaattgaattcaatcaattcctatgatttgttgcccgctgcgattggtgatgattttgatgtgccaaatgcaacaatttctgctggccaagcgttgtccaaatggttgcactctccgagaaaagatggccaacccaagcgattgcgttgcgtagattacaacaaacaaacgaacttcgattggatcaacaatttcaaggaggtgtggcccaacatttttgtgatttttgttttccaatcaaattgtttagcattttctccgtgccaatgccatttcttccgtcaattaccaaattcatttttctgttcatgtgccgtcaatgccaatggtgccatttgaattggtaaacgaatggacaaaggaaaagctgacattgaccaaagcaaatgaattggacaacatttggataatgaaacgatgcaaaattattggggagacagcggcggttgattggaaagacggaaattgggacaacaattgcaacaatgtgttcatttggctttcttatggcattaaatccattgg

SEQ ID NO: 81413 - DNA, 681 bp, Heterodera glycines
  Genomic contig location: Contig_ID=SeqID_2752; Location=278..958; Strand=+
  SCN-specific regions: Sequence locations=1-8,30-68,94-207,229-528,550- 681
  Gene Ontology: Cellular component=synaptic vesicle; Biological process=synaptic vesicle fusion
atgatggtgggcaacaatttgaaagacacgcaacttcagcaaatcgtcgataaaaccattcttttccatgacaaggacggggatgggaaaatatccttcgaggagttttgtgacgtgagttggggtgacgtgcaaaacggtcgttgttttctgagctttgcggtgttttaccgctttgattggtctgaccaaccgagccgactttggcctttctcctgacttacttttgcactttggccatttggtcaccgttttgtctctttctctttaccaaatcatccaattttacaggtagtggaggggacagaagttcacaaaaaaatgtaatactttttctgcttaatgctacgcaattcattttcacttttcagggtcctagaaaacatttgaaagaaatgtaatcctttaaattatttgtttccgttttgttttactaatttgttctcccctaatttattaacactccgtttttcctttgttttgttttccctccctttgtgtttgttttaaatgcttcgtcttttttccgtttcccgttaacatttccccattttcaggtcgttggtaatttggacgttcacgagaagatggtggtaaagccgtaaaaaaatgaattctccaaaaatgagctgaaaagtgttgtcagagtcaatttagctgtttttttaaaaatttaagaca

SEQ ID NO: 81414 - DNA, 727 bp, Heterodera glycines
  Genomic contig location: Contig_ID=SeqID_2752; Location=2173..2899; Strand=+
  SCN-specific regions: Sequence locations=1-58,80-301,323-509,542-727
atggccaaattaaagcgaaatataaaaagagaggcggtgaaacagcggtggcaaaagcaagaggagagaaaagcgcagacggccaaggcgatacaagctcgcctggccaagaaaagtgagttaagtgatttttaactcaaacatctttttttaatttcagacgctccacagccaaacctcgacgaacaaatgtcacaacaggacgaagcagggccgtcaaattctgctgcatccgccgaagaagcgatggagcctccgccaccaactccaggaccagtgccaacgccagaaatggacgaggaaattttggaatttggcttttcgctgccatcgacatctgtcacaccaatcggcgattgtctccaggtgatttggacggattggagacggcagtcgaccagttcaaggcatttctcgatcaacaaccaatggtgcaaacacttctttcaaaaaagacaaaggcccatttgctgcttcaccactttgttccatttgcgcgccaacaccgatttttggggcttttggatgagcaggatggggccatatcatttttgggggctcaattttaaatgttgtgatttttcaggagatgaggcactgcattccgtgtggtggcgacttgagcaactttggaaaacgatgccggacggtgtacaaatgcgccaacagctggagcatcatttcgtcccgaattggctgctggacaccgggagatttgacgaattga

SEQ ID NO: 81415 - DNA, 660 bp, Heterodera glycines
  Genomic contig location: Contig_ID=SeqID_2752; Location=2990..3649; Strand=+
  SCN-specific regions: Sequence locations=1-83,119-121,144-660
atgaagaaagtgatcaagaagctgacgtcgatgtcgttgactgatcgaggatttatggtttttattttcattacaagcggtagataaaatttttaaaaatttgaaacaattttaaaatcattttggtcatttttccttttatttattcattaaaatcatcaaaatacagctatacatgcaccgggaatcgaacctgggacccccattttggtgactttctcacagaccactgagacaggtatttaaatcttttttggtattggagctgatttctgggatggtggacagcaattttgaaacccggaaataccaaattttcaaaattctgtaatcaattttaatggcaccgcctgccgagaaaaagcaaaaacttttgtccgccgttgaaaatcagcagcaatcgtcgtcgtcgggttcttttgtatgccccctccctttttgaaaaaaaaaattcaaaattttttttctcggaaagactcatttaggggtttttagggtcggaatatcagattctgataactatttctacgcaattcgacccccaaatcttgattggaacaaaaaatcgaattttatggcagtggttactggcacggatagaattgagaaaaatccaaccaatcattataaagtacattgcagcaaaataaattagggcaa

SEQ ID NO: 81416 - DNA, 159 bp, Heterodera glycines
  Genomic contig location: Contig_ID=SeqID_16991; Location=1..159; Strand=+
  SCN-specific regions: Sequence locations=1-159
cgcggtgatgtgaacatttgctcgggcagttgccccttttttctttcgtcgacccgcgccaatcgaagggcgccgaaagtgaagcgaatgccaacggaaatgaaccagcggtggccgtgttcgcccaatgctgccgaatggtcgaagcacaaatggtca

SEQ ID NO: 81417 - DNA, 517 bp, Heterodera glycines
  Genomic contig location: Contig_ID=SeqID_16993; Location=405..921; Strand=+
  SCN-specific regions: Sequence locations=1-517
atgtgtgaggcttgcggccaaaaagcgattgctcccatccacacggtgtttgttcgtcttctgctacaggatgttgaacaagcagacattgctcaacgtgtcaccatgttttcgagtgttgctgaagagtttttgggaatgaaagctgccgaattgctagccaaggagaaggagccggaaagccttgcgaaacacttggacgatttgattgctgtgaatctgatcgcaaaagttaacattaaggttttttttgttgctatttattttgtatttgacaaaccacgccctaggcgaacaatcagacgtacactggatttgattggattgtcaaccttttcaagaagtgcccagggaatgatgacagtgatgtgccaaaagaaaaaaatgatgttgatgagattgcaaccaagaaggccaagaaaaattgatagagagagagagagagagaaaaatgattcatttgttgtgagctttaaaaaaaagattgagcatgtcctttactttttttttaaatcca

SEQ ID NO: 81418 - DNA, 938 bp, Heterodera glycines
  misc_feature (902)..(902): n is a, c, g, or t
  Genomic contig location: Contig_ID=SeqID_16994; Location=16..953; Strand=-
  SCN-specific regions: Sequence locations=1-22,44-71,93-95,117-119,141- 143,165-167,189-191,213-215,237-239,261-263,285-287,309-311,333 -335,357-359,381-383,405-407,429-431,453-455,477-479,501-503,525 -527,549-551,573-575,...
  SCN-specific regions: Sequence locations=...597-599,621-623,645 -647,669-671,693-695,717-719,741-743,765-767,789-791,813-815,837 -839,861-863,885-910,932-938
  Gene Ontology: Mol. function=pre-mRNA splicing factor activity; Cellular component=nucleus; Biological process=heart development
atgttggacctggacctggattccatgttggacctggacctggatttacatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctggacctggattccatgttggacctgnacctggatccatgttggacctggacctggattccat

SEQ ID NO: 81419 - DNA, 1262 bp, Heterodera glycines
  Genomic contig location: Contig_ID=SeqID_16999; Location=394..1655; Strand=+
  SCN-specific regions: Sequence locations=1-491,514-1048,1070-1262
atggaaggtgaacagcttgaaaatgatgaaaacgtttctccgagtcgcgtttcccccaccaatgcctttggtgttcaaaagagtggccatttgctgcacaattttgctgagcctggaccactgacgacaaaggttttgttgaccattgtgaaattcttttttgattgctttgctcattttcagatttattattacgtcgatgaccaacaaattccgttctccaccgaaattgccatccctccgtccaaaattacgctggcggacttcaaaaagtgtatcacgcgcaggaactaccgatattattgcaaagtgatggacccggcacttaacgcgtgagaagcgcaaagaagggaaacaaacccaaaaaaattaatcactcgtttattcagcgaggtgaagacggacattcgcgacgaaaacgccgtgctaaagccaaattcgaagaatggacgctttgaactgtttttgctgtccgagacacaacagacgcactcgtccgcctccactctccccatccaaaagctacaggttttgtcattttacgaataaaagatttaaattgaagcaataaccactttagcatgtcgatgccatccgtgcctctctcatggaaaaacggacaacggccaataattacattcttgacgggaggccaaaattcattgatgacagtcagtaaaactgattatttttgataaacttcactcctatttttgtaggcagtagcagccccgaggaagacagcaccaatttgcgtttgtttggcgagtcaaattttgagggcattacggggagcatcgacgacagcgactctcagtcagtgcaaatgattccaaatagcatgctgtttataaatgcctctcgttttgcaggtacaccaccgactttacgagtgtttctcagcagaatccacacgtgccgaagcgcaaatttgccatggcggagcgatggtgcggggaaagttgtgacgatggcaaacatgggcatggccaacaacaacaaagccaccgccatcgtctcgcctttgtgagtacgaacaaacgctacgacagcaacaacaaaccgtgttggacgcgcgagaagcggacgcgccgcaggtcattcacggcactttccagcacattcgaggacaccacggaagcatcaatgtccttggaaatgatcacggtgaaaagcctctgccttacatgatttacaagggaacattccaaactgtcactgctcagatcgctttaaaaccacttttatcgtgtagagcatag

SEQ ID NO: 81420 - DNA, 253 bp, Heterodera glycines
  Genomic contig location: Contig_ID=SeqID_16999; Location=1..253; Strand=+
  SCN-specific regions: Sequence locations=1-253
cggggaacaattgccaaggacgaatctgtcgaaatccatgttttgaaagacaaggaaaacatttgtgccaattcggacttgcgcttgccgtccaaacgcaaatacaacgaacaattggaggagagcgatgggtgtttgatgtgttccggttgatggattgtttttccatttatttgattgtatttttgggcatttttttatttggctttaaccattggttttcgttaacatatgataaattgatattttgctt

SEQ ID NO: 81421 - DNA, 678 bp, Heterodera glycines
  Genomic contig location: Contig_ID=SeqID_17000; Location=290..967; Strand=-
  SCN-specific regions: Sequence locations=1-195,217-678
atgtgttcagcagcacaaaagtttgaacagcacattcaatacgcggacatttggtatttaacgtttcaattcaaagacagcgaagagccggtaaaaaataaatgaacaaaaaacaaaaaaacaaattgagaattattctttttaggttgtggtggaaataaccgacccaggcacagtgagaaaagaaaattggagaaaaaattaattattttaaaaggagaaaacgggcgaacgccaaatggccatccaacaaaagtgggaaatgagggcaattaattaactaattggttgactgactctgagcaattgaaatacagatcagacgcgatcattctctgctactccgctttcaatcccggctcatttctcgccttggagtccgtcacagaggactttcaaacattcaatggaaaaccggtgaatggggggagacgaaaagccaaggcatttgctaattcataaattgggcatcagcccgccactctgctgctgtgcaacgaggaccaattggcggaggagggcttcgaggacggacacgaaacggacactgctgacgacggatacggcaccaactcgggcggagggtcgccgtcggacagagaaatgccaccacagacagtgccgaaaaggaggagcacaacgccaacggggagacagcattcgatggagcgaatccga

SEQ ID NO: 81422 - DNA, 572 bp, Heterodera glycines
  Genomic contig location: Contig_ID=SeqID_17002; Location=470..1041; Strand=-
  SCN-specific regions: Sequence locations=289-298,331-402,431-438,474 -489,511-572
  Gene Ontology: Mol. function=protein binding; Cellular component =axoneme; Biological process=N-linked glycosylation
agaaaaaggatgagaaaagaggaaaagaagagaaagtgaaagaaacggagaagccgaaagaagaaaagaaaaagacaaaagaagtgaaggaagaggacgagaaaaagaaagagagcaaaacggtacaatgtaaaaaaaataataattgaaattaaaaaaacaaaaattaaggcaaaaaagaaagaaaacaaaggagaagcggaagagagaaaagtagatgaagaggaagaagagggggaggaagacgaagaggaagaagaagacgaagaggaagaagagggggaggaaacagtgagagaataatattatttaaatttaatcttttattatggattaattatatgctgaatatcaggagattgatgacgaggaagacaaggaaaacattgaggatgaagctgaaattgatgaagaggaggaggaagagccacgcaaaaagaaacggcggaaggggcggagaaagaaaaaggtggaaattgacaatttaaaatggaaagggacaaacgggcaaaaatcgacttttggcacttagaactgatcagtttccagagcaaagttggaaaacgaataaa

SEQ ID NO: 81423 - DNA, 996 bp, Heterodera glycines
  Genomic contig location: Contig_ID=SeqID_2753; Location=781..1776; Strand=-
  SCN-specific regions: Sequence locations=1-371,396-704,732-831,853 -869,930-966
atggacgggcactcgtactctaaccgagcagagcaggacattatccttgactacgtcaaaagggtatgcactgaattgcatgtcaaaccatcagaaatcggagtcgtcacaccctacaactaccaagtgagtgtgaattattctaccccaatcgtcgtttaaatttgtaaaagtgccatcatttcagtacttttggttcacttttaggtccgtcggctgcggcataaactcagcaccgaacacaagggagtgactgtggacaccgtggagcgttaccagggttcccagcgtcgggtgatcattgtcagcactgttcggaacaacgaaaaggaggcgatcggatttctgatgtcggacaaggtgtttacaaattctaaaagctggtgttaatttcaaaacttagcgtttcaacacaataatcactcgtgcggaagagcttttgatcatcgtcggaaatgccaaagtgatgatgagggattcgtcttggaaggagttcgtgttgaaatatcattttccctaacaataaattatttttttattcttttacaggatgatcgactattgccgcaaaaacggtgccacagttgacatgccgtctgaagcggagcttttcccatcgggccaatttcaaaatggttttgaatgttgtaaatatgtgtcattattaaattgttttcctttaaagatgtgctgacggacagtgacaagagcagcagcagtagcagcagcgaagttgatgagaaggagcgaactgacgaacttgtgaagaagggcacgtcgagtgccgccgctgctgaacaacagaatctcagggccaaggcatcttccgccgaggaagaggatgaagacgattcgagtgttgctggggagacaacgacggaagacgatgacgaggaggaagacgacgaggatgaggacgactttgacgaatcctcttcctctggagatggggacgaatttttgacggacacagacgaggaggaggagcagcactga

SEQ ID NO: 81424 - DNA, 315 bp, Heterodera glycines
  Genomic contig location: Contig_ID=SeqID_2753; Location=1965..2279; Strand=-
  SCN-specific regions: Sequence locations=1-315
atggttgactatttcaagaagattggcattagttcctcgctgatcgaacgctacgagtccaacccgaattacaaagatgacccgtaagtagactttaaacacatttttgtcactcaaatatttggtttttatttctctttcaggcgtattgttaccatgctgcgcgccaattaccgttcccatgccagcatcatcgatgtgccgtctcgtcttttctacgccaaccaaatgtacgtccccgaggatgcgcaaccgcgagacccactcgccacgtggaaggcattaccgaagcaggtcgtctcagtacttgtttaa

SEQ ID NO: 81425 - DNA, 1669 bp, Heterodera glycines
  Genomic contig location: Contig_ID=SeqID_2754; Location=438..2106; Strand=-
  SCN-specific regions: Sequence locations=1-342,364-381,404-450,472 -540,564-803,825-1208,1230-1456,1479-1669
atgggatcacgccgaactgttcacggagggttggaaattattcctttgccgcggttggtttgtccataattcttaaattattagtccgatatttttccctttcaattattgtttaatcaaaatttcccttgcaaattaataaaaaaaacgtataaaaacaatggtaaatccttgattcttattaaaataacccagaaatttggtcgttttaatttttcttcaaatcaagcgttccctggtccgacgctgaccatggactcatccactcgcgcttcaatgcgaatcgcgttgcagctcatctcatggatgaagcaaatgcaagttttgtctggtctacaatgttttgcttgtttttacttgaggagaactctctaaattaagacaatcataatttaatttttgcaggaaattctcgagtatctcaaccagaaggaaccgcccggactgcttgcatatgccaagaaacagaaggcttacaatcgcttgttgatgcttaacgaccaggtaaataacaattacttacaatttaaagatttttcattattctatttctgcgcaattaacaccaattttgcagattaccagcgaggataacaagacgggaccgcacacggtgaagctgtgctcgcgttcgcgcaccggcgcctccgtttacggcgttcagctgagcattgactactgcgagcggaacagcaatgacatcaaagcgtccccggtgatcattctggagccatacgaacagcagcagtcgcgtcagaatatgcaatactatgacccatattacaaggtcaacagcaacagggcactttattttggaagttattaaccaataaacaatttgtttatttttaggggcgtgtgatttccactgacgagaagaagcagaccatccattttctgccattctttcgaacgatgccggaagggaatgtgagttattaacatttgatgttcattcaatttactcattactttttcagtacatggttcgctttttgccgtcccaattcgtctacaactcgagaaatcatattatgaacgagctgcaggacaaccagcggccctacagattcttgatcttcccgcctccggtggacgaaaaggtagttttcttatcaacctgaataaaatgttcatttaactcggatacaaattaacccaattctttcagctcaccgttgaacagtatgtggagttgcgcgatttggctatttcaaaatgtcaatttatgtcggatcgcttcaataccgaacagcgacaggcaattgttgtgagttcaaataacaatcgtttaggatatggtcaaattgtttatcatttagtaaaaaaatgtttattaaggcaattgccaatgcgatagaattccgcatcagtagcgagaacgacaacattctcccgttcgttttgcatggacctccaggtgagaaagggaggggcaaacaaacacacgatttgatatatgaaatgaataattacctcttcccaatgcgttaggtaccgggaagacaacgactctggtggaggcgtgtcgtttgatggtgacgcaatttgacactggcagaattctcgtctgtactccttccaacacggctgccgacttgtttgctcacgaattgatccatgtggcaggaattgacacgagcaaagtgtttcggtcagttttaataaa

SEQ ID NO: 81426 - DNA, 2167 bp, Heterodera glycines
  Genomic contig location: Contig_ID=SeqID_2754; Location=3758..5924; Strand=+
  SCN-specific regions: Sequence locations=1-126,149-198,222-407,429 -671,693-761,784-825,847-931,962-1053,1096-1151,1173-1247,1269 -1349,1379-1631,1653-2139,2164-2167
  Gene Ontology: Mol. function=carnitine transporter activity; Cellular component=integral to membrane; Biological process=carnitine transport
atggcgtccaagcaccaaatgattgcgacgccgatggaatatatgtacaatttggatgccgacaaagtgttagagcgatttggaaagtatggaaagtatcaggtaggtacatggaatttcggtgaatattaattttaaaattgaaaacgagaaaatattgttttaatcgggtttctttctttttttgtatcacttttccaagttccaattctgttatttgtaaattcgatctctgatttttttcagatgatcgtctatctgatggctgcactgaacttcttcatcttctcttacaaaaccacagtgatttcactgatagctgagccccaaccgaactgcactttacacgcaaatgttgtgcatttttttaatttctgaactgttaaaaattcattttgatttttatacttttaaaatgcaaatttctctaccatttaaggattcttcactttcgctcaatgattctcgtcactacgtaacattagcaactgattttggcattggctgtgaggacaaacatttgctggagcatgccaacggtgcttttatgctcggtaaatgccaaatcggcaaagtgattattttgtttaaatcattaacacgattttttccttttcgcaatttctctttttccggtttccattttctcattttattttaaaattccattgttttctgccccttctctctttgccaggtaactttctgttcaccgctttggccacttattcggccgaccgtttcggccgtcgtcccattttccttctctccctttggtccatcgtcgttctgagcgtcgcctgtgcctttgccccttcctacgaatggtttctgttcttccgcttcttttccggcgcttttggagctgtaatttttgaaatttgtcttactaaaaccagagttttgcaaaaatgttgacaaaaaaactgacaatttaaaaaattgaaaaataaatttatttgtgtgttcgatgttttcagtccatcactgtggttggctttgtgctcaccgtggaaagtgtcgccgcgtcttttcgctctgtccaagtcaatcattttttttttaatttattcatttttaaatttacatttatttgtcaggttttggtcaattcgctgatttgggtggccggcattctctcagttggcgttttgcaccttttcattttcaattggcgccttttgtacctttgcgtagtcgcgcccggactcttttccgtcgtttatttttggcttttcccgggtcaatttccattcattccatccaattttatgcaaattcttacttttttcagagtcaatccattggttaatagcaaatggaaaaacaaagggagtgaaacggtgggcatttttaaattattttttcaaaaattatacggtaatttattggcgaaatgtctctcttctgttacagttatatcagtcgtgcttcacgtgtcaacaacgtgactttgaacctgcactcgtgccaatcggacattgtggcgccggaccaaacgccgccccatccgtcgaatgcgccccgggcgaaacgcaactttttggatctcttccgaatgccgacactgctgctccatttgtcgctgaactgctacattttgtcagtaatttggcaacccattcatatgatttatattatttttatttgtgtcaaaattggaccaaattttggaattttctctgccttttcagcattgtgttgaactttgtctattgggtactcacgctatacagtgtgaagttgcacgagcagagaatgatcggatttttcctctccgcggtggtcgaagtgcccgcgggcattttggccatgcttttgcttttctgttgtggccgagtgagtggcgctgttgatgagatgatctacaataaatcaattaatttgtttgaatttcagcgaactgtcaccgtcgtggcactgtttggtcaaacggtgtctttgggtctgaccattttggtgccacgtctgttaatcgcacattttttatttatttttactaatttcccaatttttagaaggtagcacctcgaatttgctgctttctctggtcgccaaagtgttcaacggtgtttcttgggcttccgagccgttgctgcttagtgaaatggcacccacaacagtgcgcaacatggtacggttgttgttgttgttgttgttgttttag

SEQ ID NO: 81427 - DNA, 426 bp, Heterodera glycines
  Genomic contig location: Contig_ID=SeqID_2754; Location=6166..6591; Strand=+
  SCN-specific regions: Sequence locations=1-239,261-287,309-426
atgcaaaagattgtggtcaccgccatgtccgtgctggccattctgttcgcgttggtcgcgcccgagacgagcggtcgcgctctgccgcaggacttggcggactttgacgggggtccatgcgtcgcttttctgtgccgcacactgaaacggtggcgcagtgggggcgacacgaaaaaacggaggagaaaaagcaacgcgctggtggaggaggggagcagcggcgaacggacagcgctggccgaagaggcggcggcggaggacggaggtgacgaagacggagcagtaccagcagcagaacaacggcaaaggcagcagacaaacagcaacaacaatgacgacaatgccagccgaacggggcaagcgattgttggggatgaagccgtcgtcgtagacaacaaccgcacacccaaccgaaaatggtaccaa

SEQ ID NO: 81428 - DNA, 2350 bp, Heterodera glycines
  Genomic contig location: Contig_ID=SeqID_2755; Location=1..2350; Strand=-
  SCN-specific regions: Sequence locations=1-153,180-373,399-414,453 -522,548-554,577-665,700-933,958-1259,1442-1520,1542-1962,2006 -2052,2075-2080,2115-2350
  Gene Ontology: Mol. function=stromelysin 1 activity; Cellular component=extracellular space; Biological process=proteolysis and peptidolysis
gggaaaattgcaaagaaggggggcggaaccggaggaccaaagaaaaattaaaattaaaacaaaagatgtgaaaatgcaaattaaaattagcatttttgaggaaggcgatcaaagcttttcaatccttcgcccatttgggtgccaatttcagacaaaaaataaataataattttttatttcatcccgcacatagccagagacgggcaaattggacatcaaaactaagaaaaagatggcacagccgaggtgcggcatgcaagacgcacaaatgattgtggggccaggaggtgatcagaagtgatcggagacaattttaggaagggaatcaatcagtcaataattaatgattgatgagtagcgacgcactaatcggaattattttttggttgtttttcaggcggtccaaaatggaacaagaatttggtaaccttcaaaatcaacaatttctccccacaacttcctcagtcgcggatcaggcaaatgcaatgggcatttaattgataaatcattcccactaaaatgaaattaaaatatttaatttaaaaaaccacgaaatatttaaattaaattttgaagggatgccatcaaacgtgcctatgacacttggtctcaagtgattccagtgcgttttcaggtgaatatttttttaactgacaaatgaaggcataattttaatttttttaatttgaaattaaatttgcccaggagacacaaggccaagccgacattaatgtgcagttcgccgcgcgaagtcacggcgacccgtggccattcgacggacgaagtgagaaaagcgcacacagacaatgatgttgctttcttccgatcagtgatcggcggtcatttctctgtcgtttcacgaatatattttaaatgcgcaaaaattgaggcggcgttttggcacatgccacaatgccaacggatgggaagttgcactttgacgatgatgaacgatgggcgctggggccggaggatgcgcggaaaattgccaagttgtattatgaatcaaacaacgaattcattagtatttaattacataaccaccatttccactaattaccccctaaagcggttacaccgatttgttccctgtggcggtgcacgaaattgggcacacattgggcctggagcactccaaagtggagaacgcgatcatggccccgttctaccaggagtcggtggacgacaacggcaattacattccgcaaacgctgaagtcggacgacatcagacgcatccaagccatttacggagggtcgggcggcgggggacgaacgccgtcgtccgcggcggggaccagtggcggcagaaggccaacgacgacgacgggcggcggaagcacgggcagcggctcgttcggaagtggcggttggggaagcgggagcagtttcggcggattcggaagcagcggcaggggcagcagctttggaggcagtggtgggtagatcccggcgggattttgcgggatcccattccgcaatcctgcattttttggaaaatacctgattaatcccgcgggatcccgtcccgaaaaattttgagttacaatcccgcagcgggatccgcaaatccgaaatttccgggctttattggtgggcttttttggcattttgccaccggcggatgataacccggtcaaagtccaatatgtgaggcgggtggtgactgatcaacggaactgtccgactaatccccacttccacggaatgaaatgttccgcggatgcatttccctgtcccttccttcgacagcaggtggaagtcggagccgtttcggcaccagtgacgacgactggggcggtttgttcggcagcgggggacgatcgcggacaacgtcgtggcagtcgccggacggacggacgcgcagccgcgtaaccgccagtggcacggattggccctcctcgcgcttgggcagctcttcctcctcacgcggccacaaaagcggcggcgggggcttcagcttggacagtctcttcagcaaatggatgggccgtcgttgaacagcagcagacagaacaacccatttgaacaatgaatgatcaatgaaacgccatttttgtagttttaacataaaaacaagtccaagtcattttggagaaaataaacaagaaataaaagtgggataataatataaggagttgcaaaaaaccaagtgtgtttaattaataggaacgacccaagctattggaggagataaacagtcgacgaatatgcaactatatatatttttttattcaatttgatatgcaataaaaagtggttataatttaattagtcaaaaaatcaaagttttgcctcacaaccacacagcgaaaggaaaatgatcacaattaaatgggatgggggggggg

SEQ ID NO: 81429 - DNA, 1569 bp, Heterodera glycines
  Genomic contig location: Contig_ID=SeqID_17007; Location=492..2060; Strand=-
  SCN-specific regions: Sequence locations=1-38,61-204,228-480,502 -583,606-1011,1033-1086,1108-1133,1156-1502,1524-1569
atggcaaaatcgtatcgaataaccaaaaatggtgcgatgggaaggaatggaggagagaaagttgtcaatggattggttggtcgggggactataattaggactaattagttcaatttagtttgaacaaaattcgaagaccaagatggtctggtgtgggtaacattttgacacgaaagcgtacttgaaacttatgatttaaacccaggaattgataaaccttttttaaaggcgcctccttgaaaaatttatgcaaaatttgttcaatcgatagtatagaattaaaaaaatggactattttgtgccaaaacttaatcctccctaatttgtccgtatcgccatgtattcaaaccaaatgacattattacacaatttaggcaaataattaatcatttcgaattcgcctgggataaccattaaatttgttaacacatttcagcagcagcacagagagaagaagatcagtgttttgcacgcgcatgttgatgagcaacataataatgaggggaatggtggaccaacagcaaacgaacaaaacatgggaatggtaatgggcgaacggttggacgggtcgcacgagcacaacggcggccgggacggcactctgccgacaccgaaaaatgatgattggtctgtctcatttgtcagtcgacccccgggtttttgccaatttccaaattccccaccccaacctcaccataggcatgagcctcatcagttagctagggaccgcaaaaatcagagtttctcgcctcgagaattttccgagactcgcttctaaaaccagctgcgcatttgtcaaatgccgcggttaccctcatgtgatttttatcggaaaaatatggaaatttctcggtgaaaatcttcaaaattcatctagctttcctcttttacaataagactccttaacgagttcgtcccatattcttgccgtttcagtgcttttgttgccaccccattgctgcagcaaaggcggcgtatgccgacgacaccttccgccaccacttcaaacaacaacaacttgtactgctccaaattgtcggcaccgccgcttgctcccatgaataatacgtcatctcctccgacaaatgatcagcaaaatggcacttatgagagggtaaatgagaggggcgaatgtgagggagtatggggtccctgaaaaaatggggttctggtttattaggaacaataatcggttgtttaagtaaaattaatgatttttcataatttaatgacaatcaaattatcggatactcacttttctatcattcatttaatgctgattatatccagcagcaaatgtcatgtaaatgtttcagcagaaaccaccgacaattcgtgtgcaaatggccaacggtgccaatgcgtctttgcctggcgctgctgatcactcgggcgatgccaaaccgttggcatgtcgccaaaaacaaagccaacggcaaaacgatcagccaaatcggtggccgagtgccccaatcgcaccaaaagacgagctttgaacagatgaaaaatataaaaaacatttatttgaccatctattgccaaagggaataatttccaaaatcaaataaa

SEQ ID NO: 81430 - DNA, 369 bp, Heterodera glycines
  Genomic contig location: Contig_ID=SeqID_17008; Location=440..808; Strand=+
  SCN-specific regions: Sequence locations=1-369
atgaacggacctgaagagttcgcgattgtcgagcaggtcgatgaagcggagaatggtcggaccgtcgaccaacaaacaatggcgaaactgcgcacttttgcaaaacgctgcattttcctccaattggatcggcttcatttgtccctcataatggcaatgtctgcacgcgctcactccgcaggggatgtcgttgcgcaagtaaagttcgtgaacgcgctaaaaggattgactttaccaaagtattataagaaaattggcgtggcatttttatgacttggtcccggagttttgaaactgaaccgggacagaaacagcaaaaagccagttttccgtgaccccggtttcggtcccaaatttagcttgggatta

SEQ ID NO: 81431 - DNA, 680 bp, Heterodera glycines
  Genomic contig location: Contig_ID=SeqID_17009; Location=283..962; Strand=+
  SCN-specific regions: Sequence locations=1-453,476-680
gttcaacacgaaaatctgcaccaaatttgcgattttttgggataccgaaagagcccggactcaaacgtattcagtggttttatgttcttggtgacagagaaattgggcccaaagaccgggtgtcgaaaagcgtttccatttggtaatttttgataaacaaatcaatttaggtctgtgcaatacatttccgcttgggaaaaccaaacagcgatccatcgcacgaaggtgggccatttgtgggtccaataaatatgtcttactccccgctatttaaaaaaaccgaatccctcgtggtgacaaaacaaaacaatttaaagaaatgatcgagttcagatttcgttccccatttgaatttgaacaatgactctcccgagtacatggattatcttgaatcattggacgattgcaaaagaccgatgggcacagagaatcgaagacgcccgataaagccactgattttgaagaagaaaagcaaaagcggacagcaacaggaagtaaatgaggaaattattcgttttcacaatggtcaggaaaatgaactatgttttcagtcccaatcagcctgtgccgcgccaaagcttttgccaattccaaaatcagtcgcagaatcagtcgatttgagagagggacaacccgtacttatcagacgatacaaaaaggaaagacgacaacaaaattga

SEQ ID NO: 81432 - DNA, 286 bp, Heterodera glycines
  Genomic contig location: Contig_ID=SeqID_17010; Location=14..299; Strand=-
  SCN-specific regions: Sequence locations=1-286
atggcgcacccagccggagatgtggtgagcgattggtgcttttcattttctttttctatgtcatttcattttttcaatttttcagaccgacgcccaagtgctggagatgtcttccgaccaaattgacgaacgcgtacgacagctcgacgaagaaattcgcgtcatgagggacgaaatgcgcaaaattgcgtacaacatcaaaacaatgggaacgaagacgaaggagaacaacaaacagatgcagaaagtgagcaaacaaacaaaaggaggaacgacaaatttatga

SEQ ID NO: 81433 - DNA, 385 bp, Heterodera glycines
  Genomic contig location: Contig_ID=SeqID_17010; Location=1090..1474; Strand=+
  SCN-specific regions: Sequence locations=1-108,131-385
atggaattaaatgacagccaaaacagcaacggaatgccaagggaaaagcatgttgatctggtggattttaaagtgaaagaatttaagcttgaagtaattttttgagaataattgagtcaagcaaatatcataattttccacagacatttttctcaatgcacctggaagtaatgggaaagtacgacacgagggccggtacattgcgggactgtgattaaaattgaaaattttggccttgatgttgtaattttgaaaattttgagatagaaaccctgatctaactcagagtttcgatctcagttttgaaaatcctcatttcagccataaaaaatgatcatttgccactaaaatgctcgaactaaaaaattcgatttctattgtttta

SEQ ID NO: 81434 - DNA, 574 bp, Heterodera glycines
  Genomic contig location: Contig_ID=SeqID_17011; Location=111..684; Strand=-
  SCN-specific regions: Sequence locations=1-112,134-239,288-533,555-574
  Gene Ontology: Cellular component=extracellular space
ttatttacgcgaccaaagctcgccgtgcgttggcggcggaagcggccacggcgttggacgacggcacggaggagcccatcgatgccaccgaaatcttcgaacacatccgcgacattaacgaccccgagcatccgtacacgttggaacagctgaacgtcgtccaagtggggaaggggcacagttagaaattccgtgttttttttttgacttaattttaggatttttgggaaaatttttggaaaattagtaaattattataaaattcgaaaaaaatattaaaatttattcggggcgaacgacacgatattggagagggggaacgaactgctcccgttttttcggcttggtattaacacggccgtttagtccccgcattttttgaaatttatatccatttccattgaaaccaattgccccccccctttacttttcctctgttctccaggaggaactgatccaagtcagcgccgacccgaccgaccctttcgtcgacgtgcgctttactccgactattccgcactgttccatggcggcactgattggactggccatctacgcaaagttgagacggagg

SEQ ID NO: 81435 - DNA, 2916 bp, Heterodera glycines
  Genomic contig location: Contig_ID=SeqID_17013; Location=61..2976; Strand=+
  SCN-specific regions: Sequence locations=1-129,169-298,322-343,365 -1307,1329-2245,2267-2610,2638-2916
  Gene Ontology: Mol. function=calcium-dependent cell adhesion molecule activity; Cellular component=integral to membrane; Biological process= homophilic cell adhesion
atgaatttggaatcgggaccattgaggattcacgagaatggaagcatggaactgatcgaagcactgaactttgaacagagcgccgaatggattcaatcggtacaaattgacggaacgcataaaagtgagaaatattaaaaaatttagttaaaataatttctttattatcaagaccctttattatatgtatctttttgtggagagaataagcaaatcgaagttacttttgggaagggctcttaattagggacgaaatgaaagagaaaagatgcaattaggagaattattatagaaaaagttaagaaagggaaaaaagaggagctcaaaacgggggggggggtaaatttatggaaaagtcaggaattaagtttttaataaattattttagcacgccttcagaccattcgaattgacgtgttggatgtcgatgaaccggcagtctttataaatcgcccccggccttttctcgctgtcgtccctcccctggaaattctcccccggggcttccaagtgtttcgtttggaggccaaagacgaaaatggggaaggaagtgccgaaaaagtgactttcagactgatcaacacggagcgtaagaccaaatcgaaggcctcatttgatgagtatgccaaacattcagcaccgaattcatttactgtggacggattgagcggcgcaattcgcacagcactcacaaaatattcgcctgggggcacttacaaagttttcgtggaggcaatggacaacggaggggctgaacaaagggtaggtaaatggtggccatttatgctgtggcataatctgagagtgccttttgctaagagtcccaccggcgggcgttcctccgaaattgccgtcgtcgaagtgttcgccggggatcgtcctccccaatttctgcgtcaaaagtacgctgcgtcggtggctgaatcggtggacactgggcaaagtgtgcttcaactggagaccttctcattcccaccaattagcgaaaatgggacaccaaaagtacagaagtgccggaattcgttaactaattggatcatttagggcccaattaaatacagtcttttcgagaagggatcgaatggtgcaaaattcagccgggagacttcggattttttcggtatccacgaaagaagcggactgatttatttgaagaagcgattggacttcgatgacaaaacccagccaaggcttttttatctcttcggtctgtcggcaaaatcaaatccgaaaagcatttaaattttgaaggggttgccgaagaggacggaaaagagtcatccgttcccgtggaactttctgtcgtcgatgtgaatgacaacgccccccaatttgtccaacccgatttaatcctcttcaattcgcgaggacattcccacggggcacactatgcataagggtaatggccagagggatgctgtctcagcattttggccaccaatttccagtcgatgcaatcgacgccgactcgggactgaactcggcacttctctttgccgtcgatcacccacaattcatggtcaacggacggggcgaattgcaaagaaagccgggcactaaaccattggatgctgatcaggtgatgaagcaattagcgactctaattgacgacttccgagttcagttgcgacagggccactttctgtaccgcttcaacgtgtccgtgtccgaccagggcattcctccgctcatttcctccgctattgttcacattcaaacggaaaacgttaacgatgaagcgcctgaatttgttcctactgcgcaatatatggcgacagttaatggccaaattaaatttaaatgaaaaaaaagaatttcaggtggcagaagacgccctcgggggaacgccggtagtgcaagtgcaagcgatagacccggacagggaccaagtgaactacgcatttgtggacgaggaaggagacgaaactgtggtcaatggactgtttgaaattgaccctgacacaggttggacaaagcaaagaacggacgaaccaaccgcaaaacgatcgcctttctttttgaggactgattcggctccatctctccgttcggaatgatcagctcctttccttggactcgcccttaaatttgactgtcattgctcgagatgatggctcttgctgttctcatcggcggaagggactcgccgttcgtcacacgacaaaagcgacggtcagtgaacagacggacaaagaccgagctaattaccataataaagtaaacacgaacaaagatgattgtgccatttgtgtgaaggttcttgttggggtgctcgacttgaacaacaataagcccgagttccctcactgtgccgattattctcggatggcaatggtcgaagagggccaataccgcgtcaatgcctcgccgatccttcgtgtggaggccatcgaccacgacttgggtcgcaatgggcacgtgtcgtattctctttactacgcacgcagcgagtcgcggaagccctttctgatcgactcggacagtggcgaactccgaccttcgccttattttgtttttgatcgcgagcaaaaagtcgtcgaggaggtgaccatcaaagcgacggacaaaggcgaccgaccgttgatcggcttctgccagttcaaagtgcaggtgatcgacgtgaatgacaatgcgcccgctttcgacaagtcaatttatgagacttctatgggaagggcggcacgggtcggcaccgctgtgctgacagcggtggcggaagaccgggacgggccgcgcaacgctcacatcagctacgccttggcaccggacgagacctcgtccgcggaacacttcgaagactttcagtcgttcacccttcccgacccggaaattggcgagattatgctggccaaaaaggtgccaccagagaacgacagacttctcttctcaatcatcgcaacggacaacggatttccg

SEQ ID NO: 81436 - DNA, 634 bp, Heterodera glycines
  Genomic contig location: Contig_ID=SeqID_17015; Location=78..711; Strand=-
  SCN-specific regions: Sequence locations=1-634
atgtgccgtctccagcgggacttttcgttacacagaatagttcaagacaggtactgttcaattaatgatagacaatacagcgaatgaattgttaagatcgttaaaagggcacgacatgaagtcaatgcaccacctgtggttcctaaaagcgttgaccaactgattgtatcaggacagctgtcatcgcattagatacggagctggggaatgacgttgcacttcgtccgctcattgactggttaaactgattatttttgaaaaaacgacaatttgtgcaatttttaggttgctcaacaattacatcggacaaccaaggccaaatggaacttggtcacagccaacattcccaccagaacagtggaacgtctacactcgcacattgaatggggaagcgaggacaaacaaccacgcagaggcagaacatcaccgtcttcaaggcgccttcaattgccgtcatccatcgatctggcacttcattgacgttctccgccgtgagcagaagggcaccgatgggaagtatgcgtcatttgttgctggactcgaaccgccgcagaaagcgccaaaataccaagcgccagaacaagcgcctcttcaatttggtgcaaaattacattccagtgaacccgaacaatga

SEQ ID NO: 81437 - DNA, 839 bp, Heterodera glycines
  Genomic contig location: Contig_ID=SeqID_17017; Location=400..1238; Strand=+
  SCN-specific regions: Sequence locations=1-638,660-839
  Gene Ontology: Mol. function=structural constituent of muscle; Cellular component=muscle myosin; Biological process=muscle contraction
atgcaaatcaaaattgaagaggcggaagtgactgcgcttaaaacagggccaaagatggccgccaaattggagggacagctgaaagcggtggaaaacgaattggagggcgagcagcgaaggcaggcggacgcctccaaaagtttggccaaagcggagagacgcgcgcgggagctccaatttcaggcgggaaacagaagagtgaaattaaattgagcaattagaaacggatgatgattgatttaaggcaattatgaaaaactgtcaaggattttccttgagaaaattgaaattccgcagtttcccaaaaaataaaaattgtcccttttaggcagaagaggagcgcaaaaactacgaaaagttgtgtgacttggctgaaaagctgcaggtgaaaattcgagcgcagaagaaactgttggacgatacggtacgtaccgtaatcgaaaagggtttttcgaagtgaatgttttattcaggaagaacacgcgaatatttccctgcaaaaatatcgacaatttcaaatctctgtggacaacgcggaggagcgtgcaaataccgcggagtcatcattggcacgcatgcgttcccggtcgagactggccgtgcccagcggcagcggaccgttggccaagtcggagacatttgctctgtgatcaaaggggccgagtgtggtcgaacttgatctaatcaatcgataccatcgagcttaatctaatcaatcaataccaatcattatcgatcgattactaatcattaggactgattttgattcaaaattaattaatttttgctagtaaaatttttttaaatgcaaatgtattagtttaaaattaatacaaaga

SEQ ID NO: 81438 - DNA, 57 bp, Heterodera glycines; identical to SEQ ID NO: 56798
  Genomic contig location: Contig_ID=SeqID_17019; Location=1364..1420; Strand=+
  SCN-specific regions: Sequence locations=49-57

SEQ ID NO: 81439 - DNA, 650 bp, Heterodera glycines
  Genomic contig location: Contig_ID=SeqID_17020; Location=152..801; Strand=-
  SCN-specific regions: Sequence locations=1-96,135-260,283-650
atggggcagaggccgaatgtgcgcgacgcggcaccgagaggaacatgggaaagcattgcgcaaatgcttgggcccaacgatgcaattaattcggtgatttttatttattttattttttatttaaattttaaattggatttgcattctcttcctattttttgttcagtttctctttgatggatgtcaacgaatttggtcttgctgcaagttcttctctgcttacatgcgaagagattgccgaagtttttctccatcttacggtatttgccaaatgctttttcaaaaaggcatttttcattcgaatttccctttaggtccgtcctcgtccccaatgtcgtttttcggcacgcggtttccgtgccaattcgcgctcaaaacatattgtgcaggtgaaaagacatttgccaataaattcgctttatcattaaaattaaatatgaataaatctcaaattgtttctccaatttcagcgcttttccgccctctcctccaagcgatgcacgcgccgtgagaacaaaatttgctttaccgccgatcgggacgttctgatcagcggagtggcgatttatggcgccaatcagtcgggcagtcggatgatcaccgacgatagcacggcaaagacaaattgggaacataaaatagccataaag

SEQ ID NO: 81440 - DNA, 2105 bp, Heterodera glycines
  misc_feature (166)..(166): n is a, c, g, or t
  Genomic contig location: Contig_ID=SeqID_17020; Location=926..3030; Strand=-
  SCN-specific regions: Sequence locations=1-331,353-515,539-729,751 -798,830-861,917-1129,1171-1235,1257-1280,1302-1478,1523-1603,1625 -1886,1908-2105
atggatcttcgtgctgctccaaaagagaacggcacctcctcaaatgggggtgggcaataaatatttgaaaattgaaaacgaaacccaattaatgtattggctaattaatgaaggttcctcctcctcggcttcacatatcggtgccaatgtgtcaaccaccggtgcncaattttcttcttcggccccgtcgacatttaacagttttcaacagttttcgttggacgagcccacttcgccacgtcggaccaacaacagatcgccattgactgatcaacaccgtattcttttttgtgtttttgtcaatgaattaaatggatttgctggtaaacaaatgataaaattcataatttaaatttcagccttttttaaatccgccgatgacgccgaaggaatttccactgaagggaattctcatgccgaagtgtcactgacgagtcgactgaatgccttccgtctgaaagacgtcggttgtgacgttgcgtttgtggttggagaggaaaaagaggtaaaaacacaaaattaattatttattttatttcttgaaaatattggaaaatacgagaatggaaactatcaattgttcagcaattaaaagcgcacaaattggtgttgggtgccagttctgccgttttcttcgccatgttttacggtcctttgggctcttccttcgttggcactgccatcccgcaaattgcgtacgaagtgccacaaattgtgcatgaatcgaccacaacaacagcagcgggacaccaaaaggcagcacaggtaagaaaattagaaaaaaggaaataaaaaagcataatattttaaataatttataattttatttgacagccgacggatgagggggaagaatattacgaggaggaatatgaggaggacgagtacgaagagggcgaggagagggaggaggaggccgagaacatcagcggggacgggtcctgctccaattcgttggcctcgtcgctggagggcgaccatctgctgcgcggtatgatcgaaaaaaacggaaaatggccgctcagatataggcgaacgaggaccaattccggaagatttgaagccaattttgaacatatttaatgagaaattgcttatcgtcgtgaaaaacattttgcatttaatttccaaattaatttaaatttaatacatttaaatatgtttttaaatgcggtattattttgccaattccgcgccttttagagcccccaaaagtgttcactacgcctcaccatcctccacctccccccgccgccgttcactcgcatcaccagcagcagcgtcagcctcagtttccttttgatgggaaacggcacttttccaacggtttccatggccatgccaaattgggacacaaaacggtgcaggcgatcggcgacagtcagcagctggcggccgagttggccaagcaggggctgcaagtgatctgtgcacccgactgcgagccgaaggcatttgccattttggtaatggaaggcattttaattaattttaaattaataattttgtcattttaaataatcccccccccattttcgcctttctcagattgactttgtgtacagtgacttcgacgtgcgttcgctgtccgtccgtggccaattgactgatgacaatgtgatgaacacgctttacgcagccaaaaaatacgccatcgatgcgctcgtcacggaatgcgtgcgctattgcaccgcgcgactgaccgcgacaaacgccgtctcaccgttggcacaggcgcgccttttcgacgagggcactttcggtggaacaggtgaaaatcgggaagttgcagggcaaagtggcaaaagtgaaaaaatggacaaaatgatgacaaaatatgcatatattttaatattattcttttcaattttcgctttttcgttaattgcttcattaattttaattatgctccgttccaaaattataaactcaaaactttgaagacatgtatttttttctatagggtaagaaaaaatctgaaaaaattcatgtaagcctaacatttcattgcaaacattaagccaaatttggcttttcagtgctaccaagtgattgatcagaacaccgacttggccctggacgcggccaacgtggcggacatttga

SEQ ID NO: 81441 - DNA, 1386 bp, Heterodera glycines
  Genomic contig location: Contig_ID=SeqID_17021; Location=743..2128; Strand=-
  SCN-specific regions: Sequence locations=1-197,219-281,306-376,398 -411,433-1386
  Gene Ontology: Mol. function=IMP dehydrogenase activity; Biological process=GTP biosynthesis
atcaaaaatggcattcggtccaaccatttctctaaattagcattttttgtttttgtaaacagggaaattgccgattgtgaatgaacgtgacgagttgacttctctgatcgcgcgaactgatctgaaaaaggcacgcgaattcccacgcagttcatacgacgcaaagaaacagctgatggttggcgcggcaattaccacgcgggaaaaggcgcgggaagcggtgaaagcactcgtaaaggcggaggtggacgtattggtcattgtgagttgggggggagggcgagggggaaagagggagaggaagatgaacgcgtacaacggactaaaaatagcaaacaaaccaagggcatgcccaagtgtcagcaggttcgactgctcgcattgttccagtttccaggattcttcaaatgggtccagcaaattccaagtggatttgctccgctggatcaaatccgaatttcccgaatggccacaagtgattgccggcaatgtggtgaccatgcgacaggcgaagttgctcattgaaaacggagccgacgcattgcgcgttggcatgggcagtgggagcatttgcatcactcaggaggtgggcgagtttcaattaacttcttctcattatgcaattgcccaattcaaggtttgtgcagttggccgtgctcagggctccgctgtgtataatgttgcgcgctttgccaaaaccttcggtgtgccggtgatcgccgatggcggcattcgcgacgtcgggtgcgcccgactattttaaatcaattgacctaatgttacacaatgtcccatttgactgttagttacatcaccaaggcgttggcattgggtgcttccactgttatgatgggcggtcttttggctgggactaatgaggtcatcccccatttacttccattgggctaattggctgtttttgcaggcgcctggtgagtatttctggggtccgtcgggcgttcgactgaagaaataccgcggcatgggctcattggacgcgatggaagccaacgagtgcagccaggacagatacttcacttggtctctgctctttcactgtcagcaaatgatttattgcttttttcatttagcgaagatggaaatatcaaagtggcccaaggcgtaactgctgcccaacgcgaccgcggaagtgttttcaaattcgtcccttacattctccgcggcattcagcacggacttcaggacatcggagttcgatccatcgccgagctctggtgtgttttttgttttgttttaatggactaattaatttctgaattaaggaacggagtcaattgcggtgccgtcaaattggaacggcgaacgcacagcgcacaattggagggaggcgttcactcaattcattcgtatgtttcgagacttatt

SEQ ID NO: 81442 - DNA, 105 bp, Heterodera glycines
  Genomic contig location: Contig_ID=SeqID_17022; Location=1100..1204; Strand=+
  SCN-specific regions: Sequence locations=1-105
atggtgctgctgctcttgctggtggtgttggatgggctgttcatgttggaagtgatgttgctgaagttgctcaaagttgccatcaaattgaagctgttgctgctg

SEQ ID NO: 81443 - DNA, 329 bp, Heterodera glycines
  Genomic contig location: Contig_ID=SeqID_17022; Location=217..545; Strand=-
  SCN-specific regions: Sequence locations=1-329
  Gene Ontology: Mol. function=IMP dehydrogenase activity; Cellular component=cytoplasm; Biological process=GTP biosynthesis
atggatgtcacttcgaatcccaacggatcggtcgaatttgaaaaggtcccaaaaagtctaaagaaaggttgtgctgacactgggctggattttgatgaggatggcctgacaattcacgaattgttcagccaaggcaccgggctcacgtacaatgacttcagtaacaaaaggaaaaaaattttttttttgaattttcatccctttagacattttgcccggttacatcgacttcccagtctctgacgtcgaattgggcacgcatttgacaaggaaaatccgtctcagtgcgccgcttgtttcttctccgatggacacagtcactgaaagcg

SEQ ID NO: 81444 - DNA, 933 bp, Heterodera glycines
  Genomic contig location: Contig_ID=SeqID_2757; Location=179..1111; Strand=-
  SCN-specific regions: Sequence locations=1-332,354-692,714-738,760-933
atgaaaacattaacgattactgtacgcaatgaaaaaagtgttaaggatgaggtattactgcaggagtacaattatagtagtacaaatattataaatacttaggatccagatcaaatatccggtacacatttatgatcctaagtattccaaatcagttaatttatggaaacaaatcagacattttggttggtcaacggccattatcgcaatagagcatggtggacagctaaacacatgtccgcatcccctaactccgaataacacttggcctttctctaggcaccaattgcaccgatcacttattatcaacttttttcctctgtctctctcgtattttccttttcttctcccctctctgtcactcgcttactcatcagttggccaatcaccgtcgcactttgtgccgcaattcgctgagtcctttgttgttctttgttcagcatcgtcgcccatttgtgatcaatccactgctcggcttccagcagattttgacggaatttttgctccatttgttggcgcatcgtttccatctgctcgtccgttatcgcggctgcaccttcttcaagctttcggctgcgcatttccctggccctcaatgtcctccgccaagcgcattttgatctgtgtgaacgccgccagtgcaagagcggtcacttcttaaaacttttcaattattcttttgcatttatatttttgacattaattataccccggtcttcttccgaaccaattttcgttttttggtttctgaagctgctgctgatgttgatgatgatgatgatgccggagccatagtccgctttaagcttgaaatagctattacgttcatctcctcatttccatatcgcagaactggatttgaattttgtgagagaaactgtacgaaaaactaattgaaaaaattatcgacgaatttggctgcagaataataaa

SEQ ID NO: 81445 - DNA, 240 bp, Heterodera glycines
  Genomic contig location: Contig_ID=SeqID_2757; Location=1149..1388; Strand=-
  SCN-specific regions: Sequence locations=1-240
atgcattgtttgaagcgttcaaagtgcgagaaggactgaatgaagattagaaaaaaggaggaaaaggcggaggaagcagatggcgaacaacaacaaaaaatggcacaaaaatttttttaattttcacatttatttttatgcattttcacattttttattttttatttaccttcagtaaaccaaattacaaaattgttcaggcaaatttcattttctatgggttgttgtgtgatcaaatag

SEQ ID NO: 81446 - DNA, 1361 bp, Heterodera glycines
  Genomic contig location: Contig_ID=SeqID_2757; Location=1777..3137; Strand=-
  SCN-specific regions: Sequence locations=1-19,42-47,90-126,177 -255,282-412,481-585,607-682,704-796,818-824,848-859,899-1104,1172 -1340
atggataaagggaatggaggcagaaatgtgtgtagaatggattggaacgaggaatggaaaagggaaattaatgaacaaaaagtaaaatatgtaaacccaaccatttttatcaacttatttttttccaaattaaaaaaaaacaattttaatttaaatttagattttaaactttaattggtaatagaaattgtcggcctgcccaattgtcgtcgcatcatgccaccaaaaagagtaaaataaaatcctgagattttcaaaaaataattatttattttttttttccagacatttgctgaactattaaaaccaattgttacgcgcagtgcacaacgacgtgaagcagcggaggacacggtgctggcaaaaaggcaaatgggcttcagaagagggccacttgcaaatcgtgagtttgattttaaaatttaataaattttaaatttaattataaattcattacatttcctttattaaattttttttggcaatttaagcgccgccacaaataccaccataaaatgaagaaggtctgccgttgccaatgccaccatcaaatgccgaagtcgtcgtcgaaccaaatggcacaacttcaacaacaacagtcaaagtcgccgcccgacagaaggccaagacttcatcgacaacaacagcagcaaaagtcgtcgccactcaaaatgccggctgctcatcatcatcaacagcagcaaatgtccgtcaaccgtcgttgtcgtcactttccgccgaagaaattgcacgacaaaaaaagggacaaaaacaaattcaacaaaaaactggcaagttttaataaaaagtttgaatttcatagcatttaaataattaaaaatattaacctttcattgtctttttaaattattataaaaattgttttaattatttttatcatatcttccaaaaattttttcttttttttacagccgtcgcccccatcaatccgcattcctaatggcaaaacgccgataaggtccgtccacgccgcccggaacccaaccagccggatgaccaatacgagctccgttcggtattggcgactgatgaagtggtgtccggtggcacgacacatctgtgtctgtatgtggattttcttggtataaattttttttgaatttttacatttaaaatttcaatttaaatttcgatttaatttttaaattttcagattatcaagggcaagagggtgtttatcaacgaaaagcgatgcccttgagctgacgcacttccacgacattgactctaccatcgactctacgctccatgcaattgtggaacgaccggtggcgccatttctacaacaacggcttaatgctcgcccactttttcatcaatgtaataaaaaatttttctaa

SEQ ID NO: 81447 - DNA, 202 bp, Heterodera glycines
  Genomic contig location: Contig_ID=SeqID_2758; Location=2547..2748; Strand=+
  SCN-specific regions: Sequence locations=1-75,138-202
atggctgtgaacattgagcgaaatttgaaagaagtgcaagaggaaatagtgaaaatgcaaaataggtactcttacaataattaattaaatttattttaattataatgtgcaaaatttgtgcagaaaaagacgattttgcgagttgctcgaaatgaatgaggtgaaaagtgcaatttttgcattataaaataattgaaaagaa

SEQ ID NO: 81448 - DNA, 113 bp, Heterodera glycines
  Genomic contig location: Contig_ID=SeqID_2758; Location=1329..1441; Strand=+
  SCN-specific regions: Sequence locations=1-113
gtagatggctgggcaattgatggggtcggctggtaggccacacgaggggtagaagtgtgaggtgtgcaccgtcgcggttgttagtgcagtagcagctcaggcgcagatgcgtg

SEQ ID NO: 81449 - DNA, 686 bp, Heterodera glycines
  Genomic contig location: Contig_ID=SeqID_2759; Location=248..933; Strand=+
  SCN-specific regions: Sequence locations=1-111,133-227,283-316,363 -365,402-686
atggtagcagtgaaattgcttgtatggaatgtggcaaaaagtaggtgtaattaataaaaaaagatttgagttttcgggtttatttggcgtgtgttttataggcgacacggcgtgttttcataaataaattatcatataacggaatttttatgtgatagaaatcttgaactatatattaaattatgtgctaaaaaacatgggcaaaatgtgccaaacttcgaaatatgtacaaaatgtttttatgtgaaaaaacgccaaaatatttttgttttaattttataagcgctcaaaatcaaattttgttcgaagaaaacgctattattttttcttgttaaattaaaatatatttttaaatttttaatcataaacctttttaagaaaaaatttgtttagtctataaataaatcttgatgagttaaaatatgcctaaaatgtttgcttttataaatattaaaaaaactttttcatcagattttcgccaacagaggaaaatgcgatgggctggcacattgtcaatgctcacgacaaatacgcggttaaactgctcaagaaacaactcgaaaaacagtgaaatgagacggcaaacaggcccgtaaccagggcgagggcagttgcccccccctggaaatgaaaaattgaattttttccagttcgaatttataagttttaaccaaatgctttaaaaa

SEQ ID NO: 81450 - DNA, 381 bp, Heterodera glycines
  Genomic contig location: Contig_ID=SeqID_2760; Location=1670..2050; Strand=+
  SCN-specific regions: Sequence locations=1-116,160-251,273-381
atgcgtgttgtcataaacggaagaaatgaggggaaggtcgagaacaaagaaaagggggacgaagaaaagccgaaacagagtgccgaagatggaaaaaatggctttgaggaggtgagatattttaaaacttttaaactacttaaaataattttttttaatgcaattaattaacctttagtttacaccagcatactttttttgcaattaagttagccaagggatattttaagcaatgaaaaaaatcttatcagtaaaaaaaattataaaaaattcaggatattgactcggatgctgacagttggggctgatttcaagcgatcaatgaaggacggaggagataagcaagaatttattaatttacatagatttattgcttattaa

SEQ ID NO: 81451 - DNA, 905 bp, Heterodera glycines
  Genomic contig location: Contig_ID=SeqID_17026; Location=750..1654; Strand=-
  SCN-specific regions: Sequence locations=1-221,243-410,432-609,631 -665,687-905
atgaaagagaagaagatgggcttaaactcgaacaggaaaatatcgctaattgtgcctgtctggggccatttggggtggcaaaaggcaatttgggcgtatttgaggcccatcaaagtgccgaaaaacagcgaaacaagcacaaaagtgccgaggtaaacagtgcgattcacttttgcatgccttaattttgaaattgcattttatatttaatgccaattcttaattaatttaatcaatttattaatgttgcaattcggcaccatttttcaaatgccaattggatgagtctgtccagcccggtcagtgcgattaatgccaaactcgcactgcagccgaccaacggaacgacaaggaatttgaacgcagtgaaataggggacgaaattgcggccggagagggaaacgcagaggaaaaataaatggccaaattggtggacagtctcaaaaagggcagtcaatgccaacagaaagctcgaagtgccacgaagagagctgcgaaagggaaagccaagctcaagaacagaaaagcgaaaatgcaaacattggaacagataattaaacgaaatcaaattaagcgtaatttagggacaataagcggggaaaagtaatcggaaacattatgccaaggcttagagcctttttgagtaagcttttgcctgtatttgaaggtgatcaaaaggatgccaatgttcatcaaaatgccggggacgacgatagcattgagcagcgatgccgtgaagatgagcattggggaatggccagagtctttgtattggacccacagctgaaaaagcattggctaacgtaattgaagaaccaattaaactttacctgataataggaataattttcattgagtccttcaatttgttgcccattcattttcgattttcggaatttaataaa

SEQ ID NO: 81452 - DNA, 570 bp, Heterodera glycines
  Genomic contig location: Contig_ID=SeqID_17026; Location=1659..2228; Strand=+
  SCN-specific regions: Sequence locations=1-380,424-570
atggccaattttatcgcaattgttttttatgtgttcatttgggtggtggtcaaatggaagaaatgcaagtttttttaaattcgaaatttgctttaattggcaattccaaattttggcatttttaatttcagtcggcagccaattgcccaccaatgccatcaaatcaaagaccaacaccaacgcgcgtttgttcaagtcactggtggtgatcatttcgatcagcatcggctgctatctgatcagtgccgtcgtccgactgttcgttttgccgccctggcacttggaccaagtcaaagtgtggtttgtggagctgtactttggcattctgttgaatgtcggcgttgcgctgaatgcgccggtgcttttcatttgcaggtggcaaaatttttcaatttttaaatatttttcgattttaaattttaacgaataattaccaatttagcaaggattaccgcaaatgctttgtgcgtgaatttgcacttctcagaagcaaattggcaaaattgcacaaaacatttctaaaaggtgcttaaattcaatcgcttcctaacattatttaatttataatga

SEQ ID NO: 81453 - DNA, 1364 bp, Heterodera glycines
  Genomic contig location: Contig_ID=SeqID_17028; Location=595..1958; Strand=-
  SCN-specific regions: Sequence locations=1-341,373-539,562-970,999 -1138,1167-1278,1304-1364
atggacaatctgtggaaaatatttgggattcatttgaaaaaattgccggattttgaaaatagccaaaagaaattggagcgaaattcgctgaagccaatgcacgactttttggaagttttggagaaaaacattggcaaaaagaacacagaaaaagggacccaaagacagcgaattttggtggaaaattacgcggcacttttgacggattcgctggtggaagacgcaaaactccgcacggagttcaaacgaagggcgcgtgtccggcagagactgcgcaaaatgttcgaattcgccgagggaaatttgggaatatttgaggacgaattttggaacattttcaatggtaataaatttttaaaaaagagaaaacattgcaattagtcaattcgcacttaaaaaaaaggatttaataaaaatgaagaacagtggcaaaaagaggagagcgaaaaagaaacgatgggaaaaagaaaagagaagcgaaaattggcggaaaaggaaaagcgagaaattgacattgtaaattgggcgggggggggatgattggcattggcattggcatttaaattccaattaaaatttcagaatgacgctttgctgttccttggtaaaaaaaacacacttttagtcacattcaaaaattagtgcttttttatcttagaaaaggtcaaaagcaaattcgcaaatgagatgcaaaattatgaacagtttctaaaaattatgcgaaaatttagggaaggaaagtgagtttaatgggcaaatggcccaaattcacaggcaatttattaaagagttaattcggccaaactgttcaaaaaaattgagaatttattcgagggcgatttcaaactgatcgaagaatttatgcgatttacagtgaataaatttgaagaaacaaaggaaaaggacgcagagagtagcagaagcaaaagtgaaggaataaaaggcaaaaggaattaattactaatgatgcatttaaaataatttaataataattaattcaattggcaaattcagtgaacggaagggaaaaaggcaaacggaaggaaaacgaatcagcagaaaaagacggaggggaagaagcacaatcggacggatggaaactgataaagcaaattggggagcaatcgggtaaaatgccaaaaaagggagggggaggggaataattaatggcatcagcagagcaattacaaaaacaatttgaaaaaacgacggaaatttacgacaaattcgtgaaaacggtgcgcggagttgcggcggaaatgtgaaattaatcaattcattaaaattttaaaaatattttaaagggacaaaaaacaaactggagaacaatgcataggaattatttgcactggcggagaaataaa

SEQ ID NO: 81454 - DNA, 1304 bp, Heterodera glycines
  Genomic contig location: Contig_ID=SeqID_17031; Location=1192..2495; Strand=+
  SCN-specific regions: Sequence locations=1-41,63-87,109-283,307 -533,555-605,658-829,851-1058,1082-1304
atgccacaactgggcatcaaaggaactgccggcattttgaacattttctgttgcatttatttcctttacagtttgcacaaattgcagacaagccgtgccatgatgaaaatggtaggccaaataggatcttagcaaagaagtcaacattttttgttaccatggactggtacagtaggccagggatgttgcgagaacaaaattctattaagagaaacgagaaaagcgagacaaaaatgcgagaaaagcgagaccaaaagtcaaataaaacattgactttgtgaagggatgatgagattggagatgggagaattgggtgtgatcagttgggttgacccaaattgccaaaaacctcccctgcgttcattagtgcgcacttatgtatcagaggagtactcaataaaaaaagaatgaaaaatcacataaaactaattaatgaaaatcgtgagaattttgcgtataaataataggaaaatttcaattttctaatttttttttagaaaaaccatctcgtcattgtgacaatatgcttcgcaatatgccttgactttttccccgcatttctcagcatcggcttaactattgtaagccaatttcggtcaaattagaattaaaaaatgaattaaattcaatttaaaagttctatatattattaaaaatgcaaaatggactttcgaaatgaaaaattaaatttttttcgaagaaattgatttttttttaaattagctaattttctttaacaaatttgactctaaattttccagatccaagttttcttattttttttttgccaaaatgtgtctcaatatattcaaaatttggtgaaaatggctaaaatttccgttttttcccaaggagccaaaaatttaaaaaaaaaaacactggcaaaaattttttggccggaagagcaaaaaaaaaaaagtgtccctcccgattttttttggcctgttgcaaaattacttatttagttcggctctggcttgctctcaaacgtggcatccaccagcactgtgttggactcgctgtgctgtgccatttatttttcgctagtgtttgtgccacccagctggctgaaacggggtggtgccaataatgccaatgccattggtggcacaacaaatattcaacagcaacgacaacactcgcaactgcaaccgcaacaacgcactaatcgaattgcttcaactgttagcatgatgagtccaattattgtgccagcattgaatcgccatccgccgattagccggtacagtgacggaatggtacaaattggtacggtatcggcaacagttcgtcatggaacatag

SEQ ID NO: 81455 - DNA, 485 bp, Heterodera glycines
  Genomic contig location: Contig_ID=SeqID_17031; Location=2912..3396; Strand=-
  SCN-specific regions: Sequence locations=1-51,129-131,289-385,417-485
atggcaacaattggaattggaggtaatatttttcacatataaaattatcaatattttactttttttattgccacctttattttttaaattattttttaattaattttgatttttttttctatttttataacttattaataaaataaatgaatgttgaaaaatattattatttataattttatttaaaaaaattcaaatgtaaaagaatggtttttatagtcattaaattagtatatttttttaaattatttaataaatttatttatattttaattaattttaattttagattttcatcccgacgctgccaatgtgttggaagcagctgttgccatcgttttcctgggctccggcattggactattagctgctttaatgatcggcattgcttatcatttccaatcattgtttttcatcaccctgaggggatggcttttaaagcgaattcagttcagcaaacaacaaaagtgatcaatcaaaataaa

SEQ ID NO: 81456 - DNA, 99 bp, Heterodera glycines
  Genomic contig location: Contig_ID=SeqID_17033; Location=836..934; Strand=+
  SCN-specific regions: Sequence locations=1-99
ttgttcatgttgttgactgcaattattctggccgtgattgctgtgatgaacccatcttggcaaactgtggacattcgcgagtttcaggcggaacaccat

SEQ ID NO: 81457 - DNA, 1619 bp, Heterodera glycines
  Genomic contig location: Contig_ID=SeqID_17034; Location=341..1959; Strand=-
  SCN-specific regions: Sequence locations=1-189,211-1098,1120-1619
atggaactggaaattgatttgaaccgagccttcggaattccggcaattcgtgccgtggaaaacaaaaaggaattggacgcatgtttggcccaatatccggaggttttccaggacggagtcggacgatgcaaaaagatggcgtcgctgaaattcaaggagggatgccaaccgaagcgatgcaagccgagaccagtgccattttctcttcgcaatgaagttgaaaaggttttggaccaatggcagtcggagaaaatcatcgagccagtggcaaccagtgaatgggccactccgctggtcattgtgccaaaggcaaatggcaagctgcggctgtgctttgactgcaaagtcacggtaaatccttggttggatgtgcatcaataccctcttccacgccccgaggagctgttcagcatcttgaatggtggcgaaaaattttcaaaaatcgatttgaaggacgcatatttacaacttttgcttgatgaaaaggcaaagagttgtctcacaatttgcacgcacaaaggacttttccacttcgctcggttgccattcggagttgcttcggcacccgcaatttttcagcaagtaatggaagaagttctgctgggcattgatggcgtggcagtttatctggatgatattctgatcacagcagcactgatcagcaacatgtcaaaagaatcgaccaggttcttaaacggttgtctgagaacggacttcgagtcaagcgtgaaaaatgtgaattcctcaaaccggaaatcgaatatttgggacacattgtggacaaaaaaggtctgcatgcgtcacctggcaaaatcgagacaattttgaaaatgccggagccgaaaaatctgaaagaattgcagtcatttctgggaatggtgaactattatggaaaatttgtgccatccctggcaacgctttcagaaccactcaatgaattaaggcgaaatgacgccaaatggacatggacaaagagccaacaaaaggcattcgatgggatcaaaaaggttttgacatcaaccgaagttttggtccattatgacccgcaaaaaccactttttctggccgctgacgcgtccgactatggagttggagcggtcatttttcacaaagatgaaaaaggaaaagttggtgtgattgcgtattcctcccgaacgctaaattcttcggagcgcaattactcgcaaattgaaaaagaagcgagggcaatcattttcggagtcgacaaattcaagcagtacttgtacggtcgaaagttcgtacttcaaactgaccacgagccactaaaaaagatttttgggccaaaaggagagctcccgattgttgcggcaaaacgacttcatcgatggtcactgacattgatgaacttcgattttgaagttgtgtactgctctacaaaagaatttggcaatgcagacggtctgtcgcgattgccgtgtccggaagagacaaccatcgactgtgttggactggaagttcagcaagttcaggccgaaaatatttcatgcctgccggtcacagtcagtgccatcgcaaaagaagtcaaaaaggatgaaattcttcgaaaagtgaaagaatttatcgaaaaaggatggccacaaaagtcgaagaaggactaa

SEQ ID NO: 81458 - DNA, 1128 bp, Heterodera glycines
  Genomic contig location: Contig_ID=SeqID_17035; Location=1112..2239; Strand=+
  SCN-specific regions: Sequence locations=1-598,623-1056,1078-1128
atgtcgggatttttgcgtacaaaaatcgcaatagagctaaaggctcttgagaaggcgaaaacggcaacagaattgtatgctgagccggaccaaactctgacctcattggaaaatgcaattctcctggaaagcgcggcagagagaataaagtcagaggtggaggcagtgaatgccaaaattgagcaaatttggataaccgcaagcaaatggcatgacgtcatacaaaaaatggacaaggacgaaagaaaaagtgagcagacagcgtatgaacaatttcaaacaacggagaaactgaacacaaaaatggaagcagccaacacaaagctaacagagcttaaggacctggagatgaaggtggaagcaggagcaaagctgcaacgctccaaagcggacagagacgcgcgagtggagcaaagagaacatgcaaaagcaatggcgaagtcaaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcctggaagagaaaaattacgaaattgccatgaagctgttaaaggacacctatggagacaaaggcgaatatgtaaggaggttgcacacggagttgtcgaacctcaagcgatgcttttcggtggaagacacaaagcatttttgcatggaattggaacgcctagcaagagaattggaagcagcggaagaagacattgaagggccgccaatttatttaatgcttgagaagaagctatacaagcctttcctgcgtgaaattctggaagagaaagcaaaaaatccagacttttgggacacgtcatccctccgaaaggccttaggaagtgcattgagcaaagagctagcaatcaaagaagtcatgagggagtatggcttcgaaggcaaagaggcaaatccagagcatggattcaaacggcaattaaggcggaacagattcggaggctcagtcaat

SEQ ID NO: 81459 - DNA, 1104 bp, Heterodera glycines
  Genomic contig location: Contig_ID=SeqID_17036; Location=1015..2118; Strand=-
  SCN-specific regions: Sequence locations=1-1104
atggaaaaatcaatagaaaatgtgttggaacgactctacaatgacccaaaatcgcctgccgcattcgctggcgtagaccgattatggttggaagccaaaaaggaacttggccataaagtttctaaaaaggatgtaaaacactatttggaggggcatcgcacatacactttaatgcgtccaagacgtattaacttccctcgttcacgaacaacagctgctggctttatgacagactgtcaggtggatttggcggattttcaatcgctttctcgacacaacagcggcaatcgatacataatggttgtaattgatgtgctttctaagcaaatatttgttacaccacttcgcacaaagaaggccgatgacatggttgagggctttaagagtgttttttccaaaatgccgatgaaaccccaccgaattttcttagacaagggcaccgagtttaaaaatcagcagttgaaaaagctatttgatgaagaggaagtcgagaaatatgagagcacacactctgagaaaaaggcagcattggccgagcgtgctattcgacaaattaaaaatcgtgtctatcgttattttgctcaactcaaaactctcaactgggtgaatgtaatcgacaaaattgttagtggaatcaacaattcaccgattcgtgtacatggcatgcgaccaatcgatgtgaactttaaaaattctcaaaaagtgtgggaaagaatgtttggtgcagaccagcacagagcactttttggtaagcacagaaaaagaccaaaatttatgcccgaccagacggtgagaatgagcatagccaaaggtcaatttgagaaaggatacataccaaactacggcgatgaaattcttgaaattgatgccgtcaaacggcatacgaaaccaatgcgttataagttacgtgatgcaaaaggagaaaagtttaaaggattcttttaccctgaagaattgactcccgtacgtaaggaagctgagacggcatacagaattgagcgagtttttcgaaagcggaagcgggctgatggaacgatggaagtattagttaaatttatcggttatcccgaaagagaatggattcatgagacacaacttgtataa

SEQ ID NO: 81460 - DNA, 1746 bp, Heterodera glycines
  Genomic contig location: Contig_ID=SeqID_2761; Location=66..1811; Strand=+
  SCN-specific regions: Sequence locations=1-217,254-457,480-828,850 -1244,1268-1274,1297-1424,1451-1456,1480-1746
atggtgttgatgttccggcgtgcggtgtttcaggacgatgttacggtgtacccggtcgccatacggtaggtttatgaccggattctgtttttgtaagcctatcattcatgtaatttgtgctcaatttaaggcaagaggcccgattcggagatgcgtactggagtgaggacaatttcatgcactacctgttcagggtgatgacctcgtgggcaattgtgtacaatgtgcactatttgggtgtgttttggggtgtcgcaaatgaaaattttctaaacttatttattttagctttattgcagtttacccgaccattaaataattagacaatgacaaattaatgtactattacgttttctaggataatcctaattagatatcttggtatcattccatagccccaagaatcccaatattaatgtatgtaatttggatgctttagaaaaaaatgatgcattaaaattgtcaaagattttatggttggtcgtgtgaactgcattagagcctttattattcaatttaagcatctaatatttatttgtttaaagctcctcaacatcgacgaccgaatgaaaatgccacggaatttgcggcacgggttcagcgactgatcgccactcgggtgggcgtccgtccgattgcttacgatgggggcggaatttggtgggtgttcgtttatctgtctgacatgaatagtcatgcataatttgcatttggtcgctttcaggtacaaaccgaccgaccgacaaaaggcacacgtcgaatggcaaaagcgctgcgcgagcaatttggaggaactgttgagcacggaagtggtgtcaacaacgggcactgaagaggaggagggcgaggcgaaggaggtgaatttgcggatggggtgggaatggaagacatttcaatttgttttttattttattggtcgtcaaattcaatgccatttagaagacggggcaggatggacacctttccaagggcgtagcaagaatttttggccgattttttaaacagatttccctaaaaatggcgattttttggtcgaattttattgcttttaagggaatattgattcaggcggtgcctatagatgccgccggggggaacttttgagttttttttgatgaaatttcttacaattaacaaaatggtataccattttttttaattttcccattttcattaaaaattttcatttttcggtttcggagaggttccccgttcccccccccccctcgctacgcctttgaacctttcatttaattgaatctttcaataccgaatggattaattcatttttaaaattccggtcgttccatttcaagcaactgattgttcggtcaatttcctcggatgggaccgaagaggggggaacttttgtcgctgaaccgtccaaacatgatgaagaacagctgcaacatgagcaacaaaaaagtgccactgctgctgctgtgactcaaaagcggagggaggaacgccgtcgtcggatgagtcaaagcgtcgagtccgttgtggacgacgtggtcggcgcagcagttggcgaagacagcgacgagatggacttgatcggctgaccgaccaaacacacagatccgattggaatgaggacgacaaatgattatgatgatgataatgcttttgctggatcatgattatgttctaacacatttattcttggcaaggcgcctgctctgatggacattcttttgtcagtataattttttgatgtagtaactgacttctcgagaagtgaaa

SEQ ID NO: 81461 - DNA, 1906 bp, Heterodera glycines; identical to SEQ ID NO: 2762
  Genomic contig location: Contig_ID=SeqID_2762; Location=1..1906; Strand=+
  SCN-specific regions: Sequence locations=1-347,370-481,504-1037,1060 -1328,1366-1554,1576-1758,1782-1906
  Gene Ontology: Mol. function=ATP-binding cassette (ABC) transporter activity; Cellular component=integral peroxisomal membrane; Biological process=peroxisomal long-chain fatty acid import

SEQ ID NO: 81462 - DNA, 1406 bp, Heterodera glycines; identical to SEQ ID NO: 2763
  misc_feature (20)..(20): n is a, c, g, or t
  Genomic contig location: Contig_ID=SeqID_2763; Location=1..1406; Strand=+
  SCN-specific regions: Sequence locations=1-251,273-440,471-490,513 -559,588-708,740-754,798-1134,1179-1406
  Gene Ontology: Mol. function=nucleotide binding; Cellular component =extracellular space; Biological process=peroxisomal long-chain fatty acid import

SEQ ID NO: 81463 - DNA, 316 bp, Heterodera glycines
  Genomic contig location: Contig_ID=SeqID_2763; Location=883..1198; Strand=-
  SCN-specific regions: Sequence locations=1-20,65-316
atggccggagccggggcggaaggaggacagggagcaggaggaggacgagttggaggaggaggagaacaacagtgccggaggggacgacggtgcggttgtgctgttgctgtgctggtcatctgagtgtgagtgatgggcgagtgggaaaaacatttcgggaaggcccctaatataaaaattcggaggggggggggggggaatccgaagggttttttgctattcggccattacaaatttttcaaattgtacatttttcagaaaaaataaatttcccgtcagaaagtgaacaattttgtgcacttctggcaaaattaaa

SEQ ID NO: 81464 - DNA, 738 bp, Heterodera glycines
  Genomic contig location: Contig_ID=SeqID_2764; Location=1635..2372; Strand=-
  SCN-specific regions: Sequence locations=1-70,118-425,455-563,585 -667,689-738
atggtgtgtcccccgttttttgagcgtgctccctccatcatcaacaaacccaacgggtgctccatcttagaaatttaaaataatttaaatattacatattttttatttttaaattttgtttgtcgtttgtcagttcggtgctgttcgagtgcatttgcaacgcgaaccccgagccgacggtcaaatggtttttgaaggacaaagaattggcgggcgatcgcttcgtcagcaaagtgaagaagcaagtgggcaagtacttgtgcacactgaccatcaaagtgagtaatgacagaaaagcaaatggaaaaaggcacccacttaattacctaattagtcaattaatgagcaattgctgtttcatttaaattgaagaaataaaattgaaaataaatgaaaaaaagaatagttttgtaaaactttttccgaacgtaataaaaataaataaagcaatttattattcgcttttgaatgctaatcatttttcgtttaatatcactaatatattttaaatttagtctccaaatcagcaagatcaaggcatttacaaggtgatttaaagaaagaaatttaattataatttaattgggtccaaaggtcgtcgctacgaacccccaggggacgcactccgtctcccaaaattacatgctgatgtgcaccgccaacgaagtgttcaaaacccaaatggactgaaaacggataaatttttacaaaaatttccaacggattttcaaaaataaa

SEQ ID NO: 81465 - DNA, 1160 bp, Heterodera glycines
  Genomic contig location: Contig_ID=SeqID_2764; Location=1..1160; Strand=+
  SCN-specific regions: Sequence locations=22-144,167-599,621-668,690 -780,802-1015,1046-1160
  Gene Ontology: Mol. function=ATP-binding cassette (ABC) transporter activity; Cellular component=integral peroxisomal membrane; Biological process=peroxisomal long-chain fatty acid import
aaaatttcattcattttttctcttccattttcatgttcctgcttggcgaactgtggcccctgtggggcggcacaatgatcttaccggccaagggcaagctgttctatgtcccccaagtgaattaacccaacataaatttgtcagcattctttttattaaatttgtttttcagcgtccctacatgaccatcggctccctgagggatcaggcaatttgccacgggattggctttttgaatttactgccattgtcaggtcatttacccggaccgtccggcggacatgcgtcgccgtgggttcaccgacagtgcgctggaggcactgcttgaccaagtgcagttgcgcaacattttggagcgcgaggggggctgggagggccaacaggactggatggacgtgctgagcgggggcgaaaagcaacgcattgcggttagtggagcaccacctaaaccagacattgttttttcgttcgctttaatctcctcccttctctcgtgtctgcagatggcccgcctgttctaccacagtccgcagttcgccattttggacgagtgcacttccgccgtgtcggccgacgttgaggacgccatctaccgacgatgccatgagttgggcatcactttgttcaccgtttcccatcgcaaatcgctgtggaagtgagtcaagtgttattgggtttattgaaattcacaaatttggaaacaattcgtactcaattcaacgacttacacataaattactccgaaaatgagactctgcaatataattctccaactacgaaaatttgtgcagaggacaaaattttgtcacctgcattttttagaaaaacttaacggaaatttttcaagaaaaaatctttaaaaaatttttctatgaaaattcaaaaaaattcagctccgagattttgggtgcatccgaaaaaaatttgaagctttgactgtcggtttctctgattagaattctccaaattaggacaaatcttcagaataaggaaacatcttcaaattctctcattgttttttattacaattttatttattttatttgctttattttccccgccccttaaggcaccatgacttctctctgcacatggacggccggggccactacgattttaagcggatcgaccacgacaacccggcggagcagttcggctca

SEQ ID NO: 81466 - DNA, 2100 bp, Heterodera glycines
  Genomic contig location: Contig_ID=SeqID_2765; Location=266..2365; Strand=-
  SCN-specific regions: Sequence locations=1-366,400-1086,1117 -1303,1339-1508,1531-2100
  Gene Ontology: Mol. function=protein translocase activity; Cellular component=membrane; Biological process=intracellular protein transport
atgaccctttcatttgccaatttactaattactcccctaattcatgtccttcccaatttgttaaaggccaaccggtggatgttcatgtcgacgtcgagcaattacaaagtgttggccgcttgctttgacgtcgcattggtcgcactgattattggcagtgtcaaaatgttgtccgattcgccagtggtaagataaaaaaataaaaaattccaaaaacataaccattttttcttttttttagattttctccctctattggtgttgtgtgctcaccaccggcttattggaaacgcttttgctgcgcagcccaaaagtatgtacaaattcaattttaaataaatttctaattaagtacccgttaaagcgtttattaatttttataatttataaatttttaatccacaaaattttattttgtccattttaaatcccatggtctttcattttcaacaaatacataccattgcttttcatttgaactaattttttgttccttggcaggtgaagcgtctcttttccatcggtccgttgcccgacgacgcggaaaaacccttccgttcgctgtttcggcgccgcatttacgtcccctattccatgcactgattggcactttgttttttgtcatttgtggtggcactttttcgctcttttctgccatttaaagtattttttgggatctcattcccccgaaaagtgtcacttttgcatatttttttagactccgtttgtttatttttttctgtatactttgttttttttgttaaaattttctgttcattatttacccaatcattttaattttggtgatacttaaattcatttttttaaatttttcaaataatctgccattgaaagtgaatggaaacttttcgcattgatccttcaagctccattgatcggctcagtcggcttttccccaacccttttcggagggatgagcaaggccaatcggaggaagggcaccagcaagaacagcagcaggtgggccaacagaatgggcggattcattggggattatacttttggcactttgagtgacgggattggccattagttcttggcattttccctttgattttctgtttatcatttcactttcctttcccagcagcctccttttgtgtacactccgtccgcttttgttcgccaaatcgacgaaatgatcggctcgcggacgcgcccatggcgaaagagtgggccgggaataatcactccaatttattccacttttccgtacagttgccaacggcgttgatgaggacgttcagttgcgcatcgccagagttgttcaggtgtttcccaattcctttgcccttcaaatttttattttccattttgccgttctcaaaattcctcgagactctcgagagaagcccctatcatttgtcaacacatcatttattaaaatgcatctacttgtctgtccccttttcagtccaattttgcattgcctccgatgagtcgcgaggagcgcgtgatggcctccgttatggttgtccggcaatttcattaaattaaatttttttaattctcccctccccttttacaggaaaattgtgccttcaaatcggtggttgcgtgtgcgttaggtgccggcatcggcgttctgttcggcctgtttactgtcagcgtggacccaagttatgcgatcagcaaagacccgaccaagccggtatgttggcatttacaatatttccacttttttaaagtagattactattttttatttgattttcaatgtttacttttcatcctccatttttccattttcagctgtcattgcgcgagacgtggaccgaaatgaagacgcgggtgggccgttactcgcgaaactttgcctccatcggtttactttttgctggcactgaatgcattttggagacgacacgcgcaaaaagcgactggagaaatggtgggaattggagaaaaaatcaaaaaattccactcttaaaattcggtttctccccctttttaggcactctttcgggtgccatcgttggcggaatgttgggattccgtgccggccttcagcccgctttgctgggcgccgccggatttgccgccttttcaacggccatcgaattttacatgcgaagataa

SEQ ID NO: 81467 - DNA, 825 bp, Heterodera glycines
  Genomic contig location: Contig_ID=SeqID_2766; Location=1563..2387; Strand=+
  SCN-specific regions: Sequence locations=1-474,498-825
atgacggccaaattggaaatgttccgccaaaaaagtcggacgaaaccgcccaaaaagatcggcagaaagtcgtgcgaatggacggcgccggagacggacaatccgggaaaagcgatttacgcagtcactcgccctttgctggtggaacacaaggagaaactcaccaaactgagggaccagctgaaggcgcaaattgaggtaggcgaaaatgagcggtttttttttgtcaaaacaatgaaagttattagaaattggtgccatcccgcgggaaagttttttttttttttgatgaattgcgagattggtaaaagacaaaacgttcaatgcctaaaaatgcaggaatgttcaaaaaatgttctttagactgatactttttgggtaaaattgacaattcaagcagtttttcttattcaaattaaaaaacaattcttaaggccgcgaatcggcccgccaatagcgaccattatatggccgtctaatttattttgcctatttttgggaaatggactctccagtcccgagtctgtaacccgactcattgtcagagttgttgccgcggcctaaaattgcaataagctccaatctcacagcggggggaaccctgtctcccataaacaaaatattaaaaaaatatttctttaggccaatgaaagggaattgatggaagaagattaaacagcgacagaacatattcaaaattctgatgctaattatgatgatgacggtctctctctcttctcagcaattcctttgtctctgagtgacaaaatatttattttatgtcgccaattttaatgctttatctctcttttttgtttttcgtga

SEQ ID NO: 81468 - DNA, 208 bp, Heterodera glycines
  Genomic contig location: Contig_ID=SeqID_2766; Location=371..578; Strand=-
  SCN-specific regions: Sequence locations=1-53,77-168,190-208
atgacctttgttcgccatttcccccacttttcatttgatttgtccctgttcagttttgtcttccgtctctctgctcggtccgtcctcctccgttcttttgctcgcggtcggtctccgattggccaccgttccggtgagaattctcaccgaaaaactgacgtctcaacgtctgatgatggtccacttggtgcgcaagcaggtgtacgag

SEQ ID NO: 81469 - DNA, 731 bp, Heterodera glycines
  Genomic contig location: Contig_ID=SeqID_17037; Location=168..898; Strand=-
  SCN-specific regions: Sequence locations=1-36,94-183,221-320,424 -706,729-731
atgctcgagaattcatcggctcagctcaaggtgggcaaataaataaattaaaaaataagattaatttaatttaaataattaatttttatttttcaagacaacgaaatcgttgttatttgcttgaagagcgtgaacaaggcatggccacttcaatgagcattccacaaacgccattagtaaaagaaaatttaaaaaaacttattttttaattaattaaaaagtttgcgcatcatttattaaattttggaataattcgaaaattcgatggaaaaaatttgtttgtttatgttcggagtcaaaagttatgtgaaaagaaattcaataatttatttaaaaaatggttatgtaaattttagatttttctttgataaaataacaaaaaattaaacactataaaattgtaattttaaattaatttaaaatctcaggaaagtgccgtttcattcacaacgccaacaccattgccaatggctgatatccggctgaattccgccgcgtatggcactttttatatggaacaaatgcgcgaaaatggcacccgagatgaagccaacatttggccaagaaccaaaaatagcgtggaacaaaaagaaggatcactaaacaatggtggcattgaatggcaacgaaaaatcaagcgaagaaagacatcagcagtacaacatcaggtggtttttaatatcaagtttttttttgggcaaaaggcaaaaatttcaacaaaaaagggctaa

SEQ ID NO: 81470 - DNA, 280 bp, Heterodera glycines
  Genomic contig location: Contig_ID=SeqID_17038; Location=359..638; Strand=-
  SCN-specific regions: Sequence locations=1-87,109-140,182-280
atgagttggatcccattttttctcgaccaccgaagccttccggcccgaattacacttgctgtctcgtcactaatgagcatcacttttcaatatggaaacattttgaaatcacttccccgtgttaggtatataaaatgaacaaaattttatttttaaattaaaaatttgaaaattaataaatctaggcttcccaaattatccaattctatgattttttggtacataagttgggctttcgtgctcatatttttgcattagacaaaattaatagaaaaataaa

SEQ ID NO: 81471 - DNA, 704 bp, Heterodera glycines
  Genomic contig location: Contig_ID=SeqID_17040; Location=83..786; Strand=-
  SCN-specific regions: Sequence locations=1-704
  Gene Ontology: Cellular component=integral to membrane
attccgaattatcgttggaaaaaatttaaaaaaatcttttttccataggtttcaaaggcattgcgccgtcgcagcccctggacggacaaggacgagttgctggacgtgctctactggggacgccaactgctggccctgtgcattggcatttgttggggcctcgtgccgatgaaaggtgccattgcgctgctcctctacattctcatcacctccgctgtcggccattcctatttgacctggttccaagaggcacgtcgccaacattccgtttattttggccaattttaattgtaaattggtgcccttgaattcatggaaaaagtaaaatggtggcataattcctcaaaaattcagtgatcatatagcaagtgtcagggcaaccaaatgggcccgattacaatttttgagatttaaacaaatctgttttcccggaacgggttctcaattttgtaatgtaattcattagagtccggacgacggactttgacgccactcgacacttttaccgggccaaattgtctaattgtatgcccgggcccgtcaatttcatccgggctctattcatgttgtttcaatttgcgctatttcagcaagatgatgaggagtttggcggcttttgggaaattgccaaggagggatttggcgctgctttcgcaacatttatgggtacgtatgttacccttttttgctatttcaaaattagt

SEQ ID NO: 81472 - DNA, 605 bp, Heterodera glycines
  Genomic contig location: Contig_ID=SeqID_17042; Location=440..1044; Strand=-
  SCN-specific regions: Sequence locations=1-122,144-429,451-605
ttaattcaatagtagacgaatataatgaaaatataatcaaatagattgccgggggaatatcacacttatttaagtattgatgaaagcgatccaaacagtgattttcctatctcacatgaaattttaaattctttaaagtgtccaagccttccaaatcataaaatagagcttaaaactaattcaatgataatgttgttgagaaatttaaatgttcgagaagggttgtgtaatgggacaagaatgcaaataaaagaaatgggagaccatgtaattagttgtgtgattaaaagtggggataaaaccggagaaacgacattaattccaaggattactttacttgaagacaaaaaatttccatttcctttgcggaggcatcaatttcctattaaacctgcttttgcttttacgataaacaaaagccaatcacaaactttttcaaaaattgggattgattataccgatgaaccatttgcccatggacaaacttatgttgcattttctcgctgtaaatcatggaaaggcttaaaaataaaacttttggatgacaaaaagaaaggaaaatcaaaaacattgtgtggcaagagattttaaaataaagaaaaata

SEQ ID NO: 81473 - DNA, 326 bp, Heterodera glycines
  Genomic contig location: Contig_ID=SeqID_17044; Location=2005..2330; Strand=+
  SCN-specific regions: Sequence locations=1-326
tcgcgggcactgccccgaaaactgaaaaatgtattctttcaagttgaccgattggggtactcaaacaattatggggagcaaaaatccaacgcagaattaaagtacaggctatagggaagctattccggaaggattcggtctccccataaatctgggcgcatcggttcggagggactgccccgaaaacaaaaaaatcgattatttcaagtgtccgtttgcggtactcaaacatttatggcgagcaaaaatccaacgcagaattaaagtacaggctatagggaagctattcccgaaggatccggtctccccataaatctgggcgcatc

SEQ ID NO: 81474 - DNA, 686 bp, Heterodera glycines
  Genomic contig location: Contig_ID=SeqID_17045; Location=62..747; Strand=-
  SCN-specific regions: Sequence locations=1-120,142-216,245-304,326 -370,446-485,646-686
  Gene Ontology: Mol. function=structural constituent of cytoskeleton; Cellular component=insoluble fraction; Biological process=epidermal differentiation
ggtacagctatcactttttttactccatacaacggtccaaaggctcgtgatctcatcaaggtgttggaagaggctaaacaagtgagtgcatatcgaattgaaacgatttggcatcaaatttatccaattttcagaatgtgccagtcgaacttgccaaccttgcgaacaatgtatctgataacggttacggagaccgtcgtggccggtcgtatggtcgtggaggaggtggtggcggtggctactcgggatccagctttgcgccaactggtgccaatcgttccgctttcaactccggtggtggaggcagcttcagagggggaggaggatcgggaggcggaagcagaggagggtacggtagctccaacagctatggtggtggtggtagtggctatggcggtggcgccagctacggtggtagtggcggtggcgccagctacggcggtggaaacagctacggtggagctggagctagtcgcaacaccagaggaggaggcggctccggtggcagcagttacggaagcggcgccggcggaggcagcaactaccgcggtggaggtggctccggtagtggtgctggtttcaaggccagcggaggaagtcgcggcggtggttctggcgccggttgggcaggtggcggtggaggcgattcgaattggggaggcagcggcggatggagtgccaactga

SEQ ID NO: 81475 - DNA, 565 bp, Heterodera glycines
  Genomic contig location: Contig_ID=SeqID_17045; Location=1..565; Strand=+
  SCN-specific regions: Sequence locations=1-102,263-302,378-422,444 -503,532-565
  Gene Ontology: Mol. function=RNA binding; Cellular component=nucleus; Biological process=mRNA processing
ctctgaaacaaaacaaaagtatcaaaaagacaacaatttgaccgcctcttaagttgctcaatcagttggcactccatccgccgctgcctccccaattcgaatcgcctccaccgccacctgcccaaccggcgccagaaccaccgccgcgacttcctccgctggccttgaaaccagcaccactaccggagccacctccaccgcggtagttgctgcctccgccggcgccgcttccgtaactgctgccaccggagccgcctcctcctctggtgttgcgactagctccagctccaccgtagctgtttccaccgccgtagctggcgccaccgccactaccaccgtagctggcgccaccgccatagccactaccaccaccaccatagctgttggagctaccgtaccctcctctgcttccgcctcccgatcctcctccccctctgaagctgcctccaccaccggagttgaaagcggaacgattggcaccagttggcgcaaagctggatcccgagtagccaccgccaccacctcctccacgaccatacgaccggccacgacggtctccgtaacc

SEQ ID NO: 81476 - DNA, 576 bp, Heterodera glycines
  Genomic contig location: Contig_ID=SeqID_17046; Location=1346..1921; Strand=+
  SCN-specific regions: Sequence locations=1-120,146-576
atggttcgaattttgttgccaaacggtgagtcggccaacgtcagtccttcagaaagtgttgaagaagcgattaagcattgcgttggtggagatatttcatcgcagaatgactattgtgagtttttttaatttaatttaaaaaatagaatttgaattctcccttttcagcattggttttctttggtcgcaaattaaactccgaccaacgcttagctgacattccgcatttggacggcgagtcacgctcagttcgattagtctgccgaaaatcgcccggtgttagcattgaaaagaacctggcggatgtggacaaactgcggtcacaatgccgaactttgtaccagaatcttggcgaggaacttcagcaaaaggttggaaggaccaacaatttgttttttctccttatgtttaattacaaagctggagacatatatggtggacgataacaatgccatattcaattccattctcaaagaccatcccgaacttgtgcatgatccgatcgcccttcccattgtcaaggatttgcgactgctggtgcctgccatcattgaggtggtccgtttaggagtgaaa

SEQ ID NO: 81477 - DNA, 423 bp, Heterodera glycines
  Genomic contig location: Contig_ID=SeqID_17049; Location=1..423; Strand=+
  SCN-specific regions: Sequence locations=1-423
ttaattaagcgccgctggttttttgaccattgcccttgaagcgcccttttgctgtgctttcgtcgatttcatcgaaagaattgctcaattttccgagtcgcgtgcgtattggcaaaaggcagcactttatggcgggatgggtatcgtccccattttgctgtgtgccgggactgagactattttgggtgccgggatgatatgcgcttcgggcgtcgcctacggttttatggcattgggaaagaagtgggtttaatttgttgcactattgtcaattgacaaaaaactgataactacaccggctctgtttttggttcaattctaagtacgtttttaagggctgaccgtactacgatgttaggcggtgctaataccgctggacaggacccggcatggagcccacaactgaaccaaccatttccacaa

SEQ ID NO: 81478 - DNA, 409 bp, Heterodera glycines
  misc_feature (360)..(360): n is a, c, g, or t
  Genomic contig location: Contig_ID=SeqID_17052; Location=980..1388; Strand=+
  SCN-specific regions: Sequence locations=1-33,55-261,283-409
atgcctctcatcatttatttttccgtcgttttcctgcttttgcttctgctgttcaaaattgacacaaaaggatggagctggctacagtactacaacttactgtcaaccattccgatgtttttgcccgccgttttgaatccaattgtgccaatttgcaccatcaattattatcgtcatgtgctcgtgtcggacgtaaaacgttttggtatatggtgtatcaatttaatttttagcattttaaaatgtacacataaaaatttcagggaattttttgaaagttttgtttcatctaaaaattggtcaacaaaacatgaatgaaaatgagccgaaacaacagcaacacaccagccagcaagatgngcaattaatgtgccaagaacgcaaaatatcgaaacgcaaaattaattaa

SEQ ID NO: 81479 - DNA, 3466 bp, Heterodera glycines
  Genomic contig location: Contig_ID=SeqID_288; Location=89..3554; Strand=-
  SCN-specific regions: Sequence locations=1-609,632-1373,1395 -1577,1599-1901,1923-2879,2905-3065,3087-3118,3140-3466
atgacatcgcaaaatagtgcgtcatcagttggcacacaaaacacatcggccactcaaaatgttgagtcgccgccaagcagtaaaaaattgaaggtcgaagatgttgatcgacccctgtctgctattgaagcaattgcttcaacgcctgtttcaacgcaaaaaagccgtggtgggcggccggccaaaaaaactcgaggaccaggcaggggccaaacagttggttcaatgagcgaaggctcttcaattgaccacggctcagaagcaatcacaaatgtggcgattttaccaaatgtgcctgaaaaaataaatttcagcacagtgcaaattaacttcgccacatctcgtattgggctttacgaatgcgatgagagacgctctggcccaagattcattgaaacgtgctggaatgatctgacacagtttctaaatgatggctttattgtcgaatatttggcatacttggcaagcatatcacaacgaaaagtggtcgttgttgatccaatggtgtggcaaatgggcatagaccgggtcatccaatataaaaaaatgacatttgggtatgaccctaatgttacggcagaagtcattcttttgccaatacatttcccgggacactggactctcattgtccatgatgttcagtgcggtactcattttgccgattctttgcctaccccttatggcagattggattttcaagtgacggataaaattaaaaatatcatttctgatgttttgccgtcaacagtgttgaccggtattgttaatgccataaatctgacggtccaacacgatggaaatagctgcgggtactttgtgtgcctgtatgccgaatcctggctaatgaacaatcgcacgtttgttctgccagacttatccatcaattatgaaaagaagcgtattttatggcacattaacgagctgtatggctctgataatgtgccatatcatccaagggaaggggtgccaactccttgcccaattgtctatcgacatacagatgaagcgcagtcgaaatccaagaccgctgagccaatggaaattgatgagcatgatgacataacgatcatcgaacctcagacgagtgggcaggcagttaatgccgtttccacccaagcccaagtggcaggtgaaaaccaagctgacacgcttggtttggtgtcggatttttgcgtcgtgcaagagccaattgcgcaggctgacgatgcaatcttcgtcaggccgaagacgcctccgaggcgatcatcgcgcataggcagacggcaatcatcttcgattagccgttctccttcagccgcaccaagacgtcgttcatcaacaaatgctgttgagcaagtcactgcatttacgcagcgttgctaccttgtccacaagggttggtgctgtgctgctgcagcagcaaagcattatccagaatacacagattctggtaagcttggcgaaaaaaaatgctcttattgtggagcgctacttttcccgcatgaggacagcagcctttgctgtcgtcagggaagagttgtgttgccaaaactcaatcctcacccaaaagagcttcaagagctaattgtgggggaaaaacaatcccgcgagggaaaagaatttattcgcaatatgtcgcgttacaacaacttgctccaattcgcgagtgtttcggctggaaataagccatgccctgctggcggcccgatggctgtaattctcaacggggaattccatcgccgcataagcagcatgcaggctggcacaacacagattcctggctttggtcagctgtacattctggatccagtcgaagccatggagcagcggcgaaaaaatcccacctttacgggagagaaaatcacaaacgatgaagagtttgtgcaaggtcatcagcttaatgatgagacccttgaaattttggagcaaatgatccaagaaaatcatccagctgcttctgcttataagcaggctcgtgaacagctccatgagttgttaaaacaacaaaggactgaagagcttcggttcttcagaatgactttgttggatgagcgctctgctccgggtgctatgaaagacccgaagttgcatccccaccagataatcaccccctcaacgggtgaagggatgttcgcgattcatgcggatcccaacggtgccccggcaccaaaagggatatgggtggaaaacaagcaagggcagctgaacgaaattgcccctctcagtccatggactgatagcttaacctatccattgattaagcctaagggcgacgatggatataaaattggcattccatatgccaaacccgcacaaagaaagcggaaaagcgacatgtctgatgatatgtttgacaatcaagcaatgtcagatgatgacatttgcgataccgagtcaattgcatcgtctgggtctgaagcatcgatgcagtcagtgaccagtcgctatgacaaatcgaaaaaatttgtctccctgcgagattactgcaagtattatctcgccataagggatgaaaatttggagtggcaataccaccacattctttcatgtggcggtggtcttggacagcgctggatcttagaccaagcgtccaaaattgactggcaaattgcaacctttttgcgccgtccagacatggacctgcgcataagtactccaaaaaatctgctgcattatttggtgaaccaatacaataagcagcaagctcggcaaaaccccaatgcacgacaaaagactgtcgatgacattggtagcgttgttcgcctttctgagagaaatgtaaattctcttcagtattggaaaaaaatgtatgaagactgcaacaccatttttgcgcgttgccatgacgcaaaaaaggcgcggctcttcatcacattcacgaataaccgtgagtggccagagttcaaggaaaacatttacaaaaatggtcaaatgttcactgaccgtttcgacatgtggatgcgtgtgtggtccagcaaaattgctgttttccaccaggagctctatgaaaagagtttcttcggaacaatccttggctcaggcgagtcaatggagttccaagggcgtggtggcccacacgcacacattgtagcccagactgacctggacgcagtcccagaagtcatccaggaatacatatgggctcatattccacctttgccgtgcaaagacgatgactcacccatagcgcaaatgcatcgcgaagtccgcgaactaatgcatatgcaactgcacagatgcagtgatagttggtgtggtccacgtgaccccaactttgggcggtgtaaaaagggcttcccagccccgtactcgaaatgtacaatactacacccggacaggcccgcattgtattaccggcctagcccaaccgacggtggtgcccaaattgaggtgaacggcttaatatacgacaactcgcaagtcgtgccgtacaacccatacattttgctgcgttaccgagtacaccacaacgtgttattcgcatacg

SEQ ID NO: 81480 - DNA, 1135 bp, Heterodera glycines
  Genomic contig location: Contig_ID=SeqID_290; Location=775..1909; Strand=-
  SCN-specific regions: Sequence locations=1-187,209-1135
atggaaggctgcagcgctccaaaacgtagtcgtcaatctattgggattaaaacgacgcctgaccatcaaaacgaacacgttcatgtctattcaaagcatcaaaacagaattcaattcagccaaggaaattttttgttcagttctgacacacttctggaatttgttgaccctgatgaaatgtgagaagatttatatttatattaaaaatgattggctctttaattattggcgactatagcttcaaaatatggttttcagttctctagagcagtacataaagagtgatgatttgaaaagatgcagtgtccccaggcccgaaggaatggatctttgggagcgtgattcggagtgtggcagcccaaagcgttagctttaattttaaatcggctacctgaaaaaaagcttttttattgactttgttttataaatcacactattctctgaatcacagcggataaatatgattcgcttacaattttaatattcagtttagtaatacttggcactaccctttttcaaagggagaaattttctgtgagaaagtcattcttatcgtatagtgtagcttttaacaccccatgctacactagctaataacctaatgtagtgatgatacactagcttaataacctaagatgctacactagcttaataacctaatgtagcgatgctacactagcatcttggggattctgaggcatcattctgaggggggggggggaagttcgaatccgggcggtgtacattatttttctttgcattttatcattattttctatgcttttgattagcctatataaagggagaaattttctgtgcgaaagccattcttatcgtatagtgtagcttttaacaccccatgcttcctacgctgactaatgacatagcgtagtattcctacactagcctttcctacactaggctaatgtagttatcatactcgagctcaaagtctataaaagggagtggaaaatcgcttcctcggatcatttttgaaaactagcgtaggaatcctacgctgactaatgacctagcgtaggattcctacactagcctttcctacactaggctaatgtagttcaaatgcactagcgtagagtatccagtgttttagttaattggcaacctgaataaa

SEQ ID NO: 81481 - DNA, 578 bp, Heterodera glycines
  Genomic contig location: Contig_ID=SeqID_292; Location=22..599; Strand=+
  SCN-specific regions: Sequence locations=1-163,185-200,235-402,454-578
atggcaaatatatacgacgccaactttatccaccagtttcacaataaaaaatgtgcaagtgagcaaataccaagcctatttcgaatagaatcatcataatgttaataagaaacattaaaacaaaggttaagaatttaataataaatgcataacattatttgttaaaacaattaatagtttgttataaacttttgaaaaacaatattattttcaaatttatttttaatttatttacatcttttaatgtaaattgaggaattcgatggtggcaaatattcgctggcagctattggcatgccgcttttgggctttttatcccatttttccgcttgttaatggttaataaaaattcagaaaagagagcaaaaatgtttaatggaaaaatggagaaaatgggggacgaaaataattgattaaaaattcaagtataaaaatttcattattttaatttttccacataacaaaattagcaaattttattttttcagtgaattttctttttcttccttatccataatggctttcaggtaaatagttcttaaaatattgatattggtttgcattataattataaaaaa

SEQ ID NO: 81482 - DNA, 2274 bp, Heterodera glycines
  Genomic contig location: Contig_ID=SeqID_2768; Location=3334..5607; Strand=+
  SCN-specific regions: Sequence locations=1-1,24-213,240-263,289 -343,365-462,486-708,730-885,907-935,957-1012,1035-1049,1071 -1803,1836-2069,2254-2274
atgttcttcctttgccctcccattgttcttcttccattggcccttttctgcgtcgcttcccatggcttaacaaatcattcgaaagcatttggaaatgaaagcgaatcgaatagaacggacttttttggcactgaacccatggaaattccccgtcataaaagtgccgacggattcgacccaatggtggacgacgtattcgctttgctttctgctggagaagagggggaagaggagggaaatgggacgaaggtgggaattacggtggaggaggaggaggaagaggaagagcagcaggtgagagacccctgacaggcttcgtgcctttgtgctcctgctgatcaccccttcgtccagctgcttctccgttgtgccgatcagctgtcgccctttgtgccgcttttgctcgtgccgccccattaccatcgctgggacttcagttgccattttcaaggcaatttggcgttttgtttttgttgatttatttttaataggcaatcagtccgaaaagcccgccgatctttccccaaacaatgccaatgaaaatgccgacctcttcttgaaaatgtcaaagccgtgccgctccagccaagtgccgcttacttaaggaacgcactcaaattgttcttttcagtcatttcgcgatgccatcacttccgaacctaactgtcacctttttgttggttttgtcgaccatttccactcattccccacaaacactttggtcacaaaactcaacggaaaaactatgaacggaaaagaagcggtggttcggttggtatgtggtgaggagatgaagcagttcaatgaaagcaatgtgaaggagaacggactcaaaaaaacgagcggggatgaggaaacggtcagaattaatggaccgaggggaggggcaattagaaaattatttatctctgtgggggagagggccggggaaggcaaagcttgtgacatcataatcattttgtaacccattgtcccaatcaccacccccctaatcacatatgacataaccaattgttgccttgggggcggtccctttaatccagctcttttccccttccccacttctccacacaatcagtctctgactgcgaatcgggagaggcggtccatccaattgtataatactcttgaataaatgattgttaacaacacctctaccaaattgggaatgttaatggacccgcctggacccacagtattcacttgtattgtaacccgacccttttcagttcctgaagactttggtggttgttgagaagacttggcttcccggttgcttggctgtttttttcgactcgcgaactttggaccttcagctggacgaaattgccaaattattgtggaaagacggacagccgaaattggggacatcgaacggaaagaacaaatgggcggcatcaaaagtgagcagagaatggaggactgcgaaaaatgattaattaaacttctcatcttagtttgtgtgtggggagaacgaacgcaaaacattttatgaggagctgagaaaaatgaaaggccgaaacgagaaaatgggaaaaatattaatcattgaggacggggaaagtgaggtgggcatcgggggagacggatgatcagaaatgggaagatgggtgatcagaatatgggaagacgagtgatcagaaatgggaagatgggtgatcagaatatgggaagacgagtgatcagaaatgggaagatgggtgatcagaatatgggaagacgagtgatcagaaatgggaagatgggtgatcagaataagggaagacgagtgatcagaatatgggagatgaaccgtcaatgcacggagagggaggggggaggagagggggggggggtacggtaccccaccttccctaccaacccaaatcttggcacggacctcccctgcttatttgtaaggtcagaaatgttctcctgaagaagagtgacgaggagctgtactgctcggaacaggtaatttgcctcaccaatggtcattttggatttatttttccaaggccgagaagggattctttcaacgcctttgggacggattgtttggataaaacgggacgggaggaagagactgaaggaagaagaggaagatggaggaagagaagtgaggagaaagaagaagatggaggggggaggaagagactgaaggaagaagaggaagatggaggaagagaagtgaggagaaagaagaagatggaggaggaggaagagactgaaggaagaagagcagggggaggaagagacggaaggagaaagagggatgaacacggaaatgattga

SEQ ID NO: 81483 - DNA, 104 bp, Heterodera glycines
  Genomic contig location: Contig_ID=SeqID_2768; Location=1..104; Strand=+
  SCN-specific regions: Sequence locations=1-104
ttggcagactacctcagccttcaggtcgacccgattcattcaatcggaaattggcaatgtcaattggggacacaatgtgagaggaggggaggtggaggggggaa

SEQ ID NO: 81484 - DNA, 71 bp, Heterodera glycines
  Genomic contig location: Contig_ID=SeqID_2768; Location=5631..5701; Strand=-
  SCN-specific regions: Sequence locations=1-71
ttaattaccaagtccaatttgtaaagttgtcaatgtttctattcataaaaaacacataatttgaatggaaa

SEQ ID NO: 81485 - DNA, 49 bp, Heterodera glycines; identical to SEQ ID NO: 51181
  Genomic contig location: Contig_ID=SeqID_17054; Location=735..783; Strand=-
  SCN-specific regions: Sequence locations=1-49

SEQ ID NO: 81486 - DNA, 1106 bp, Heterodera glycines
  Genomic contig location: Contig_ID=SeqID_17056; Location=225..1330; Strand=-
  SCN-specific regions: Sequence locations=1-348,370-474,497-518,615 -632,1004-1106
  Gene Ontology: Mol. function=calcium, potassium:sodium antiporter activity; Cellular component=outer membrane; Biological process=N -linked glycosylation
atgacaataattgtattaattttggattttttttttgaatcaggcaacaccgcaactggacgacaattgcccgggggaccaccggcacccatcacagaccctgttggagcagcagaacaatgcgttgtaccggctcctcttcgatggcagcaacgagaactacttcacccatttggagcgagcccgtcacctcgtccacacatgcgccgtgtgtgagaagaagtacgagttcgtgttggtgcggttcccggacacaggagtcgagactccatggcatcctgtgttaccaacgcatcgcaacattcgtgatggttggacgttgctagacctagcaatgttggtaagcgaaatttgtttcaatttttgaaattggtcatcgaaaaaaaaatatttgaggagcccgacacaatttatcttttgacgcagcatggcaacaatgtgttgcacctgatgaagcgattggagggaatgaaaatgatgatggtggcgatgatgagaacggcagaggaaacaacagcggaggaagaaacaagaagaagggcggaggaggtgggcagaaagacggaggagggagcaaagacggagcaaatggaggaggaagagaagaggaggagcaaaacgacaacaatggaaagaggggagaaagagagagagaagaggaaagaagagaagaggaggaggaggaggagcaaaacggaaacaatgaagagaggggagaaaaaaagagaagggaagaagggagaggaaaagaaggaggagaacaagacagaagagaagatgaggaggacgaaggaagaggcgaagaagaaacaagagagagaggagacgaaaaggaaacggaagaagcaagagaaaaattgaagagaggtgaagaaaaaggaggaggagagaaaggaggaggaaaagccaaagaaggacgaagcgaaggaggaggaaaagccaaagaaggacgaagcgaaagtggaggaaaagccaaagaaggacgaggaggaggagcaggcgagaagaaacagccgccgcccgggtcaaaaatggtgggacatttgttattttgtgaaatacgaaaacgcaaatgtgtattggccatcggaggtcaatctttatga

SEQ ID NO: 81487 - DNA, 344 bp, Heterodera glycines
  Genomic contig location: Contig_ID=SeqID_17058; Location=1304..1647; Strand=-
  SCN-specific regions: Sequence locations=1-317
attagaagaggtacaacagtgatgagaagaggtacaacagtgattagaagaggtacaaaagtgattagaagaggtacaaatctgatcagaagaggtacaacattattagaaggggtaaaaactgattagaagaggtacaacagtgatgagaagaggtacaaaagtgattagaagaggtacaaaagtgattagaagaggtacaaatctgatcagaagaggtacaacattattagaaggggtaaaaactgattagaagaggtacaacagtgatgagaagaggtacaacagtgattagaagaggtacaaaaattgaatgcaatttattataaattttaaaaaataaa

SEQ ID NO: 81488 - DNA, 411 bp, Heterodera glycines
  Genomic contig location: Contig_ID=SeqID_17059; Location=544..954; Strand=-
  SCN-specific regions: Sequence locations=1-189,215-411
atggtgtgtacgttcgtcttcgagattttcttcaacaattcgttgctgaaaaaccggcccgtgaatgcttcagtcgccgcagccgatcagaaattgcgcaaagatgtcgccacggaatgtgccaatgtcgtcattcatcgccagcagcagaagaacggaagtgccatcatgcagacttaagcagaggacgagtggaatgaatgatgctggtgccaacaaaacagtcaatgcgatgaaacgatatatgtaaagcataatatgtatttctctgctgtattccattgtatattccattatatcgctacatgtgaatgcattgtcttttatgcataaactcacacaggattcggatttatcaatgtttttttgtcagatttggaccatccaaatcagaatatttctgaaattaaa

SEQ ID NO: 81489 - DNA, 411 bp, Heterodera glycines
  Genomic contig location: Contig_ID=SeqID_17059; Location=189..599; Strand=+
  SCN-specific regions: Sequence locations=1-17,39-411
atggtgatcaacgacagcgatgatgagaacagcggcgatgtgccgttgagtgacgaggcggcacaactgctccgacaggtccttccagggcaatgttcaaagttatgggactggcaaatcagtcctgtcgattgggatggcactttcggctgattagtttgatccgggagtcaatgaattgcgttttcccctcaggttgaactcggctacgctcaaaattcggcaacaaattgcgacaggagttcccaaaagcagcaaacaatggccgacgatcagtgctcaggcctaaaaggcacttaaaagctagagaaagccagcaaaaattcagtataaaagcaacagtgtgcgatatgtttttaatttcagaaatattctgatttggatggtccaaatctgacaaaaaaacattga

SEQ ID NO: 81490 - DNA, 871 bp, Heterodera glycines
  Genomic contig location: Contig_ID=SeqID_17060; Location=39..909; Strand=-
  SCN-specific regions: Sequence locations=1-157,180-331,353-385,429 -670,692-785,807-871
atggtaagcgacggaattatggaactgctcgaccggaacgtgatcaacaacagcaagaaaagcatgttcccgggtcgagtcgttgtttgttttgcgatgggctctcacaaattctacgagctaatggacaacaacccattgttttgtaagttgtgacaaataatttaaaataataatttgtgcttttcagtgtttgcgagtgccggatttaccaataaaacgacaacgataatgcaacaaagcaaaatgacagccatcaattcggctatcgaagtcgatttcacgggccaagtggcatccgacacaattggcacttgtttctattcaggtagaaccaaacgaaaggaccaatacgtaaaatcgggcgcaagacaaaagccgccgcaattttttttaattttaagaaaaaatattttttaaattaattagcctacataaatcgaaaatttttttgtttttgcggcgatgttttgggggagtgcccgtaaaatcgtaatgagatgtcaagttttggactaacttttttatttgctggccaaatccaacaataggtacaaaagacttggactgggccgaaacgacaccgcactagtctgcgaattggattttattaattaagaatgaattttctataatttttaatggtgaagtaaggaattaattggcattctattttttaaaattttacttggcggggaaaatttccacaacttggtctcatagcttgaaattttgggtgtaagtcgataaaaaaattagcgctatttttctttttgtttcgctaatttttaatgaagaaaatgattgtgtttttcaatacttttaaggatttgggggccaagtggactttattaatggcgctgctctctaa

SEQ ID NO: 81491 - DNA, 2394 bp, Heterodera glycines
  Genomic contig location: Contig_ID=SeqID_17063; Location=1..2394; Strand=-
  SCN-specific regions: Sequence locations=1-616,638-814,836-1070,1092 -1561,1632-1682,1739-1787,1824-1903,1926-2001,2029-2358,2380-2394
cccccgacttccacaagggtttatttgcgccattttctcgccctctctcaaggcggccatgcacaaagcccggagtcgcacagcaattcaacattctcaaatacttgctgttgagtgctaaaacgggatttggcgttgaggatctgatcacggcataaatcttttttatacgcccaaaataaatgcctattttcagaatatttatcaaaaatgggtcagtccgcggggctcaattcgaagtgacatttacgtggtcgggtcgacaaatgcgggaaaatcgtaagcaaaggaaaacacatgcaattaaacagattgtaatcgaataattttagtacacttttcaacgccttccttcagtccgatttgtgcaaagtgagggccatggatttggtggagagagtgtcggtttctttgttttcatttgtcgtcacctttaccttcccctctttaggaccacttcaatttggcccggcacgactctttcgctgctcaaatttccgataatgaatccgtccacgcaacagctggaagggggaataggcccaaaaatgtcggggatcggggtcggggaccggggagctcggggtcggggcttaaccctacggtaaagcaacagaaaattttatttttcaaccccgaaataaactgtacagcacagtgtgatttttgtccaaaatctcaatcactcatccccccatcatactgtaattccgagtcagtatttgtcgaaagccaagatcacttaagacaacatgtcataatatgtcaacaaatcataccgtttttttttggggggggggtcgtagtgaagggcaaaagaggaaaattctgaaaatttttgcttattttcttaacaatttcattttttggtgaaagcagagattaaaatggatgtaaaagctgcaaaattttccggcggctccttttggcacgtaggaaggaccacaaaatcatattagcttaatgaaaaaaaattggctctaaattagagttgtacgggaccgggactggtactgaaaaaacgtacaactgagtacctaatttatctttcggcaccaaacggacccccaaaattcttaatttctgcataattatcttttgatttacaagtcttgagccccttcgtaaacttaggtgtctaaccatcctccttgacctaatctaaatctacagtaattcatactgactgtaataccgtacctcccaatgcggtatttcgcccgggttgtaagtcatttcgtcaaaatatttctcgtttaatgtttccaccaaaatgtctcggtcccaaatgccaatgatcggtgtgctgatgccaatgtcttcaacaattgtgtttgcgcttgtgaagggattcaaaagggccttaacatttgggcaaaatgaaataattgccaaaaattgatggcattatgccaattcagtcaaattaattgaattaagtcggcaaattgaacagtaattaaaaatagggaagggttgaaattttatgtaagaaaattctagcatttttgtgcctaaggcttaaaatcatctcacgaaaaatttaatttgctaccgaaagaatttttttttattaataaattctttcaaaaaaattccaaaaagtaaaaaattaaaaaacaaaaaaaaatgaaaaaagtcactttttatatagattcctggcgcagcgtttttatgtacacaaaaaaaattaaattttttttataaacctttttgaaaaaaatttagattttattttctaatgaataaagtcgaactttttaaattaaagtcggcagaatatgcccaaaaattgtaaaaaattattaaattttcaaaaatttgacaaaaaaaattcacctcaattaaatgtatgaaaaaatacacatcaattccataatctgctttaaaaacaattcgcttgataaatggtcttccatttttgagtaaatcatcaaattccttcaaatctcttggaccgatttgcattaccaactttctgtctggtcgaattctaattaggaaatattttaaaattaaaagaataaatgatttctatgccggaaattagggtggaatcaagaaaaaaaaaacggggaaattttcccaattttcccactcactccgatttttccaccaatccgtccacgcatgagttcatcattttgcgatacaaatccaactgttttctcttgaatttattcgcattgaccatcctgagaaatgtgcccttcatgctgcgccatggggtcacttcttcggacggtcctgcgccaatgcctcgttcattgatttgggctcgagcgtcctggaaaagggccagagagatcgatcgcatttgtccttatttctatgatctgtctgtccttaaatttccaagatttgtctttattgaagagtttcacccttacaata

SEQ ID NO: 81492 - DNA, 725 bp, Heterodera glycines
  Genomic contig location: Contig_ID=SeqID_17065; Location=116..840; Strand=+
  SCN-specific regions: Sequence locations=1-207,230-258,281-485,530 -540,576-725
atggggcgacggggatactgtaggagcagccaccgtaaaatggggcgaaattggccgacaaagctgtggtggtgcaagcaaattgctgaacaatttacagaccaacgaagaaaccatggccaacggcatcgacaagaagggctcggcggcattcaaattggatggacacaaatgccaacagcgacaaaagcagaaatagtgggagcaacagcaacattcaaccaatccgtgagtgcaaaatggataatttatagctgttcaaattggcaatggaagccggtttattttcaagttttataaaaatggattttaaaaaaataaatatcgtatgcgtgaaaaattttgaaaaaattttgcagactgccggtagtcctttagccaaaatattaccctgctaagtcatgtcattatgaatgacaacattgaacaaagttaaaaaatcatcttgttcaaaccattaaatttttgtacataaaaacttcagctaatattaattaattattaatgctaaatttattttatttttttacgaaatcttgaaattttaaaacatggtcaaatccggaaaaatttggtatcattcaaccatttttaggcaaatgcctaaaatttgatacgtttaggataagcaatggaaaaacgcgtttttagcttggtttgaggcttctacgaatgacttttataatgcatatttttgtcaatttctggatttttattacttttga

SEQ ID NO: 81493 - DNA, 438 bp, Heterodera glycines
  Genomic contig location: Contig_ID=SeqID_17065; Location=941..1378; Strand=-
  SCN-specific regions: Sequence locations=1-28,53-105,178-438
atgaaattttctgtacaaattgaccagctcttcctcctcatctttctcttctcgatggttcgcatttgtaagtgtgtcaatgcgatccctttgctcactttattcattttttaaatgaaataaaataatttttttcattttttaaatgaaataagtaattaataataataattttttcgctataaaaattatacctcaaattgagcgaagaatcgtggtggtaatttgttgaaaggtcaatttgtgacgggatttcgaccttttgaatgccaaaaggagtccaacattgatgaggcggtgccaattcttcgcggtgtttattgtccaaatttggggaactgtaataaaaatgataaattcgaacaattagcaaacggcttaaagctgaccttgacgtccaaagatgctgcatcttgtcaagattcgaaattccaataa

SEQ ID NO: 81494 - DNA, 768 bp, Heterodera glycines
  misc_feature (750)..(750): n is a, c, g, or t
  Genomic contig location: Contig_ID=SeqID_17065; Location=1501..2268; Strand=+
  SCN-specific regions: Sequence locations=31-264,286-525,547-768
atgatgatgatgctgacaatgataatgatgtcggaggattcaatgagtttgttggcccgacatgggctcagatggtcaggcgaaaggtaaagcgcaaatgttttgactgtgctttcattcatttgttttgccattgatcagggctcgcaagtgtccttatttctaagatttgtccttattttcaggcttcccctaaactttttaaattttttctttttaatgatttatttcgctgatttttgagaaaaaaaatccttaaatgaatctttttaagtaaaaatttacataaaaatgttaccaaaacttccaattttcaaaaaaaagaggtgggggggggtcatatcgaagggtaaaagagagaaatttctgaaaaataaatttagctgatttcttaacaaaaacgttaaaaattctttaaaaaatttttcccgcggcgcctatcggcaccgccggacccaaaaaatttctcttaaaaattagcccaaaagtgccaatttatattgctcatttgacccccttttcagtcctatttgcgccaaaagtcccattcatcgccagcaatcaacagaaattgttcgacaaaatcggttgccggcggcaatttgtgaagaatttttggcaaaaaatcgcgcccaatgtccaattgatttgattcatttgttacaaagtgtttatgttgagaaaatgtgtaagaaaatgccaagatactggtcatgtttaattgtaatattattccatgttatatgtttnttttatgtatgttgttag

SEQ ID NO: 81495 - DNA, 4433 bp, Heterodera glycines
  Genomic contig location: Contig_ID=SeqID_2769; Location=81..4513; Strand=+
  SCN-specific regions: Sequence locations=1-734,757-2834,2856 -2988,3010-3519,3541-3903,3925-4025,4047-4075,4105-4433
atgttgcggcaactagaggagaccgatgcacgcgaatggaatgcatttgatcagttgatgtcaggcattcggcgaaaaaatggagaagatttggatgatttggctgatcgcgtaattactttagtcagacgtgcctaccccggattaactgaccatctcgttgatgactatgcaataaagcatttgatcagaacctttgaaagctctgagttagctttaagtttggaaatgggcagaaggccgggaatgacattcgatcaatttgtggggatggctgcgcgcgccgaggcaacgcagaaagcaacgcgtcgcattgcatcaaataatgcttatggaaaaacgaattttggagcaactctaacacggcaaggtcctgaaccgaaaaccaattttcaacattccactggaaaccgtccaaaatgtttttactgtgaaaaagagggtcatattgcgcgaaattgtttccggcgtcaggcggaagaaggcaatcagaatcataattcgcaacaaaatcataatgtgacgggttcaaataaaaccccgttgtccttgtacccaagccaaagtcccgcttataaacccgaaccgaacaacgcaaatccgcaacgcccacaaaatacgcaatcacgaaattttctcaggcaaaattacttagtggaacaaaaagacttaaatcatgagtcagcggatatcaaatgtgctggagtgatcagcaacgattctaagatgttggaatttttccaaaaattttggaaacaaaacgatgagaattttgagccaaattcaaacgaaacttcgttagttgggaaaataatagcgatcacggtcacaatttttgatcaggaagctccgtctatgatggacagtggagcccaaatttcactagtgcaagcgatcttcctcaaagagctgttcgaaaaacaaaattttggaaaggaaaagatgattatttttcctaaaacgagaaatgtcgttgacgttaacggcaagcgcgtcgaatgctacggcataatttctcttccagtcgctcgtagagactgcgagcctattaacattcaattccatataacggatgctcccattggattaccaattctcctcggaacaaatgctttgggcccccttggtttcaaaattcttgattccaaacatggcgagcttatcgaatttgagcttgctagtgaaaaatctgattctgttcgcttaattcacactataatgctcgagccatattctacaaagttggtcgaactttctgtttcaaagtcctttgatcagaaaaatgttttaattgcgtcatccggcgtaataaacgatgtgaaagttgaatcatcagtggacagagtgagaaatggcaaagtgttcgcttcgattacaaatttttcgctaaattcgataattttgaaagagaatgaaagggttgccatagtggaaactgtcgatgaaattgctaatgccgaagactgcttaaccaattcatggctatttgataactttcaacaaaaaatcgactcggaatgcagaaatactaatttctcagaatggaccccaaggatcggtgcccttgacagtgataaagcaaagacacttgaaaaagtgttactggaatctaaggatatttttgcttttaatgacaatgaattgacccaaacggaaatgataaagcatcacattgacacaggagaagagagtcctgtcaaaaagcgaatgagacctgttccttacgcttaccgagaaaaagtggctacaatgatccaagattatttgggccggggaataattcgtccttcgctttcaccttggtctagtccgattgttattgtaccaaaaaaggatgggtcgttaagattctgtgtcgattacagaggtttgaatgcaattaccaagaaagattgctttccattgccaaatattgagcgaacactgctaatgcttgggggtcggaaatttttctccactttggactttatttctggttattggcagattaaaatggacgatgagtcaaccgaaaaaacagcttttgttactgaatttgggttgcatgagttcaccgtcatgccatttggcttatgtaatgcggtagcaactttccaacgcttcatgtcccatttatttggcgataaattaaatgatttcgtttttgtttatatcgacgatgttcttgtggcatcagaaacgttcgaacaacatttagagcacttaaagtttgtttttgagcacataaaggaggctgggctaaaattaaaagtggcgaagtgccaattctgcaccgaggaactccaatttttgggccatgttttaactcgcaacggaataaaaatggacaatgacaaaataaaaccgattttggacatgccaacgccaaaaacaaagaaggaactccattcatttttgggattcatgacctattataggaaattcatttattcattcggttctatggctgcaccactatttaagctgttaaaaaaggacgtaccgtttaaaatggataacgccgaaatggctgcgatttcaaaattgaaagggaaaattctgagtgatgttgttctttattttcccgattttaaagctgctatggaagacccgacacgaaaatttttgattatgacggacgcaagtaagaccggaatatcagctgttctttgccagcctgatcaacaaaatcggattcgaccaatatatttcgcatcaagacaatgtaataaacacgaatcgcgatactgtcccacagaattagaggctttagccgtcagattcggcgtaaaaaaattcgcacaatacattataatgattccgacaagagtattaacagaccacaaagcattaattcctatgttcaaaagtaaaaacgagaccggtaatgcgcgcgtcgacaaatggataatggaattaagctcccggtttattttggaaattgaatataatcccggcaaaacaaacataatcgcggatgttctttctcgttcgggcgcattaaaaccgaatgaaacagcagaagataaaactgtgattggacaaatagccattggaaatgaaccggactgtgttggaaacgaggcggaaataaatgaatggattgccgcgacaaaagaaagcgaatttggtcatatctatgaatttctgcaaaaacggaaattgcctgaagatcctcgggattctcagcgaattttggacacaatccaaaaattcacagtgctgaatggattgctgtattttcacgaatccaattctggaaatctccgtctttttgttccaaaaaaatttcgtacggacttaatagaagaaagacatgagggtaaatgcgcggggcacttaagtgggaaaaaaatatttggacaattagctgaaaattatttttggccaaatatgcgagctgattgtgttaatgcggcgttaaaatgcaggatttgtgctcatacgaggagtccacggtcaaacgtcccacaattaaaaccagtaattacatcagaaccatttgaactggtctgtatggacatactttccattggaatgtcagagagagggaacaaatatgtgcttgtaatggtggatcattttactaaatacctgataacagcagcaattcccgacaaaagcgtcgaaaccgtcgctaaagcatttattcagcaacttatccttattttcggttcccccaaaaggattcattcagacaaaggtactgagtttgtaaacaagacatttgaagaaatcacaaaaattctccgagttgaaagaagcatgactgcggggtacgatccaaatgcaaatggacacgcagaaagggctaaccaaaccattttaaatatgctcaaaaggtccacagaatcaaactggtcatgggacgatcgcctgccatttgtaactttcgcttacaatattgccccatcagaaactactgggttttcaccttttatcttactttttggacgaccggttaaatttccttcggcaaatggtgtgaattttccagttaatccgctctatacagtggatgaagagtcatatttgcaacttttccgtgaaaatttgcagcaaattttaatgaatgccaaagtcaacgcagataaagcacgggaaaaaatggaaaattggtttaattcacagccaaaagtcactgcaaacaagtacaaaaagggcgagcgcgttatggttctttttcctggtgccaatcaaagagtagcacataaaaagctaaaatggaacatttttggcccctacgaaatcatggaaatatctacgtcttcagcaaaagtcgttccggtggataaaaagtctgctgaacagatttctgtgccagtggaacgactaatacacgtcccagagggaataccaaacatttcaacagttccacgtggaaaaaatgcttacaaaaatttgttgaatgcgatgaccatcttgaaacttttggaactaaatgatgttgaggg

SEQ ID NO: 81496 - DNA, 671 bp, Heterodera glycines
  Genomic contig location: Contig_ID=SeqID_2771; Location=275..945; Strand=-
  SCN-specific regions: Sequence locations=1-299,333-359,382-456,481-671
atgatcagtcaacctttgttgttgctggttggggccgtacttcaccatattgttcgaatgacagtaagccaggcccaagcaaacaattgatgtacggtcaaatgaaaatcagtgcaccagagaattgtcaaagtgcatcaatcaaatgtaatttaaattgaaaagcaaaaaataaataaattaaaacattggtttagcaaaaagactttcaattgctgatgatgatgataattcttctaatgataatgagcatgaccaaatcatttgtgttcagcctgggccgagcataatcgaaactgtaataaatttaaaaaaaattaaaataatttttacttttagggtgacagtgggagtggattaatgaaaaacacaacaatatttgggttcaagtgggcgtctcaagccaaacgacttgttatcctacagatcctacacgaacagaaggcctcacaggtgataattattattttttaaaaattacttgttatttgttgcaattaaaattgccaacattttcaaatcttcttttatttttttagaacaaggtccatttcacgaggaattaaaaatcaatttttcaaaacattctatgccgaattatatgttatttttttgcatttaaggacgtattcacgctttagaactttttttccccaaaaaatcataataaa

SEQ ID NO: 81497 - DNA, 673 bp, Heterodera glycines
  misc_feature (545)..(545): n is a, c, g, or t
  misc_feature (591)..(591): n is a, c, g, or t
  Genomic contig location: Contig_ID=SeqID_17066; Location=20..692; Strand=-
  SCN-specific regions: Sequence locations=1-162,184-200,223-673
atggacgcgcaaaatcgaggcgaattggatgaaagtgctctcctggacagccatggtaattcggtgtttcacgaaaactcccaagaacaaaatttgggtcgagaaaatggtcgaaacatccagcaacaaaatttggggataaatttggaccagcgaatcgcccatttggatctggtagataattgggagttcaaccctcatcttacctcgaccccaaatgttgcggcggcacgtattcgtcagcaagaagagaatttggcgataaatcgtcaactggcatttcaacagcatttctttgcggaagaaaattttgcggcgcatccaaatgttgttgccgaacacctcgaacagcgagggcaaattcatttcgcaccggcgcgtcggccaatgaatgtgcagcaacgccaaaacgccgattatcaaccgcggctaacgcatcaacaaaattatgcgcaatttgaagaacgcgcttaccgtcaacaaaacccgggaaatttgttcgtgagaaaccaacccgcgcgttatgaaaatgcgaacccaaattntgggtatggaacttcgggacatgttatggccgatccagcaggaggngcacaacccccgatcagcattttggagtacgtgctcattctcgatcgacttcccgaactaaaagggaatgaggcgctgacaa

SEQ ID NO: 81498 - DNA, 1793 bp, Heterodera glycines
  Genomic contig location: Contig_ID=SeqID_17071; Location=265..2057; Strand=+
  SCN-specific regions: Sequence locations=1-185,211-263,290-310,356 -619,644-852,875-1125,1236-1271,1319-1382,1405-1473,1516-1629,1673 -1712,1734-1793
atggcacccaaaaaattcatgccaatggagttaatcgtggaaattgtcactttcctccaatttcgtcggcgatgggccaatgttcgcgtgtcgagagcatttgatcactttctgcttgaacaaattggcttctttttgaccaaaacgaactcatcggtctgtgacaccaagcaatatcattcttgaatttatatatttttttaatattttgccattaacccgttggatttgactaacaaaattttacagaattctcggaaataactgtaaaaaataaataaataaggtgcaatttacaaaatgtattaagaaaaaaaaaatttgttttttaaattaagattttttgaattttaaagcctcattaatcccctttccttgcgcttacactataaaattttaaattagggcttaacatttaataataaatttcaggccaagcaatgcttaacagagtttggacaaatggtcaacaatttaccatcaaaacacaagagaaatgtttttaatgaaagcgcgcgtgaattaggtgtaaaattattgtttggaagtgagttttattactaacagttttattgtatttttgaggaattcctccccgactttgctcatatttacataatattgaaataaattatttttgaatttgtactgcagagctttacaggaaatttttagctccattcagcattaatcagcttacaaattaaagaactttgctagtacgactcagctgaaaaaaatgcacaaatttcttaaaaattatgaaaattttaatgcaaaatgttcttttaaaaatggaaattggtttaagaaataattaacaaacaaattcaattcgaattttcttatttcatatattaaaaaataaaaatttgctgcccaatttttttgcccaccattctcagcagaacaactgtctattcctggacaattttgaactttttttttacaaatttttcggggttctgaaatggttatggttgccggaggcctgaaaaaaaattgtgtaccaggcccccgaacctgctagagctctattagatatcatatggttcatccagaaatggattccatacattggacaaaaaattgaatggaggccggacaagaccaatacggtattagaatttaatgaattattattattattatattattgttttaattctaaaatttagatgcaatttttgaatgcaaattaagaattattaaaataataaatttaaatattttttggaaattgtcgaaaagccaaaaagagttttatcagcattatttaaaatatttattaaaaataaatatataattcttaaatttaggacgacatttatctagcaacagctgaacaaattgtacaacttttgatgaccaattatgagggaaaaactgccgaattgatgactcatcatattcaagtaaaaaatgaaattgaacttgcagaaatttgaagacaaatatggccaaaataattccaattaatttttaatttaaaaaaagaaaaaaaaaattttttttcctggtttttgggccttagtttaatttaaattcttttggaaaattttccgaagaatttgttgaattgtattaacaattttttgaataaattttgtcattttacactctaaattttaggctttttagagcctattatccattttgtttttattgcctaatttggcgctttttagagccaaaataatcccgacataatgatgtataatattttaaaactttattttcagcattggtcggaacagattgccaagctcagtactaccgtatggattacttaa

SEQ ID NO: 81499 - DNA, 943 bp, Heterodera glycines
  Genomic contig location: Contig_ID=SeqID_17073; Location=37..979; Strand=+
  SCN-specific regions: Sequence locations=1-88,146-150,436-656,679-943
atgcccagtggagaggggccgaggaatgtccacaaatttgactttggattcaaggaacaccagcggataaggtaagatttttccaattaataaaaataaaataaaaaatagaaaaaatcaaataaaaatcaaaaaaataaataaacaaagaaatttaaaataattatttctaaaaaatttaatgaagcaaaaaaaaaattttttttttttaaagaataaaatgaaaaaataataatttaatgaaacaaaaaaaaacaataaaattaaaaataaagaaagtaaaaaataaatttaaaataattatttaaaaaaaaaattaatgaaacaaacaaaacagaaaaaactaaaaaaataaagaaatttaaaataaaatgagtttaaaatatttatttttaaataatttaattaggcaaaaaaaaaataaagtaaattttaggattgtgaatactgataaattttgccttttttacgcactggcatcgtcgatgaattatttaattatggaccgttttgaatttaatcgatttatgaaaaatattgtgagacagagggatgcagctattgagcttttacgtaattgtggaattgatggaaacgaaattagttatggtgtggagcaattgccgaatgttcagaaatattgggtgggttaaatgaaaaaatgcaaaattaataaatttttcaggatgagatttaccccggaaagtaccgggttgtggcatttgagaagtcagctgatccgcggaaatcgatccgtgttttgtggaaggcccctatgggacgagagaaggtcgtaccgatatttttggagaatggtcactgggatggtctgaagaattatgtctgctttttcaaccgtgggaggaagttctgcgttgaatgtgaatgtttttacgatcaggatgtttatcatacgatggattgccgggcgagatgttattga

SEQ ID NO: 81500 - DNA, 413 bp, Heterodera glycines
  Genomic contig location: Contig_ID=SeqID_17073; Location=1213..1625; Strand=+
  SCN-specific regions: Sequence locations=1-9,32-62,85-413
atgccgatcgaggagaaggaggaaaaagatgtctacagaattgtagttagggtaagttctacaaataaaatcaacaaaaataagtctttaactccaggatttggagactttgcaggattctatttacaagggggaccagaaggagcatgttattaattatatttcggtgagagttacgtgtacggaatgctgtgatgacaaacgaattgcaaaatttgtggggaggagaggatcaaggattggagcgaggcggagggacatgagccgaccaaggattttgtggagtggattttaactgcttttacgaattacgatacgtacatatttgcacataacgccggacgttttgacggtaatgaaaaaaaattaatctaaatttttaaatcctaaatttttaggtcattttgttttaa

SEQ ID NO: 81501 - DNA, 779 bp, Heterodera glycines
  Genomic contig location: Contig_ID=SeqID_17073; Location=1747..2525; Strand=+
  SCN-specific regions: Sequence locations=1-5,27-201,224-566,588 -722,744-779
atgccggtgaagcttgagtcgctgaaggcgacatttaatttggactgtgaggacaagccctttttcccctattattacaacaagaaagaaaattatggaatacgattggaacatctgccaccgatggaggactattcgccgggatatatgaacaaggataaatttataaaattctaaaaatggtaagaaaagaaggacaaaattaacaataaataatttttcaggtacaacgaaaacaaggagacacctttttatttggatgatgaattgaaaaattattgccgaaacgacacggagattttattgctgtcaattattgagtttcgaaggatattgattaacgacattactaagggatttgacccactaccgaggagttgtacgaatgcgggggttgcgatgaatatttttaaggcaatgtttttgttgcggagcagttatcgattgtgccggagaagggatatgagcggtgtgatcgcgccagtgtgatggcaataaagtatttggagtggcggagccagcgggatggaattgagatacggcacacggggaacggacgagaggtcaaagttggaaaatataaattggatggatttattgcgaataacggagctagggacaaatgcatcgaggttatgggatgttacatacatggatgtttgaattgttatgacccggcggcggaactgattggaggaaggacggcccaggaattgaacgatgagactcaggagagattagtggagctacggaagactttggatgtcgaagaagtttgg

SEQ ID NO: 81502 - DNA, 1263 bp, Heterodera glycines
  Genomic contig location: Contig_ID=SeqID_17075; Location=180..1442; Strand=+
  SCN-specific regions: Sequence locations=1-19,41-55,91-145,185 -252,368-419,442-512,592-822,1091-1228,1250-1263
atgttccttgtctttaatagaggttataataaatgataaactaatcttctgttggaaattttacaaaaaaaaaaaaatttgtttttttatgaattttggaatattcattttctataatgctcttttattaaaatatttttcgattcataagttgaaacatttttgtttttattaaaaaatattagatggaaggaaaattcaatatttgtttttcactggtttattgtttatgctgtattcttaggaaattacttatataattgtattatttttattttttattctttatttaaaaagtgcataatagtcaatatattctaattaaatttgtaatttgttatattttatgtttttatcttattttttagttttctttttcggtattgcttatttctctaacgcactgagaagcaacgaaacataaataaacagaacgaagatggtaataatcgttaagagacacaatttgtggtcaagcaaaaaggtgtttttaaaattgaaaaagtcactacaaaaattttaataaattttaaaaaatggattattctataagttttaattttcaataatactttatagtttataaaattaccaagttaatttttgtgtatccggcgccattgattgtagagctcatcgagctttacaaaaatccgctggtaccggcacgcttagcttgggttggccatcgacatggtccggggcgaggctgaggatcctccggcatatgtcccgacacataacgggctccaagtgaatggatcgagaaccggaccgtcactgagtttttttggatcgactcaccacgaaaaaatgctaacgttataaaatttattattatttaaaaattatttattaattgttgatagatttaattttaaaaatttacttttcaattatcttgtcggcattttaaagttttatgaattcttttttttctaaaacagaaaacaaaataaaatccaataaaaaaaaaaattaaaattttgatgtttattagtatttaaagataaagaaatttaataataaaatgtgtattaaattatacaaattttaaaataaatctatttaatttattaaaataattttagacaattgtaaaatatttcaagaacttgtggatgcgaattgcacgaaattggctgatacaaaaataatatttttattctattgtaaaaaaaagataaattggagaattattgagttactttaaattataaaaactaagcaaaattaatgacttttcattccttggtataagaa

SEQ ID NO: 81503 - DNA, 146 bp, Heterodera glycines
  Genomic contig location: Contig_ID=SeqID_17076; Location=1729..1874; Strand=-
  SCN-specific regions: Sequence locations=1-4,27-146
ataactatgtctccagggattacccaccattggccgttagctaagttgtctgtcacctttacccccagcggtttgccacccttaccaattttgggaagcgattttattcataaccgttcacatgcggcattggtccccgaatggca

SEQ ID NO: 81504 - DNA, 1125 bp, Heterodera glycines
  Genomic contig location: Contig_ID=SeqID_17077; Location=107..1231; Strand=-
  SCN-specific regions: Sequence locations=1-244,275-815,837-1125
atggacagttttgttaaaacacccaaaatttcaagaccactcccaactgagctgctattggagcagatcatgtgcatcccacttatgcgtctgtttaactcaaatggtggtaatcagatggtaataatcgcagttaaacacttttttgttatttaggaccaaaatcaatgatcagcgcaattaattggaaatttgaagttttacgcaatgaacgaaaaaatgcacacataaaagctaaaaaaacaattgtaattttgttttgtttttaaattatcattcttatttaaaattaagaacgaaattgtgcagaaatttaacatggcaagcaggacgagaaaagtggaatttgaggggggcaatttggacttcagttcacttcgtgaagaaaatggattgacgaaggatgaattccgaaaaggagtcctactgtatctgtgctatgggggaaatgaaaaggcaatgttggtgaataacgttgcgattaccgttcccattctcaatgtaatttttgaaaattttattttcgtttaaaactttttattttagtacattttcattcgaccacttttggagcaattatttgagttcatcttggagtcaccaaacccattcaccatgcaaaaacgaatatgcgtgggagggcatcatccgattcatttgcccaagtcccttagtctgcctgcacgtgtcatggccaccaaagggattcagccccaggtccgctcggatgacaaagaaatttacaaccttttcaatgtacatctaaaaagagtggttggacgagtcacgattttttatcatattcgatttgatgatacattttcagttatgagtagccatttcgtgttggaatgctaatctatgaaaaatccaccatttgtatttttagtcaggataaataattgcaaaaattcttgtcggaaaattcaaatgaataatttaacatatggtaatcaatcattttgatttgagctgtaaatttttaaaattgtcggcaactttaaaggaattttcttttaataatattcaaatgtgatcaatcatttaatcatattttagtttaggtcgtaaaatatttttaaaatgtcggtatgataaaaagaaatattttgagcattaaataaa

SEQ ID NO: 81505 - DNA, 662 bp, Heterodera glycines
  Genomic contig location: Contig_ID=SeqID_17077; Location=1718..2379; Strand=-
  SCN-specific regions: Sequence locations=1-299,321-324,346-365,387 -620,642-662
atggcgtcgattgtgttggcagttatttggcgcacgggtacaaaaacatcaccgccatccaataatgcactgctgatcaggcatccaaggtgtgttggttcgctgctcttctcacggctgtcgctttttgcttcatcaatgcagtgtttgaagatcgaggaaagaagactttcgggatcggctggcacatcccggatgacgaagctcgatttgactttcgtgtagttaaatttggcaacatgttcaacgctgcactccagcttttcaacaaattcgctgggtaattttttgttggatgagctctcggccccttcaccctcctgaacggtgagaccaagcagctgattgatgaggaagccttgctgcaatgttttgggtggtggcggggtggtgagaatatcattaatagtgaatgggaatgggcgttttggaggacggctttccattttttttttttgatctaataagagaagagagagatgaaatgcggtttaaatgataaaatagcaaaaaaaaattgaatttatagggggcgaaataatggcgatggcaaatcgataatggaggaagggttggtatacggtaataagtgaggaacggaacgggtatggatacgataatatttatttgagtaggcaaacttttaacaatgtataaataaa

SEQ ID NO: 81506 - DNA, 125 bp, Heterodera glycines
  Genomic contig location: Contig_ID=SeqID_17078; Location=193..317; Strand=-
  SCN-specific regions: Sequence locations=1-125
atggaattgtttgttcgccaaactgccactgtgcgcggtcatttccaacacctttctgtgcatgcacggcggtttgccacgacctggcggatgggactttatgatgggaagcgcatttgtggtga

SEQ ID NO: 81507 - DNA, 1143 bp, Heterodera glycines
  Genomic contig location: Contig_ID=SeqID_2772; Location=3603..4745; Strand=+
  SCN-specific regions: Sequence locations=1-28,50-183,205-786,808 -985,1007-1143
atgagaaccaaaaatctgccttctaagctttccaatcccgaagttttaacaagtgatgagagttcagcaagttttgaaagccctgcggggaccatttatgaatcattcgaggcgttgagcattgatagctcaaaagtagcttcaaacctcgaggggtacactaatgttggggctgaaatcgttattgaagggactgaatccaatgaaaaccctgcggggtccggatatgaagaagtgagaatcgaatgtagtagcgtcatcattgcctgcaagaagtcgcctaagtcaaagccaaatgttgaaaattcggataatttcatgagtctgtttgaaaatttggaattgacggattctgaaaaattagctaatcaatgggaaattgataaaatattagcggacaccgcaccatcgctagctggttcatcgcaaattgagagctcagtcatagggtttgtgtgcatctcacaccccatattgtgggcattggtacaaccggacattttgggtgaacagaatgagttattggatcgaaaacatttaaatttggaattcgatcaattgatttttcaaagtacaccaagttatgtaacggctattacactaaatccaaacaataactggccacatttcacccaaatttcattgaattggaacaagcaatccctattgggaacccggatcaaaacatcagatctgaggcaattaacttctcctcctaagatgggaccatcagtgaatcaaattgtcccttcgagttgttgtggaataattagggaggtgatacaaaacaaaatcacctcccaaatcatcgccattgatgtctttttatatggggaagaaaataatcaacgcttcttcacacaccaaatcgattcaagtgttaatttgatggaattagaagaaggcacacgggttcaaactacgggattttgggccaaaacttcagcaattgaatggcaaacttcgagtgatggaattcgcgattggtggactgagcagatctatgtcggaacaaacttaaaaatatttggcgctgatgaaggcgaagacaatcatcaatggctccaaaatgaacaatttctattgtcataccgttacctgtgtgccgccatggatttgcaacaatcaccaaaacggagatga

SEQ ID NO: 81508 - DNA, 1083 bp, Heterodera glycines
  Genomic contig location: Contig_ID=SeqID_2772; Location=1998..3080; Strand=+
  SCN-specific regions: Sequence locations=1-6,29-153,175-182,236 -247,271-996,1019-1083
atcagttccttcatttccccattttcctttgatcaaaaggccaagtcttccccaatcgcctttgaacgaccccattaatccgggatttttcactctaccaattcttcttttattttggtctcttctatttctgttcaacaccatccctcatttcttgtcaacccatctctttcatttctggtcaaccccctttccccatttccctctcatctctcaaaatatttccttttaattaccgatcagttccattttccccatttattttggtcaacttgccccaatcatttcgatcagtgccattccccccatttattgatcaaatggcacaaatttagtttgggtcaatgccattcatcatttttctcaaattgcgcgcaattcttctgagcagcgtatcccttcctctttgatcagtgccattctctcccccattttcttttgatcaattgtccctcattgattaatttcatttattttgatcagttccaccccattttatttgaccaatcagtcccaattaatttgatcaggcccctccctctaattttcaattgattaaattgtgcaaatttcttttaatcagcgccacctcctccgtttttgtgttcgaattgcgcttttccttttgatcagttcccacatttttttgatcttagtgcgaacatttcttttggtcaatgccattctccattttattgtttgatcaaaattgcgcgcaatccttctaattatttacatccattcccaaatttatttaagatcagtccaaccctgaggggcccacaaatggtacctttcggtcaatcagtgccatccctttttctgatcaaatggcgcacattctcttttgatcagtgccatttccccattcttctcttcatcaaattgccccaaattattttggtcaatcgtcttttggctatttcttttgatcagtgtcacccctccccatttatattgatcaattgacgcatatttcggctgatcagtcccatcgccatctttgatcaaattgtgcaaatttatttgatctgtcccattttccccatttctatttgatcatttgtaccatttttcattgct

SEQ ID NO: 81509 - DNA, 783 bp, Heterodera glycines
  Genomic contig location: Contig_ID=SeqID_2772; Location=5445..6227; Strand=+
  SCN-specific regions: Sequence locations=1-673,707-783
atggacttaattaggactgaggatggtgtcaatcgcatgacacgtcaccttaacaggaagataaatcaaaccaatagggacttgactgaactcaaggatgatactcaaaccctgataactcaagtaaatactctcgcaaatagttatggtacagtccaagtgttgcaaaaacctaaccaggcaccaaaattcaataaccctcctatcttaaattatgcgactccctctccactcaagaatcagaacaatagctttagcaatgctaatgcttcggttcttgaagccatacctctcaacaacagtgaggaagattcccaagatgaagaatttcaattaaatccttcgggattccatcacattaacatgctttttgctcaaactagtcactctttcacattcacaattttctctggaacctcaccattagaattcgatcgttgggcaagaaagttcactgacttgcttgactgcaatggcagaaagtgggataaatctgaaaagttggcacgtcttaaggcatgccttgatggcagggctggacgtaactgattttcagttacggccatccgtaatccgtcattacggcgattttttcagttacggccatccgtaatccgtcatgacgggggtcaaaaaaggccgtaatttggcgtaatccgtaatacgtaatccgtaattttcaaaaaaaaatttttttttttttaatcacaaatcattcaattgagaaaccggttaaaagtaaattgtgatgaagaaacaaaagttttgcaagattttctggta

SEQ ID NO: 81510 - DNA, 422 bp, Heterodera glycines
  Genomic contig location: Contig_ID=SeqID_17080; Location=213..634; Strand=+
  SCN-specific regions: Sequence locations=1-9,31-373,395-398,421-422
atgagattttttggaatttttatgcaaaaatcgcctcccatcgattcgtctactcaacgattcgtctattcaacgattcgtctattatacgattcgtctactcagccaaaatgtgacgattcgtctactcggtcaaatgtcaacgattcgtctattatacgattcgtctactcgacgattcgtctactcagccaaaatgcgacgattcgtctactcctccaaaaaagttcgaaaacccggattcgaactcgaacaaactttaaagccattttccggggtttcctacttaaaaaagcagtttccatagtctgacgactttcttgtgcgttttggtgccttcagtagctgctgttgttcaattagtgttcgaatttatttcatttgcttaaaatgagaaaattgatttaaaataggttgaatta

SEQ ID NO: 81511 - DNA, 540 bp, Heterodera glycines
  Genomic contig location: Contig_ID=SeqID_17080; Location=828..1367; Strand=-
  SCN-specific regions: Sequence locations=1-54,76-126,148-150,190 -354,378-540
atgctaaaactattaatttctctattgattctaaatgtccaaagtgattttttatccatataaccaaaatttttagcatttacgaatttgatgttttttgtgtgttagagatgtaaaaatagtacgccaaaaagagagaaaaagtaatgcattttcatgttttatatatatcttttgaaaaattgtataaaacataaaatggctgtattacattatgcagaatttttttctctatcagtatgtaaaatttggtgtggatttaacaagtagaaaaaaagttaaacagaatgaagtaaatgttgttttttacataattaaaatgaagagatagtacgccaaggagagagaaattacaaagaaaaagagaaacgacgagatagtactaggcttttctctgcacagtggggcgtacccataggcgcgcctatgattcgtctactcgacgattcgtctactcagccaaaaagtgacgattcgtctactcagccaaaaagccacgattcgtctattacacgattcgtctactcagccaaaaagtga

SEQ ID NO: 81512 - DNA, 522 bp, Heterodera glycines
  Genomic contig location: Contig_ID=SeqID_17084; Location=102..623; Strand=-
  SCN-specific regions: Sequence locations=1-127,149-282,304-330,352-522
atgttcaacaatttgttgccgcagcaccgccattgcctcttcctgatgcgccgtttacatttgaaaacatttttgaggtgagtctcacaaggaatatttgggatgccaagcaaaaatattcgaaaaagggtacttttctgttttcagacccccccctgaaattttcaaagaaagtcagtttctggggttatttgtgacgctgatcacgaatatgacatttgttttgctgaattccgaaacttggacccgaactcgagcaaaaattcaaattcattaatacacaaggaaaatcatattttggtagaagttcagtttgtccctccatttttgaattttttatttttattttaagaccataaaacatgttttaaggggttttagagaaagctgatcacgaatacaacaataattttgagcaattccgaactccgaacatgaactcgaacaaaagtcgaaattttaaactttcgagttacgcattttcggttcaacaaaccagcttaatgcaaggaaacaaataaa

SEQ ID NO: 81513 - DNA, 348 bp, Heterodera glycines
  Genomic contig location: Contig_ID=SeqID_17084; Location=3016..3363; Strand=-
  SCN-specific regions: Sequence locations=1-348
  Gene Ontology: Mol. function=signal transducer activity; Cellular component=cytoplasm; Biological process=cell-matrix adhesion
atggtctggtcaaatgagcgggtcattaaatggctggaagaaattggccttggcgcgtttgttgtaaatgccgtcgactcgggcgtccatggcgcactaatggtagcaaaagggaaaattatcctaatttcgcaatattttaaggccctcgatgtaacgtttgatgtgcccgccatggcacacattttacaaattccggacagtgacagcgcacgacggacattggaggaggagttccagaaactggtggccaattgccggggcagaggcgagccgcgagatgaaaacggcaaaggaggaagcggcgagaagcaaccgcaacagcacaagacgcgatctcacaaataa

SEQ ID NO: 81514 - DNA, 1830 bp, Heterodera glycines
  Genomic contig location: Contig_ID=SeqID_17085; Location=98..1927; Strand=+
  SCN-specific regions: Sequence locations=1-652,694-1060,1082 -1384,1445-1801,1823-1830
atgtccacggccaagaccggcataatcaaaaataccacggccaagaccacgtaagcagaaaatgccatgccacgacgatgactcgcaatgtatgagtttggtctatggatgagttgggggtgactcgatcatttcgtttttttgacaattacatttttcttttactttagaatcaatttgcttgataaattggcaaattcgtccaaaggtaccaacatcgtattcagtgccgcttttcaacagaacatcccgcttggtcaaatttatgttggatttgccggtggttcggcttctcctcaggcgaatgccaacgacggcgtttcgtccgttgcttcagatcagcgactacactttgagaatggcagcgagatcagtttcgatcaatttgtcaacagtgcgctcagaggagagacatcggtcaaaggtggcactgatcaggccaataatcacttggccaattgtgcagcaaatggagtaaaaagagaaatgttggtgccggacgcgacatttatggacaaacttcgggttgcgatacgaaacatcatacaagaatcgccgcccaatagcaaatggaatacattctcgagaatcaggcagaatttgtacttcgatataatttgtcaggttcatctttttcaattgtttctttgccatttggtgttcatcctttgcttttcaggtggtttcggtccatgtgccaattgctggtttgtccgtgacttatctgcgcgtttgtgatggcacaaaagccgatatgtgagtttattgcttattgtcagatcgatgaaaattaattcgaaagctcatgaaatttagggaaaaaaatttactgcattaattttttgtttttgtcccctaattccagtgaagacggacattctttttactccggcgtttcctttcgtgaaactcacgccgtgcaaagtcaattgtttcccgaagaagcgatcaccgacgagtgcaaagaatttatctacttaattggatgttggggtgggtgaacattttgcactttcattccatgtcatttctttttcagatacattttgcactacagccatgggcattgaggtgaaaactacacagtttctaggggtcgtcataaatggcctctgccggacggagggtggcggccatcgtaataatcggggaaatggtcaaagggatagaagggaggagggaaaagagaaaacgaacgcaaaataagacaccaaattctcttaacaaatttcattcaaaatttcgatttttttttcttgcggcgactatttttcgtaagcgctaatgtaaaaactgtgaggcctttttaatctaagccaagtcgaaagaaggggatggccttcttaaccaaagtggggggggggaaggataaattaaatcgcaagtgaagggaaaaaagaaacaattgaaataattaaaaagaattttttaatgttttcaggctggtgacattatcaaaattttcaacgccaaaatgaaaacgcgccaagacaacgttattcatttctcgttgcacgggcacacgccgaacagcgaaggacgatacaaaagggccatcgaatgtgtgaggaaagcgaagcggcgaattggggacgaaatggcaatgaacggagggactgaaaatgagggtgatgggacgggtgggaaaaggacgcgacagagcgaagacagttgagaataatgtgatggatataacgcaattgagccaaattggaacggaattttggacgttttgaatttgcattacccaaaaagtggcgtttttaagtgatgccttttatacattaaaatatatttgttttacatatttatgaattaaacccttcgaga

SEQ ID NO: 81515 - DNA, 523 bp, Heterodera glycines
  Genomic contig location: Contig_ID=SeqID_17085; Location=1909..2431; Strand=-
  SCN-specific regions: Sequence locations=1-42,68-224,247-523
atagagagagagagaggggtaaaaataaggtttttattcaccttatttttaaggtatttaaaaatgtgccctgaagcgaaagagcgctatcacaagctgaatgggctggacatcgattcgcccgagtgttcagagcccgccttcgagacaattgcctccaattatttgaaagtgagccatagggaaataagctaatgagggggggggggaggaggttaagtcactgaaaatttttgattttcaagaatgacccctcatttgtcaggtgtttgacgaggttatcagtgccgtcgagcaaacgcccgccgacgcgtcctcggcatgccaacgcctttcgtccatcggcaaaatgcaccgctcaaaagtgaatggcattaaatttgacgacttccaacagttggaggcgccctttctgtacatgataggcgaagtcctccaggacagattcaacgaaaaagccgaaatgctcttcaggaaattcttccaattttgtttgcgctttattctcgaagggtttaattca

SEQ ID NO: 81516 - DNA, 1098 bp, Heterodera glycines
  Genomic contig location: Contig_ID=SeqID_17086; Location=88..1185; Strand=-
  SCN-specific regions: Sequence locations=1-222,265-273,382-871,893 -915,937-1098
  Gene Ontology: Mol. function=transcription factor activity; Cellular component=nucleus; Biological process=behavior
atgggcatgcctccggcgcccccgtcactgcacagtccgctggtcggtgtcaggtcaccgtgcgagggcggtgtgcccggtccgttccccggcggtggcggcggcatgccatcagctgcgtcggcactaccgcccggggcaataatgggaatgccatcgccctacggcacaatgccaccgggcatgaccaccaacaacccaaacatgaacatgatgatgctgcaacaacagcaacaactacaactccagcatcagcaacaacaaatgatgtgccatcaacagcagcaacaacaacaccaccaccagcagcagcagatgaacgccgcggcggcgtcggcatgcatgaacacgcaacagcaacaacaactgcagcatcagcaggatgccattttcaaaggtggcccaccgaacaccgactgggatttaagggtggcacaggccgggatttatgggacatacgtagctaactcgctgatcaactcctctgaacaaatgatcattgctgggcatgcgtcggtgtactctctggtcaattacagtcggacgattggccgagtccgagattcagggacatgattagctgatcaattttgggctaatctgatctggccgaagcattatgtttcgatcagccggattattttcggatagttggccgagtccgggattactccggatcagatttttgagctgatcagctctggactgatctgaactggccggagtgtgatgctctgattagccggataaattgttcgggacctggcttccggcccatgagctgatcaattttactgatcgtgccgtggcataattcatctgcaactagttgtaggcatcggcctgatcaaaatgacatttagcctctaatacatttttgacacactattttcatagggaaattggcgattgaagtttttaaaattttttaaaaatctttttgtgttttccagtgcctggccgttcgccctcgtcactgaagcgtgcctcgttgccgcccgcatccgccatgttcacgccgccgtccacgctgatgccgatgccggagcagcgaatccaactcagcgggcagtgccaagcgtgccgcttggaacttag

SEQ ID NO: 81517 - DNA, 1015 bp, Heterodera glycines
  Genomic contig location: Contig_ID=SeqID_17087; Location=1062..2076; Strand=+
  SCN-specific regions: Sequence locations=1-306,328-377,399-835,859 -867,908-990,1012-1015
  Gene Ontology: Mol. function=heat shock protein activity; Cellular component=plasma membrane; Biological process=response to stress
atgatctccaggagggcaattattatttgggccattgctttgttggcattagcaggtatactggctgaattggcaccatttgatggcattttaattgatgtgccaccaaattttcagcgatttcgcccaacttttccaccgctgacaaaggagttgacgctgtcgatgcggcggacgaaatcattgacgacccaaaagtggaggtgccgaagaacggcgttggcaaaggcaccgatgaccaaacagtgcagcgggaggaggaggccatcaaactggagggactatcagtggccgagttcaagcagctcagggagagtgcggagaagcatcaattccaagccgaggtccgcgcgaaaatggaccaccaaatggggctgtttggaattggaggatggggcctttttttgacaagtcgacatcgaaaatttctccgaaatgtgaccccaaaaagcctgacattcacttctttccgcgatcgagtctcatgaattgcggactttaactcgagaaaagcattgagggttgaacaaatttgtgagaaaaagtccccaaaaattttaggtcctgaaaacagtgccgattgttttttttaattagcaattttactactttggtttcccgcccccccccccctccatttgcgcttttcaatgttgttttttaattttgttttctattttttttgtcaataggtccaatatttaccaataatatggtaggatagatagagaatcactgttttatagatccatttttttcttggattaaccgcaaaatccaatttttttttttaatttttgatatagcccaaccccattccgttcaggtcaaccggatgatgaagctgatcatcaattcattgtaccggaacaaggagattttcctccgtgagctcatctccaacgcgtcggatgccctggacaaaattcggctcatttcgctgacaaattcgacagcacttgcggccaccgaagaattgtccatcaaaattaaggcaaaaaattttcaaaatttt

SEQ ID NO: 81518 - DNA, 1156 bp, Heterodera glycines
  Genomic contig location: Contig_ID=SeqID_17088; Location=1051..2206; Strand=-
  SCN-specific regions: Sequence locations=1-437,459-1156
atgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtacccttttaaagggccaggacattgttatgtcgagtgcaaagaagagtccggcaataaaatcaaaattgacgagccggctcaatatgccaagatgaactttcgtggtgcaacggaagcatatgccattgttcattcaatgccatttgcccgtctttcgcatcatgttgtcaaattggcaattcatttgccaaaccaacagcccattgtatatagggctttccagctggtgagcaaagctcaacaaatccagcaaggcgaactgccagaaacgcagtgttcagcctattggaaacaatggcaaaatgagtggaagaatgatccaaagtttaaggacattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggagacccagaccatcttaagatggttaatgggttgctttgtacctcattcactgaggctgcaataatgcatggtcttcttgaagacgacaaaatttgggacaaaactctggcggaggcagctctgtcgcgctggtcagatcagatgagatggctctttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagct

SEQ ID NO: 81519 - DNA, 225 bp, Heterodera glycines; identical to SEQ ID NO: 50965
  Genomic contig location: Contig_ID=SeqID_17088; Location=124..348; Strand=-
  SCN-specific regions: Sequence locations=1-225

SEQ ID NO: 81520 - DNA, 1634 bp, Heterodera glycines
  Genomic contig location: Contig_ID=SeqID_17089; Location=164..1797; Strand=-
  SCN-specific regions: Sequence locations=1-6,28-84,116-174,196 -835,857-1063,1092-1218,1272-1404,1428-1634
atgaattattccaaattggtttttctattaattttctccatttcattaatttcaacagcaaaagaggcaaaaccattggtaaggatttaatttaattcaaattaaattaattttacagtttaatgatgacaatgtgctgctcgcatttgtgaagggatcatcaaaatttgagcattttttggctgatgaaaaattcgattataatcagtcggagaaggaaattttggagcaaaactatgagaaaaaattgggccttatttttttcatgagaaagcattggcattgtgccaaaattgggaccgattttgaggagtatgagcagagggaatgccgaaaattccgcaaatatttggacattctgtacgaatatttgttcagagtgtacgccggacttcccgtggtgaagccacagttttattttggcaaaactttcacaatttgtttggtgacggaagtggtgcaaagtctggcaccaatttggaacttttacttctgcccaaactttgccagcggaaaagggcacaaattggacaaactttttgtgagaaattacgaattgaaactgtacaatgagcagaggctgaattatggagcacatttggacaacaatcatcacaaggaaaagttccagggaatatttgttgaaatggcacttcaaaatgccaactacgcatttcggcacaattttgacacatttttggcggaaatgctcaaaagagcggagaaagggtcactacacttcccaattctgataaccaataatgacggttcattgatgattgaacagctggcgtttgaatcgtactttttggtaatttccaccgacgaaaggaatatttattgaaacgaatattttcagaccggagagcgcctatttgtagaatttgttagaggtcagtcctattttgaacaattttgctgcgatttggaaagagatggtaaattgaaggattttgtcatggcccaagaagccactctcgaagaaaagcaaaattttttggcgaaagaatatgagacttacttaggcattttgtatttgatgcgacacaattggcattgtgacaaaaaaggggaggaaattggggaagaaaaatggcggacaaaatgcgaaagatttcacaaatacacaaacattgtgtacgaatatttattcaaagtctatgcaaaaagtaaggaaggaattacggtagaatataatgttgtttggcatactgtaggtttaaaattaaattattatttttaggaaattaattaattttttcaaatttaaagctgaagagcctttgttgggtcagcaattccccgtatttaaaccaacgtttaatgtctcaacattaataaatgaagtattgctttatctgcacaaatgttcagtgttattttttgacgaggaactcagaaatcaaaattattatatttttaaaatacaattgcaaaatgggcacaaattgcgcaattataaggctaattttggcactttggaagaatcgctgcgcaaaaaatttgacaaaaaactgaaaacgatgcttaaaaaggcgagagaaaacgaaaggaggacgagagaatggagtgccaattacaatgacagcagcaatttgctgtgggaatcgccctttttccatagagtttcgcgg

SEQ ID NO: 81521 - DNA, 103 bp, Heterodera glycines
  Genomic contig location: Contig_ID=SeqID_17089; Location=2347..2449; Strand=-
  SCN-specific regions: Sequence locations=1-75
agcatcatcgggtcgccatagtcacgcgtaaaactattcgacgaattgactccaatgaatggacaatgaaaaagcataattaaattaaaaaaataataataaa

SEQ ID NO: 81522 - DNA, 837 bp, Heterodera glycines
  Genomic contig location: Contig_ID=SeqID_17090; Location=45..881; Strand=-
  SCN-specific regions: Sequence locations=1-429,451-575,599-697,719-837
atgagcgccgcacaagtggagtgtcagcgacgtgtgacccagctcaagcggcgtgcagttgagacgtgcgaagcgccggctactattcgtgcgcaagtattgcagaaacagcaacccccgtgttggctgcttttccgaccaaagctgcgacaaaaaaggtcaacgtttgcaaatttttatgccaaaatttgatttttttttttcctttgctttaggttataaaacatgttcgtcatgacgaagatgtaccacctgctgcaccactcagtttggacgcattggaattgccgccctcgtacagaatgtacaatcgaacagagaatgacgaggagaattttttgttggcatataccggcgtttttcaaattcagggacaggctggaccgcaaaggtgaaaaaataaaaaccattaaatttcacaaatttccatattaagaattttgatatttgtcgttcttcaacttcggaatggagcggtattatgaaaaatgtctacgcagatggcactttcagtttggcgccgcctttgttcagccaaatttatgttctcgcaaagtaaaagcctatgttttcacgttttttgttgttgtctttttagacgtgataaatgggtttttccgattgcgtactgccttctcacttcaaaatgtgaaatgatttacacacggatgcttcaactaattgtccaaaaatggccgaattttgcacctgaaactatatcgttgggcttcgagcaggccgtggttgctgctgtccgtacaatgttgccactctgtcgtgtgcagttctgctttttccatttagtgggaaatatgaagaaacgaattgctgccgagg

SEQ ID NO: 81523 - DNA, 57 bp, Heterodera glycines
  Genomic contig location: Contig_ID=SeqID_17090; Location=1402..1458; Strand=-
  SCN-specific regions: Sequence locations=1-57
aatgtttaatttggatgcttcttgaaaaagttatggttcactaaacttgcaaaaaaa

SEQ ID NO: 81524 - DNA, 1516 bp, Heterodera glycines
  Genomic contig location: Contig_ID=SeqID_17091; Location=426..1941; Strand=-
  SCN-specific regions: Sequence locations=1-200,222-309,334-493,515 -568,590-728,751-876,898-953,982-1133,1159-1348,1376-1516
atgtactcagaagaagagatacggtttaatgctcaggcaatgataagagaaaataatgaaactaatgaagaagaagcattatttcaagatgaaatatcaatgtcaatttcatccggtgaatctccaaagcgacataaaaacgactctgtggactcagaaaaagagatacaatctcggttaaatgatcaagcaatgacaagacaaaataaagaaattaataatgaaaatgcattatcttatggtgaaaaacaaagttcattttcgaaagagattaatgtgcatgatcaatatgaaaagacaatggcctctgatgaattagaagaaggagaaattgagccagaaattagagataaagaattaccttgttggggaaatgagtcggactcaaatgcggcaaattaccattctaaaaacaacactcttccatcaccatctgagaaacggcaagagtataataaagatcatcggcatattgcagtagaaaaacagcgccaaggacgggaatggacagaccgctcaaaacatcgccgaagatcacaatctccagagcgggcagaaaaacagcgccaaggacgggaatggacagaccgctcaaaacatcgccgaagatcacaatctccagaacgcgcagaattcaacgatagctcgaaaaggcaagacctatatctaagaaacacaagcaaagataaggaccttagagtgcgatcagaccatcgtaaattaacaaactcaagaaagaattgcagaagcaattattcaccagaccagcattggcaagaatcgccatcaaagcgtcgtctcatattgcctgaaaataggtataagtttaaccattttcaatagaacaaattatattatagggcacctgttcgttttcaaattaaaaaacaatcaaaaccagtcaataagcatgcattagaccctgaccacaacaagacaaatatacaatcaccaaatgtaaaaccaagaaacaacgaaacatcatgttcacaacaaataagttctgaacaaacacatgcagaaacaaatatagaaaagcatgaagaacaagggaacaagaaagcattagatgcagaactaataaacgacaaatcaccaaatttgcaaccgtcaaacgaaatattatcgggagcagaaaaagctgacaaagaagttccaaatgtagaagcatccaacatggaaataaatagtgaaaacgaacaactacgaatgagaaatcaacaagcaaatatacaggaaacatatgcagatccaatgcaattagaagcaaatatagaaacggtccaagtacaacggaggctcacgaaaaaagcaagcatagatttgccagaatcatcacatcgaggacaaataaataatgaaccaacatattcacaaaggctagaatatataagaacatcgctcgaacatgcaaatattgaatcgagtaattccaaagacaaagaaatcgtagacccgcccgcaactacagcagcaactaatgaccagctgcaatttttattgtcccaaattcaag

SEQ ID NO: 81525 - DNA, 2598 bp, Heterodera glycines
  Genomic contig location: Contig_ID=SeqID_2774; Location=54..2651; Strand=+
  SCN-specific regions: Sequence locations=1-321,372-466,488-830,869 -976,999-1021,1253-1329,1362-1618,1641-1859,1881-2223,2272-2368,2407 -2598
acattctcatccagctgtgctaccagaaatgcgaacaatcggacaccggcaactattccattcgcattgtgaacgacttcggctcggattcggtggacttgcgcctggaggtggtcgatcgccctgcaccgcccgaagggtcattgaaggtgctgaacattgggaatatttttgtaaacagaaaatgctatgagagtgacatatttgtaaaacaattaggagtggatttttttgttttttttagaaatcaatttttaacggagtattttcgtttttctgtattttatttttattcctcgcttaaaacaggtgttatgatgcatatttttgaatattttataaaaattttttaccaaatatattttttttttgttttttctcaagaatttcgcttctgctgatcatgttccagacaaagcatccacattcaaaaattttttttaaattgatcatttttttctttgtaaaatgttggtttaaattgtccccttattcaaaacgaaacttttaaatatttaatgtattacaaaatcatgaacaggagcgaactacgtccggtagcggaaggcgacgcgttggcagcaccgcggcggcccggcaggcacaggcggcagcagcggcttgcgctgcggacgaagaagcaccgaacgaggaggggcgacaggacgtggcggtggtgacaaaaaagatggcaattttggtaaaaaaaatttctaatttattggatatatttttcggggtaaacgcaattgcgaacttttcatcaaaatataatatttttgaccttttttatttatttttccttaatgcatcaaggaatttttgttttctttattttattttttatattatttaaaataaaaaaaatcattcatttcaaaccgatttaaagcatacatgcgaatgcgtcgggcgtaaatattagtgtgtttttttggcatgatgatcaattaataattttccaataattctaatcaggatttttattgaattgtgaaaaatttcgcagaattcgaatgcgaatatttattttatgttatttataaataaaataattatgtttttaatgctttaattaacttcaaaattaaagagaaatttttttaaattattaaattaatatttttaattaatcaatatattacagaatttaaattgcaaatatctttttatttatattttttaaataatgatttttttaatatatttatcataaattgaataaaaaacagtataatttaattgttttattgatttgtgcaaaaaaattgaagtcaacctggcttgagtcagataaattgaattttttctaattgaaatttggagaacaaaatttttctaaaaaaataaaatataaatttcgtcaaaataccactaatttaataaattcgtaaaattaaggcacttcggcgcgccaatgatgagcatgaaactgaatcatcagctgttgatgaagacgaatatgtggtcgaaagcgatgatgacattccggcggttgaggtgggaataaatttgaaagggagggaggggggtcaaaacgaaaactttgcaagagagggggtggctctttttttcgtgcttttttcatggaaaaactttatgactcttattcctgtctattttctattttttgtgcctaataacccaatctatattcatgataattttcatgagtcaagactctcgagcatcacacaaaaacattcatgagtctcgacaaaagaatagagagttgagacgaattttttagcatcgcagcagtgtggacatgcgtcgtgaatcattggctgaaatcctggacctgggcacatccggcacaccggcacggattgggtgagccaaaatacagcttccagcagaaaatctggcaccgaattttggaatggtgccaaaaaaatcggtgccaaattttgcatcactaattttcttttaaatttgactaaaatttttcaatttacaaaaatttggcaccgaattttggaatggtgccaaaaaaaatcggtgctaaatttgtatttaacaaattttcttttaaacttactgaaatttcaaaaaaaaaaaaaatttcagtgcctcgttgttccctggaaagcgtgaagaacgatgggtcgacccattaccagaaaagctgcaatttcagcagcagaagaacaaaattgccgagctgaaatgcaaatactcgcgcgccaatgccaaaggtgaaaagccatgggatttcaatgcttttattaaaattaaatttgaaaaataaatcatttttcattatttaaacaactgataaaatcataatcaattacttttttcatcaataaaatacgaaaaaaaataaatgagaaaattcaggatatattcaaatctaatcaaattctaaaaaaaataaatttttaaaaatttcttaaatttaatgccaaaatgtttttgtttcagtgcattggtacaagggccgcaaggagctgttctcggactgtcttaagtacaaaattctgatcgacaagcagtccatcacgctgatcatcaacaacccggacccggacgacagcggcaagtactcatgcgaagcgaacggagttccgaccaattcatttatcactgtggagg

SEQ ID NO: 81526 - DNA, 2203 bp, Heterodera glycines
  Genomic contig location: Contig_ID=SeqID_2775; Location=105..2307; Strand=+
  SCN-specific regions: Sequence locations=1-283,342-592,819-979,1008 -1067,1095-1565,1587-1936,1961-2104,2164-2203
cccaaagcaggcgagccgcccaccgaagtgcctcaagaacgatgggtggacccattgccagaaaagttgcaatttcagcagcaggagaataaatttgccgagctcaaatgcaaatactcgcgcgccaatgccaaaggtgattattaaaattaaatttgaaaaattgatcatttttcattatttaaacgactgataaaatcataatcaattacttttttcaatttcaataaaacaccaaaaaataaatgataaaattaaggatatcttcaaatctatttttaggataataaaaatatattaatttttaaaaaaataaattttaaaaatttcttaaatttaatgccaaaatatttcttttcagtgcgctggtataagggccgcaaggagctgttctcggacggtctcaagtacaaaattctgatcgacaagcagtccatcacgctgatcatcaacaacccggacccggacgacagcggcaagtacaaatgcgaagcgaacggagttccgaccaattcatttgtcactgtggagggtatgttttggacgggcggacaaaaaaaagcagttaaacattttccacggacatttttggtttttaatttaaaaaatttacttttttatctaattaatactttcattttatttaaaatatatatatttttttcaattgtgtatatatttataatataaaatttataaaaatgttttaattttttttaaataattatttcatattaaagaaaataaattattgctttttttcaaattagataattatatttttcacataattttatatagaatatgttttattaaaagaatgcattttgtttcagactcaacagaccaacaaccattgtcctacaccgcccgtcgcagcgagtcgcgcagaccgaaaagtgccagaaaggaagccgcagcattgacccccttggacgccatgcagtggttggttaaacaaaaaaaaacgaaaaaaaagtttaattcatttattttattttttagttgcagcagccatttgacgccgccacatcccaaaaacacggtgagcaaattcgggtttttaatttttttttttttttttgtttttttttcaataattccttggtcatagtaaagtttgttccgcaccctttttcgaaaattttttccattggttttcatgtcgttgatcacgaatccggcctccttttcgaccaaatccgaatcccggacccgaattcgaaccaaagtcggaaattgattcttcacaaatgctcctttagtgtccaaaatcgattcaaatacatgaaatggccacgattccctattttctattcaattcagtgcatttggatcgatttggacaataaggatgtattttggtaaaaaaattttgactttggttcgaattcgagtccggggtacgaaattaaattatttctattttctaaagaacctgggcacattcggcacatcggcaccagaccaaccattatcctccaccgcccgtcgccacgagccgcgcagaccgattgacatggcggcggttgaggtgggaaaaatttgaggccggagtgggtggggccaaatgttgcttctcaccactttttttctgtgttttttaaaattttttttggggggtttggcgagatccgatggtgccaatagtgaaattttgaaaatttgaattttgggcttaatttttttattacataaaacccagaaattgaaatttttgctctttgttgaaataatgagttaatattttccaattttttaggtgcgctgcgcggacgaaccgctgctggccaacgcgccattcaatgtgccagggcggccctacccaccggattcactgtacaccacctacaactcaatcatgctccattgggcaccaccgttgcgggacggaggcacgccgatcactgaatacgagctggagaaacgcgagcatggcaccaagctgtgggagaaggccgacaccaatgccgaccccaaagccaacaccaaaaagcagtgggagaaggacgcatttgccaatgtgccggacacacgattcaaggtgggggaaaacaggagccgttcgtcccctccctctcgtttcatcccccccccctcgccgtaaattttttttttaatttacaattagaaatttaaacaaaatcagaaaattttttataagacgtttcagcaattttttgcaaaaacagaaaatcgttag

SEQ ID NO: 81527 - DNA, 1363 bp, Heterodera glycines
  Genomic contig location: Contig_ID=SeqID_2777; Location=612..1974; Strand=+
  SCN-specific regions: Sequence locations=1-237,266-326,348-662,684 -777,799-1086,1108-1215,1237-1272,1295-1337,1359-1363
  Gene Ontology: Mol. function=protein serine/threonine kinase activity; Cellular component=nucleus; Biological process=cell cycle
atgtttttcaaggtcatcccatttgctgccaacgaggagcattgttcgaagctcgtcaatggcgactacctgaagccagcaaaattcatcttcaacgagctgctcatcaccaaagagcttgcaaagctatccgagaacaccggcattggcgtcacgccaacattcacacaattgctcatgagcaaaatcgtcagaggtagttttttaatggagagacatttaaaatgcacataaaatggtgtaaaaaatgtttggaaaactccaattgctaaaactcatatttccgtttaggctgttttccgcccgaattgctgaccgcctgggatgccttcaagaagagaaagcctgaattggcggagaatgaacgaccggacacttatgccgatgaaggacttcatttcatagtcatcggtctttcctatggcggaaaagacctggaggcgtatacggtagctttcaaaaaaaatgaaaaaaaatgttttcgcagatcaaaaatggccgagaatgttactccatcttccaccaaatcgccttgtccatcgcgatcgccgaagacgtgctcaaactagagcaccgggatctccacgccgggaacattctcgtggaggagtgctcggtcgatgaaaaaattcggtaagtagcaaaaccgatacactgggaaataatgcttattttaaaggtataagtaccttggaaaacaaatcgctgtccgttcaaatggggtgcgtgcctccattatcgactattcaatatcgcgcatagaaaaaagtaagcattaaaatttttctcattaattgtgttttcacaaaaccagaaggcgttgtgttcttcgctgatctcagcgaagaaacgggacttttcgagcaaaatggtgtcagcaaaggtggcgactaccaatacgacgtctacaggatgatgaaggcggcggtcaagttgagagaaacgatttttttacataaaaaattttttttagcgaaaattgggccaaattctggccccaaacaaatgtcctctggatggggtacgcggcaaagaagctgtttaacaaccgcttcatcagagcgaagagaaaacaagcgattgaagaacttttttcaaattttgaaaacaaatttgaaacaattcaccatttgcttgcccatcctgattttttgtctgtgttcacggcacatcaatcagcgacctacaggaagaagatcacgaaaaccggtaaccaattttttacattcccatttttcctgaatttaaaaattccaccaactttgggtgtgttttgttattttcagccaagtttcatcccatttatgagaacttctcttctccaaatagttactcagtttttgtttgttctttagccctttaa

SEQ ID NO: 81528 - DNA, 497 bp, Heterodera glycines
  Genomic contig location: Contig_ID=SeqID_17092; Location=1338..1834; Strand=-
  SCN-specific regions: Sequence locations=1-497
tgacgatcgcccattggacatcgatgagatcgagtccgaagtggcagcataaaacagacgcacagactctgggatgcctcaccactgtctgcaactaaaggtcggaagcgttgttgtcatccttatcaacaaaagtgatagggaagggctgatcaatggcacacgcattgtcctcgaagaacttggcgatgatcaccttgtcggtcgtgtaatcaatcaatagcaatgctattggtggccaagtgaggtgtttccttgaaagatctcgcaatatcttcgaggacaaaacgcctggtgggctaaaatacgcgcgtttgcagttcccaattaagcctgcattcgctatgaccattcaaaaaggtcagggccaaacaatccgcactgtcggcatttaccaggaaagggaagtatttacccatggtcaattatacacggccttctctcgggcaacggacggcaacaatgtccgtgtgcatgctcccaaaagggagatcgat

SEQ ID NO: 81529 - DNA, 490 bp, Heterodera glycines
  Genomic contig location: Contig_ID=SeqID_17094; Location=817..1306; Strand=+
  SCN-specific regions: Sequence locations=1-109,132-134,187-223,245 -312,334-334,358-490
atggcggtacgaaaacgtcctggcccggagaatccgtgcgtcggcttcgcgatactaaaaagtttcaaatttagagatgtaaaatctaaaatgtttccaaaaaggtaacaaaattaaaccaaatcagtattgagataaataattttaaaatcaaaaattgttgttaaaaaataaataaataaatttggagatgaatttttgagaaatttttgatttctcaggggtgtatttttgaaaattttcgggtcgattcttaggggtgtattttttgaaaaaaatttttaagtcgcttcttaggggtatatttttcgtttttattgcatttttattagacaaattttgggaaaaacccaaaaatagttgaaaaaaaacatggttttcgtgcatttcaggtcacggggagctcaggaaaaaataatgaaaacctataaatcgtatccctaccgttgaattgattttatttttttttgaaaaatgtgcaactaaatta

SEQ ID NO: 81530 - DNA, 1319 bp, Heterodera glycines
  Genomic contig location: Contig_ID=SeqID_17098; Location=235..1553; Strand=+
  SCN-specific regions: Sequence locations=1-9,152-481,503-743,765 -1074,1098-1123,1145-1319
atgctgactgacgaagaggaggaggaaaatgaagatttcggagaagagtcgaacggagaagaaatgtcggaaggaaagggggaggaggaggagcgaatggcggagagattcggtggagaagagcagcgacaggacgaggaagaggaggaggtgctttacttgtgactctgcacttttatatatgtgtttcgttagagagaactaataattgttttctttttaatttataacttatctttaatttattatgttttttgtttttgttctgacatttcgtattaaaattttgatttttttattctgtccgataaatgaggttttacaattctaaatgatactatgttccccaaatgccaccgggaatattacttaaaaacctagaaatatcccctgaaaggatctgaaattttttgacaaataaatccggttagaaggttcatgtccatatttattaacaatcgaaaggaaaattaacggcctatcaaagtaaattcacataacaataattggtgaggtaaaatggcgtagaaacaagcttaacattgtgcggattaagtttattcaacatccaattcaatgtttttattgtcagtcttttgcaaattctcgtagagtcgagcacccaattcgcaggcaaccaacggacccgaattttgacgaacaaagcgcatgagcaacaacccgtccagaccgagcagctcatcctcaaactgtcggacattccatccctcttaaaaagggataataattcaaaattgaggaaaaaactgaccaatttcggtcgggacaagtttaaggaatgatttggcactgtaaagttggaacggacgcataagacgggcgatgaaaaggaaggaattgaagacagtcaggaagatcaaagcgaggtaccaaaagtaaaggaacaggaaaaccttcaacgaccaaaggaaaattgaatgattgtgaaaaattgtacaacaccttttcattgatcatattcacgctcaacacacatcgaacttcgctaaaattcataaattttaattcaaattctaagacattttagagaacctgagaagaccgccgtccgtatgtcccaaaaaatcccttccaaattcgcagtaggaaatgcggggaaagtaagtgaattcctcttgccatccgttgttacgccaaatggattcgatcagcttttgcgagggaatcaattattattttacaaatctttcaaaattactgtaatgccccatcgccaattttcataaccgacgaaatgagtgaggaaaaacaactgggcaccattgacaaagatgttcataagctttaaacaatggcaa

SEQ ID NO: 81531 - DNA, 331 bp, Heterodera glycines
  Genomic contig location: Contig_ID=SeqID_17099; Location=1631..1961; Strand=-
  SCN-specific regions: Sequence locations=1-141,200-331
atgccaaaaatggagaaaatcccaaaaagtgaaatcaaaaagtgtctcatctgtggcggattgtcttctttcaaatattacagcattcctagttgtgaaggtattgttatggcacaagcactttttgacgaaagaaatttgatttttaaattagtatttgtttaatattttatttcaaaatttatcttttaattattttcagcgtgtaaacagttttttcgtcgcacagttatgctacagatactatacgtgtgcaaaaaaagcggaaattgcgaactgttacctgcacacaacagtaattgttttagaataattatgaaatttaaataaa

SEQ ID NO: 81532 - DNA, 1446 bp, Heterodera glycines
  Genomic contig location: Contig_ID=SeqID_17100; Location=975..2420; Strand=-
  SCN-specific regions: Sequence locations=1-532,554-890,916-1446
atgccaaaaacgtcgacaccactcaaccaacgggatcagcatggtcagagaaaagaagctgtgcttcaagtgcatgaagccaaaccaccgcgcatcaaatgcgctcgaccatctaagtgctatcactgcaaacgtcggcatcccacggcactctgccgagatcagtacaaagccaagaatggcatcaacacgcctagcacctcttgcagtgaagagaagccaaatgccaacgatggcaagcgatcaacagtgatcgaacaacaacaaatgtgtaatgccatccaaagcaaggaaaccagagcgttgctaatgacgacaaaggcagcgatcttcaatccgtcacggccatccctcagcatgatgggaaccatcttcattgacccgggaagccaccgatcattcatctcgagcagtgcagctgaacaattggatatgaacgtcctcagcacggaagaatgctacttgtccagcttcggtgaacgagaaccgaagcgatacataagcgaccgcgttgcaatcggcattttatgccccgaccaggacaggttcattttcaacctgaacgctttgaagttcctgctgaatgatttgccggtactacaactaaacgcattggataatgacgaacttcaacaaaagaagctttccctgccgaatgagtcacggcaaccggacattctcctcggaatggacgtttggcaccagctgaatgttcaaccaattgaacaactgccaagcggatttacgatttgccaatcgaaaatcggcaatatcatcagtggaacagggcgaatcaagctcaagcaaccgtccaacatctctttcgtgctaatggtcaacaacgatgaatcgccacaaagcagtaaaacggctcagaggcagaaaaacattcaacaaaaagaaaaggacgaactgagacggcatcaacgcaacaaactcttgtccagcattgcaacattgcgatcaagacggaagagagaatcggctcccatcagctcaaaatcaatcgtgattgatctttcatcagacagcgacgcatccggcattgagatcatacaaaatccagtcagggatagacaagccaaatcaccaaatgagcattcaacggcaccaattcctatggcagtgcaacggctaacaccaacaaggaagagttcatcagttgccaagcgaccagcattttcttccagcaaacaaccaaaaggaaaagcagcgaatcccgcacaaacaagccaaacaaatgaactcaacagaaaaatgaaagccttgtcgccaaccgcaagtggatcaggcgccaaccatcattgcgtcgctacattggccagaagctcggactcaacaacagtaattgataagggcagtcaacagaattgcctaaacatgagctcggcaacaatcagtaagacaccatgccaacagcactcgtccgagaagacgttaaactaa

SEQ ID NO: 81533 - DNA, 1268 bp, Heterodera glycines
  Genomic contig location: Contig_ID=SeqID_17101; Location=541..1808; Strand=-
  SCN-specific regions: Sequence locations=1-40,63-377,402-742,778 -946,968-1066,1102-1165,1187-1200,1229-1268
atggtagtctctcgagcgacccgcttcacttatgttgaacaacaacacacaaaacaccaaaacaattgccagaattggcacaacagcgacttgcgagttcattttgtggttctaatgatggtgatggtgtgtaagttagttggttagggtttggaaaattttttaacacaaaatgtatctgtaaaaatttattgaaaaatttattcgcctatgaatcagggctgggcgtaattacggcttacggaaatgcgacattttttgtccctcgtaaatacggatgtgggttatatttttgcgatttttgattacataattgaaaaaaaccattaaattacggttttcgttattgaaagcccagccctgctgccaacaaagagaaatattaaaattaataattttaagatttttcgaaaaaagatataatgtatgaattggtattttcattgggtcgaaatttatttttatgcaaataatttgtcatttttttacaacatatcgtatgattgcacaatgccaggtcattgttgctaaatgaaatgtactgattttttagatctgccctaatttggaagtgagcaatttgaaaaagaaaatattcagacttttaagatcttttggtgttcggcatcctaacatttggatggagcctaacatggacatcccccataggccttcgaatttgtctcagacgtgattaacgcctaccgtggaaagtgttactgaatgtgatacggtatcggcgttaaatttcttttttcaattttaattatttattttggagtactaaatgttctcttaacctttttgtataacagcaaattaacatgttttccaaacaacaaaaaattgaaaatattaaatataaaactcaaattttaatcaaaaaacttgtgaatttttaaattaattcattcatttttttgtgcgaaaattgcctcagtaaatttttattttggtttttcctgaattccctagcaatagttattatcacttttttaaaatctcatttttttcttccgaaaactccaccacaaaaattcgccacttcgaaaaatccgacctcatattaaagtttatcaaatttttggccaaaattaaaacaattttgtttggccaatttcttcccaatttcattaaaattaaaaatcataaccgcaaaatttggcattcatttgagaaataattttttcgacagcgcacataaaattaaaaaatatatttaaaaaatgataaactaaaaaacatggatgtaagtaatcaaaaataaa

SEQ ID NO: 81534 - DNA, 213 bp, Heterodera glycines
  Genomic contig location: Contig_ID=SeqID_17101; Location=2033..2245; Strand=+
  SCN-specific regions: Sequence locations=1-176,206-213
atgccaacaaacttgttcatggaaactgaatggccaaagaatacgaaaaatggtggtcagcagtgagtgccaaaacaggtcggaaattaattgccaccattggtgaagccaatatttatagatatttgttttccgattagtttaattagtgtagtccaacaattgagtaccatttcgtgatatttttggaaaaagaaaaatgtttggtcgaat

SEQ ID NO: 81535 - DNA, 1471 bp, Heterodera glycines
  Genomic contig location: Contig_ID=SeqID_17102; Location=58..1528; Strand=-
  SCN-specific regions: Sequence locations=1-108,130-143,166-194,280 -283,306-326,348-626,648-1361,1387-1471
attttaagtaaaaaaaatccgcagaatagttacttaaaaaggtaaaaaaatatatcaaaattaggcatcaaattaggtataaaaatttcaaaataggtaccaaaataggtaaataaaaatttttattaacgatttttagtgaaaaaagcaaacaaagagggaaaatcttggttctacatatctctttgtaaacgaaaatttaaatatattaatattttattagataatattgacattttaaattaaaaattttgtcaatagaaaaaaaaaataaattttgggataaatttttgagaaaattttccaattcttagggtgcatttttgaaaattattttggtcgattcttatgggtatatttttgattttattgcatttttgttaagcattttttgaaaatccttaaaataggtagcaaaaatgccgaaataggtaaaaataggtattataaaagtgggtgtagaagctccaaaccaagctaaaaactcgttttttatgcttatctcaacgttacaagtgcgcaaaaattttaggtatttaactaaaaatcgcatccctacttgtcacacaccaatttcctattttcgtctcagtaaaaattcactatataaaatgctatcacggatcaaaatcacggaaaatttgaaaaaatcagtgatccgagatcacagcaccccaaaaaccccgtgagccgtgatcacggccagccctgctaccaacctttaactgactgatttataatcataaaatttcaattttcgaggcccttccctgggaagttgctatcggcatttaaaatggcatataaacttatgcattttccgagttacacttcgcgaggtttccttgtcaattcactgttttaggtattcgtggattttaccggtcggtttttctttcttcttttttcctttccctctaattgagtttttcaagtggctttttctcctctctgatgctttacatcccttctgctatggtcttttggtttacctattacacttttctcactcggcttaaaagtctccgtggcgagtggaaaatcagtgcgaaaagctcgggaaaaaacactgtcaatattcggggggacagcgagaatttgttggtgttgcaagcattttccggagcgttgggcggaatttgtgcgtcgctttttacaaatccgttggaagttcttcgggtgaggatacaggtaaaaactgctgaacgaatgaatagtcgtccacttctgtttttaggttcacaggacgaattattgggaaaccattcggcgtctttaccatttcgaggggtttcgcgtgttcacgaagggactggcgccgagaatgattagcagcggtcacttttagcaattgccgttgcctatgttatttttaattaatttaggcataaattcctgtttaattctgaccgggtacgaagtgataaaacgcctttgtgtgctgcctgaattccgagatgccatcgtctgg

SEQ ID NO: 81536 - DNA, 199 bp, Heterodera glycines
  Genomic contig location: Contig_ID=SeqID_17104; Location=289..487; Strand=+
  SCN-specific regions: Sequence locations=1-199
atgcgcacacaactttttactatttggtttttttttttgtaagatgtcctttcggcctaaaaatcaatgtattttttccaaaatcggttaataaactttaataaaaatttccaggattttacccgacttcgcctatcggcactacaaagaccacaaaccccctcaatttatttaaaagacggaatgccaaaatttttga

SEQ ID NO: 81537 - DNA, 135 bp, Heterodera glycines
  Genomic contig location: Contig_ID=SeqID_17104; Location=1..135; Strand=+
  SCN-specific regions: Sequence locations=1-135
tgacaggacggagatagagagaaagacgacagacaaattaccgattgattttttaatgtattgattgaccagttttgtaccaaaaatcttctcttttttctggattgatgcacaacgatgggaattgttcaaaaa

SEQ ID NO: 81538 - DNA, 1144 bp, Heterodera glycines
  Genomic contig location: Contig_ID=SeqID_17104; Location=1196..2339; Strand=-
  SCN-specific regions: Sequence locations=1-102,128-230,252-266,288 -979,1010-1144
  Gene Ontology: Mol. function=protein tyrosine kinase activity; Biological process=protein kinase cascade
gatgtcatggaggaaggcctgaaaagcatggaacaataaattaaattcaaatgaattgtcaaagcaaaagcaacacctttggagagacaaaagtgccgcagaattggtgaagggaaagaagttgccacacgaaggccaaactgagcacaatttgcaacagtttgaagtagacgatcttccgcataatagaagaattaaaatttgacgggctcaatgaatgagagcaaattttccaatccctccctttatatagacaagcaaaaaaatttcgaaatgaaggggaaaaaagttgtataaaaggcagacatttcctcatttttcctcacaattcttttcatcgccctcatattgtattatattattattattatcgtccatcgtccatcgtctacaacacttcatcacacacgaagcggacgtgcgtgcccggccacaagcacaatggacgttgacatgtggaggctgccctactatcacggactggtgaggagcagtcaccgtcccccactttccacatttaaatttttttttcaactttaagctgccgcgccaagacgtagtggagctgctgccgaacgacggggacttcctggtgcgcacgacagaagaaccggactgacccacatccactccaagggcatcatccattgcgacgtcgctgccaggaactgcctctacacggacggcgtggtgggtgaaaaaaagaaattttttttttgtcatgaaacgtctaaatttgttcatttttccccacaggtgaaaatctcggacttcggcatggcgaccaaggcactttcaaagcaactcgagagcggcgcaaaactgcccgtcaaatggatgtcgccggatgcactgaccgaccacttcttcacccagaaggacgacacgtgggccttcggcgtgctgtgctgggaagtcttcaccaatggcgagacgccattcgcagaaatgcgcgggagcgtgatcttggcagcagtgagttaaaacccaaaaaatttccatttttaatcgtttccccccttttacaggtgacaaacggataccggctggaatttccgaacgacgcgcctccgaagttcgtcgagttcgtcatgcagcacatctgggacccgaagcgcaacaaccgatactccatgggcgcggt

SEQ ID NO: 81539 - DNA, 262 bp, Heterodera glycines
  Genomic contig location: Contig_ID=SeqID_2778; Location=180..441; Strand=+
  SCN-specific regions: Sequence locations=1-262
cataaaaatggcactgatgttgaggcagctctggaggcgcgtctttcatctgccaaggacaatctgatcagatttggcgacgaaatctacataaagctgagcggcgaccatggccagagttgtatgaagattaccgtctcattcagccaggctgctcggtcaaattctccatcaaacaatttcgtgctctgacaaaagaatcggcaaaaaagaatggagagaaaaaatggataattattttcacattaaaaaaaaattaaaa

SEQ ID NO: 81540 - DNA, 155 bp, Heterodera glycines; identical to SEQ ID NO: 51421
  Genomic contig location: Contig_ID=SeqID_2778; Location=2558..2712; Strand=-
  SCN-specific regions: Sequence locations=1-155

SEQ ID NO: 81541 - DNA, 1398 bp, Heterodera glycines
  Genomic contig location: Contig_ID=SeqID_2778; Location=546..1943; Strand=-
  SCN-specific regions: Sequence locations=1-337,377-449,471-488,554 -589,616-637,804-856,878-1208,1234-1398
atgattgcacgtaattgccgaaaaaattcgagaccaatttccgaatgttgaccgactaattgcaaaacgaaagccgtctttgtcaaagcgccttaccgagtcaaaaaatttggaaatgtatctcataaaatgtattacaaaaataaaaattcaaaaaaaaccgaaacgatataccgaaaattattcatcggtttttttcggtttcggttttttttcggttttttaaccgaaaccgacctaccgaaaatttttcggtttttttcggtttttataccgaaaccgaccgaccgaccctcttgtccggtctctagttgaattttaattaatggtgaaacagtttttatttatattattattattataaaattattaatttcgatcattcagtagagagaaaaattcactttacaatttaatggatatagtgatcctgtcaatattttaccattaatgtaaatttataagaaagagaaaaattcatttttgagaaatatttttattattatttatttctttttttcatatcgaataaaatataaattttaatttttaagaaaaagaaaaattgtcaacaatgaaattatgcctattttcaattttaattgtatttttaattgctcaaattgaaattgtagcggaaaagaaaaaattggaacaaaaaacatttgaagaaatatttggggaaaaatgggaagaaaaagaaaatgaacagaaaaaaagagaaattgttcaaaaattcaacaaaattaaagaaaaaatcaaacaaaaagagagaaaatattcaacaaaagaatggaataaaattaatgataaaattttgaaaaaattgggcacaaatcgaaagataatttaccaatggatcaaagaattaagaatatacaaataccaatgcaaattgaaaacggatgaacaaaaaattgaaattgttcaaaaatttaatgcaatgaaaaatgaatataagcaaaaaggaagaaaatattcgacaaaagaatggagtcaaaattatgaagaaatttgtaagaaaattggagtaagttatggaacaattcaaaaatggaagaaacaatttggaatgggtgaaagaatgacggagaaagaaaaaatggaaaaagtgaaaatgtattggcaaataaaaagagaaaatccaaaaattagtgccgagaaaattgcaaaaatattgaaaattaatcgacggaccattgacaaatggaagaaacaatttggagaagaataaatgtaaacttacaaatgaaataggaatttttacaaatttcaactttgttttgagatgttaatttgtgcattttgaattttgttgtttttaaaatgcataaatttgttaaaatttttcgccctgaaacggacttaataatgataatggttttttcgaaaaataaa

SEQ ID NO: 81542 - DNA, 47 bp, Heterodera glycines
  Genomic contig location: Contig_ID=SeqID_2778; Location=3048..3094; Strand=-
  SCN-specific regions: Sequence locations=1-47
ggagtccaattatatggaaatccatatttttttcctggactgtggga

SEQ ID NO: 81543 - DNA, 863 bp, Heterodera glycines
  Genomic contig location: Contig_ID=SeqID_2778; Location=2431..3293; Strand=+
  SCN-specific regions: Sequence locations=1-264,286-307,345-383,408 -835,858-863
atggccataaaatatgggccaaaaatcgcaaaatatggacataaaatggcaaaaatctcaaaatatggaaataaatggcaaaaatgtcaaaatatggacataaatttttcaaaattgaatgtaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttaagaaaatttaaatttattcaatattctcaagaaattttggcaaaaaaatgattttttgaaaaatttttcgggttttgggctcaaaaaggctaatttagctgctagggcccgttctaatagaggttttttggaaaaatcccagaatatggataaaaatgccaaaatatggaaaaatatggaaatatggacataaatcgcgaaatatggaaaaatatggaaaatatggatatagaaatccttcctagaagcttcaaaccaaactaaaaacatgtttttcgtgcgtttcagacctcccacagtccaggaaaaaaatatggatttccatataattggactccctaatcataaacataaacaaactcgcacgcattcagccctgcgtgacaaccgcacgcgttactcattctaacggtgctatgtcgttatataaaaaccctcaaaaagggcgttatataaaaaaccgtcaaaaagggcgttatataaaaaaccatcaaatcttattgttaccgtattaatttagaaaaaacaatcgtgcca

SEQ ID NO: 81544 - DNA, 232 bp, Heterodera glycines; identical to SEQ ID NO: 77097
  Genomic contig location: Contig_ID=SeqID_2778; Location=3523..3754; Strand=-
  SCN-specific regions: Sequence locations=1-84,106-232

SEQ ID NO: 81545 - DNA, 824 bp, Heterodera glycines
  Genomic contig location: Contig_ID=SeqID_2779; Location=2167..2990; Strand=-
  SCN-specific regions: Sequence locations=1-15,42-63,230-282,304 -426,458-733,755-824
atgaaattatgcctattttcaattttaattgtatttttaattgctcaaattgaaattgtagcggaaaagaaaaaattggaacaaaaaacatttgaagaaatatttggggaaaaatgggaagaaaaagaaaatgaacagaaaaaaggagaaattgttcaaaaattcaacaaaattaaagaaaaaatcaaacaaaaagagagaaaatattcaacaaaagaatggaataaaattaatgataaaattttgaaaaaattgggcacaaatcgaaagataatttaccaatggatcaaagaattaagaatatacaaataccaatgcaaattgaaaacggatgaacaaaaaattgaaattgttcaaaaatttaatgcaatgaaaaatgaatataagcaaaaaggaagaaaatattcgacaaaagaatggagtcaaaattatgaagaaattggaaagaaaattggagtaagttatggaacaattcaaaaatggaagaaacaatttggaatgggtgaaagaatgacggagaaagaaaaaatggaaaaagtgaaaatgtattggcaaataaaaagagaaaatccaaaaattagtgccgagaaaattgcaaaaatattgaaaattaatcgacggaccattgacaaatggaagaaacgctttggggaagaataaatgtaaacttacaaatgaaataggaatttttacaaatttcaactttgttttgagatgttaatttgtgcattttgaattttgttgtttttaaaatgcataaatttgttaaaatttttcgccctgaaacggacttaataatgataatggttttttcgaaaaataaa

SEQ ID NO: 81546 - DNA, 262 bp, Heterodera glycines; identical to SEQ ID NO: 81539
  Genomic contig location: Contig_ID=SeqID_2780; Location=138..399; Strand=+
  SCN-specific regions: Sequence locations=1-262

SEQ ID NO: 81547 - DNA, 1111 bp, Heterodera glycines
  Genomic contig location: Contig_ID=SeqID_2780; Location=597..1707; Strand=+
  SCN-specific regions: Sequence locations=1-211,242-254,327-842,932 -1007,1029-1111
atgcacaaattaacatctcaaaacaaagttgaaatttgtaaaaattcctatttcatttgtaagtttacatttattcttccccaaagcgtttcttccatttgtcaatggtccgtcgattaattttcaatatttttgcaattttctcggcactaatttttggattttctctttttatttgccatgctgagtcgatctacaaaaaaactcagtgaataattaaataattaattttaattatatagaacgtgtcactgaattaattataattaaatttattttataccattatatttcaagataaatttaaaaagaacaaataaaaatttgtcatttttgttctaattttttgcataaatatcttttgtcatttatggcaaaaaatgaaaaaaaagggtaaacaaaaggaatggcatgaaatttcatactaaaattgaaaaaagaataaaataaaatggaatggcttgaaatcctaggagcaaaaattgcattcgatgagaatgaaatgttgaataaaacaaaaaaaacatttttcaactttgacttcaagttttgaagcaccgggatttgaagtgtttggaattgaatcatcaagctttgaagcatcattttttgatgcatcatctttttttgtatgcgcggaaacaacaattagcttatgcatgtaacggtttaatgtacaaaaacttatcttaatatctttttgttgcatttgttcatgaagtttttttaatgttttaatttctttattttgatagcttttgacgagttctatagcttcatgattttttataaattcttcaaaaccagaattagtagtaaccgaatactcaaatagagataagaaaaaaataaaaattttattcatttttctaggttagaataatattataaatatatattttttaaataaaattcaatgtatattaattttgcagttacaggcagcgaaaattatttaatattgagtgttattgatttgacacatgaattttgtgaagcgcataatataatacaaaattattattattcactgagatttgttgtggatcgcccacactgagtttttttgtggatcgacctagcaccatttatttcttaccattttatacaa

SEQ ID NO: 81548 - DNA, 1545 bp, Heterodera glycines
  Genomic contig location: Contig_ID=SeqID_17110; Location=984..2528; Strand=+
  SCN-specific regions: Sequence locations=1-10,33-141,396-606,638 -775,798-1324,1346-1368,1406-1545
atgcccctgattttcctcctctccttctttttgcagattctgctcttttggttcatcgaaggccatgcaggaccgatcgtggcgcgagagttgatgggcgaattgttcgaaacatacaagacggacatggtaatgcaaatgaataaattatttatttttttaataaatattttaataaatttatattttttaaatttaaattaccaaatgaatttaataatttttttctttattaatttaaattttaattatttcttttgataaaattaatttttttttctatctattccatttttaattaaatgcatatatttgtatttaaattcccaagtaaattaaatttaataatattttatttctttaataaatatttatttatttttattaatttaaatcaccattacttattttaattgcctatttttttgttccttttcagcatgaagaggatgacgagcagcccagtgaagtgagcgtggtcaacaagaagggcaagggctcattctcgtcgcaaagcaccggttctctggacgacgacacgtacggtggcattgcgcagcgttttggtaacggtaagagcgcaatgaattaatgtaattaataaccaatttttaaaatgattttttaattataaaaagggggtaaagctattatctatttcattgaattgtttttcaaaaagctcgagaattacggtatttgagaatttttttaccgtacactaaactcactcactcatgaaccactttatctgtttacaaattttccctgtcaccgaatatttgttacagtaactatcgtataattgtttttttaccgtacactgactcattagcctcattattttattgttactttacaacaagttttctcttgggccaattttcaacaagccatacctcaatttttggcaaatttatatacataaactgctcccctcctccccggcaggcatttctccgtccgcaccgcccaaattcctgcccgaggcgtcctccttttctcatcgcaggagcgtgaactgcttgacacggacggcaacagcacggagcagaccgggctgtactcgtcgacgcccaagcagaaattgttgcccaacgacaacaacaacgacataaacccgcaccattatcaccaacagcagcaccacaacaacattggcggacgcaacaacggacggtacccgccgcatgcaggtcggccgggcgaaaaaacgataggtggacagatacttttgaaaaaacaaatcagcaatttttgatcacttttggcactatgaccaaaaacccattgagaatttttttttatttttcgcgtggcgggaaacgaacgacctgctccgtcctgcatctctcccccacccctccgaatttttttataaatagagatttttattttataaattgcttaggggtcttttttagaaattttcaaaaatttttccaaataatttttttcctacaactttataagaaaattttgaaaaaattcacttttttaagaatttgtttttttcatttttaggttttttttattagaaaaaaa

SEQ ID NO: 81549 - DNA, 135 bp, Heterodera glycines
  Genomic contig location: Contig_ID=SeqID_17111; Location=214..348; Strand=+
  SCN-specific regions: Sequence locations=1-49,71-135
atcggaaggagcaaaaattggaatgatcagagagacaataaaagaagtgatcaaaagcaggaggaggagagaaggtgatcaaaaaagagataaggagaaaaggagaaaaaaaggaatgatcagagagggcaaaaa

SEQ ID NO: 81550 - DNA, 2376 bp, Heterodera glycines
  Genomic contig location: Contig_ID=SeqID_17111; Location=1..2376; Strand=-
  SCN-specific regions: Sequence locations=1-176,199-325,364-537,559 -735,791-838,860-1060,1082-1227,1290-1390,1424-1503,1525-1570,1592 -1977,1999-2093,2115-2376
ctgtcagtgtattcattgaagaattcgctgaaggagaccttaatcgaaataaacacggaggtcgagtttgacccgtacatgacagcggacgaaatcatcgccacggggcgactgaaacatttgcggacgcgggcacggagtgagttttggcatttgtgccattggaatgcaaacccattaattttaattaaataaattgaatcggcgagtaggacctcaaaatgcccacatatgttcagttgtcattgtcgaaatgggcatggatttgcacagcgtaaccgcctttatgatcgccgcctatcgctccggcatgaaaacgtgtgccaaaaaatatttaattttattaaaattcaaaaaaaaattgaaacacctttattcaaatttctcaaactgaaaaaataattgtattgtataaaatttaattattccaagtaaaaaatgaataaaggtttttttaatggtccctccatttcagctccgattacgtgtacatcatcccgtggcttgcccacgtccgtgccgaattcaaattaattatttaatttactttaatcattttttgctcagatgaacgaccattacccgtgggagtcgaccaacgtggagaagcaggaggtgaaggctgcttttgatgacgcaattgtgatcactgcgcatggctatgacaagaaattcatcgaagactttgagcggcgcttcaacatggtcagaagccgaaaatttgttcaattgcatttaattaactaattagccaactaattaactggttagtcaatcagttaactaattaccctcttattgaagtctatagttggctttcatttggttattgcatttggacattgatcaggttgataatcagatagcgctgctattatcagtggctcagtcaatttgcccccaatttaataatttatccctaaaatctcatgaatgaatcatccgcgcaaatgattctacccgtcatcaatttcaggtcaccggcgttgtgagtaatcatgtacgtcttggatttgattttaaaaaattcggttggccctaccgtaccacacacccaaatacagtatgccaccctctcgtacatgtcactgtacgacgcgctgttcctttacgggttggccattcgcgacgcgtttgaggagaccaaaaacaaaacgatttatctggacgggaagaccgtttggcgcaaaatgaccggcagacaattcattggtggcacatttcaacattaattaattaattaataattaacccatcagtgaaattaattggcatttaaccaattaattgtaagcgattttaattcaggtgccactggtcaagtgctgatgaacaacaaggcaattcgagtgccaagttacgccacttaccacaccaaaaatggtaaatgttttattttatttttaaatttttaattatttttgttttttcaatgccttcccccccccccttaagggacaatgaaaattgtggtcgaattgaccgctcgccttggtgaccgcctgaagtgtttgaagatggaacatgactgctctgagcatgtaattaattactattaatctatttttaattcagcaattaatgaaaaggttgcccacgaagtgctcagccattattggagcagttcggacggttacatgcccacggatatgccccgttgcggcttcgacgacagtctctgtgactacacggcgatgtacgtgctgggcagtgcgcttctgttcttggcaggtactcctgctgtccaattacaacagatcactctgtgcttgttttctgctgctaatcactcctctgatcagcggatcagtacaacattttttgtccccatttaaatatttggaacatttcttccccagtcactgatttcatttggttgtcactaataaatgttaaatgctcatttatcagtttcacttctgctaattatctctccactactccctctcctgctcacttctttgatcagttcggtttttgtttctgatttttgctttcaaatctctttatttgtccatatttgatcattttttgccctctctgatcattcctttttttctccttttctccttatctcttttttgatcaccttctctcctcctcctgcttttgatcacttcttttattgtctctctgatcattccaatttttgctccttccgatcacttttcgaatttatttccgcctctttcagtggtcattccgttcggctattttctgtacgtgcgcgaaaaggagcgcatgctgtacgacatgacgtggcgcatcccgcgcgagcagatcaaactgttgggcgaaggcggcaaacaccagcgccgctccgacccgtcgctgggcaaatcgatggaaagcgcctccgccggctcaatggtcgcg

SEQ ID NO: 81551 - DNA, 1322 bp, Heterodera glycines
  Genomic contig location: Contig_ID=SeqID_17112; Location=219..1540; Strand=+
  SCN-specific regions: Sequence locations=1-90,115-384,406-807,829-1322
atgcaaaaaagtgatggtcgcccgtgccatttcggtggccgaagtgagcgcaacggagcccaaagtgtcgaacactaacaaaaaaagatcaattttaattaaaattaaataattcgaaaagtttgaccagttctgtccgagagggcgtcgtcgcccgacaaatgcgccacaattggcacattccatcgggacaccaaacggccaatgaccagcatttctgaaaaacgaaacaattagacgcctaactagaacaattagtcttcctaattggctgctgctgaccgttgttgcagccgggcccaaagtaaacgctggcattgcgcaggtaatgcaaataggcggaatgctcaacgccgctgaaacggttgcacgactccatcgtgtacacctgacaaatgaacagagcagctgattttgcttttacatttaattgattgtctatggaattcaactataggcccattaagtgctaattggccattaattgattgacctgtaggttcatcgactccggcaaaatgttgcgctctttcaaatcgctggcgcacaatttgagcaccaacggttcgtggataatgttcgggttgtttggctgcaagtgcgcaattttgatcacactttccaccgtatttttgcagataatgggcgaaaaacggaggaaaaaaagcaatggcaaaaaaggaaacaatgccaacgaaggcggaaacgaaggtatcatctaaataagagaaagaaaatggaataaatgggaaaagaaatgccaaaattcaatttgatatgagagaagaaatgccaaagttaagtgataatcagacatttaatttgaaagttggccgacgaaaggactggacataattggcacattttatagctgcgattctgccggctgatggatgcttccgtggttctgctgctgtatgtaaaccacaacgcgctcacttttctctgtacggctaatccggttgaatttggcacttcaaacggcgcagattaagtgggcgatggacggacagagatattccacttaattggtgctaaatccgcttaattcgggttaatggacgtgaggaagcgaattgccgcgcactaatggaagacggtggtggtggtggacgcggaggcaccgggcgcaattccggcacaaaaacagcgcagaaggcaagtgagaggcattattggcattggcatttcacacccccaaggcggggcagaaacggtggctaatggtaaacggtaggccatttgttgcactaatccatgccaattgtacggtgagtgatctccgatttattggactaattgacagacactcaaaaaacaaa

SEQ ID NO: 81552 - DNA, 1575 bp, Heterodera glycines
  misc_feature (1423)..(1423): n is a, c, g, or t
  misc_feature (1511)..(1511): n is a, c, g, or t
  Genomic contig location: Contig_ID=SeqID_17112; Location=1..1575; Strand=-
  SCN-specific regions: Sequence locations=1-529,551-952,974-1243,1268 -1388,1427-1472,1494-1575
atttcaattcattcaatccaattatttttatttattttgttttttgagtgtctgtcaattagtccaataaatcggagatcactcaccgtacaattggcatggattagtgcaacaaatggcctaccgtttaccattagccaccgtttctgccccgccttgggggtgtgaaatgccaatgccaataatgcctctcacttgccttctgcgctgtttttgtgccggaattgcgcccggtgcctccgcgtccaccaccaccaccgtcttccattagtgcgcggcaattcgcttcctcacgtccattaacccgaattaagcggatttagcaccaattaagtggaatatctctgtccgtccatcgcccacttaatctgcgccgtttgaagtgccaaattcaaccggattagccgtacagagaaaagtgagcgcgttgtggtttacatacagcagcagaaccacggaagcatccatcagccggcagaatcgcagctataaaatgtgccaattatgtccagtcctttcgtcggccaactttcaaattaaatgtctgattatcacttaactttggcatttcttctctcatatcaaattgaattttggcatttcttttcccatttattccattttctttctcttatttagatgataccttcgtttccgccttcgttggcattgtttccttttttgccattgctttttttcctccgtttttcgcccattatctgcaaaaatacggtggaaagtgtgatcaaaattgcgcacttgcagccaaacaacccgaacattatccacgaaccgttggtgctcaaattgtgcgccagcgatttgaaagagcgcaacattttgccggagtcgatgaacctacaggtcaatcaattaatggccaattagcacttaatgggcctatagttgaattccatagacaatcaattaaatgtaaaagcaaaatcagctgctctgttcatttgtcaggtgtacacgatggagtcgtgcaaccgtttcagcggcgttgagcattccgcctatttgcattacctgcgcaatgccagcgtttactttgggcccggctgcaacaacggtcagcagcagccaattaggaagactaattgttctagttaggcgtctaattgtttcgtttttcagaaatgctggtcattggccgtttggtgtcccgatggaatgtgccaattgtggcgcatttgtcgggcgacgacgccctctcggacagaactggtcaaacttttcgaattatttaattttaattaaaattgatctttttttgttagtgttcgacactttgggctccgttgcgctcacttcggccaccgaaatggcacgggcgaccatcacttttttgcatttgtacggctggaaacaggtgaatgatggcgaaaaaaatattattaaaatttatttttattattanattcctcctcaggttggcatcgttcgctcaaggtaattttgaaatatccaagtttatttatctattttttctgattatttccttattngtttctaaccgtttctttaacttaataattctctaatttgctaattatacgtaataaccaatta

SEQ ID NO: 81553 - DNA, 422 bp, Heterodera glycines
  Genomic contig location: Contig_ID=SeqID_17113; Location=1726..2147; Strand=-
  SCN-specific regions: Sequence locations=1-323,346-360,387-422
tgccaagtgcaatgtgttgacgatcctcgaacggcacttggttcacatcgtagctgcagttgtacaattgttgataccggtcggcatggaacagatacaaatccatgttgaaaaaattgtaaaaaaatagttttccctgaatttttaaaagtttttaaatatttacaaaaattcctacgaatcgaatccatccgagttgtgaaatttactgtttttcccaaaccatggctttatgaccctttgtccttttcaattccccgacaattcatacttaatttttgggcactgaaattcatcaccgacttaggtactcagttattgtgaatctctgtatccattcccaaaccgaagaaatttttcgagatttttgtgaaaaatttttggtctaatgtacgaaaatgtcataaaacataatgtaacaa

SEQ ID NO: 81554 - DNA, 751 bp, Heterodera glycines
  Genomic contig location: Contig_ID=SeqID_17114; Location=334..1084; Strand=-
  SCN-specific regions: Sequence locations=1-252,277-328,350-751
atgacattatttagaccaatttcgatagctaaattgccacattcatttgatgggtcagaaatttgtataagcaaatttgtttagctaaatttaggtattcaaaaacaaattgggattgaacattactatgtccccctctggtaggatgtcccctccaattaaatgccccttttgggaggggttgaacaatacaatgcccaggcattcaaatagcggatttacggtaagtgactttctaaacaacctaagatgattaaataaaaaattttaattttacgaaccatataggtaagttatagccccccccccctgaattacagcccccggtggctttatttcaataaatacggtaaacaatttctcattgtgtgcagccaacagcgaagtgatcagcaacagaatttgccgccattccttgccgcacaattggacgaaaacaatgatcagccgaagcagaaaaggacgaaaaagaaagctgtcggaatggcaaaaagaacaaagaccggtgcaggaaacaacaaatggaagaggccgggaaaaggggcaacaacaaaatgatgacgaattattgttgcggttttatgcaaaactttttttcacaatttttgttgattaaaatttataaaaattagtatacctaccgtattagctctaattattccccatgggtgattatttttcaaacgcctcgtagactggggataattaaagcaaatactgtaaatgaaggccaaaccgtaaggcaaataaa

SEQ ID NO: 81555 - DNA, 1178 bp, Heterodera glycines
  Genomic contig location: Contig_ID=SeqID_17116; Location=17..1194; Strand=-
  SCN-specific regions: Sequence locations=1-128,150-310,332-593,622 -859,881-888,986-1178
atgatgcacaacagagtagccgaaacattgagcagattttggcattgcgttgtttggcatccgatgactcatccgctgatcagtgatcacaaagggttcgtccgccgtaaaagtggcacattgaagaagcaaatcagaaaagaacaattaattgtatggaaacaaacattgagtttttgccactgttttccgacctctattaaatattcggttaggcaattagttgaatattttcaacaaatattaattaggtatctattttatatctaagtgaacttttctccattttcttttgatcgattgtttttgcccttttctttcattttcctttggtcgtccgtccttcttcatttttatattacttgataaaatatttctctattctttgatttgataaaaaaaaaatttgagattttctcttaaaattccaacgttaattttcccattctccaattttattttatttttttagattgtgccggattaaatatcttatcgaagaaaaaactactaaatatctctaaaactttcactaaagattattcggtttcagcgaacataattatttttaaatggctcaatttttaccattcattaatttttatttataatttttttattcgtaaagactggaattttaaatttaaattagagaccggaattctcaaaaatgccggaccggtctgatgttttcagaagcaaccggtttccgggccaggcctctcaaaaaccggtcaaaccggaaaaccggtcgaaccggtttttccaaaaatcgccggaccggtttgccgggcccggtaaaaaccgataccgggcccggtccggtccgctctctaatttaaataatcagacaaagtagttttgttttttgttaattgtaaaaagaacattaaatattttttataaaattaaatttcatttttaattgattttttcattttaaatttttttattttcacttttcttttttggctcaattttatttgatttgcaaatttttttccgcgttatgcgcctttctctctacaaatggaccctttttctgctgtttttcgcctcccaccaatggtgccaatgtgccaaagtgctttttacggtgtttcacgaccgcggcagtcacttcgcttcgatgtttcctctgatggaaaagtgcggggaattaaatgtgcaaaaataaa

SEQ ID NO: 81556 - DNA, 477 bp, Heterodera glycines
  Genomic contig location: Contig_ID=SeqID_17117; Location=875..1351; Strand=+
  SCN-specific regions: Sequence locations=1-9,31-444,467-477
atgcagcagcttttgttttttctgcttttggtggcggacatttcgcacggaaaagggcaaaaagaggaaaaatccgaggcaaaatgcgacgaaaaaaataataatgaagcgataaggtggaaaataagcataactaattgtttaaatatccaaatatattttttaatctttaggcttcacaattggggcggcaatttcaaattttgcacccaaaatgtcgaatatccgcgcaccaccgccgaagtgcaacaaattgtgcggagggcacaaaagctgcgcgtttttggcagtcggcacagctacaacaaaatcgcggacagttgcggcacgcttttgtcaacgctcggaatgaattcgatcattgccatcaatggaagccgaccgaccgtaacggtgcagccggggatcacttacacggacttggcaccgacactttgtcagttgaaaatggaaaataaaagtggaatttaattgcaa

SEQ ID NO: 81557 - DNA, 640 bp, Heterodera glycines
  Genomic contig location: Contig_ID=SeqID_17120; Location=406..1045; Strand=+
  SCN-specific regions: Sequence locations=1-67,90-195,218-250,272 -320,342-386,408-519,541-640
atgcgcgtaagaaataggcaaatttccaatactgttatacaaaagaatttcaaaatttttgaaaaagccaaggtcctgatttaaatatgctaaaacaatagaaaagttcggaaaatgggtagtctaaattgccaaaaaacaaggcgcacttgaatgctcatgactatttttgacttgacactaaagataaatattttttcaaacactttctaaaaatatttgctctatagcatgtttagcaaaaaataacgtgaaaatttaaatctttaaacaacctttcaagaatttgtttctaacacgcaaattcgccttgattctatcaaatccagactatccattttccgaactcctctattgtttgagcatatttaaataaggaccatgtgttttttcaaaaattttgaaattctttggtataacagtattggaaatttgccttatttttacgtacattggtgccatcaagttcccgaaacccattcatttttcagcctaatttaaatcattagccacaacaaattaataattttagaacatgaattcggctttcgctctgctctcgacaaatagcagcccccttgcgcatacatacaactgtttcccgaaacgggtgtattgtacactgatttaaaacataaga

SEQ ID NO: 81558 - DNA, 607 bp, Heterodera glycines
  Genomic contig location: Contig_ID=SeqID_2781; Location=665..1271; Strand=+
  SCN-specific regions: Sequence locations=1-607
  Gene Ontology: Biological process=induction of apoptosis
tcatgttgatcaacggtcccaatttgaccatcctggatttatcaatggggcatttttaccaacaattcacggttcgtcttctttccaatcgctgttagaaaatgaacaggaacaaaattgcaacaaagacgacagagaggccgacgaggaatccgatttccttggagaggaagaccttaatctgatcaacaatgaaggtgccttttgattatccatcgaataatcgtattttcattcattctcaaaatttgtttaagatgttccggagtggctcaaattgtattcccaagctccctttaactctgatcacatgctcaatgtaaatgaattaatcctaataataatttaattgtttttttagttcaacttgttcaaattgaaccaattggaggcatatgatcgtaagccaacaaattacagttttttgtttatatacaaattgaaattgcaattcaggaatgatcatgagattgtataaacaggtaaagatccaaactgaataactttaaaatgtcctttttaggatgtgattaacactgtcgtcaaatacgaaggtccaatgtcggagattgacaatgaactcatgcaacgtcataatttaacataa

SEQ ID NO: 81559 - DNA, 1408 bp, Heterodera glycines
  Genomic contig location: Contig_ID=SeqID_2781; Location=1510..2917; Strand=-
  SCN-specific regions: Sequence locations=1-384,407-1025,1056 -1270,1300-1408
atgccccattctcgttctacaactcctaatactaaccgcgaccgttcgcatcgctccaaccggaaacgttcgcgtgaccgaagcagcgaaaagcgtcaaaaggcgtcgcgttcgtctcataaagataggcgaagagatcggtatgtacaatgaagcatttcatttcattctggaatatcccttctaatgactgtccaaatatccttttttgaggtctcgctcctcttcgcggcatcgggattccgctgcagactcagccagaatttatgccccatccgacgtggcggtggaacttggcagtggaaatgtgaatatggcgcgtcttgacaagcgggcagtggaatggttacaatcgaaaataaacgaacaggtgggccagcccgttttggaatggcactgttctgtgtaaaacgcacatcaattaatgatttattgagtgtttaaaccatagcgggcgggcaccgtctggacagaacagaaaatggccataaacgctaagcgatggtaatggcattgcagcgattgatcgctgttcaaatgatttatattcagaatagtaataaaatttagagatcactcattaacggcttttcaggtatcgtccaaaatcagtgacattgaggaaattgtacacgaacgcgtaaaatccgcaaaggtttcacaaagttgaaaagcccccccccataaaaatgaaaaaataatcagatcgaaatggagaaacggctgagacagcaaatagaagccgagctaaaggaggaaatggaaaacattcatcggagggaggtaagcacagcccaagccaactgttgtaaaaccatagaaaagcatatttggaaccgaataaacatttagaaggagtctcaggaacgctgcaatgcgatggagagagcgttggagacgaagatcaaggaattggaaaaggccgaaaggaaattggtatgtctactatttgtataggtactcaattacaccttccaattagcaaaacggataatactgtgctttattctccccccccccttttcattaaaaaaaattttcaaaaattttaatatcaaaaacaagcttcctgggtttttgaagtagctgatcacgaacgaatccggcatccttttcggccaatcccggacccgaattcgaacaaaaagtcgaaattcctaacttcgcatttttggttaaaacgtgtttattggatatttttattttagaacgacgaacgcttggaaatgctggaatcaaagcggaggtacgaggaagaacggatcgaactggagaagcaaagagaaaatgtgaagaagacggaacagcagtcaattctaaacaagggaggattaatgagggagaagatcagactgtcttttggcaaatgattgggagacgaacattctgtgtttaatgtaacaataaa

SEQ ID NO: 81560 - DNA, 1560 bp, Heterodera glycines
  Genomic contig location: Contig_ID=SeqID_2782; Location=2076..3635; Strand=+
  SCN-specific regions: Sequence locations=1-262,284-389,411-735,757 -791,813-886,908-1091,1114-1253,1275-1471,1494-1526,1556-1560
atgggaatttcattgacgacacttctctcgcaaacattgagcaaaaatggacaaagagccaacaaaaagggaacaaccgcactcactccattggaaactttgaacagttcacggtttgtattattttgttcctgtatttctataaaaatggatagatttgtgagaatgggacttatgtcgacttgaggggcgaattccacggggaaaactccgcggatggcaactcacagctcaccaaatactgctacgagtgcaaaagggtgctctttttagtccattgtttgttccttcggtacgtcccttttccttctatcttcagacaactcctggtcgctgtcagcactgtccgttgtgcaacatttgcgtgctccgcaaagaccaccactgttttttgctcggcggctgcgccggtttggccaatcaggtcgttttcccctgacccgttggtcataggaatgttgatcgtatcattttacagcgctatttcattgtcttccttttttgggcctcaattggcgctgtctatggctcctctttcaacttttcttacgtactgtatttatttgctaatccccttgaaaaatcggacatttccagctgagaaagcatgcctccccgtgtttcccttttggatggatttgttatttgggaccggtaattttgtgggtttcgcttttttcaccgttttgtctttgggtcgcgttgtgccgctggttttttggctacgactcgctgttcaatgcccttctctctgtgatgttctcaatttcggccgcttcttcgttcgctgcctttggatttttcgttttccaagtcggatctctaataataaccctcgtaacttccgtttttgtccagatgatttacacattgaatggctacacaatgcacgatttccatcgcgcgggtctcaggagaatggagagtgacggcgagttgtttagaacggtttatttttcaggtaacccttttgtcattcaggcgaagatttccgagagcgtcttgccctggtgttcggtaggagatggtggctcaatttcatctttccccaattctggctgcccaaccaaatgaatgagaaaattgccaaaaacattttcctgaatacctcaaaggatctttgaaccgtaaatgcaaagctgaacaaatgttttaaagaataaagcacaaaaaaagaaaccgttattgtattgtatataaaagaaacaatggatgcaaaaagttgaagttgattgtccaaatctcagacaaacaattttttattttgcttaaattttgaattgcatctattgtttcgaaagccaaactacatcaagtgatctcgctgttttttgaaacaacaataaaaaagatcctctaatccgactatcaataagaacaaagaaaacggaaaaaaggcaaactaggcccgtattgggttttaaattcagtgtttcagacatggcagcaaaagaatacatcagaaatgataatatgaataagagaaaaacaaatccaaacaaagaaaaggggaaagcaatgagaatttgggggtggggagggcaagaaatgttcagttag

SEQ ID NO: 81561 - DNA, 1275 bp, Heterodera glycines
  Genomic contig location: Contig_ID=SeqID_2782; Location=4364..5638; Strand=-
  SCN-specific regions: Sequence locations=1-229,252-332,395-721,743 -989,1020-1112,1134-1275
atgagaatttctacaggtaaatgtgaagttaaattacaattaacttccccccccccctcataatcactctttcatgtcatttgaccttcacttccagattctgttcttgctttgtgccaccttcccaagaaatctgttctaagatatgtcttcagggttttaccgacgcattgcgttttctaacaacatcttgtaagattaaaattgccagtcttcttttattactacaatttgttgttctgatttttaaagcaattacgccctgtacgaaatgtctaattttgagcacacaaaaattcaattcgcttatgaatgacgaattgaaacgaaggtattaataaataaaatataattatttatttatattttgtatttattttttattttaattttagtcgaagttatttcaacatccaacaagcgactgcaagtgcgaccactccgaagaggaggaaacggttggactcggaatgtggcgtttgcatggcgcggttggagcaacgcctgagcactgacatgaccaccgctctcttcccagaaatacttcataaaagtaggaatacgcaccatttgaagtccttaccactcaaaatcttttaagcactcaaagagccgatcacttgtgcttctctgccggctcagctgtttcgttatgccagaacttttcgtgccgtcgagttcggccttcgtattgccgacccatttttgcgttccctcgactatgtggtctatgtgatgcgaatgtaagttttaaaataatcttggtgtgaataatgtgaaagtcggattgtcccattcatttaggcttaatgagtggcttttgaaacttaaaaaaggcgaccttattctcgaccgactgcagaaatttctcgactttttgcttagtcaaatagaagatcaaaatttgctgtgcactccaaacatttcgtgtcaataccaattcactgcgagtcgcgtcaaagacacacacagcgaagtgaacttttgttgttattagtttatttatttattttcatttaagcattggctgatggatgaaatgttcaatgatatgtatgaaaatatgcacaacgaaagtgttcaacaagaattgatattggccaactattacaatgatgttcaaaatgtaaaatggaaaacaacttagaataagaaaaaaatcattcacttttaggcgacgaattctgttgagattgaggagagctcaggaaatgccttaactgacaatgaaaaaaaaatagacagtaattacgacttaaaaaaaatactattaaa

SEQ ID NO: 81562 - DNA, 1107 bp, Heterodera glycines
  Genomic contig location: Contig_ID=SeqID_17123; Location=108..1214; Strand=+
  SCN-specific regions: Sequence locations=1-67,90-274,342-367,410 -593,616-773,795-876,899-1038,1064-1107
  Gene Ontology: Mol. function=transmembrane receptor protein tyrosine kinase activity; Cellular component=integral to plasma membrane; Biological process=cell proliferation
agaaaaacaatcgggatttgcagtcaaacttgcggttggttgtttttgatgtgatgactgatgaccatttattttaattatggttctttcagatgccaattttggctgctggggcaaggaaaacagagactgtgtgaagtgccgaaatttcacgatggaacacaatgtgtgcgcggaacaatgccatactgagagggggtaaataaaataaacaaagtcatgcggctcgggattagcgttattctagaccgaaattacgagatttgagacagggatttatttttaaaattttatttaactgttaacaaaaaatcaaaaaccaaaaataattttttaattttgcatagcaaatgtttccatatcaatgtttttatattcaaacattaattatttatattattcaaataatcactttcgattctgacggaacatttaaacctgagaatttgatcaactcaagactctcgatactcaatctatgtctcccatttacagccatttcattgtttcactgtcctccgctgacagtgcccccgttcggcattgccttcggtgccatgagcagtgccacgagtgctacgggccttccgcgcgtcaatgttcaaagtgtcaaaactttcaactttggctcaacaccgcacttccgctggcggacaatccgtacgtcgacgcgggcactgcaggggccgtgaagcaatgcgtggccaaatgtccgaacatgacgtaccccgaaggtacacacagctgaattctcgagtatttcagaacatttggcaacaccaagatcatgtccatgggttttggtctcacatcttggttttttcgttttttcttgagtccttagaaaatttgactccgcggaggggaggagtggtgataaaatgaacacaatcattttcagacgatgtttgcgtgccgtgccataaggcgtgccgcggcggttgcactgggccgagcgcacgtgttggcaccggcggatgtaatcagtgtaattacgcattggaaggggaacattttggagaggtaaaaaaaaatgtcaaaataattataaatatttattttagtacatttgtctgtttggtgatgagccagaaaaagctgtttgcg

SEQ ID NO: 81563 - DNA, 900 bp, Heterodera glycines
  Genomic contig location: Contig_ID=SeqID_17125; Location=1263..2162; Strand=-
  SCN-specific regions: Sequence locations=1-41,63-290,312-479,507 -530,556-665,690-727,767-774,796-879
atggtttccaaaactggcattttcaaggcccccaagttacataatgttttaaaagtgggtttggaaattctgaatttaattaaacaaggtaaatcgggtatgttgagttcgaatatggtcttagatttggtctctgggatcgcaacaaacctgtacagctcgaacttcatgcatggagttggagcagtacaagctcaggttgaaaagataggtcgcatttaaggccatattcggattctactggtataaattgtatagaaaaactaagattttattatatcagctttggtttttgaccataaaaaattcgagaaaaattagtgggccaattttcaattttggcatggtcgggaaaaaaggcagaaaaatctatcaatcaaataaaaagtgaaacgatagtaagatataaaagaggaaaccatgaagaacaaaataaaaaaagaattatttaaataggcgcagaaataacggagttatgatttttaaaaattggaaaaaatttgggtatcaaaattatgttccaccctaagtaaaaaattttatttataatattttcattagtcaaaataaaatgccgaaaaaaagaaaaaaagtatcaaaaatatcacacctgccgtaaattaaaatacgaaatgccaagcaataaatcagacagatgccataaaataatgaatgtttcatttttaagagaaaaaatggaaaaaaattggcattccgttggataatgaaaaaaaattaaattaaaatgaaatattattatattaaacatcaacagataaacacaataagacaccaattagcaagatggcatttgatgtttgtttctgtctgttaataaaatggaaaatgccaaaaaacgacggacggaccgttgccaggcaaaattcattttaaaataaa

SEQ ID NO: 81564 - DNA, 2888 bp, Heterodera glycines
  Genomic contig location: Contig_ID=SeqID_17128; Location=448..3335; Strand=+
  SCN-specific regions: Sequence locations=1-940,970-980,1002-1319,1362- 1373,1395-1431,1539-1622,1660-1678,1743-1759,1795-1835,1862-1876,1898- 1936,1958-1963,1988-2033,2057-2110,2146-2888
gttcattggtggcgacatcagctttatttggtcattgatcggtcactgcggttcagccgttacaacttttccttccccaatttgcacgtgccgagctgatcagatgcttcatgagcaatgctgccaacacaggacaattgatcaaacagtggaactcgcggaacaataccgcgcagcattgcaaaatggcgacaaggcgactgcagcggttcgatcggcatcaatgggcatcacgaaaccgcctcttctccgttcaattaactttgatcggatcatccctgccccttttcacgtctttcaaggcattggaaatgccattgttcgagaacttgagaggcaggagggatgtgcgccgattgttcaacagttcttcagaaggatcggggcccgaagggaacaatttcgaaaaagggatttgaccggcaactcaataagaaaaattttggttcgcgctaaagaaatggccgaacttttcacaatggaatggcccaaagctatttgtaggacactcgaacacctcggcaaaattcaaaacttttcaaaagtgttttgtccgattttattgaaataaaatcataaattttaggcacaaatgttgtccccaaatgacctggacggacttgagcgatcaattgacaatttcaaagtgtttttggcagagcaggaccggatgagtgcctttctctcaaagaaacccaaggcccatcttctactcttccactttgtgccatttgcacgaaaacatcaattcattggccttctggatgagcagggtgttttaatattttcaaggtgatgaagcgcttcattcggtgtggcgaagactcgaacaatggtggaaatgtatgcctgacgcggaacaaattttgcaacaattggagcaccatttcgtcaacaattggctgctggacaccggaaggattgacgaattgaagcgggtttgttttttcaaaaggtttcccttttctgaattctcatctttagaattatgaagaaaggaagggcgaggatgacacggatgaagaagtggcggaagaaattgatgacgaatgccaaattgatgtaatttaacaaatttggattaagggatgattttcaaaaaaaaagtgaagaaacaaaatattttatcatttttgtttatttttcagaatatttatttgtcatttataagtcgttttttgcttaaaatcaccaaaaacgtccgttaacatgcatcggattcgaacctggaacccccttttggtgactagcacatataccactgagacaaaaattcaaatctttttggaactgggaggcaaaaactgaaacggtgtgtctataaataattttaatttactaataatatttattcataatatctcaaaacaaatatttaaatgtagaaaaatgaactaaatgattaagcatcaggtaaattattcttacaagaattttaatatgaaaattttatgaaatatgtaataaaaaaaatttaaaaaaatctagttaaaataaattcatatggaaaactatttaaaaaatattattaataaaaagacgaaatgttttttccaataaatataaaggcaatcaacaaaataagaggatattaatgaataaaaagggtgaaattaacactcaaaattactaattaatttgaataaaattttttaataagttttggtccaattccaactaaataatattatttaattgattttattagtttttttattttgcttatttaaaaatattaaattcgccgaccctcatttagatatttttattaaatatttccaaatatttaattttcaaatcatgcatacctatagtatgttatataatttaagctattttttaacaattttaactctttattcagtatattttaacccaatgtaaattggaaaatattcttatctaatcatatgatatggtgatatgacgaagttacaaaagtaataaagtttgtaataagtacattaattattatttaattttatttgctaaacaaagaatgatatcttagcttaaacatagatcctttactacttatgtaatttataaaaatctagcaaaaattttaaaaagttttagcttggtaggataagttttataaaaaaagaagtaatattcgttgtttctaaaaaagtaattaattaacaaatttaataaactagcggggtcagcgccttcggcgcatcccccgctaggtagtacgattgtagtgtaagattatgtttgataaaatcgactggctcggccgcttcgcggcctcgcatcctttttttgctttttctccaatcgtcggactcaactcaccagcatttcaatcaccgggactcaattctctaggagttcaatcactgggactttattctcctgcgtttcaatcactgggactaaaccctccagcatttcaatcactgggactcaaccctccagcatttcaatcactgggactcaaccctccagcattgcagtcactgggactcaacacaccagcatttcaatcaccgggactcaattctccaggacttcaatcactgggactctattctcctgcgtttcaatcacccggactcagtttttatgcattccaatcaccgggactcattctcctgcatttcaattactgggactcaaccctccagcatttcaatcactgggactcaattctcttgcatttcaatcactgggactcaaccctccagcatttcaatcactgggactcaattctcttgcattccaatcactgggacctaacctcacctggtccttcggcatcgcaatcatcgagactcaattctgcgaaattccaatcaccggaactcaattctgcgacattccaatcactgggactcaactcaccatcattccaatcgctgggaccgaacctcacctga

SEQ ID NO: 81565 - DNA, 572 bp, Heterodera glycines
  misc_feature (489)..(489): n is a, c, g, or t
  Genomic contig location: Contig_ID=SeqID_17130; Location=1224..1795; Strand=+
  SCN-specific regions: Sequence locations=1-229,251-546,568-572
atgtttcttggcatcgatctcggcacttccgcggttaaagttctgctgatcagtgctgatcagagtgtcgttggttcggcgagtgttccgctgaaagtgtcgcgtccgtttgacggatggtccgagcagtgcccttccgattggctccgtgccacccgcgaggccattgaccaattgcggcattcgaaccctaaggcaaatagtcctttattcaaatatggtggaaagaaattttaatttacttttaatttgactttgattcaaatatggaaagaaattttaatttacttttaatctgactttgaggcgttttgtgccctccgcggcatcggtctttcaggccaaatgcacggcgccgtgctgctcgatgcggccggcgtgacgcttcgcccgtgcattttatggaacgacatgcgaagtcaccgcgaggcggacgaattgaacgcggacgcgcgcttccggtcgatcactggcaacgcggtgttcccncgggttcactgcgccaaaattggcctgggttcgccgaaacgaaccaaagatttttgcaaaaatgcaaaggtggaaaaaaggaa

SEQ ID NO: 81566 - DNA, 905 bp, Heterodera glycines
  Genomic contig location: Contig_ID=SeqID_17131; Location=431..1335; Strand=+
  SCN-specific regions: Sequence locations=1-297,350-437,459-463,486 -537,561-905
atgggcgtcattctgtccgcgaccgattcgttaaattggcttaccaaagcgaccggggcgtcgccagatgaattgacggcggaactcggcggcgatttgaatgctcccggcgcagtcatttttttgccatatctttccggggagcgaacgccgcataatgacgcgatcattcgcggaagtttcaccggactatcgcaccaaactgatcggaaagcactcactcaggtcaattttgaattgggtaaaggatttatgggaaaatgacacaaaaaggaaaaacggaaacggagaaaatcgaaaaattaattaattaaacaatattatttcaatttcacaattaaataataaacaaaaagataagcaaattaatttgatttcggatttctgctccagagaaatgagggcattcatttgccaattttttcagcaaatcttctttatcttttttaaataataaattttgcatttcaaatccaagtggctttaggctgttctcgaaggagtggctttcgcttttcgcgattcgcttgaggcactttgcaaaagtggcaccaaaatgccttcgcggatcatcgcgactggcggtggcgttcgctgtgcttattggatgaagctaattgccactgtccttggagtccaaatagaagtgccgacagaggaaagtggaaatttaggtaattttcggacgcatttcaagttcattagcaaatcctaattaaggtgccgcttttggtgctgcaagacttggaataattgccgctgaagggattgaccctttgagtgtttgtgagccgccaacgattggccaaagcttttccccgaatgagcagctgagagaggcatttgagcggaactatcggcgctattgcgcactttatccggcactgagagcgattgatcagtga

SEQ ID NO: 81567 - DNA, 232 bp, Heterodera glycines
  Genomic contig location: Contig_ID=SeqID_17132; Location=1..232; Strand=-
  SCN-specific regions: Sequence locations=1-50,77-131,153-232
ctaatctggacatgtaaatcaacgacctttttccgctctttttttgttgcgcgcttttcaaaaaaattttgggggacagatggtgtgggggggggcatgccgacaggcgccacagtggaaatttttaagtattttgttaagaaattattattaatttcattccaactttctgatcattgacgactctcttactacgaaacgtaattcagatgcaaagattcgtcttatattt

SEQ ID NO: 81568 - DNA, 90 bp, Heterodera glycines
  Genomic contig location: Contig_ID=SeqID_17132; Location=872..961; Strand=-
  SCN-specific regions: Sequence locations=1-90
tgctttgcccgagtacaccactttcaaattcaacatggacccagtgagccatacagcaggaaaaccggttcccgtgaaccccttaaaggt

SEQ ID NO: 81569 - DNA, 679 bp, Heterodera glycines
  Genomic contig location: Contig_ID=SeqID_17133; Location=235..913; Strand=-
  SCN-specific regions: Sequence locations=1-8,31-36,58-172,202-437,460- 591,632-634,656-679
atgcagataagagaaaaagggaaaggtaaatcggcgaatcagcctttttaaatttcaaaacataaggccatacaattaattatttattcaaaatttctctgcatttcattttcttcccaaataaatctacttatatatccgcccttccaatgtttgcagttacagaaattactaaatttttaattcatatttttttaattactgactttgaaaaacaactgcttaatttatctcttatcattgaaataaatcaaattaagattcaataaaaaattttaatgcatttgtcagtttgttcattattgctaaaaaggcttccttctacacgcttggccactacgcttgctaatgttagggcaaaaaatgtgaagcagccgtcgactgagcggataaatgcaatttctctggatgatttcccgtggggaagaaattaaaacgctttattctttagtaatttagaattgcttatcctgattttcttcgctccgaagttcttgatcgtagagacccgttgtttgaacaactcgtccaagcagacatgtttgaaagacgtatggtaattgacatccccgaattctatgttggttggtgtttttaaatttaattttcatttttattcaaataataaattcgttctccaggttctgtgttagctgtcacaatgtctgaccctaacacc

SEQ ID NO: 81570 - DNA, 1116 bp, Heterodera glycines
  Genomic contig location: Contig_ID=SeqID_17133; Location=988..2103; Strand=+
  SCN-specific regions: Sequence locations=1-427,451-1116
  Gene Ontology: Mol. function=protein binding
atggctgctaatgaaaatatgcaaacagaagacaataaaaaaggaaaagtgaccaatgatgagcgtaacttggtcgtctcatttattcagtttttgcgtcacaaagtctcatcgaaccaatgcactgatgaacagattgaaggccttgaaggttttctttttgactaattgttggtggtatataaaaaacgctgcttgaattttttaatcatttcatggctttttatttattgtctataattttaatgcatagaattaatcagccaggtttctaagcaaaatctcaaatttatttcatccagtggtgaaagcatgaccggcaaattgttggaatgaataatagaacatttcgaaactggccattaaaattcaaatagcaattctatagagtacgagtcgaaaaaaatcggattcgggctcgaaaacttaaaaagcagtttttaaaatagaattgttttattctttctatcttatttttagttgctattcaatgccttgagaccgccttctttgtttctgacagaaactatgcgttccaaccgtccaaacctctcatcgaaattttcaaagcagctgaaggacttcccgatggggttgattttcagttttcccttacgtttaattgaatttttattgaaggatcaagagtttcctaagccgactcaaacggacgttgagaagtcaaacgcattgaaggaagaaggcaacgaactcgtgaagtcgaacaagttcgaagaagccatcctcaaatacaacgaagcaattaagttgaatcgcgaccctattttcttctgcaacaggtgtccattgaattcacacaatgcactattgaaatgagttttacaaatactttagagcggctgcttattgtcgtctggagcaatatgatctcgcaatccaagactgccgtacggcattggcattggacccgaaatatgcgaaggcttacgggagaatggggtaatggacattaattagtattcgttatgtttacaaccaaatccgttttagcgttgcactttcatgtcagaatcgttacgatcacgcggttgaagcgtacaaaaaggcattggaattggatcctggaaacgaaaggtatcatgaataaaatgacaa

SEQ ID NO: 81571 - DNA, 817 bp, Heterodera glycines
  Genomic contig location: Contig_ID=SeqID_17134; Location=9..825; Strand=+
  SCN-specific regions: Sequence locations=1-167,204-208,490-523,552-817
atgacaaaatgttatccatggtcccgtatacaatattatcgccattcggtaagctaaggattacagtatcgtcacattatttaatgcatttccaccaatgtatgcgttcagatcaaaaaagtgcagctgtattagtggaagtgatgatgtcaatccataaaaagtagaaaattatttctaaatattaaattgtttttaatatagagtgaaataaattattaaaaaattaaatttaaatatttttaaatgtttaaaatgatctcatgaaaaatctaaagaaacaattaaaaagaaattttttaagttaaattaaaaattcataacaacaaaaaattaaatgaataaaaaaatttaaaaaaaaaatttaaataaaataatcaatatttttaaaaatctttaaaaattcataataataaaaaatattaaattataatataaaataattattaaaaaatgaatatttaattcttatttttttcaaatatttttcccctctttagcacttgcattcgttttggtatgtatgtaaattattttgttaatttttctgttcattatgctcacccttttccgaccgtatcaacacgccggcaaagcaacagtactaccgtaatgatgattacattggcattataaacgaccgggggtaaagcaaaaaatatgccaaaattgtgtatcaattttttttgttgtttttgctatttttcaggtgccattccgtcattgggcgacacagtggcaaaaatttgttgacccttcaggttggggaggctggcaaagtgccaaaatttgatttgttttttacaacaattcgaaa

SEQ ID NO: 81572 - DNA, 1263 bp, Heterodera glycines
  Genomic contig location: Contig_ID=SeqID_17136; Location=1..1263; Strand=-
  SCN-specific regions: Sequence locations=1-344,384-653,676-686,709 -769,791-1115,1144-1180,1215-1263
gctctgaactgttacatttgtgctgagaatggcttggacgagttcggcgagtgcaaaacgtcctttccgttcagctgcgatgggtacgccaaacgctttccaaaggacgagaaaatattttgtcgcacgacgcgacacaaaacggcgaatggtgcggcactttttggcaattaaattttgtttaaaatgtttttcattgcttcccccccccttttttaggcactttcactgtggtgaaggaatgcatcgcggacagtgcgcaccacgtcactttcccgcgcaaaccgtaccaattggcggaggagtgcgacgtggtcgaccttaatggggtcgaagtggcctattgcctttgtggggaccaaaatttgtgcaacggcgaggcaattgtgggccaattcagcgcatttgaggaggtgaaaagtcaaaatcagagaatgttattctttatccattgcttatttgaacatttgcatattttaagtttttcttttaattagtaaaggaaaacccaaattaattatccgaaattacactgtctatttcaagtgaaatgtttaatttataattcaaaagttcaattgaggaagagttcggcatgccaatatcaacaagcaaaatttgaggatttaatcgatgatttatgtgcgcaattatcacattttcaaaaaataattaaatgtagactcaaaataaggacagatcttaaaaaatatggacgtttgcgagtattgcttttgtttccgtgcccatttccctccaattccctataaaatttaaattcccctaaattcctcagaaataccccgaattgttcgactccgatccgacgaccacggcgtccgaacagttgtctctgtctcagtcctcacaccagcgatcggcggaggaaaagcaaagggagcgaagcggagaagaagcagcagaatctgcggaagaagtgggaaaaatggaaaaaaaataaaattagaaataggagaaattgaattggtaatgggcatttagccaatggaaagcagcacatggcacgggcaaatggttgacggaagtgtccattttggcacttcgggccaattcgaaagtgccggttgggaaacggcggccaccgaacagaaccaaaacaacaataataacaacaacaacccatttgtggcaccaccgacacgaaacgaaggcaaaaagcatttatttaaatttaaataattaataaatatattgtaagtttttaaagataacaacgaaaatgataaagaaaaaatcggcgaa

SEQ ID NO: 81573 - DNA, 356 bp, Heterodera glycines
  Genomic contig location: Contig_ID=SeqID_2784; Location=251..606; Strand=+
  SCN-specific regions: Sequence locations=1-195,217-259,281-356
atgtctttaagcccttaccaaatgaaatctgcaaaacgaaaaaatcttaaaaatgatcaaagtttgcccgtttttgttcaagtcgacgacatttcatcatcggttgatcttggaaatgacgggataaatcctgaacaggtgggaaatgcgtgaatcgaatgcatgagaaaaagctgcttttctttacaataagctaaaaataattaattctgatttcctcagcattctaacacgaactcaatggagagtaactcgaaggaaattgaaatgcgtgaacatttggaggaaattgaaagccaaacgacaaggcggtaattaatggattttgtttgaaaaaaaaatctcttttgtccaca

SEQ ID NO: 81574 - DNA, 1081 bp, Heterodera glycines
  Genomic contig location: Contig_ID=SeqID_2784; Location=1158..2238; Strand=+
  SCN-specific regions: Sequence locations=1-42,132-138,161-165,189 -434,457-568,613-688,718-872,894-1081
atgagatcttcgggcgtacgtgcccgccgccgtgccgcacatccaccgctacgccctccaccaccgtcgccacgccctccaccaccgtcgccacggcctccaccaccgtcgccacgcccaccacccccgccccagaagagccatggacatggcaatggcacgtattggtgctgttggtgacggtggtgatcgccgccgccgcacttggtggtaagaaaatttactattttggttaaatattttatggtaaaatttaacttttcagtgggtttgtggtgtcggtatcgccggtcgcggacggggcctgacgacgtggagtcgcaggcgcctgttgcggtaatcataatttttacaaaaattcttttagaaaaattcttttttgggtgggtaataaaaatgtggggttgaaaacaaaaaatgctaaaaaaagttgctttatttttttttttatttattgtcaataaagaaaaagtcctcaaaagggaaaaatccgcttacattgaggacaaaacattaattaaaatgccctcaagaaagcgcataaacaattaaaaacgagatcgccgccaaaaaataaaatataatgtgaaatcaataaaaaataaaaataatgaccaaatcactttttgtttaatgaattaataattcgacttttatttttccggtcaatcttacagaaatgaaatagttttaattttatttttaaattgatttaatggtcttccagggtctggttttgatcacgtgccgcccgggacaaaaaacaatggggattgaacggatggtggttggacccctgcccctggatcacattcgttgtttaaaaaaatgggtgaaatgtatgattttttaagcgggggcaggggtctggacccccgcccccggggccttatactactgtcaacaaacattttttggcactttacaattactaccctgataataatgtctaattatttcaggcccttgtcgattcaattgttatttctcccccaactgacagtctgcaaattttcaatagccctgacgttcaagcgatgactcgaaaacaatagtacgtgaccagtaaaccaaaaaaata

SEQ ID NO: 81575 - DNA, 852 bp, Heterodera glycines
  Genomic contig location: Contig_ID=SeqID_17137; Location=29..880; Strand=-
  SCN-specific regions: Sequence locations=1-246,269-323,346-852
atgtcttccgaaaatcctccgtcaccgatgcaacgccaacagtcatcggtgcaacgtcaacagtcatcagtgtcggatatgggcgacccggacgagtaagaaaacagcgacaaaccctaaaaacgacgaaattacgcctttttcccttttcagttgcttctcaatgttcctggttttcatgagctatgtgctgctgttcttcacctttccgtgcactatcttctcttgcattaagataacaatttgccttttttccatttggtaattgccattccgttttcttttttagattgtccagcaatacgagcgagcggttggagcaatgtcactttacacaaatccttttccaagttcaggtcatttttcgactgggacgtattcgtcgtaaagcgcaaggacctggtagccaagaaaacgagcaaatatcatttctaatgtttttttttgcaggattgttcttcatccttccatgcgttgatgagtgcgtgtgttttatttatattgtttgattagaattgaagacaaacggtgcgccaccactcaatttgcagatatcgctgcgtggacttgcgcaccgtgacttgtgatgtgccgcctcagcaagtgctttccaaagattcggtcactgtcaccgttgacgcggtcggcttcctgtgttatttttaaatgcccgtttaaaatattcccctattataggtggtcttttaccgtgtgttcaacgcaactcaggctgttatgatggggaatatttcgtcgtccaccactctgctggcacagacaactcttcgccatgtgttagacacaaagactctgagcgaaatactcggcaacttcctcgtggagcaaccgtga

SEQ ID NO: 81576 - DNA, 76 bp, Heterodera glycines; identical to SEQ ID NO: 51235
  Genomic contig location: Contig_ID=SeqID_17138; Location=341..416; Strand=+
  SCN-specific regions: Sequence locations=1-76

SEQ ID NO: 81577 - DNA, 569 bp, Heterodera glycines
  Genomic contig location: Contig_ID=SeqID_17139; Location=183..751; Strand=+
  SCN-specific regions: Sequence locations=1-108,130-501,526-546,568-569
gtacaatttgttctcgactcaacgctggacgtgatactttccacaaaactgaagggttgtgggctttactgaaccatttactttacacccatatgtaattcctcacactattataaaacatgcaaaatttttacaccgatttttttgaattgagataaaatgtgacaaatttttaaaaaaataggcctagcgaacccgtgccaatactgtttcctgctgtacttcgttgtgtcaaatgttttgtgaccgatttgccttacaataggtcattagcagctataactattgtatttcatgtgtctctgattataatttttatgctactgtttttgcttgactgtcgctattagagaccgaccgatcgctttatcgatcaacgcctaccaatgtttcgattttatatctttttcgagagcgatcgatcgaatcaattagtcggtctacagcagggacagtcttgtaaaggggaacctacggcttatttatttgctcttcggccgcaaaaaaaaaaaaaaattaaattttgtacaagagaagggctggcggttaaaaattttcaaaaagaccaa

SEQ ID NO: 81578 - DNA, 519 bp, Heterodera glycines
  Genomic contig location: Contig_ID=SeqID_17139; Location=792..1310; Strand=-
  SCN-specific regions: Sequence locations=1-113,150-208,254-300,326-519
atgaataccaccaataatggaacacttaaatggacagttgtgataggcttctttgatcggaatttgggtttccgaaataaaagttggaaaattttccaaaaaatcatcttctcaaatttaaattttcataaacattataaaaatattttcagaaaaaatttatgcccttttttctcatgaatcaaatttggaaataattaacgcactcatattataataaattataaaatattttaatgtattgtatttttttgacgtttcgatacatgaaaatgtatgaggcagttttatgctaaattcaaaaaattatttatttaaaatttaacttctaatccaatattttttgtcaatatttttaaatgttttcgcaaattttttcctaaattttaaaatttcatatgaaaatccatttatttatttttctgtaaacgagttaattaaccacaattttttaatttgttttttcgttttgaattgtaactcttaaatttaatgaagctggtgatctttagcaataaa

SEQ ID NO: 81579 - DNA, 406 bp, Heterodera glycines
  Genomic contig location: Contig_ID=SeqID_17140; Location=82..487; Strand=-
  SCN-specific regions: Sequence locations=1-133,201-406
atgaagaacataccgttggaaattgccttttggcaatttgtgctgacttctgtcatatcgttttttgtttttctgcttctttttggactgtcgcaactttggaccggtggaaattttaaattttttttgccacatataaatattttacagttattttaaatgttatttaaatattaaaatctaaatgttaaattaaaaaactaatgcacttcggtctaaaaaaaattgttttttaaaaatttcagcactagggagaaaaaccacgaatatagccgtctgccaaaaaatgactatttttggcaattttgggggtcaaattttcaaaaaatatagtgaaatgggagttcggcggtgccgttaggcgccgctgggaaaaaaaaatttttttttttgaacctttaataaa

SEQ ID NO: 81580 - DNA, 860 bp, Heterodera glycines
  Genomic contig location: Contig_ID=SeqID_17141; Location=768..1627; Strand=-
  SCN-specific regions: Sequence locations=1-223,245-860
atgctaacaaataaaagtttgcctttgttattttattcagaatttgcaaaatgtaagcggtgccgactgaacaaatgccttacggtcggaatgaatcctcgcggtgttaactgcaacaaatcaaatgtccacgaaacattggcatttgcacaacggatgaaacagcaaatggagcagcagcagcagcaggaaaatgccaatgccaaccaagcggagaaagcagcatcatcagaagcaacggacattggcacggaactgtcggcactgacgaccgaacaaagcagcgaaccaccaaaatgggccttgacggactcggttatcaaacagtgcccacttagacattgcccggaaaattagacacaaaaacaattaaaaacagtgttagtgccggtgccaaatattccaatgtctccaaatttgtgctgctccccattagttatctctattaatttcaaactttcagccaatggtacaaaaaaacttcgcgcgtttcattttgatgaaacatatgatggaggttgagcggaaagtgcaggattcgcgactcgaaaactaagatcccggacatctttttcgcccaatgcgacgcatttgagtcgatttttgaacgaaaattgagtttgattgaatgtgccgacaacttttcggtttccaaaccataaaaatgatgaaaatttgacaaatttaagaccgaaatgccaagcccacccacagaattgtttcaccaaattgtccaacagaatgggccaatgtgcatgatgccgccatatttggccatggatttgttgtttgtgttcgaaattggcagaacgtttcccttctttcagcggcttagcatcagcgataaggtaaaaaataaa

SEQ ID NO: 81581 - DNA, 705 bp, Heterodera glycines
  Genomic contig location: Contig_ID=SeqID_17142; Location=290..994; Strand=-
  SCN-specific regions: Sequence locations=1-198,226-364,403-438,476-705
tttattttgatagttttttgagtgacgtcaagcaccaatgaatatgagctataatgacaaagttggcttcatcaacagtgccagcaaacagttgggggacagattgtcggagcagaacaaaaagatgcacgaaatgttgaaggaggacaaaaacgaacggagcagcacatcgcattttgatgagggcaataaaaaggcaaataaaattataaaaaattattaaaactcgaagtattaaatcttaattaaattcgtgttttttaacagggaagttcgtataattttgaaaaattttcttcatccgaaagtcgtcctgctccctattcatattcgggaaagcccgcggattattttcgaggtaaaaataaattatttgtttgtttgtttaatgagtttatttttagccattaaacactaaatgttttttaaatcatgaactaatttttataaaaacaattaaaagaaattaaattttcggcttttgaatgttttattttttagatttaattttgttaattcaaaactctattcccctataaaattaggtcctaccatcagagatgtgccaccatcgaacggttccattggtggcacagtgaccacttgggaatggggaacagtgagcaattgaaaaagcattaataagaaaaagattgtccatcgccagcaggagaagatttagacgattttgatatgatgatatct

SEQ ID NO: 81582 - DNA, 1530 bp, Heterodera glycines
  Genomic contig location: Contig_ID=SeqID_17145; Location=427..1956; Strand=-
  SCN-specific regions: Sequence locations=1-43,66-96,118-435,457 -520,542-821,845-976,998-1003,1025-1075,1098-1530
  Gene Ontology: Mol. function=glyoxylate reductase (NADP) activity; Biological process=metabolism
atgccgagggaaatgcttttgagagaattggccgacgcggaggcacttttttgtttgttgagggacaaaatcgacgacgaattgttggcacgagcaccaaaattaaaagtcgtgagcacaatgagtgtcggatatgagcacattgatttggaagcatgcaaaaaacggtgggaaaagcacagaaaaataggacaattttgaaacatttcattcgtttgcttaaagtcaaaatgaattggatccataaagcctccgaaaactaaatgagtcgttttttatcccgttttattattggatttcagtgggattcgcattggatacacgccaggttagtctctccattccatggattgtcatttgatcagcaggtgttttgaccgatgccacggccgagttgggcatggcacttctgctgtccacggcgcggaaaagtatttttcataaatattccttttatatttccttaaatatttacagttcctgaggctgtgagatctgcgcaaaagtgagtcagtcatccgtttggtttatttgtcgtaatatttaagcggtggatggaagacatggtcaccgtattacagtgagtctcactttcgttacgttatttcctctgttacgcttcccttcctttgatgtcatttgttattcattttcagtgtgtggcaaaacactcgttgactccgttgtcggcatttatgggcttggcaaaattggcacttgcatggccaataaaatcgtggcattcaaaccgaaacgcattatttacaacaatcggaagcccgtgactggtgcgttaattaaattggaaatcattcaaacggttattttcattagttggacaatgtttttactacttttagactctccgttcgaatttgtctcgtttgacgagcttcttcaacaaagtgactttgtgattgtgtgcgctgcgccttccaaagaaaatgtcaaaatatttgacaaaggcgcattttccaaaatgaaaaaagattcgattttgatcaacatttcaaggtcctgttcagatgagaagtacactttgcaaatgttcatcaccagaataattcaggggcattttggtggacattgaggcactgacggaagcacttaaaaatggactcattggcgccgctgggctcgacgtcacggacccggagccatttccgactgaccattccctatttcgcatggacaattgtggtaagaagtgcagttaaactaacgcttataacatggacacagaacgtttactattagccaaccaatttgattgcttctgaaagagcatatttaatgaattgtttttaatttagttattctgccccacatcggttccgctacgtatgcgacgagggatttgatggctttgactaccgaacagaacatttgcaattgtctcgaaggaaaggaaatggtggcggaattgaaaattgattaatattttgtgacttgttaatatgtgattgtttttgtgatagtttatgttttttagattttatctttgatcgttttaagcatctaaaaaataaa

SEQ ID NO: 81583 - DNA, 1105 bp, Heterodera glycines
  Genomic contig location: Contig_ID=SeqID_17146; Location=1..1105; Strand=+
  SCN-specific regions: Sequence locations=1-451,473-595,617-813,855 -1105
  Gene Ontology: Mol. function=myosin light chain kinase activity; Biological process=protein biosynthesis
aagaagagaaaagaggctgaggagaagaaggctcagaacccccaccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgaggctaaagccaagaaagacgcagaagagaaggctaaaacggatgccgaggctaaagccaagaaagacgcagaagagaaggctaaaacggatgccgaggttaaagccaagaaagacgcagaagagaaggctaaaacggatgccgaggttaaagccaagaaagacgcagaagagaaggttaaaaaggatgcagaggctaaagccaagaaagacgcagaagagaaggctaaaacggatgccgaggttaaagccaagaaagacgcagaagagaaggctcagaaggatgccgaggctaaagccaagaaagacgcagaagagaaggctaaaacggatgcagaggttaaagccaagaaagacgcagaagagaaggctaaaaaggatgccgaggctaaagccaagaaagacgcagaagagaaggctcagaaggatgccgaggctaaagccaagaaagacgcagaagagaaggctaaaaaggataccgaggctaaagccaagaaaaaggatgccgaggctaaagccaagaaagacgcagaagagaaggctaaaacggatgccgaggctaaagccaagaaagacgcagaagagaaggctcaaaaggatgccgaggctaaagccaagaaagacgcagaagcaaagaaggaggaagaaatgaagaagcaaaaggctaaacccgaagaaaagcctgaggcacctgccgaaggcgtagcggtagtgccggaagcgaagaaggcggaagagacaaaggaaaggctgaagcaggaagagaaaccagtggaagtgccaccatctccagcagaaaagaagagaaaagaggctgaggagaagaaggctcagaaggatgccgaggctaaagccaagaaagacgcagaagagaaggctaaaaaggatgccgaggctaaagccaagaaagacgca

SEQ ID NO: 81584 - DNA, 1961 bp, Heterodera glycines
  Genomic contig location: Contig_ID=SeqID_17147; Location=15..1975; Strand=+
  SCN-specific regions: Sequence locations=1-5,27-1805,1827-1961
  Gene Ontology: Mol. function=myosin light chain kinase activity; Cellular component=microtubule associated complex; Biological process=protein biosynthesis
atgccggaggctaaagccaaagaagaacgcagaaggagaaagcttcaaaagggatggccgaggctaaagccaagaaaggacgcagaaggcaaaggaaaagggaggaaggaaaatgaggaagcaaaaggcttaggcccgaaagaaaagcctgaggcacctgccgaagggggtagccgtagtgcccggagcgaaagaaggcggaagagacaaaggaaaggctgaagcaggaagagaaagcagtggaagtcccaccatctccagcagaaaagaagagaaaagaggctgaggagaagaaggctcagaaggatgccgaggctaaagccaagaaagccgcagaagagaaggctaaaaaggatgccgaggttaaagccaagaaagccgcagaagagaaggctaaaaaggatgccgaggctaaagccaagaaaaaggatgccgaggctaaagccaagaaagacgcagaagagaaggctaaaacggatgccgaggctaaagccaagaaaggcgcagaagagaaggctaaaacggatgccgaggttaaagccatgaaagacgcagaagagaaggctaaaaaggatgccgaggctaaagccaagaaagacgcagaagagaaggctaaaacggatgccgaggttaaagccaagaaagacgcagaagagaaggctaaaaaggatgccgaggttaaagccaagaaagacgcagaagcaaagaaaaaggaggaagaaatgaagaagcaaaaggctaagcccgaagaaaagcctgaggcacctgccgaaggcgtagccgtagtgccggaagcgaagaaggcggaagagacaaaggaaaggctgaagcaggaagagaaaccagtggaagtaccaccatctccagcagaaaagaagagaaaagaggctgaggagaagaaggctcagaaggatgccgaggctaaagccaagaaagacgcagaagagaaggctaaaacggatgccgaggttaaagccaagaaagacgcagaagcaaagaaaaaggaggaagaaatgaagaagcaaaaggctaagcccgaagaaaagcctgaggcacctgccgaaggcgtagccgtagtgccggaagcgaagaaggcggaagagacaaaggaaaggctgaagcaggaagagaaaccagtggaagtaccaccatctccagcagaaaagaagagaaaagaggctgaggagaagaaggctcagaaggatgccgaggctaaagccaagaaagacgcagaagagaaggctaaaaaggatgccgaggctaaagccaagaaagacgcagaagagaaggctaaaaaggatgccgaggctaaagccaagaaaaaggatgccgaggctaaagccaagaaagacgcagaagagaaggctaaaacggatgccgaggctaaagccaagaaaggcgcagaagagaaggctaaaacggatgccgaggttaaagccatgaaagacgcagaagagaaggctaaaaaggatgccgaggctaaagccaagaaagacgcagaagagaaggctaaaacggatgccgaggttaaagccaagaaagacgcagaagagaaggctaaaaaggatgccgaggctaaagccaagaaagacgcagaagagaaggctaaaacggatgccgaggttaaagccaagaaagacgcagaagagaaggctaaaacggatgccgaggttaaagccaagaaagacgcagaagcaaagaaaaaggaggaagaaatgaagaagcaaaaggctaagcccgaagaaaagcctgaggcacctgccgaaggcgtggccgtagtgccggaagcgaagaaagcaggagagaaaaaggaaaagctgaagcaggaagagaaaccagtggaagtaccaccatctccagcagaaaagaagagaaaagaggctgaggagaagaaggctcagaaggatgccgaggctaaagccaggaaagacgcagaagagaaggctaaaaaggatgccccg

SEQ ID NO: 81585 - DNA, 603 bp, Heterodera glycines
  Genomic contig location: Contig_ID=SeqID_17150; Location=304..906; Strand=+
  SCN-specific regions: Sequence locations=1-180,211-353,376-565,594-603
atggcaaaagagtgtgcaaacattcgagtcactgtaccaatttgtgtccaaattggtggaacggacgaaggacaaatggactccgaggttacggtggacagaagagcaatcgatgcaaatgaaaacaccgtatgtgactgaagaccacgttgggtttcgagcaccacagtcaaaacagaccttagaaagaaaaagattaaaattaaaaatgggttgagactttgttggatggattcgctcgtagtcttttaaaaatgttctcaatgtccggaggtgtgggagaaattaattcatttgccataataaaacaatattttcgaccttgcctgaatgtttaacaaattatctgtgaaataaaacaaaattataaacaaatgtttgaactggttattccacctttctttcatagacaaaatgaaaagccatcaatctaaacaaaaaaatgagaaaaaactgatccatcttagcaatttgtctgtgcgccaattcagaaagtccgaccaaaattataaattgtcaattacaacgcgcaaataaaatgaacaaattgactaaaggaaatcgctttaataatttaattttcaaaataaaatgcagacataa

SEQ ID NO: 81586 - DNA, 604 bp, Heterodera glycines
  Genomic contig location: Contig_ID=SeqID_17150; Location=1..604; Strand=-
  SCN-specific regions: Sequence locations=1-91,122-347,369-604
  Gene Ontology: Mol. function=protein transporter activity; Cellular component=Golgi apparatus; Biological process=intracellular protein transport
atggcaaatgaattaatttctcccacacctccggacattgagaacatttttaaaagactacgagcgaatccatccaacaaagtctcaacccatttttaattttaatctttttctttctaaggtctgttttgactgtggtgctcgaaacccaacgtggtcttcagtcacatacggtgttttcatttgcatcgattgctcttctgtccaccgtaacctcggagtccatttgtccttcgtccgttccaccaatttggacacaaattggtacagtgactcgaatgtttgcacactcttttgccatttcaggtcatggattcagcttcggttcaataacaatttttataatttggtttgttttccaaaatttagtgccatgcaaatcggaggaaatgcaaatgcggtgaatcgctccattttcgaataattgctaaagcatctgacaaacaaattaaggtggctttcttcaagcagcacggatgcgagtcgaatgatgcgcaagtgaaatatcacagcaaagctgctgcgatgtataaagtgagtggggtggataagtgatacggggagatggcaaatgttggccattctttagatgatcaagaaactg

SEQ ID NO: 81587 - DNA, 568 bp, Heterodera glycines
  Genomic contig location: Contig_ID=SeqID_17150; Location=1469..2036; Strand=-
  SCN-specific regions: Sequence locations=1-144,166-224,247-568
atggctttggttgaatttaaggtaaaaaaatccttttctggaaaactttgtttgtttacaataatgatctttaaggtaaaattggagcttgtggtaggaatttattctgctgatatgaagcttgaattgcgttcgcacgaagggaaatttatttcagaattaattggcgacgaccgtaccttagaagaagtttgtaatttccttttattttattctcgaattttttcaacagttgggagtccgagatcagtgcattgtgaatgtttgcgataccagtgaaacaagaaatgataattccacgaatgaccccaatgcattttatgtaattcccgaagagagatacgccaatagaaaaggttagactttttaaaaaagtgaaaatacaatagtatgataatcaacaagctaatgtaaaacgatgcttattattttagacacagctcgaaaatggaaacaacaacttatgacaactgcaacgacaacaaccgatggtaaacaaacttaatagcctttttagtggaccaatcgctttttagtcgaacgatccgagcagcaagtgccaaataaa

SEQ ID NO: 81588 - DNA, 1117 bp, Heterodera glycines
  Genomic contig location: Contig_ID=SeqID_17151; Location=1146..2262; Strand=-
  SCN-specific regions: Sequence locations=1-180,209-315,337-598,621 -758,806-875,907-1015,1037-1117
atgctgaagaaaggaggaacaattggtgctgaaggtgaaacaaatttgccagtttctcttgtgatcagatttctcaaaaaacgtgaagtgatcgaaaagtaatacagttaattattaaatgtaaaccaaattgccgtatttgtttggcctcaggctcatgccggtggtggaatgggaaactccaacaaaaataaagggaataaagaaagagtttggcaaaagataccgtttggttaggtcatcttatcaaaaatttaaaagcggcgaaattttactcgtcggcgtctattttgccaccgccggatcctagcactttaaataatttttgtgaacaaactcaaatcaaaaattaagtgattataaagtgcaaaaaaaaacgctttgaggggaatggtagttagccctccgcccctactccgaaattatctggctatggtactgatccttttttgtacatccccgcccccctccatttactcagtccatgcccgccaatttgttcgccggacgacgatttgactgtgcacatcggcgatcgtcagttgaccatttctgcccattggcttatgtccgtttcgccaatggtcaaacaaatgctcagcgtggagatgcaggagaagcatcagcgggcgatcaacctggacggattgggcatcacaatggagcagttcagcgaatttgctgatgccatttcaatttcgtccttgggtcaaccgttcttcccaaatcgtaaatattttttttttggcaattagcacttatatatttatatatattaatgagatattattattattattataaagttttacaatttcgaaataaaaatgagcacaccaattagtctcctttgggactattattcaaattaatccataattttaaaactataaatttaatttttttcaattttctgtgattttatgtttttttttcactttagcccaaaatgtgctcactttccttttaattgccgattacttccaaattgattggctgaaggagcgttgcggcgtccatttggccaattgtgtggaaattccattcttagaacgacttcttttgattgaacgttataaactcaaaaatttaatggtatgataaatacattaataaa

SEQ ID NO: 81589 - DNA, 244 bp, Heterodera glycines
  Genomic contig location: Contig_ID=SeqID_2787; Location=2846..3089; Strand=-
  SCN-specific regions: Sequence locations=1-54,87-178,205-207,230-244
atgaaaacttataaaaattcattttgcttagtatatttttcataatttcctatgatttttattttgatttaattaattaaaattttcagatttacttctttcttattgtaattttcaccgtgctgacgattgttatttttattccaatattgtagagcgtttttaatatgtttgtttagttttaattagaagtgtcctttttgtatgattttttttaatatttaattttcaacccaataataaa

SEQ ID NO: 81590 - DNA, 1241 bp, Heterodera glycines
  Genomic contig location: Contig_ID=SeqID_17152; Location=434..1674; Strand=+
  SCN-specific regions: Sequence locations=1-167,189-461,485-542,564 -916,1109-1241
atgtcttttaaacgagtgaactctgtcaaacccgccgtgccaatggaaaaaatgggatttccgctcaattgggtaagtttaacaaatcttaatgtataaatagctaatccttttaagaaataatttcctgatggagccctttaaacttattgaccaccaaacttcaaaatgcaaaaaagtttggttttacgaaaaacataacggaatttgtgatcaacccggatgtggagcgccccgatgaaacgctcccgcgaatcatcgagagaaactccacacaggcttgtgaaaaaagttgaaaaaagtggtgaaaaaaggtgaaaaacgcatggataaaggtgaaatttaatggtgaaaacctatggggggaggggggttattgacagccacacgtgcaagggtataaagacgccccgcttcttacccccacctaaacccatatcttggtccatccctttttcatgtaattaattataaataaaaatttgctaatattttcgttatttgtgaaaataattaaacatcttctaatcaattatttggtccctccattttcaaattccattatttttggtctcctcctctctccttctgttccctccctcctctgccgccgcccgccaattatctccgattttgatcaaaaaatttatttcaaattccacatttatttttcgtcatcaaagtattccgtggcgtagtggttatgcgcccggttcgctctctcagtgctggtgttcgagttaagccccctcgggggatggcgtgtttggggttcacgccttcgaacgtcccccatgcgcaccttcgctgagagggacgagcccagctcggacatggtggtaatgcataatgaacccagttgaggaccagtccaagacaaggggtaccactattttttctattttcatatcattattttttatttttatttaaattttcataatgttttttgcagatattatatttctttttatcatattttattttctattttcattgaatatcttattttttgttatatttggcatcactattttcatcattatcattttttacactattttttctattttcatatcattattttttatttttatttaaattttcataatgttttttgcagatattatatttctttttatcatattttattttctattttcattgaatatcttattttttgttatatttggcatcactattttcatcattatcattttttatctacgaattatttttta

SEQ ID NO: 81591 - DNA, 321 bp, Heterodera glycines
  Genomic contig location: Contig_ID=SeqID_17152; Location=1945..2265; Strand=-
  SCN-specific regions: Sequence locations=1-116,150-321
atgataaaattgattctgcatgatgctgggccgcttcaaaagcacgaactggttaaaaaaatattggagacctacaaactgaattcgaaaaagcatgtaataatgacattttttgttatatatatatatatatatatatatttaaatattatttaatttgtttaggtcaattcccgagttaaaaaaactctgcggacctacgttgggaatggagctcgcagtcgaagctggaagatattcggtggccgcatcgggcggtggtgataaatgattggtttgacggttccattttgtttttttcatttgttaatttttaataaa

SEQ ID NO: 81592 - DNA, 1702 bp, Heterodera glycines
  Genomic contig location: Contig_ID=SeqID_17153; Location=216..1917; Strand=+
  SCN-specific regions: Sequence locations=1-56,79-89,113-139,178 -279,307-425,448-556,578-600,622-673,695-706,728-1019,1041-1193,1239 -1394,1428-1437,1459-1487,1509-1551,1616-1702
atgaatccgcagggcgttagcgcaacaaaattcagtggtcaacaaatattggcatttgtacaacaaatgaaacagcaaatggcatcattagcagcagcatcaacatcagcaaatttgacaggatttgaattgtgcgcacaaaccaacaccacaacaaaaaatgggccacaacaattgggatcactaaattcggttgtcaaatcaaagacagaaataagttaaaacgcccggttaccgtaacccgttttcaaactttttatggtaactgatcggtaacggttaataaaattttttaattatttttaagtcaagtccaactcggaatgaactgattgaacgggaaaattttctctttttttaataagccgaacttgcaaaaaaatttagatttataagatcttctgaaaaagtgcatataattgttcttaggccaaacaataaaactccgagggttttgcacaagttctggtcaagtacagttcgaaccgatttttccaagaaaaattattatattttccataattcaaaattttacttctttcttaagtgcaaactttaaataaaagaatatttccccgatgaaaagcaggctagaattgttttaaagttttcttcagtttttgagtttcggcaatagcatcttgaaaaagtaaaattgaaagaatgaaaattatttctttcgggaattttatatttcttgcaaattttataaaatgaaagtattttgttttgatttttttttaattaagcttagcttttcaggtaaacaatcattagcatttgtataataatatgagtatttaggcgctggaacaaaaagattcgatgggtttcattatgttgaaacatttgctggacattgagcagaaagtgcgccgaatacgcttctcaccgacaccgattccggaatttttttataaacaatgcgattcatttgaggcaatttttgcacggaaattaaatttgcttgatttgacgcgtaaattttcggtgagcaaattatttaaaatgggttttaattttaaaatttaagacaaaacagtcgaacgtgcctaaagcaatattttttgaaaaaatacgtcaatttgggcccttctttataaggccagaggaactggtcagagatttgttatttgtattcgaaattggcaaaagttttcctttctttgcgcggcttgacatcaatgataaggtaaaaaatatttttcaaatttattcaattttaatttcaatttaaagattgccctgtgcagtaatattgcgatgccattgtatgtgttatgcaacggtttctactcagtccaacaaaattgtgaagttttttgtaatccagctggtatgaagcccattcagaaattcaaaaattcattctatcatgaagacccaatgtatgcatttatttaataattttcttaaaaaattaaattcagtgccatgggaatgggtgacacattgttgtgcaaagccatagaaccattccgccgtttaaaactgagcaccgaagaatttgtacttattcgagcaatcatttactccaatatgggttagaagttttttataaaaaatttctacaagaaaatttatataattaatgacaaattcaattaaatttttagtttcgccagggcttagtgaccaggcacagaaattgttattatctgaagcggagaaatattcttcactgttaatgagcattttacag

SEQ ID NO: 81593 - DNA, 2284 bp, Heterodera glycines
  Genomic contig location: Contig_ID=SeqID_17154; Location=4..2287; Strand=-
  SCN-specific regions: Sequence locations=1-742,767-1035,1069 -1316,1338-2284
  Gene Ontology: Mol. function=receptor guanylate cyclase activity; Cellular component=integral to plasma membrane; Biological process =transport
atgtgggatacccgtggtggggtcattccccaggcggtgcccccgtgcggcttcgatggcaacggttgtaccgtatcggtgtttgagttgtacaaagtacgatatatttctgtaacgttaacaattttatttgctattcaaaaggggtacttcataagcggaattgttctcttcgtgctaatcataggcagcagtttgcttatcatggtctatttaatacagtaagaaaaaagttgctgaagtattactgtagcctaaatgtttaaatttcagttcgaaaattgttgaaaaccgtaaaaccaacttactgtggcaaattccatttgcgatgatgaagcgagtgaagcaacgggtgagttttataattcatcccaaatcattttctaatttttatccccccccctatttaagcatggcgccgagcggagtcaccactccctccgctccaaccaaacgaacgtttccgcgctgacccattcgacgatggacagtttggcccagtccaaaaacttctctctgtacacttacaacggggacaagtgcattgtttgcacgtttgggtcaatgacagccgccgcgccattgtctgtcgctgaaatggccgagtgccgagcggtgaattggcggagggggcggggaaaggatggccaaggggcagggaacatcccaaggggttaatggggtacgtatcccccagcaaggataaagcttcttaagaaaaagacaaaaaatgccattttcgatttaaaattttaattaaaattttcagatgcgcctattcgaccacgagaatatgaaccggtttttggggctgagtttggacgggcccaatgtgttggccgtgtggaacttttgcatgcgcgggtccatcagagacgtgattttgtccgaaaatgccatggtcaaagatgtgatgttcatccaatcggccgtcaaggagctttgcgaagtgagagattgatttattttgttattgagggtaattaaataaattggcatttagtttaaaattggttttattctaaggaactcatgaaaattaaaattattaatttcaaaattataaaagtaaaaagcattttttccccttccagggccttcagttcctgcacaattcgccactccaattccatggtcgactgaaatcctccgcttgtttgatcaacgaacgatggcaagtgaaaatctcatattttgggcttcgatggctgaaaagtccgcaaaaaatgcaagcaaaaggtgaaaaagttacaataattaatcaatgaattaattcttttgtagaccttttatggctgtctcccgaacaattgcgaagagcgacggacggcgccgaaataaatgtggccgaaggctcaaaacagtcggacatttacacaatggcattgattttcacggaagtaaacaaacggacattaactcattgtctaaatttgccaatttatttgctatttacgatggtgaacatggccccgtgttgggaggagggccgcgactcggaggaagacggcggagcgacgcgcgacttggaagaaatggggtggagcagaggcaccgcgacgcggcacgtcgcaggcgcaacgcgcggacgcaacgcggacgaaattgcctatttggtgaagcggggcggattggtgccattgagaccgatgatacggcccgctttggataatttgcacccggaattggtaattaaaggcaattaatgaaatgactaaatgctaaaacaatgaaaatgaaccatgtgcatagaaaatggttgggttttcggtaattaaatcaattactgtttaaactcatcagattcatctgatccgcgactgttggaccgaagccccaaacgaacggccgactattgtaaaagtgcttcaacggttgcggcaaatgaacgccggtcagagcatcaatttgatggaccacgtgttcgaaatgttggagcagtacgccaacaaattggaggaggaagtgcaggaaaggacgcgcgagttggcgggggagaagcgcaagtagggcattttgctctatcggatgatgccacggttagcggggggagctctttcaatattcaactgttttagccaagtggcggaccgagtaaagctcggccaatccgtggagcccgagcagttcgactgtgtgtcggtgttcttctcggacattgtccaattcgcggcactgtccaaccaaatgcggccgctgcaggtggtcaatctgatgaacgacctgtacaccatcttcgacgcaatcattgacgagcacgacgtgtacaaggtggagtccatcg

SEQ ID NO: 81594 - DNA, 1258 bp, Heterodera glycines
  Genomic contig location: Contig_ID=SeqID_17156; Location=361..1618; Strand=+
  SCN-specific regions: Sequence locations=1-131,181-847,869-1139,1162 -1258
accggcgcactcaattttcgaccacctctcagccgttcgcgcagtgtgccacgcctttgttccattgacggggaaaggcacgggccgaggaacaagaggtacggtaaatgcctgcttataccgtaaatatgtctctctctttctcttttcccctctctctctctatccgtctcactctcttaactttcgccatctctcgctttctcactaatctatacccatgtttaagtctctcactctctctctgcttatttctctcgttcatcattttctgtaaaagtgttttctgtccatttctgagatcacgtaactcaaaatacatatgaattattacaggatgactgtgatgagactgtgaaggatgaagacgaagatctgcagctttcatcgtctgatctgtactcattgaacaccgcggttcattaccagccagtgccaaccgctaccacaacgatggcaaacgcaatggtctcccatgcctgtgtcgctgctgatcatcagaccatcaacgattatcactatttttttatttttgctcctcatttccattttttctttcttttgccattaagtatttactgagttaaatactgtacgatgcggtgtatattacgccgctgctgtaaattccaaaatatttccgtatatcatacgggtttttatttatattttttaggcaaaacatatcattgaattcaacctttctgtcatacggttataaagacactaaaaatgtttttcatagaaaaaatttataaaaaggaaattttcaaatgaaaaaacatcaatttgatcaaaattaaaaaatgccagcattaagaattgcaaggcagctccgacaaaaaactttatcaatccctctgaagtcgccttcgtgctgatactcatgccggaggagttcatcacgattaccgtcaggcacgatgaccttgcgcaacccgaagtcactcatgcctacaactttgtccacaattttgctgacatactgcacttggccttcgagtccgattcgtcccgaaaaggcaacgttcattcggacgcaacggttgatcatgagtgaaaaaaaggcggcaaatgcacccgcagacagcgaaggcccttcggtcaagccatgcggagaacgcgacacaaaaatggggtgggtgacgagaatgttctggatggccgggtgtcgctgtgcaaacaatgtccgcgcttgatcagctgcattgctgattgcttgctgtaaacatatcgattgatgataaatccaaaaata

SEQ ID NO: 81595 - DNA, 715 bp, Heterodera glycines
  Genomic contig location: Contig_ID=SeqID_17157; Location=160..874; Strand=+
  SCN-specific regions: Sequence locations=1-58,127-301,324-397,419 -460,493-625,667-715
atgcagcggcaggttcaaatgcgatcattctctatattaacaggtaattaattattcgattatttattaatatttaatttattcttatatttataaagaaataaatatttaaaaaaacaatttttagcactgaatatcgccatgaattcagaaaaatattgcgttcgctgaccaaatgtttttgtaaaaataatggtaatggataacttagttgaaaattttcaaatcctcattagcgcaataaaaattattctgtgttttggcattaaaataaacagcaaaatccctatatttcttgcaaaatatctctttatattttttaaattagtatttatgcgatatgtcaagaaattttgacaaaatgccaattttcggccgaatttttgccaaaaaccaatcaaaaaatccctctttaaaatctcaagttggggataaagcctcagaaatggttcagccttattaaatcacatttttatttaaatttgtttttagctgtccacgacatcgccgcaattcaaaatcgcgctgtcaatccgaactttatcagaccaaaccaattaaatgctttcaatccatccgaccgatttagtcgttattaattgtcctcaattgtcatttatgttgcttttttataaatatttttgtaaaaaaaacattataaaatttccccatgaaatcaattgaattgcttatgaattgaaaaaccaaaatttca

SEQ ID NO: 81596 - DNA, 467 bp, Heterodera glycines
  Genomic contig location: Contig_ID=SeqID_17158; Location=346..812; Strand=-
  SCN-specific regions: Sequence locations=1-467
atgatcattagtaatgaattaattaattattttgtcggtcagattgagtgcgaaggcaacgcctcattggtcggcatggaaatacggcatgcaaatgtctcacttgggcaggagcatgtgctcaacttcgttgaaattaatgctgacaatggtgtgttacgggccggtgacaaaatcaacgtccgaattcccatcgatggcacaattggcaaaacggaagtgatcaatgtgtcggtgaaccttttcttcgaggcgcttcgaaggcatccacacagtgagtcgaaaatgccaaaattgtcagctttgaattaaaaattgaattttgggggaggaatgccgaaatgtcccctctgctttcagtaggggtcagggctcccggacaatcggacagtggacaattggacagtggacaatcggacagtggacaattcgacagtaaggacattccgacagtggacaatccgaca

SEQ ID NO: 81597 - DNA, 316 bp, Heterodera glycines
  Genomic contig location: Contig_ID=SeqID_17158; Location=997..1312; Strand=+
  SCN-specific regions: Sequence locations=1-204,226-316
atgaatgtgatctacggcccatggcggatatctgtgttccttgacggaatttctagatctaaattcttccggaaatggatatgggcaattcatttcgaagtcgacttcatcaattttgatgacgaaatgttccgccgtacaattaatggacaaattgaatttttggccatatttattaagcaaatgctcaacagggcgcccatttgtgatataatgatcaaaattcttgtgctcctgtaatttaatagggtttttaatcacaaagaaattgattttaacaaaatttgaaaaatgtttgatttaaaattaagaaaaa

SEQ ID NO: 81598 - DNA, 1198 bp, Heterodera glycines
  Genomic contig location: Contig_ID=SeqID_17159; Location=235..1432; Strand=-
  SCN-specific regions: Sequence locations=1-37,91-402,482-664,687 -703,726-729,767-1198
atggattttgtgactttggacacaaattatgtaagaaaaataattaattaattcatcggaaggttaatgatcaattaattaattaatcaagatatttctttacattaaacagaaaccaccgtacatggatttaccatttaacaacactttgagaaaattgcaatacgcgaaaaatattattttccgaattcaactgaacaatgtaaaatcttttggcttcattatctctctgttgcatgatcgcccagagaaaaatgaggacagtaagtttttagagggtcgagagtctcgacaaagttttgccaattaaaacaatcaaaacgcaaaaatgtttagtcggcgctacaataatggaaatgaatgttaggccaacacatatctcaatgacgtcattttcagtggtaattaaaaacaaattatatttactttttttaattttaaaagagtttcttcatttaacaatttttttaaattttaaattccgttaaaggaaaataagtcatcagagcccgtaaaagattcgatcgatctaagcaaagcaggagcattggaaattaacatcactttgttcaaagatgacaagatcacaattcaaataaatgacattttgaagaggaattacacgtcagaaatgccaacttgggccacaaattttgtccgggtaatgccaaaaagtgaaaagtgatgggcaataatttccattagttttctgggaaattcttttttaggaaatatttaaattacaatttttaatgctatatttaaatacaattaatgggtccccggtaataatcaactgcaccggttgcacaaaagttttttctttctgttcagaaagtgtagaacgtgggaaaattctttttacataaaaggctcaatcaaaatggtaatattctaatgaaatgtaataaaaaggaataattaaacataatttttgcctaattattacaggtggaagagatcaacaaatacaaaggcggcatcactttgatggaaaagccgtttattggcattgatacgcaattggcagaggcaaacgagggacagcagcagcagaaagacggattgccattgaccaagcgattaatgacagtgcttaattacggggacgtaattcgcatggaattcctcatcaaaaggcaaatcggcaaattgaccatcgctttgatgcacgaggcaaaatatttcgacaaaagac

SEQ ID NO: 81599 - DNA, 689 bp, Heterodera glycines
  Genomic contig location: Contig_ID=SeqID_17160; Location=190..878; Strand=-
  SCN-specific regions: Sequence locations=1-203,378-539,561-590,612-689
  Gene Ontology: Mol. function=structural molecule activity; Cellular component=cytoskeleton; Biological process=spermatogenesis
atgacttctcactttctcgtcggcgttgcagccttcggggcgggaatggtaagttttttttttgtttttcgctccaaattttacatctcaaacaaatttttttcaaattttcagtgcttcgcgaagacgtacatggagaaaccgaagagcgaagacgacaaagaagcgcccaagaaggaagaagccacgaccggcggcgacgcggaggagaaggcaaagaagaaggacaagaaaggcgacggcgcagctgcggcggacaagaaggaggagaagcgcaaggacaaacacaaatcgaaggaggggaagagcgacgacagcaaccgccgttccaagaaggacaagcacgggaagaaggacaaaaaggacaagaagaaggacgccgccgagccagccgctaacgccggagaacaaagcacagcggagacgacccaagcggacgaatagccagcgatgagaacgacgacggtgcacgacgacctctcccttcacgatcagtcccccctactgcttgctgttgtttgtgtgaagtccgttccccatattttgtacatattccatgtgatcagagcgaccttcctaatgtgatcaaaatatgtatgtatgtataatatccattaatttgctgcttcatattcgttatttgtgtgtatgtacaatgtttgtattcattgttcaatgtgtgtaataaa

SEQ ID NO: 81600 - DNA, 1085 bp, Heterodera glycines
  Genomic contig location: Contig_ID=SeqID_17161; Location=59..1143; Strand=+
  SCN-specific regions: Sequence locations=1-176,257-342,365-752,782 -1085
atgtcggagaacacaacggaagcggagaggagacaaatggaaaatgaactgtgtgtctttttctagggatgtacgggtccgagaattggtgcaaaaaccgggtccagatattgccagagggtccagaaaagccgagtttgggtccgagcccaagtttttcaaccgggtccgagtacttaattaaaaaaaattaaatatttcgcgaaatattttgtacataattaacaattattaaaataaaaatttatttttttttgaaattgatagcaaataaaaatctgaataccaattttataattttatagaagataacgtggctatcattttttttttgcttttcatatcttttttcagtctttttaggaaacggcagtgatccggcggtgccgacaggcgccgctggcaagatttttttaaattttggaaagatttattaattgctttttatcaaaaaatgaccattgatggatatttggatcaaatttaagaaaataaggtagtttggttacagcagaaccataaaggcagctctttccatacttaagacaaagtggaagttttacaaaagtcgtaaaaaaaagtaaataaaatccaccggtatgagagtgttttccctttccctcaaccttgatcatcaatttgacgctcacacccattcgtactaatatttttctgggcccggttagacccggacttaggcccgggttttcttgaaaaaaccggttatccggctctggaccgtgtaaccctagttttttaaatgaaattttaaaattaatttgccatttttcagtttcatttgtgccgattgttggctttcagtcttccatttgctgccgccttctcaacttggccttggcattgcactgctcagccaccgatttgactgtttggtggacgaacacttcaaaacgcgcaaatggatgttgggagttattgcgattggaaataaaattggagaaaatggcaaaaaggaaatgaaacttcagcaatgtgcaaatttttgggaatggagaacagtgccaattccgcaaaatccgttgccgaacaaattcatcggatttcgacacattctgattacgtaa

SEQ ID NO: 81601 - DNA, 929 bp, Heterodera glycines
  Genomic contig location: Contig_ID=SeqID_17162; Location=175..1103; Strand=+
  SCN-specific regions: Sequence locations=1-21,43-717,740-929
atgtggggagttattgcgattggaaacaaaattggagaaaatggcaaaaaggaaatgaaacttacaaattttcctgaatggagaagaatgccaattccgcaaaatccgttgcccaacaaattcatcggatttcgacacatccggattaggtaaaattgaccgattaaatgatttgcgttaaaattctaccatttagatacattgattctaatgtgattgtttttctccaacgttttcgttctttttttgcttctcatcagacaaatttgtcaattaaaacaaatagtggcgtcagccattttttggaaaatgttgtaaaaaacatttggccaatgatcaaagacaaaatttgtgccattagtttttcgtctcccgacgaattttgccgttttcaacaattggtgccgtccattctcagcgacaattgttgttgttgtcaatctcttcgagcaatgtttttttacactggtgatttgccaaatttttgcattttgccaatttttggcgatttgccaaatttacccgctaatggctgtgccaatatgtcgactgaccaatcggttatcaaatggctattctcgcctcgcgcagacggtgctccgaaggtgctccgatacagtctccaaatgaataataaatttccgagaaaaattgacgcatttaaaagggtgactaatttaatatttactgttttgaaatttccctaattaaggcatttgccaatgccttttctcgtgccaatttcatcgtttacattcgctttcgcttttctttttggagtgttcgggttggtattccgacctttgaattgttcaacaattcaactggggagcgattgacactgaaacagatttatgataagtatgttattaatcttacatatcaatcaattgggttgatgggaccgcattaggccaaaaacccaaaaa

SEQ ID NO: 81602 - DNA, 522 bp, Heterodera glycines
  Genomic contig location: Contig_ID=SeqID_17162; Location=1481..2002; Strand=+
  SCN-specific regions: Sequence locations=1-77,108-138,160-522
atgagcacaaatgggccaagtgggaaagggaagcgattgaatggatattcgatgatcagtggagccatattaatttgtcagaaagtgatgaagatgatggatatgatctcatcagtacatggttggtactaattattagggatgatatttttatgtttttacctatttttcccctaactcccagtgacctgataagcacgaaaaatatgttttttcagttgttgttaagctacttttgaagtttttaaagcccatttcttggtttttactttttagaatctaacctaaaaatttcgtccctactaatcactacttacatatctatccaatcactttcgtttttttcattagtttggtggacacaacgccaggcccaagtggtcagcagaagtgaattgccgttgctttgtctttatttggatgggcccaatctgagaaaatttcaatccgatttgaaatacttaccctttttcagcctattatctactttatgctttcctttatttgttaaacataataata

SEQ ID NO: 81603 - DNA, 309 bp, Heterodera glycines
  Genomic contig location: Contig_ID=SeqID_17164; Location=374..682; Strand=+
  SCN-specific regions: Sequence locations=1-143,165-309
atgattgcattgctagcgttaattctaagttcaattgcatttaggacaatgttgaggtatttgtcgaaatctttgtcttcgactcgtagtgccctcgttgatatttcttcagtgcatttttctttttatcatctatttttttatgaattcaaaaattttcaggttggaaagccttcttacccttccaaaacgtctagccctaccggaagtttgcttctcagcgaaggcgagcattccactgcgtctgggtctcttgttaacgtccgaatgccgaacataaaaggtgaagctgtgtcaaaatccgattaa

SEQ ID NO: 81604 - DNA, 632 bp, Heterodera glycines
  misc_feature (285)..(285): n is a, c, g, or t
  Genomic contig location: Contig_ID=SeqID_2789; Location=559..1190; Strand=+
  SCN-specific regions: Sequence locations=1-111,133-249,282-480,533-632
gctggttatccgttgccttttaagcgcccctcgggatgggaggagccctatcggagagataaaatgggggggggggggagggtaaaggccatttccggtcccggccttacacctccggccctccaaaagaccgtccctggtcgttaaaatttaaataatttccaaatttaaatgaagtcctcagactttttctttcttttgattttttttttacggtgagaaatttgttttgattttaaagccaaactgaaaataaaataatttaaatatttatttaattactcnaaataaaaatggaaaatgccgagcctctaatgggaatgaacccattcctccaaccaatccacagaagctctgtcattgagctactaaaagaaatccgccctttttttaaattaattttcttgaaattctgattcaattggatttgaattaaattggcattgcttttcaaattatgagccaagagaaaatctgatgaaatttaaaacttttaaaattgtataaatttaataattgttttatttaatttccaatcgactaaaatttggatttttgatataacccggtgtgactgtatgactatacctccccttcatacctgaggatcgtccctgatacaagaacttaaa

SEQ ID NO: 81605 - DNA, 419 bp, Heterodera glycines
  Genomic contig location: Contig_ID=SeqID_2789; Location=3695..4113; Strand=+
  SCN-specific regions: Sequence locations=1-317,339-419
ctaatttgtcatattgtacttttgaccgtaactgagcttctttaatgaccgccgcagcagattcccaagcttttctgagagacttaactaatttctgcttgacattgtcaacttcactggtgttttcgggttcggtgttgggattcagaatttgctcaatgcaaaatattgggtctcgcccaaagaccaaaaagaaaggtgtctcctttgtggaagagtgaattgatgtgttatagcagaagttggcacattcaagaaattcatcaaaatctggttcttcatttgaaatatatttcgcaagtatattgtgaaatgtcctaaaagatcgctcaactactgcattgccttggctccaatggggaatagcataacatttataagtatagagaagcgaacagaaggacttaaaaaaatcagag

SEQ ID NO: 81606 - DNA, 1975 bp, Heterodera glycines
  Genomic contig location: Contig_ID=SeqID_2789; Location=2123..4097; Strand=-
  SCN-specific regions: Sequence locations=1-65,87-639,661-815,837 -938,968-1139,1161-1311,1333-1975
tccttctgttcgcttctctatacttataaatgttatgctattccccattggagccaaggcaatgcagtagttgagcgatcttttaggacatttcacaatatacttgcgaaatatatttcaaatgaagaaccagattttgatgaatttcttgaatgtgccaacttctgctataacacatcaattcactcttccacaaaggagacacctttctttttggtctttgggcgagacccaatattttgcattgagcaaattctgaatcccaacaccgaacccgaaaacaccagtgaagttgacaatgtcaagcagaaattagttaagtctctcagaaaagcttgggaatctgctgcggcggtcattaaagaagctcagttacggtcaaaagtacaatatgacaaattagtacgcaatcaaaccgtccaaataggagatagggttcttttacgcaattacgcaggaaaagtcaaaacatccaagaaatttcaattaccttggaagggactgtatcgagtgatagagattaatggtgtccttatcacaatcgtcagctgcacatcacctcaaacaaacccaagaattgtacacattaatcaagttaaaaagtattttgagtactcaggacccccttgcaccacgaaaaatcttcaaaaagatgaagaacaagcactaaaggaattagaatcaagagaacagaccaatgtacctggctattctcatgattcctatcaaaaaatctctgataacacagtattaatagaaaacgcacctgcactcacccctaatccctcaccctctccacagtccaataatcaggtaaaagaaaaagaattaaatagaaatctttgctcaaaacataatctccgcgaaaaccctaggaaaaagaagcattttggtaacttttctgaggactaatttcatgggatagccaaattcaatcattttttccattttttttttttttttttttaaacatactgtcttttaagaacgtggactggtctcgagaagccatttcaactttaatgccaacaaaaaaaaatttggacagactctcggaattatttaatgaaatttttttttaacaataagtcccgcgggactatttatcgcttcatttttttcagttctgaggaacttaacacatcttaatttataaaatattctaattcaactctttaaattgatcacttataactcagtcttttgacagtccggataattatctttaagtcttaaagaagtgtatttttctcactaaccgttttgtttacatagcaaaatgtcatgcgccgcggcgttcgttaattataatctgggagagatgaggataatttcgcttcctgatggcctttccttaatggcttttcaggggatgcaagacccatttagcaacttctacttttcgccatttgtttatgagggagaaagttactgctgtgtggagcaggcatttgtaatgaagaaagttcgtacatacgaactcaatggagtggcggcggaagtgatgcgatttgtccacaaagacgactccacaccaaactccccgcggtggcccgatggtcacccacgtgaactaaaatggttcggacgcgaagccgaagagagagcctctcccgccactaaaagaaactggtcggagaacgcacaaagaagctccatcgctttctttgtggagctgaagtttcggcaaaatcagcacttggcagctcttctgctagcgacaaacgacatgtggattgcggaagcgtgtaaagatcgaaagtgggctgtcggatactacaaagacgatccattcttgcacaactacacaccagaaaatggggcatttgggcgaaattggatgggcaatatcctcatgagcttgaggatgcgaatgctaaatgagcagcaaagtgttgctggtccttctaggcaaattggtaaacgggaggactcaatagcttataattatgaaaactctgaggagttaatataa

SEQ ID NO: 81607 - DNA, 2777 bp, Heterodera glycines
  Genomic contig location: Contig_ID=SeqID_2790; Location=37..2813; Strand=-
  SCN-specific regions: Sequence locations=1-362,384-1705,1727 -1786,1808-2167,2189-2741,2763-2777
gagagcatgacatagtaaccacgtctgacactcctgtgtcgtcgaagccacaccgaacaccattcaagtatcgtgatgaactccaaaaacacattgatcaacttttggcatccggagtcatggttgagtcggacactccgtgggtctcaaatatcgtcctagtgcagaagaaggacggtgggttaagaccatgtatagacttccgtaaacttaacgaagtgactgttccggaccattatccacttcctagattggaaacaattatggaacgaataggtaattgccgttactattcaagtttggacctgtcaagtggatacctccaaataagactaacagaaagggcttccagaaaatgtggcttaattactgaaaacaaaattttccagatggttaatcttccttttggtctaagaaatgcaaccagtgcgtttgccagatgcatggcgcatgtcctcacaggtttggacgattgtgtaatcgcatatgtcgatgatattctggtatacaccagggatgataattttggcgagcatctcaatgctttgagaagtgtttttgaaagatttaggaggttcaacctaaaattaagccctaaaaaatgcacattcgctgcggcgaccatgaattttctcggatacttagtcaatgctgacggctacactcctagtctaagcaaagtggaaataattaaaaaccttccagaccctaaaacaactcgagatgtgaaacatgtagtaggaatggcttcattctttcgtaaacatgttcctaatttttctacaatcgtagaaccattgaccagactaaccaaaaaggagagcaatttcgagtggggtacagaacaggctgcggcattcaatgaagtaaaaagaattttgagtgagaaaccaatattggtgtttcccaattatgataaaccctttcacatattcacagatgcctctaatgttggccaaggtggggcactcatgcagtggaatgagttggcggaagcatatgaagttattgcttattgcagcagaacgctgtcagcatctgaacgcaaatggcctgctgtacaagcggaattgggagcaataatttttgctctgcgaaatttcaaaccctatatttttctgacagaaattgaattacattgtgatcataaacccctcgccttcctacttaaaaaggcagaagcgcatccacaccttgcgcgttggttaattgagttacagaattacaatattaaaataattcatgtagcggggaagcagaatcttttagctgacggtttatcacggtacccacatgaaagaacccaagagattgccattagagatttggctgaattggaagacatagcaaattttcccgtctgtcttgcactgaatatgaagccaagaatggttcatgagcattttcttttaaccatcactgctcgtgatatagaaggaaaaacattcgccattgatgttcggaaagaacaaaatgacgattctgaggttaggaaattaattgaatttgtaaattttggttcattccctgaggggaccacagaagttgaaaaggaagatattgcatcaagagcggaaaatttgagtctttcctcaggcatattatatcaacacttaccagatcaaaatgctcgaatgtacattccgctttctcttcgtccactaatttttgaagcttttcatacttcacaaataaatggtggtcatatgaacatcaaaaagacattagggaaatgtagaaaattttattggccaatgatgcaccgcgacatcacaaattggacaagacaatgcatcacatgtcaactaagacattcacccaatccttcatatcgtgcagaaatgcaaatgccaccaaaaaatactctcttcgctcaaattgcacttgatttggcaggtcctcttcccctcacgcagaaaggtaacaaacacatccttaacataatttgcacatttaccaaatatgtaatctctgtacctatccctgatgctaaatcccaaacaatagcactagcattctttaaacactgttatttaaagtttggaggctgtacgagtcttttaactgataatgccacggcattcacctctgatttttttaagtccttctgttcgcttctctatattaataaatgttatgctattccccattggagccaaggcaatgcagtagttgagcgatcttttaggacatttcacaatatacttgcgaaatatatttcaaatgaagaaccagattttgatgaatttcttgaatgtgccaacttctgctataacacatcaattcactcttccacaaaggagacacctttctttttggtctttgggcgagacccaatattttgcattgagcaaattctgaatcccaacaccgaacccgaaaacaccagtgaagttgacaatgtcaagcagaaattagttaagtctctcagaaaagcttgggaatccgctgcggcggtcattaaagaagctcagttacggtcaaaagtacaatatgacaaattagtacgcaatcaaaccgtccaaataggagatagggttcttttacgcaattacgcaggaaaagtcaaaacatccaagaaatttcaattaccttggaagggactttatcgagtcattgagattaatggtgtccttattacaattgtaagctgcacatctcctcaaacgaacccaagaattgtacacattaatcaagttaaaaagtattttgagtgctcaggacccccttggaccacgaaaaatcttcaaaaagatgaagaacaagcactaaaggag

SEQ ID NO: 81608 - DNA, 488 bp, Heterodera glycines
  Genomic contig location: Contig_ID=SeqID_2790; Location=309..796; Strand=+
  SCN-specific regions: Sequence locations=1-317,339-488
ctaatttgtcatattgtacttttgaccgtaactgagcttctttaatgaccgccgcagcggattcccaagcttttctgagagacttaactaatttctgcttgacattgtcaacttcactggtgttttcgggttcggtgttgggattcagaatttgctcaatgcaaaatattgggtctcgcccaaagaccaaaaagaaaggtgtctcctttgtggaagagtgaattgatgtgttatagcagaagttggcacattcaagaaattcatcaaaatctggttcttcatttgaaatatatttcgcaagtatattgtgaaatgtcctaaaagatcgctcaactactgcattgccttggctccaatggggaatagcataacatttattaatatagagaagcgaacagaaggacttaaaaaaatcagaggtgaatgccgtggcattatcagttaaaagactcgtacagcctccaaactttaaataacagtgtttaaag

SEQ ID NO: 81609 - DNA, 2087 bp, Heterodera glycines
  Genomic contig location: Contig_ID=SeqID_17165; Location=1..2087; Strand=+
  SCN-specific regions: Sequence locations=1-504,526-807,829-864,906 -917,1069-1121,1148-1408,1430-2087
  Gene Ontology: Mol. function=acyltransferase activity; Cellular component=peroxisome; Biological process=histogenesis and organogenesis
aagcatacatttatttaaaatttcgaagtattaaaagtttttattggaaaattacaatgggaaagcctgtaaaaatgattattgtttcagtgaattctctcgtccactcgtcgaatgatttctttttttgttgataatttctttgtacgtttatcgataagctccgaattacctccttccctctaattagtgtcctacaaaatcgattaactaattgctttttgttggtttgttgctataattcactaattattttcatcggcgtgtaaaaatggcacggagtgaagcgaacggtcaccggcaaaaaagggaaagtccgccgacttacgacgattggcttggcacaattcggcaggagggcggccaattggcatggctttggcggaagagttgcggcgaagtgcacaatttggggaggacgaagcagcaaatggacgaagccgttctgtcctcaaagagaattcgggtgaaatcggaaaaaagcgacttttttgaacgtttcgccaatgtttttcaaattttatttgttaggacgcaattcgaactttggccgcccggggggaaacggtcgacgccgccgtccgagccgaagcacagcaaattctgtcgacgatggcactcgactttcgctttcattccgccgcacaaccaattggctacagtttggccaccgtttttgaagtcatttcattcattgagtcgatgattgtgttctcactttttgactgttcagcgcattttctcccacatttgggtcaattcggcacggatgtgccaaatccgacaaatctcagctgaccgatcagtgcccatcgtttggttgcccacgcatcgaagtagcacaagaagcttttgtcaaactacctctctcccgctttctctttctctctctgctactctctccccacacacacacactctctctctctctctctctctctctctccactctttcttctacttcctttctctctctcctcttctctctcccccactctctctctctctctctcctactttctctctctaacccctttctatatctctccttctctctccccctttctccgcccccactttctccctcaacctcctctccctgttccattaggctatctcgactttttgcttctctctcttctctcctaccattaccgtatccaactcccggccatttgtgccgccgatgacttccgcgcctcgcgccttctcggcgaggctttgcgccgttgcggcgcctttttcatccgtcgctctttcagagaagtgtttacttacttccatggctttgttttgctctcaaatgctttctctcccttttatgatttgctctatcgctctgttttttctgaatatgtccaacaaattctctcccacggcgaccgacccatcgaattttttatcgaagtttcgaatttgtttttggtctcctctaagccaattcctttgtcagggccaacgcagtcggacggccaaaagtgttttcccgcgcgttggactgctccaacttgtcgtggaaccgttcatcagagcgcaagtgtacgacacggtagcgacgaggcaattaagctcattaaggtccacttaagattttggtgcccgttaccatcgattacgaccgaattttggaggaaaaactctttgcctgggaattggtgggcttctcaaagccccgggaaaccacaatgggtcagtgcaaacggagtgaacggctgctttattcctccgatttcctttaggccttttgcgtgcgcattcgattttaagtgacaattttggcgatattcgcgtcacagttggcgagccgatttcccttcgcaaatattttttcgataaatttggccatggcttcgacttccgattggaaatggtgggccaaatgattgcaattggagattaaatcactcactaatttttatgtgcagaacaaatcagattcggacgagagagttcgcgaaatggtgcacaatttggccttggaaattgtccatttgcaaaatgccaatggcactttgattctttggccttttgttgcattggcaattcttcaaactctcaacgaattccccttaaattctcagccaatt

SEQ ID NO: 81610 - DNA, 1959 bp, Heterodera glycines
  Genomic contig location: Contig_ID=SeqID_17167; Location=276..2234; Strand=+
  SCN-specific regions: Sequence locations=1-148,171-484,506-847,874 -1223,1267-1647,1669-1797,1822-1844,1867-1959
tccctgacaccaaatctctcactactgcaaaggctctccttcgacatgtttacttaaaattcggtggttgcactgaattaataagtgacaatgccaccacattcacctcagacttctttaaatctttttgttcccttctctatattaataaatcattctccaccccttactggtcccagggcaatggtgcaacagaaaggacatttagaacttttcataatattctgtctaaatatatcaatcccaaagagcccaatttcgatgaatttctagatgcagctaccttctgttacaatacttccattcatgaatcaactggcgaaagccccttctttctcgtgtttggcagagaccctatctttagtattgatcaaattcttgatccctccgtccatctaccactccctcacaatgacttagctgagttcaaaaccctccttgtcctttccctaagaaaagcctggaattctgcagctgactcaattaaagaggctcagaataaatcaaaagtgcaatatgataagaaatttaggaatcctaacatttccattggggaccgtgttctgttacggaattatactggaaaaccgggcacttcccaaaaatttcacaatccatggaagggcgttttcagagttattaacatagaagaactccatgtcaccatcgtcagttgttcctccccacaatccaacccatttaaagtccatattaatcaactgaagaaactttttgagatttccggtcctcccagcacctcccccgtcctctcttctgctgaaaaagctgctttagaagcagcagaagccaccgagataccaaacacgataggcttcaatcatacccctgatatttcaccaaaaaccctccctcctgatacccaaaaatccaatgtaccccaaattttacctacttctattgacaaagaacaagcggttttccctcagcgggatctcttgcataaaagtaaatacaatctccgctctcgcccaaggtctaacagttttaaacaataacaaatgcacttttctccttacccattttcatactcacaattaatttttaacttctcacaccacttttttacaacatttttccccttttttggtttcattccttcacaccgccttgcacccaaaatttttatgattaattcgcgtttccctcccttccccaacagaatgatccccttcctgtccaacatccccgaacacaaatacctctcccaacttctaccccgcccccttcttctaccctccctcctcctgtcacttcctttcgtcagagcaatgttaccaatccacaaaagcaacattcttccaaagatacgacatagacaccgaaatcctgaaaaccacctccccagtcgtagcaaaacgactcggggctcgtgcccaaaatgaagctgaccccgcagcagtaaaagtgtggcacagcacgaagcagtcaaagatggaagagattctcttccacaagttcgaccagaaccccgccctggcagagtgcctcatttcaactggggagaaatttttggttgaagcgagtcacgctgaccgattctggggcgctggtgccaccattgacgacattcgtcaatggaactttactgggcgaaacaccatgggccaactgctaatggaacttcgtgaaaaattaaaaggttttaggattcctcattccccagcgtcccttctcaaataaacatcataagtctcacacctttattccccccccccccatcttcctctttcccttccaaaagtatcgacccctcctttgcactccaagttctccttaaatgctttgttttgtttgtgttactaacaatgctttaccatacttccacattgctgtgttgttttctaatctcgttttgtcctctcctcgaatatctcttcactgccacattaagtatgccgaaacgacaatcgaaaccctggattccaaagacgaaatgcc

SEQ ID NO: 81611 - DNA, 545 bp, Heterodera glycines
  Genomic contig location: Contig_ID=SeqID_17169; Location=1828..2372; Strand=+
  SCN-specific regions: Sequence locations=1-365,389-545
ccccaattcgtcccttctctctgccgatgctttcgccttcgtttgcgctgtttctccgtacgctttttcttctccttgcgatgattttcctctccgtcgccttcgaattcgatctccgcgacgatggccaatccgtccgctttggtccttcctcttccggtggcaccagcggcgcatccgttgcctcccaactgttcgtgaactcggaggacaacgcgggtttcattggcggaattccgggcggatccgcgcggcgcagactcatccaaccgccgccgctgaaaagggatggaacggcgctgccgtggggggcggaagaggcgtgggcacggatcagcagaagcggggggagaaggttctgattgaagagcggagagagaaaggaagagtgatcggacgaaaagggactgatcagaagaggaaaagccaccaaagaaaggaatcatctgatcggtggcacccaatgatctttggtccaatgggcaattcgacgtgataattctcatttcggaaaatcaaatataaaattaaattgagtgaatttt

SEQ ID NO: 81612 - DNA, 919 bp, Heterodera glycines
  misc_feature (901)..(901): n is a, c, g, or t
  Genomic contig location: Contig_ID=SeqID_17170; Location=73..991; Strand=-
  SCN-specific regions: Sequence locations=1-91,126-429,477-519,541 -637,660-712,734-808,839-919
  Gene Ontology: Mol. function=death receptor interacting protein activity; Cellular component=synaptic vesicle; Biological process =synaptic vesicle fusion
atgcacgatgccaagtctcgtttattccagcccggtcgaatttcggcagaacaatcgctttgcccccgcttaattgattgtaaatccgtagaaaaaaatgaaattaaaaaaaattttttaattttcagacattgtaattgtcggccgtcgtcctaatgccaccgttcgacgacgacggcacccgccgtcagccggcggttatgtcaatgtgacagccggcgggggagcgggtccaatggcaatccccggtggcactgttagtcatcccgaattgctgagaaggtctgatggccacggaaaatgaatggacttggccaaaagagtgtgtcaacaatcattgagtgccccaggaagatattttttcggggtgcacgaaacaaagtttaacgaaattttgaatgatttccaactaagcgatgtcatagtatcaatattttgaaaaatttaattaaaaatatatgatttaattaatttttcttttcgaaaaagtttatcatttttgaacataattttttaatgcaaatatattttttcattcttaatttttttttttctttaacgaacacgaacaaaattttcctgggtttcacatgctagataccaataacttcattatctaataatctttgaacgaatgatattaattaattaattattttccaaggtatcccagcgaaaaccatcgtgatttcgagttgccccgtgatgtcacatatttttgccaacccgaagggtgcgtgtcatttaacggttccgcatttcggcagttgaaaaagcggtaagtaaaattatagcatttaatttgttgaaaatttttgatttaaaattattattttttcagcaatgccttccaagaggccacttttttcgtttttacactcactgacaaagattcggccanaagtcgatttggcgtcac

SEQ ID NO: 81613 - DNA, 487 bp, Heterodera glycines
  Genomic contig location: Contig_ID=SeqID_17172; Location=1182..1668; Strand=-
  SCN-specific regions: Sequence locations=1-154,189-413,468-487
atgttttgcgttcgccgcccacgtcgtcgtcctcaatgctcagagccgatcttgcgcagttatcgtcgtggaaaggtgaaaatgttttcaaaaaaacgtaatttaaacttaattgttttctttccaaattacatttttttttgttctatgagtcaaaatttttaaattatttgtttataaatatttttgtcctttacaggagcacgtggtgctcgaattggggagtccgatggcgatccgagataatgacgaggacggggcaaacaaagaaattatcgatcaggaattggagggtgagtgaaaatgccattataaatttatcgttttttacttactattatttcagtcactctcgaaggcaatgagaaagagtgttaggccaaggcgcacagagtgcaaattttgatatgatgaatttaaaatattaaatttaattatttttggttttaaattttcatttttaaaatcatttctaagctcaaataaa

SEQ ID NO: 81614 - DNA, 433 bp, Heterodera glycines
  Genomic contig location: Contig_ID=SeqID_17173; Location=3033..3465; Strand=+
  SCN-specific regions: Sequence locations=1-366,388-433
atgctgcaaattaacttgatgattgttttcttctcatttttattcgtactaattgatggaactgatgaagaattatttgatgatttgtgtgaaaaccttcagccatcgacctcagaaaacttcaaaaaaacaaaactcgaagaaatgaatgccataaagaaagaaattgttgataacaatgaaaataccgaaaaacaaaatgccaatcaaattgaaatggaagacataaagccaaaagaattgcaaaaaattaaaaaggaaaaaatattggaagaacaaaatataaaagtgacgaaaattgaattggacaaattgagcgaagaatcctttgaaaatgagtttgatgaacaagctgatcagaatgtttcgtctgctgatgctgaaggctacaatgatatggtaatataacagataaaataacatcattcctgga

SEQ ID NO: 81615 - DNA, 522 bp, Heterodera glycines
  Genomic contig location: Contig_ID=SeqID_17175; Location=107..628; Strand=-
  SCN-specific regions: Sequence locations=1-136,159-173,199-318,350 -483,506-522
atgaccaaaatatttcaaacgacaaaaattgagaagaaaacatttgacaaaagccaaatggacaaagccatagcaaaagatcaaatgctcaatgacaacaataagcggatgtttaaaaaactatttaacaattcaagcaaaattgttgaaatttatgaaactttattaaaaggtaaataattataattaattatttttgaaaatcccaattaatcaaaatgaacattttgcaacatttttcaaacttttgggaccaaaagatcaaaaaaaaatttgcgtcagactttaaaatttcttgataaaatagtgacattatgcaataaaattttaaaattataaatatatttaagaaatcagaacaattttagtcgctaccccaaaattagaaattcttataaataagaacaatgtataagccctggtttaaaggccagcttctaacgaaatcagattattaaactgacaaaaaggaagatttacgagaatttaaaaagaaaaattggttttttgggttaaaataaa

SEQ ID NO: 81616 - DNA, 473 bp, Heterodera glycines
  Genomic contig location: Contig_ID=SeqID_17176; Location=105..577; Strand=-
  SCN-specific regions: Sequence locations=1-133,155-164,193-230,275 -294,316-323,348-473
atggcggaagcagcaacaattattacaacaatttggggtaagccctggatcgaacggaaatataactagagctcggcattttgaaaaaaagccttgacctggattccatgttgaacatggatttccgggacaaaaacccaggcttgtcaagagatagtcctgggttttttgaaatttgttttaaaggcaaacaaatgttcgaaaaaatcaattaattgcttaagaacatctaaaaattttaatttataataataatgtgtttttaaatttattacctaattctttttgatattttaataaaacatagtaagtcacatgaaataacaaataataaaatattaaccaggcctagcctggacctggatttcttggaccaaaacccaaatccaggagaaatccattttgccgaaaaatgggctggacctggatccaagaaaaatccaagctggattcagatccaggtcaagctctaa

SEQ ID NO: 81617 - DNA, 443 bp, Heterodera glycines
  Genomic contig location: Contig_ID=SeqID_17176; Location=918..1360; Strand=-
  SCN-specific regions: Sequence locations=22-25,47-83,111-124,146-443
atggttaacttagtgagaaaagggtataataataataagctgatcaaagggggctaaattggtctgagtgagtggagtgattaattggtgaaaaaggggaacggaaacgatcaaaagtgatcagaccaaaggagataaaacaaacgatcaaatgacatataaaaggtgccgaattaaacttgacacgcctttttttctctacaacttatttcaagattaattatattaatttgctcattttgcagaccagcaatctgcaggcggcggtgcacaacgacgacttctcggacttccggcgcgcgtacgacgcaccgcctgggcccgccttttcggatgcaaatgccatcgatggacggacttacggggaaccgcgggtggcatacccggcggcgattaaaagtcggaaaaattaaaagaaaattaaaacatttttgaataataaa

SEQ ID NO: 81618 - DNA, 341 bp, Heterodera glycines
  Genomic contig location: Contig_ID=SeqID_17177; Location=98..438; Strand=-
  SCN-specific regions: Sequence locations=1-341
atggagggcgaacgccaattcgccttcgattacatcgcaaatgtgcagagacacgtggacgccaaagggtgaaaacgagaagcaaaatcgaaaaataataataaaaaaacaatttcagagttttctacgaagtctctgtcaggcgaatgccgtgcctaccgaggccaaaaagtggcggaaaatgtaagggaggggaggaaaaggaaaagccaactaatttaaaattgaaagtggaagccggagtggacaaagaaatgataaagcgactaatggggacagaagaaggaacggaggagaaaaattaccgaagccaaaccaaagcagggacaaatgtgatcaaa

SEQ ID NO: 81619 - DNA, 228 bp, Heterodera glycines
  Genomic contig location: Contig_ID=SeqID_17178; Location=285..512; Strand=-
  SCN-specific regions: Sequence locations=1-228
atgcaacgcgccccacatgttggagcagtaattgtggaacaaacggatgatttgtttctcacaaaaaatggccgtccacggcgtgtgatgtcatgtcagcagctcaggaaactgctgaacggcttggtggccagcgtgtgcaacaacagcgaccaccttgatgaggctgatgagcactacgattacgacgacattccgccaaaatcccaacaacatcagcagttgaag

SEQ ID NO: 81620 - DNA, 967 bp, Heterodera glycines
  Genomic contig location: Contig_ID=SeqID_17178; Location=1058..2024; Strand=-
  SCN-specific regions: Sequence locations=1-26,48-259,290-532,564 -638,662-884,925-939,961-967
atggtacactatgcgaaggatgtttctaaaaatgtgtcaaacacttgctcaaataacagaagtgaccgtgaagaagtgtacagtgtgttagaacattacatgggtcagtggggggtcaatggcgcgacatttggggatttataacattggataccagtaatttggggacccaacatttcggggtccggaaaatccgtcagtgaaggacaatccatcagtaatggacaatcttttcacttttcgtgctattttttgcggctttcttaaaaatttcaggggatgggaggggtccggcggtgcctataggcgccaccgggataaataaatacatacaaatcccttttctcttcaacagacattggcactattcggtcaataggcgtggcaaatttcgactcagaccatgtcgaatacttagtcaagaatggcatacattgtgtgccggccgttgtccaatgcgaaatgcacccattcttacagcgtgacgatctgcttgattactgtaaatccgcagggattttcctgcaggtggtcaaatttggaaaaaataaatttaaaaacccctaagcgttgtgatcggaaggttcagtggaaaatgcatcagagaatcagataattttctaacaaaatatcaaacaaatttttaaaattaaattgttaagccgatttaaaattttataatttactttgcggcacaaaatttgcaccaagggcacaaaagcaccttaaattttttctaagtataacctaaatacttaaaatatcgacaatttgcgtttagattgtgagtgtctgtttctcgggtttgtgatatggtgctagatggtcctagaaaagctctctaaaagcttaagaatgcttttctgtgtgcgataaaatcagacaaatttttttaagttaaatttttaattgatttaatattttctctatttcagaaaaagaaaatccattaattgttaacttttaa

SEQ ID NO: 81621 - DNA, 941 bp, Heterodera glycines
  misc_feature (535)..(535): n is a, c, g, or t
  Genomic contig location: Contig_ID=SeqID_2791; Location=371..1311; Strand=+
  SCN-specific regions: Sequence locations=1-391,415-426,448-458,484 -791,816-880,902-941
atggccttaaatgggacctatcttttcaacctgagcttgtactgctccaactccatgcatgaagttcgagctgtacaggtttgttgcgatcccagagactttgtgtaattaaatttagaatgttcacaggcagcaaaaaaggaacaaaacaaaagtaaaaaaagcacatgccaaatgcaataaatatactgtggaatagctatttataaaattgtaacgcattaatgaaagcgaaaacaattagtaaccgattagtaaaaaatggccaattatttgttaattactgaaattaaccaattaattaatcagaagggaaattaacgtaaattggaaccaaaatataaaataaaaaagcatttattcagatatatttcggaaagtaatttaatgatttattttaacaaatttttattggccatttaacttttgggttttggggagagaaaggactttcgtccaatttaaatatttaaatttttttttctttgaaatgccacaaattggccctttttgagttgaagtttaaagcgtgcgntctctttctcccccccccccttttgctcatattttatgtttctgtctccccccgcttttctccgcttttccttccccccattttctttcgccgcttttccccctaaatctccccggagatttacccattccgcccaaattctgtttgtattttggctttatgtagcggagtaacaacaaattcgtgatttatcccattttataattttgcccgactccaaaaatatttctcctgtttctgaattttcatcccatcgatttaaaatttatttttattttttgccgaattgacaacaaaatgccattaatcttttcgtttcaacgaagaaaggtgagcaaaaaatggcacccaaagtacccaattcagagctccattcattcatccatcacaaaaagaaaaagcgaaa

SEQ ID NO: 81622 - DNA, 2586 bp, Heterodera glycines
  Genomic contig location: Contig_ID=SeqID_2792; Location=847..3432; Strand=+
  SCN-specific regions: Sequence locations=1-421,465-943,965-1054,1077 -1115,1144-1457,1515-1585,1610-1774,1798-1896,2023-2044,2066 -2276,2302-2313,2336-2586
atgccatcccctgctcagatgtcttccccatccccgccgaccttcgcttcccatttcaaatactccgtcgccgtttgtcacggcattggcaccgccggtggacgacgctcgccgatgcgccgcgtttcgctgccctccgcgctgccgcacccgcgcacgccgaacacgctgagcccaaagctcggcttcctcaaggtacagcccaactgctgctgcttaattatgctcattagtgaattgattattttatttatttgattatttttgccatttcatttggcggcaaatgtcctttttaacacattttcaccgcataaaattacgtttttgcttaaaaggtaaaagtttaaaaagctgtccttttctggcactttttttacgttttttggccctaaaatattttcacaaaaaaaacaatttgtccatttcttatgtggccaaggaatttctacatatattccatgatttgattacgtaaattgggcccatccgtccacaaataaatccgcgcttttctcggatttgtgccaatgtttgatgacttgcaagtcgcttttctcgcattccaataagggtttttgcggtccttctcccatttttgccattttttgatctcacattttgccaatttcaggaaatctccgaatttgacattgacccgccgttcatttcgccggctgcttcttccagttcaaggtcagtcagcagagatcaatctaatgaccctttaattagtcttaattgctgcattaatcacccaattatctgtttaattgtttatctcattttggtttgttttgcttttttcccctccaccgattgttgtgtaatccaaccctaatcccatttttggcggtgtcacacatcgcttggcactcgccgtgggaaaatgagtgaaaaggcatttaattccgcccattttggcatcatcagacggcacagaatgatgatgacgatgatgcaattggcatgtgctctccccccccccccccgctgtttttgtttttcaaaataagcataagcttgcgcatcttttgcggcattgcctttcgtacaatgcaaaattattttgttgggaattggacaccaatcttccgcatgtcggcttttcctcaatgcttttcccccttcctcccactgtctcagcttttcctccctatttttcttcccccctaatggttccttaatggtcgcagctgagtttacgaaatgccgaggggtccttaaccggaggaggggggcagtgccggctaattggattttacaaaatgagtgtaatttgtgagagatcacctcggccgggacgggggggggcgagtgacgtcaaaaatgtgccattggttaatgcaatttggcaaagtgtgtgtggcaccaattttgggagcagctaaaaatatatacataatgatgatggctttgaaagtgacctaactaaaaatttgtcgataataatttgctaatttttatttttattaatttcatttttggatttaaataaaattttaatattttttcctcctttggcattttgataaaaaaagtgccaattatctgtcgacccaagaaacttttagcggcgttttgcttatatataaatttaattttttatcgggcatcagcatcatcattaattattcgcgcttgcctgatcgttttgagccccgcgggtttctttccatggacggaccctcggggcaaaaggaaaggcaaaatgccaaatttgaattgcaaaataatgaagagtacgaaacgaatgactcatttttacgtcatcaaaaaatacaaatgaaaaagaaatgatgatgtgcaaataaacatacataatagaagagggatggtgaagcgcagcagacggacggagcaatgagctcattttggcatggaaaatgccaaatttttcagttttttttacttccttattttttggttttattttttatttattttccttttccgaatttattttccattttgttttaactcttttaaattaaaataattcaatttaatttttttaattttgaatttttcagtgccgacacttcgccaatgcttttgtcgccctctttccaacggccggcttccgcgcgcctttaccgtcgtaatccgcagcatcggcacagtcagcccaactcgccgggctcgcgcaaatcgcgctttttgaaccgccaaccgccgccgatgggcgacggacgaacggcggcagtggcgaaagaggcggaggacgacggattccgctggacggatgtggacggattttatggtaggaatgaaaattgattattatttttaaaaatactaattgctactaatgccataggtaattagctaattagggtacgaatgacataaataaacgtaataaattttgtttaaggccgaaaaaattcgatacctctgcaacaattgttggccaacgatcttctgaacggcgccaatttgtttggcgatagacacgacgagttgaagccgaacagagggaggatgatgatcagcaacggaatggacaacaatgagaacaacgagacggactatgacaacacaatcgacggcagtctgctgaatgttgagcagcaacagaacgaa

SEQ ID NO: 81623 - DNA, 359 bp, Heterodera glycines
  Genomic contig location: Contig_ID=SeqID_2793; Location=349..707; Strand=-
  SCN-specific regions: Sequence locations=1-132,174-318,350-359
atgaagcagcagcagcagaagcagcaagaggacgagaatttccggaaaatgcttgaggtgttgaaaaacccgaggaaattcaatatttctttgacggaatcatcatcgtctgaatcgccgagaagggttcgcaattttaaaaataaataattaattaatttttgtttaattaaggaacaaaagcccgtgccctctcagcaaccgttgaccaccgtaacggctcctcccgcccttcctcctacaggccctactgtaccggcagttactgtgccacaaatgtacacggcaaacagagacagcagcgactcggactcggactttttcaaataataccaaaaaatttaatttcgaaaaataaa

SEQ ID NO: 81624 - DNA, 392 bp, Heterodera glycines
  Genomic contig location: Contig_ID=SeqID_2794; Location=3027..3418; Strand=-
  SCN-specific regions: Sequence locations=1-392
ggcgaacgcacttttgaaggcaaatcgctgcaccatttggacaccaacgaactgaacccataccaacaagtgggcataattagttaattaatgatcgattgcccattgctcaggtgatcgaaattgtcgggaaaacgttgtcctcctttgacgcggatgggatcatccccgtgtacggattcggcgacgaggaatgcactgatcagagctgcttcaacttggtggaccgggacgacgtggactcggcatgtgtcggatttgaaggtcttaatgggctcaatgggtgccgaaccgccaaaatattacaaattgtcaaacagaggtgctccgcgtgtacaacgagcgaatgccgaccattgccatgtcgggaccgacaaattttgtgccattga

SEQ ID NO: 81625 - DNA, 375 bp, Heterodera glycines
  Genomic contig location: Contig_ID=SeqID_17179; Location=2344..2718; Strand=+
  SCN-specific regions: Sequence locations=1-348,373-375
cgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttgcataaaaattatttaaatga

SEQ ID NO: 81626 - DNA, 1681 bp, Heterodera glycines
  Genomic contig location: Contig_ID=SeqID_17180; Location=340..2020; Strand=-
  SCN-specific regions: Sequence locations=1-142,191-645,674-799,821 -891,928-978,1000-1496,1518-1521,1543-1681
accattatcggcaacattgaaaaggaacggcaaaagtttatggaagagttgcgcaaggagggcaaatgtgttgacgaaattggacttgacggactgctggcggatgttgaggctcaacagcacatcatcgcaatttcttcggtaaattattattattattattttgcaaaaatttattttctaataaatactaacgcggttaaatgtttcccgggaaagggaaaacggaaaaaaattcgattattcatttttagaatcccagaaatttgacggacgagccaccgctcacattcgcactcgactcggacattgcgctggtcaaacagtacgcggatgccctcttccgactggaccctcggctggcagtgctcagatttgaacttgtgccaaaattgtgagtaaaaaacaaaaattccggcattttttttttttgggttatacatcttgaatttgttgttggctcttcctcatcctcttaacccataaccattccctgttttcatttcagagttccggaggacaaattttggcgcaactacgcctaccgaatttcgttggtccgcaaatttgtggccgaaaaaacgacgtctgaacaacgacagggttcagcgaaggaggaggataaaagcaaaaaatgtgtggaaacggagcacaagcagcagcagcagccacaaaaactacaacaaagtgcgtggcgttttgtttcgatttctaattttaaaactagggttgcaaccccgacttttttggccatttttcggggttaaacccgactccgacgcttccaaccccgacatcagggtcgtaaccctatttaaaactgctattgaaatcgagcccccccccccccgcaaaaagcttcagaatttttttaaaaacgaaaagatttagtcataatattttgttaaaatacctagaaaagtttgcaaaaaaattttttctaggtttgaaaattttttttttaattttcgctctgaaataaagtccactccctttttcgaggtgaaaaggttgaaaaacacacacaaagccaccaggggcctgtaattcaataaatatggtaaatttagcaactgctgatgcgacaccggaaaatgatgaggaggaaaagctggagaaggaactgttaaacgatttgcacgagtttgaaatggtggtggacgatggcaaggagtacggtactgacaatgcgaatgatgaggacggacagatgggagacgaattggacaaacatcttgacgaactgttggacaacaacagcaactgacggactgtgtcaaccaacaagaaattgtgtattataactaactaaattcatatagaaagcccaaattttgaaagatagagagccccctggacttggaaacagatcaaattttggaagaaaaaaatgcccttttttactggatttttggattcggattttcaaaatcccggtaaaaatcatggtcctgaatcttggctaaggctgccgttattatacaaaaccacagcgtttctttttgtttgagtgccaaaataacgaattttggaaatgaatttccgtagctacggactttccatggcactcagccaaccctattatgcccggattttcacttccgttcacttatttatctgtcccaatttctttccccacccaattaatgtaacatgtctctatctgtcctcatttaataaa

SEQ ID NO: 81627 - DNA, 877 bp, Heterodera glycines
  Genomic contig location: Contig_ID=SeqID_17181; Location=1147..2023; Strand=-
  SCN-specific regions: Sequence locations=1-57,81-150,186-405,428 -464,487-707,746-877
atgcttctcgagatcgagaaacgcctctatccagatggcctaccggagaatgcgccaaattttgtgcagaaacacttcaatcttgtgggcggaacaagcacaggagcggtgagaaaaaccaaatgttttatcatattcataagatttttcaaaaattcaagaaaagaaaattttgaatttttcttgggttttgatgaaaactgaaaaaattattcattcatcacaaatttccagaaaaaaaactttaaaatttttcaaatttcttttttgaaattttttctttcaaaaatatcgttttttattttatgacttaaaagcaaaagtgttgctgagagaaaattttaaatttggtacttcttaagccgctgccagggatattttttcgtgaaatactttttttcttcgcctttaacctcactccctccctttttcgtgtacaaaaaaattccactaattctttttaattgtttctttattttgctcattaaaattcatgttaattgtagattgtagccttagcacttgcggatggctcgtcattgctcaattgcctgcgactttactttcgtctgaaggacgccgttttttgcggtccaaaaatgcttcttggctgctacgcgcccgaaaatttggaagagttcctcaaagagcaatttgggtccaacaaaaggatgtccaatctgtggtgtggagaaaagatgaagttggttttgagaaataaattttttattatttcagttaaattatcgtcactatcatacattttagggggcggggttggccggggaggggttccccagcgaaggggaaagaggggaatttctgaaagatttcacaaatcttattttaatatggttcgttcagaattcttaataaa

SEQ ID NO: 81628 - DNA, 751 bp, Heterodera glycines
  Genomic contig location: Contig_ID=SeqID_17182; Location=24..774; Strand=+
  SCN-specific regions: Sequence locations=1-264,286-307,329-380,417-751
atggccataaaatatggaccaaaaatcgcaaaatatggacataaaatggcaaaaatcgcgaaatatggacataaatggcaaaaatgtcaaaatatggacataaatttttcaaaattgaatgtaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgcttttttgcttatttttgacataatttattaatttttaagaaaatttaaatttattcaatattctcgagaaattttggcgaaaaaatgattttttgaaaaatttttcgggttttgggctcaaaaaggctaatttagctgctgggggccattctaatagaggtttttttgaaaaatgccaaaatatggacataaaatatggacaaaatgccaaaatatggaaaaatatggaaatatggacataaatcgcgaaatatggaaaaatatggaaaatatggatatagaaatccttcctagaagcttcaaccaagctaaaaacatgttttccgtgcgtttcaggcctccaataatccaggaaaaaaatatggatttccatataattacacgccctaa

SEQ ID NO: 81629 - DNA, 155 bp, Heterodera glycines; identical to SEQ ID NO: 51421
  Genomic contig location: Contig_ID=SeqID_17182; Location=151..305; Strand=-
  SCN-specific regions: Sequence locations=1-155

SEQ ID NO: 81630 - DNA, 441 bp, Heterodera glycines
  Genomic contig location: Contig_ID=SeqID_17182; Location=808..1248; Strand=-
  SCN-specific regions: Sequence locations=1-179,201-441
atgctcgcaccgctgtgcatctacgacaatgtgggaggtgtgagtgtatgccgtgccgaggggttggaatagcaagcaatttttgttggaaattttgcgttttcatgttcatatttcatgcccttccccaataaaaattttagcgccatacattgccgaacccctctctctttttcaaaaatccacaaaattggtcaatttttacatgaaaatctgttacaaaatgataaattcagatttttaccgcgccaagatccccctccgcctaaaagttaaaaaaaagctctcagcaaaaatggcattaaaagaaaaaaaaatggttttcgccacggggcggtattatggagccccgacttttgcggccccgacatttacgcctatgtccaaaatcggactcaaagttgaattttttcaacccctgatagcctaataagcattaaa

SEQ ID NO: 81631 - DNA, 1205 bp, Heterodera glycines
  Genomic contig location: Contig_ID=SeqID_17182; Location=1501..2705; Strand=+
  SCN-specific regions: Sequence locations=1-92,114-216,238-537,566 -662,684-1012,1034-1149,1171-1171,1193-1205
atgcaaaatcgaaaaatgaatgggtttgtccttaaaaaacataaaaagtcgcccagaaaaaaacaaacatcataccattctgggaaaccttttttaaatttaagtacttggaattttaaaaaaaaaatctggatataaagcgcttttggtaaaggttaatttataaaaaatgcattaatcaggaagaaatcggaggcgggtcagtaaattgagaacaaaataaattaaattataattctcatttttgcttttagtcttatcgaggcacttccgacccaagtgatcagtgtgaatgtaactggccagatttcggtacttttcacaaaaatgtaaaatgaaaaaaatgtgattttgaaggcgagttcgcgggtgtcaatgtgcgactcgaacatgcttatggcctgcgcatcgaaggccgattcgcgcggatgaccagggtaaaagtatccgctcactttagcaatagatttttatgaaaaattcaagaagttcagcgattttttttcaatttttgaaaggactaccctgtcgcgtgtatgtacctcccccaccaaaaaacacccctaacccgccgatattttgagaggaaaaggatctttgtcagaaaaaatgtacaattaatcgtgcataacgaattcagagtatatttagaaaatttataaaaagcaaaatatttcaaatttctgtttttcatgaatttttcaagcaataattttcgatgaacaatcttattactctttaaaagtttagataattttttgacctgttatttaaaagtctgttgtctgaaagtttttcttctcagcggtcttcatgactgccttccatcttgtgtgcgattacgccgaagctgaacttggaccggcggaacaaaaattcatgcgaacttaccgctttcgcatttcgataccaccaaaagatgaaaagaagtggggtactagcctcgcttctgccgcctacatcggcatggttgtgttgttgacaggccgagcagtgcgcgccaattggtgtgtcaccggcgcactggatagcgatggagaagtaaatgaagtcgctgggatcccgcaaaaagtggcggcggcaaattttaaacttaagacatacataagaattgaacgggaaatccaagttggatatgttgtgcatgcgataatttaaaaacaaaaatagatgaaatcataaagctaatgtattgttattttaga

SEQ ID NO: 81632 - DNA, 616 bp, Heterodera glycines
  Genomic contig location: Contig_ID=SeqID_17183; Location=584..1199; Strand=+
  SCN-specific regions: Sequence locations=1-211,233-616
atgtctcttccgcatccggaactgagtcaattgttggagggattatttgctgcggtaattacagcaaatgagacgatgaaaaagggtaaaaaacaaaaattgaacaaatttataggctgaactttcaaaatttttcagtccaaattccattggaaagccctggaaagcccccgccgaggggagaaggaaaacgagccaaaagcaattttaattgaactaattgacatttataatgagctgaaattggatgattataaggcaatagaaagttgccgaaaatgtgacaaaaaaggaaaagaaaatgggaaaaatgaaagagaaaatcatgaccataaaaaacggcgctttctccgatttgtcgcgcgatcattggaaattgaatgggactcaaatgcattttgtgctgatggacaaaatgacaacgacgatgctggtaattaagtggatttttctgcacccgaaattttttacgatttttatgacccaaaattcaaaaaaacgaaatttaagtgctttatggtattcccacgtaacactaaaagtaagcaatccacatttgccacattatttatccacattttaaatagagaccggacaggagcgggatcccgcggga

SEQ ID NO: 81633 - DNA, 1743 bp, Heterodera glycines
  Genomic contig location: Contig_ID=SeqID_17184; Location=721..2463; Strand=-
  SCN-specific regions: Sequence locations=1-26,48-314,336-580,603 -1440,1462-1671
atgcgcgatacaaacaatggaagtctcaccccaacccgactggaacatccatgctcttgggaacagtgcactttgcgaggccaatttcagctacaacgtcgtgttgcacagctgcggcaacaattggctgagctgcagcgaacaccttcactagtccgtgaaccggagaaaaggcccaacgatgacgacgacaaggaaaataggacgcccagagggaggcccaaaaagcgattcgccgaaaagaaaggaagcgcgcaaagagctgacatatgccaactcacaagcgtactcagtaagagaaaataattttgctaatttcacttttatgcatgtttctgtagaccaacattcgccaaggtccaagcgtttacttgccggtgccattgtccgccgcttgagccgatcgatcagccttgcgtgttcttcctggcaatgcgctcaaattgtgtctcgctggtgattttggtggcaatttcatgaaactgggcttcctaattggaaatgtggcaacccctggggcagcttcaaattttactttgcttgggtgctacaggggtaatttctgagcaagccaattgttaacatttacatgtgcattttataggtgcagaaacaagtgcaggcattcgcgttgcctttgcggacgtggcaagacaattggccgacatatgtgaaattgatggcctttcgacccaatttttcctcaccggcgacctgatgttcatctcaaaaatctttgggcaccgtggagcagccagtgccaatccttgtttttgctgtgaagcaaaaaatttaccatccgagccaggccgtcaacgaacacttgagcgcatgaggcaacaggctgctcaatttcaagaaggcgttcaaaatggggtaaatgtgacacaaatgagcaaacaatgtgcaggaatgcaatttgagtttgtatttattttgaattttttcaaaattttgaatgttttacagcccatttttcaacattgagccttcaatgacaattccaccgtcgctgcacatcgtcgcttgtcaaggagtttttttcgggattttcaaagaattgagacacctttgcacacgccatggaactgagtacgaggaacagctggagatgcggttgcgggcattgggggcttacaaaaatgcgtggtaccaggaatacagcgggtaccatgtgcggtcagttcgaaaattgcttttttgttaaatatcgagaatttttaggaacattttacgcggtggcgggcctatgcatgttaccgagtttttgccacaatcaccacgccgcgacaatattttgatggctcttgaactcttggcaaaactccaatcatttgccgtcgccgatttgctttctgctgatcaaatcgctgatttccgcgccactgctgatcaattccgtgttcacatgttggagcactttcgtcggcactgttcgacttcaaaatttcatcatttggtccaccatgcccctgaatttgctgaaaaccatggattttggggccttctcagtgagcagcctgtggagaaatttcacgcgttgttcaatgacgatctcgcgcgcaaagcaaacaccaaagatctccacgatattttgatgttctgtgctagagaatctgccattcgaaacgccatttttgattcaaatgaactctgatcagtcttttgtagttttttttataagtttattatactttttgttgttatttttcatacatttttcaattttttatatttaataaa

SEQ ID NO: 81634 - DNA, 162 bp, Heterodera glycines
  Genomic contig location: Contig_ID=SeqID_17184; Location=253..414; Strand=+
  SCN-specific regions: Sequence locations=1-162
cagtacgctgtgaccgaccagcgcaaggaggaccagaaaactgttgactcgcaggttatggaagtgatccgcaaacatcccgagaagaaattcttgttcggctaccttggctcacgctttcatctcgccaagggaatgcatccccataaaatggtcttctga

SEQ ID NO: 81635 - DNA, 936 bp, Heterodera glycines
  Genomic contig location: Contig_ID=SeqID_17186; Location=598..1533; Strand=-
  SCN-specific regions: Sequence locations=1-48,70-96,118-249,364 -386,436-473,502-535,635-915
  Gene Ontology: Mol. function=protein binding; Cellular component =axoneme; Biological process=N-linked glycosylation
tcgcttctcagcgcagcgattgacgaaaaaatgactcaacatgaggtgagtgaataaaataatattttatgaaattggtagaatttcgattttcactccccaaatttttcaaatttcagtcacttctcatcgcaactgatcaaagaattgtccattttttgcttttggcattccttctgatcgccgccgtttgccttacgcttttgctgatcaaagcaattgtcgaccaatttttgaagcagaaatttggacaaaacaacaacaacaccatggataaggaagaggaaaagcggactgaagaagaggaaaagaaagaaaatggaaaaggaggaggaggagagaaaggagaacggaaggaggaggcaattttggggaaaaatgatagggaagaggaggagcaagaagaggaaaaggaggaagaagaagaggaaaaagtgggagatgaacgagaggaatttgttggtgtagggattgaggaagaagaaaaagagaaggatggaatggaagcatttttggaggaattggaaggggcaacggatgaagaggaggaagaagaagagggagaggaggaggagaagcggacgacggaagaggaggaggaggaatttgacagtgaggaggagaaggaagaggaatcagatggaggaaaagaaaggcgggagacggagaacaaattgggcggaaaaagggcattttggtaagtaaagataaaaaaacagtcgaaaaagctggacaatgaaaaatgccaatgcgctaattaatgtgccccattttttccagcatcattcgttggcacaacaaaaaacggtaaaggcaaaacgcttctcgtgcgcacattgtccaaaaagttatggccattcaacaaacacacttaaagagacacttgcgcaaacacacgggcgagaagctttttttggtaaaaataataataataaa

SEQ ID NO: 81636 - DNA, 2530 bp, Heterodera glycines
  Genomic contig location: Contig_ID=SeqID_17187; Location=708..3237; Strand=+
  SCN-specific regions: Sequence locations=1-86,108-1249,1289-2028,2050- 2282,2316-2530
atgagaacacgcattagtgccttcactgttctctcgcaccttgtcaggtatttactgattgatcaatgaactacatgataatgattgcttgtttcagaactttcccaggaattatgaacgattacttgggcaccattactataaacatcacaaaaactttgactgatagtgcggcggacggaactatgaaaattgaaattttgcgtttcatttcgctgttgttgaacacccacgaacctgaggtagaaagccattcggtggtttgcataaattgatagatgggtcttacaattagtttcgctaaataccctccccttctttttagtgtttcattttcttcaataatttctaggcaattacttaaggtcccaggactactctgctttcgtttattttggggttgtctcattcgcaatattttgtgcttagtattgcaaattttctttagcggctcgttccttttgtcgagacggtgcttcctcatttggctgctgcggtcggtgaccatttctacaaaattgctagcgaagcacttttgactactcaatcgcttttgcgagttttacgcgcccaaaagacggacttttcgaaggcattgcccgttatgtattcagctgttgtctcaaagctaaaaattgctgacattgaccaggtaattttgagttattaaatggaaaatttggatttacgttaaggaggttaaagagaaaaacattgctactgtcggactgctggttgctctgttttctgctgaacttggaaagaaaattgtactaattttggtgttttatgcctttttttctctcgttttcagaccgacgaatgtttgcctcttcttttggaaagactgcgcaacgaaatgactcgacaaggtgcgcatttttgggtgaccgttgtctaaatgtgcccaaattttagtggccctccgtgccatcaatcacattgtgcaaagtccaaccaaattggaccttcagccgatgctgcccgaacttttgtctctttgtgccgattttttgcgtaaaaaccagcgatctttgcgagttagcacattttcttgaaacttacattgatttctcattgtgtttagctgaacactttgactctgttggagtctttggtgtgccgtttttcccacaacggactgcagggaccgaatttgatcaaagtggtcaaggaggttcccgctctgatttgtgaacaggatttacaaattgcattaattgcggtcactttcattacaagtaaggcttttttggtgtgatctttttctctctctctgtttttaactcgtccgtactgattttcagatgtcgttaactcttaccctgaccaaattttggccgactcattgaacaacatgttccagtaataacccatgcttgtattacaatttcacttaatttcccttttcaggtcactaatcactttggttcacagttcactgctgcagggcacgacacttaacgtgagacatgccaaacaaagaacctttcccactttttaattttccgtttaggcgactcttttactgttgtcttctttgataaaatcacctctcccgaacaaaccatcgtttaaggtattctttgctttttggcatttaactatttttccattaaagcaaattttggagcggatctctgagccggtttacaacactggcacttctcaatttctccaccgtcaaacgtacagttccattgccaaggcggtacggagctaataattttctgttaaattttatttatttcctaagactgcgacagtggcacaatcgaatgccgaacaaactgattcgcgcactttggtcctttccttgcgcgacgcctttcggaatgctgggccagtaaatgactcgggtccttgcttttctttaaattagcaaatatgcacttaataaaatatcccaaaatttagttcgtctcttttctgttttggcacttggtgaattaggcagactttgtcgctccgtttttgagtcacttcaacgcgaaataaagtcgtaatttaattttgttattattcagaacttaatttagtattgaatcactgataatcgaagcatttgaatcgcaattggaagaaataaaatcggccgcaagttacgctttgggtcagtgttatggactttgtccttttgaataatcgtttttaagggagtctggccaccggaaatctgcaaaaatatttgccatttttattgaaagaaatttcaagagaggaggggaggcgacaatttttgttccttcatgcgttgaaagaggtcgttattcgaaaataacgctttgaattgcattttttaggtgattaacagcgaatgcggagaatgtggcactgtcggagacgctgacgaaatattcaaaaagggcgttgaacaaatttgggagcttttgatgaaatactgcgactcggctgaggagagcatcagaaatgtcgtcgccgagtgcatcggtcggcttatcatggtcaacccgcaaaattacgtcgaagaacctttttggtttagtcaattgtactgctcgatcgtagc

SEQ ID NO: 81637 - DNA, 386 bp, Heterodera glycines
  Genomic contig location: Contig_ID=SeqID_17188; Location=220..605; Strand=+
  SCN-specific regions: Sequence locations=149-207
atggaactgtccgagaagggaggagtcatagtgagtgtctaacatgcgggaaacttccgcatcaattattcattcgacattccttgaatttagtgttccatcggagcgaaggttgaaatggcgatgtcctaaacgcgaacctgcgacgtaagtcactcgtcacattaattgaatttaaacgtggacaaaatattcgatctatttcaggcctccgccacgtcgctaacagaacggaaggatatgaatgagggaagaaagattgtgtttctcaatttgacaacaactttgtttaccattttctaattaattttcgtaatacatccaccaatttacaattattttttcacatcttttgacttgtatttcaatttctcactttacattaa

SEQ ID NO: 81638 - DNA, 259 bp, Heterodera glycines
  Genomic contig location: Contig_ID=SeqID_17188; Location=562..820; Strand=-
  SCN-specific regions: Sequence locations=1-218
  Gene Ontology: Biological process=lipid metabolism
cagaatttcgattccgtggaggggacaccgcgatgatcaattggagaaagaatcgggcatcgaaggggccatttttgtacacgcaaacggattcattggagggacaaaatcactggaaggggcaatgcgaatggcagaggaaacgttgaaaatgaattaacaatcaaacgcgttaatttttttgttatttttactatttgttgtattcattttatttaatgtaaagtgagaaattgaaatacaagtcaaaagatgtgaa

SEQ ID NO: 81639 - DNA, 373 bp, Heterodera glycines
  Genomic contig location: Contig_ID=SeqID_17190; Location=583..955; Strand=+
  SCN-specific regions: Sequence locations=1-12,34-373
atgtcagacaatccaaaagaagcggaggaaaaaatggcaaaagcaatgtaaaattaatgccaatttcacaattttaaatttcatttttttcagcttcatctccgccgattgttggctttgtgtcttcgatttgctgcccccttctcaacttggcctcggaattgcactgatcagccaccggtttgacttttacgtcgatgaacacttcaagactcgcaaatggacgctgaaacctattcaaattcgacgcaaaaatggagaaaatggcaccaaggaaatgaaaattgtcaattctcgttggaaaccattgccaattccgcaaattcaattgccacgcaaagtcatcggattcaaacgcatcgatatctcgtaa

SEQ ID NO: 81640 - DNA, 154 bp, Heterodera glycines; identical to SEQ ID NO: 62241
  Genomic contig location: Contig_ID=SeqID_17191; Location=565..718; Strand=-
  SCN-specific regions: Sequence locations=1-154

SEQ ID NO: 81641 - DNA, 675 bp, Heterodera glycines
  Genomic contig location: Contig_ID=SeqID_304; Location=543..1217; Strand=+
  SCN-specific regions: Sequence locations=1-585,607-675
atgccgcccgtctcaattgatttcggagagggaaacggcgaaatttgcgccttccaacagcgatttgaggcattaattggacaacttccggcggaatgtgagccaatcgcagcagcacaaaaaatggaaaagcttcgatttgtgcacgcggttatggtaatggcaaattcggacggagaaaggggggagagaataaaggtgaaaaaccaaagaaaaaagaaagtaaaacactcccaacagaaaaggtacaaggcaccgctgctgaacgaatggacggaaaataatgaaagggcaaagggacagcgaaacgcagcacaaacggaggagccgagttggggggacccaattggggaggcggtgaaagtgctgagggagacgaccaaaatgttggagcaaatgctggacgattggaggggcgaggaacggcggggagggcacgcgactttgtggcacagaaaaaaggacggagcgatggcaccgccgtcgcctaacggaacagtcgaaggacgcacagaggcagcagaagcggtggacactgatcaaacagcatggaaaccaacgacagaaaacacgcgtcaccagcagccgcattcactgctgtcctccaaaatcagttttccaagcgaattgcgcaggtaccgaatgacggaggaacggcacgaggaacgaatctga

SEQ ID NO: 81642 - DNA, 967 bp, Heterodera glycines
  Genomic contig location: Contig_ID=SeqID_304; Location=1530..2496; Strand=-
  SCN-specific regions: Sequence locations=1-820,847-967
  Gene Ontology: Mol. function=protein binding
ttgttttgttttgattttccaattcgtttttcgttttcttcagtctcttcgttgggcatttgaaaagtgccgggcgaaggaattacagccgactcccgacaatttgcgcctcgtcctcggctccgccctctccaaaattcgttttccgctgatcagtccgtccgactttgccactttcgtcggttcgtccgtctgttttgcttttcatttggcgttgtgtctcattgtcagccccgaccaaattgctcaccgacgccgagatggtcagcgtgttcctctactaccatttgggccctaaacagcccatgcctttcccgtccacttatcgcgggttgtacactcccgagttggtggtgaaacgcttccaacgcattgaatcctcctggggatacaccggcacgcccgaccgagtgaagtgctttttttgtttgtatttgcagtttttgcatttcgattaacatttttcaggtttatggtcgacactccggtgtttatcctcggctttggtctctacggctccaacagggagtcgtgccaatacaccgtcctcattgaggtcgtcgcccctcctccccccattcgtctgtaattgaccatcctttgcctttgtcagattttgaatttcaattcgggcaaatccctagcctccaatgagtgttttttcctctccgatggttcgcccacaacttttcgcgttctctttgacgaacccgtcgaaatctcttcgaacaccacttacgtcgcctccgccaaactcactgtaacccttcgaccaaccattgctctcttaaaagtgtcatcctattttcaggggaatgagtcccactacggcaccaaagggctgcgaaagatcaaattggaacggaacggacggccggacataaattggcacttccaatacgcgcccgggaacaacaacggaacttctgtggaggacggacaaatcccggaaataatattctgcgca

SEQ ID NO: 81643 - DNA, 809 bp, Heterodera glycines
  Genomic contig location: Contig_ID=SeqID_305; Location=82..890; Strand=-
  SCN-specific regions: Sequence locations=1-279,301-432,471-574,596-809
atggcctctcaaaagcaattacgtgataaaaagtgttccgaagtcgaggacaaaacaaacgacggcacagaacgggaaatgacaaattccaccagcaatttttacaaattgaccaaaagtgagccgccgattgcctttgatgtttaaatccctctcattggcagccgattcgcaaagctctgtagaacagaatgttgctaatttggagcgtaatttgtcatcgaatttggtggtcccttcgacgagtggccgatgtgccaatcggagagacgaggaggaaacttccaaccctaaaaatgcccaacttttggagcaaacaaagtgtacaccggaacagcacgaggaaaagacggacgaatgcccgccgaaagagtccaacgttcgactgaccaataaaatctgcaaaaggcgcagtaagcgatgcctagattattttttaaactttttgtaatgtttcagtgaacaaagttgagaatgttgcccatttgaatggccgtgggggcattggggcgctcggttggcaggcgacgcttccgtcggcccgggaaaggctcactttcatgctgatgaacgacactttggccgacattttcttcattttccgtggttcggatgggtccgtccaggttttgttgtccctcccccactggcaatgattggctgtcccttctcagagaatccccgcccacaaatttgtgctttcggttggctcggcggtgttcgaggcgatgttccgtttcggcgactcttccgactgtgccaatggcattcgcgtgggactcctcaacctttgtcatgccattcgcaat

SEQ ID NO: 81644 - DNA, 303 bp, Heterodera glycines
  Genomic contig location: Contig_ID=SeqID_305; Location=964..1266; Strand=-
  SCN-specific regions: Sequence locations=1-47,69-94,138-195,224 -240,265-303
gcaaattgcgcttcattctttccttattttttgtggccttttaaatctcattgcccaattctttctctgaatgattttattggcttgtgaagacttatttttagtttttttaatttctattcattatttttatcttttaacattccttcccatttaaaagtgcaatattttttcattttcattaattgtactgtgattgttggaaaatgtgttaatttggagagataattttgttaaattcaattttgtccattcttttcctttaaattaaaataacagaatgccataaaatgcgtatttgtc

SEQ ID NO: 81645 - DNA, 2116 bp, Heterodera glycines
  Genomic contig location: Contig_ID=SeqID_294; Location=209..2324; Strand=-
  SCN-specific regions: Sequence locations=1-131,187-232,319-330,352 -419,461-527,583-668,737-783,805-1010,1032-1200,1227-1560,1582 -1753,1799-1988,2011-2038,2061-2116
gctgccatgaccatctcaattggcttcagtgtggacattccggcccacgtgtcctaccattattaccaggcggcagcgcatggcgttgatcagccacaggcgaaactggtcagtcagtgtagaaattttccaaaaaaaaaattgaaaattttttataagaaaatttcaataaaaaaaatatataaagcgatatttgaaaaacttatatattcgtcataaaattttgtaacgctaaaaaaaatttaaaaaaaaattctttccttgaaattttcttataaatatttttaaattagaaaaaaaatttttttttaaatttttgtacgaaatgaatgatctgttccaacaataatgattggagtataaaaaaaaattttttttgggaaaatgaaagtgctctggcgctgacctgacacggcatgaaaattttaaaaaattaatatacatttttaaaaatttattagtgaatttttagtgtaatttaaaaaatgcaaattgattggagattcgtccgtccacctatgccttggaaaattttttttcaacatattacaaaaatttatttttttaaaaaactaaaaattaccaaatttattccaggtgaattgtttgtcctcggtggcttttcctgccctccaggtaaatttttattgaaattgctccagccaaaataattaattaattgatggactaattacataattaattatttgaaactgtaattaattaattaattgatggactaatcgtgtaaattagttgtattgttttgcttataggctgctctttccacctcgctgtgtgtgtcctcacttctgcttgtccatctgcacatggctactgtatttgtgaggactatggtaggtttgattgacaggaccaaatattgaggggttagtacgggttagacttttacaaaattttgttgtcccgaatcacgagccaggaactagaacttaacacgagcacctagactggcgcccacccacccaccctaataaagccgagaaaattagtttaaaacatacattagtgctgtcagagagtctcggtctcgactcgagaaaagtctcgcgttccgctagattacgtgactcgagaattttgattttgaatgaactaaaaatataggccgagaatccaaaccacgagaaaattctcgactcggaaacgccaaactcttgcacagccctacggcgtgccaaaaaaaaaaaaaaatttttttttttgccctcaggttctgtgcgtggtgttgtgcaacctgcacggtctggtgttcctgcccgcctttctgatcctgttcgactccgttgtccaacacatgcgcaaacgcgccgcgcaacgacgcgccgccagcgcggcgaccgacgccaacggtggcggcggcgccgtaaacaagcgctggccgacgcccatcccggaggcgaacagcagccaggaaagctcgttgcgtgtcggcaccgcgccaatgtcgccgccggcgcagcaccgaaacggcgtcggtggccaataccgtaacggacggaccaaagcgccggcggaacagtcccgcgtcacagacaggtagataacaaatgatagttaatttcgtggcacgattaattaggccattatgtgatcgttggcatttccgctgggccaaattgatcactcactgatcagcaatttgggtctctttctgtcgccagtgtaatttttattgtaaaaattttcagcgccgggcaaaaaaatcaggaatttttatccgtttttttttcttccagaaatagttaattttttgtaactttctttaaaattttttgaaatttgctaacccaaattttcaaaatattaatttgcccgtctttcttgaaattttcaaaattttgcatttcgggagggggaggggggttaagctatcccttgaggcgattacaaccaagactgcagtgcccttttagtgtctcaggactcaaatggctgttgttgtttttttttttttggtaatttcgggcacctctgtttttccaggccaatgttggaccgtttcaactcggtggacgagacggacggcggcggcacggaaatggtggcatccaaaccgtcgatgaagtcaattgtgaaagtgccagcaacggag

SEQ ID NO: 81646 - DNA, 1321 bp, Heterodera glycines
  Genomic contig location: Contig_ID=SeqID_296; Location=292..1612; Strand=-
  SCN-specific regions: Sequence locations=1-976,1000-1321
atgcgcgaggtgaaaatgatcatgctccggttcgaggcggaacaccagcagaactggacggtggccatggtcaagcagtacgagttggccatgcgcaacacattccaacggtgggaagaaaaaaaattgggcagtgattgatcagaaaatgatcagaggacgaagaagccgatcaaaatttggcaccgattgatcagaaaagtgatcagacaaatacatgagcaaggggtacgccggcgcacgtcccccccccccccctcgttcgtcgtcgaagaggggcggctgtaaaagaggcgggagggggggggggggtgaggggggtcaaaattttataaattgtaaatccgcacggtgccgaacctaatcgaaccgtgccatgccattattgaccaatcaacaagcaattttttttgcatttccagggaatacaaatcggatcgtattgccatgtacgtgctgtccaagtcggtcattgaggatgaaatggtcagtgtttgtagtcaagttgatcaagctgtacttattcgtcagatccgcgccggcctctccatcatcccgtacatgtccattggctttgcggtgatggtgatctgctcggtgttctgtgtgtacatgcgtgccctgtacatgcaccagcacagtgcgccaaaggtgatggcgtaggttttgattgattattcatcgtctgatcagttgggctagcagacaatagccaaaattaagttcatttgagaattgatctgttgattagccgcagatttacagaaatgattcttagcgatacaacgaaatttgatcatgtttggacctacgtgttctagttgatcagagactgatcacttggcgctcgacaacatatttaagtggtcagagatatatggtcaaagattgatcagctggctagccaaaccgtagctcaattcagactgatcgctgtagctgatcagataatttggtaatttcaatttggctaaactaaatctgatctcacttgagaattgatcgctttagctgatcagatatttttcaattagtcagctaacataattgggctgatcaattgattagccacagttagaggttagcaaaagccacaaactgtaattgttcacttatataaacacactgtattctacagatctttctggcgattgccgcctgtgtgctgccgttcatgtccaggtgaaaatcaattgccttgggataacggcgctaaagtttttttgaggaattcaattttttatccacatctgatcagtgatcagtaaaaaaaaatttggaaagcctcaaaagcccataattctggaaaatttaaaataaa

SEQ ID NO: 81647 - DNA, 1614 bp, Heterodera glycines
  Genomic contig location: Contig_ID=SeqID_297; Location=703..2316; Strand=-
  SCN-specific regions: Sequence locations=1-452,484-881,928-1069,1099 -1526,1548-1614
atgtcgacaaccgatcgggttcgacccgcgtcaccctccgaaaacggcacagcagtgacaatgcgccaacgccggtcaacgcttgcccgacaaggctccatgctcggcggcggctttccggaacggcgacgctcatccattttagttggccaggtcagttggcggcacttaaaaaagtcgctttaaaaacgtacgtacgtacagcaccaaattagtataggggattagtcaccgagatcatcggctggtaatgagatggcaaagtcgagagtctcggcccaaagttaaaatcggggttgccttggtcatggatttggtccaattgtcggcttaattactcaatcaatcaaagcaatcaatcaattttgatctatgccaagattctcgggcctctaatggtttggtaaaaatcgaacatctttaatgatcagaaaaggccagagttctcgaatgtatttttaataataattgaatgattaattgtctgatcaacttattacaaactttttgttcaattgaatgatgaactgttcaaaagaaattacaaactctttagccaaaaaggctacaattaaacaaaactttgatcacttaattactgttagtttgtgtagcgcgacaatttttttttctttgtagttcgagattctcgactacagtgataattactttaaattgaagggtgattaagaattttgactaccattttcagcgttcaatggacttgcaaatggaacaaaccggcaatgtggggccacgctttgtgctgtttatcatccgaatgttccggcgatggggccgttttgtggccaaacacgactggaaggtaggggattgtggcattttgtcaaaatgtataaattgtaggccttggcatgggcaatttatattttaatgaaatttagaaatttttttttgaaaaatatacctttaaaaatcattttctttttattcaaaaaacagaaaccaaaaattatttttaagtatactaaaatgtgattctaagcctatcttagtcatttttatggcattttgtgtctatttcactttttatgaagaatttttttccaaaaaatcacaatttaaaaaattgtatttacatattttattacatatttggaggtttttgtacatatttcatcatattttccgcattttttatacatattttatttacatattttgcgatttttgttacataaaattcccagccctactgatcaataggccttggcacatcgcctaaacctgaaagtgttatgcgtttggtattatgcctattcatatgtttatttggcacaatgccaaaactgattaagaggccttggcattttgccaatttgcatatatatttttttttatcatttaggcaatgctgctgtgcttaatcaccagtctgatcggctttatcgttgtcatgctcactccgtatggcacatttaattaacagaaaactttttttgcgctgaaattttcggtttttcttattggtacctcttccaaaacgtttcaaaaatttggcgaaattttttcacggcaaaatgtctgggaaaaccggattcggggaaaacaaaaaaaaatctcgggtcgaaaaagaatggcaaatttattaaa

SEQ ID NO: 81648 - DNA, 54 bp, Heterodera glycines
  Genomic contig location: Contig_ID=SeqID_298; Location=2330..2383; Strand=+
  SCN-specific regions: Sequence locations=1-54
atgcacacccgtccgatctggcaagttaagcaacgattgctgactagccaaaag

SEQ ID NO: 81649 - DNA, 929 bp, Heterodera glycines
  Genomic contig location: Contig_ID=SeqID_2795; Location=750..1678; Strand=+
  SCN-specific regions: Sequence locations=1-202,224-602,624-929
  Gene Ontology: Mol. function=metabotropic glutamate, GABA-B-like receptor activity; Cellular component=integral to plasma membrane; Biological process=G-protein coupled receptor protein signaling pathway
ctccgcttctccttgccttttctaggctttgtgccgcttttccgctgttcccatcgacaagtgttcattcccggtgatatcattctcgggggccttttcccaatccatgccggcagtcgcaacacttcggacggaactctctgcggccgcataaaggctgaccaaggagtacagagaatggttggcactcgcagcgaaagggcaaatgaaatgaaaattgctttaaggtggcaatgctcttcgcattagaggcagtcaacagaagtccgcgtttgttgcccggactcaaattgggagcacaaatattggacacttggtaaggcacaagggcaatttgccaagcgaaaaaaacgacaaatttgaactgcaaattggcgcccatctcttaatttgaaaatcgaaaagccaaattcgaacagttccgtcgaaacacatgctctcgaacaaagtttggagttcataaagtccgttcggctcgggtgtgcggacgacgaattcgacggcacccaacgaatgtttcttccggtggaaatgcgcgccaacgggccgaaaaatgtgcaaattcaaaggaacggccgacggcaaaaaatcaccgccgtaattggttcagcatcttcacaagtgattaattcatttaaatgttcgatggaaaagtcgtttcaaccctcacatttttcccttaattgaaagtgcctttgtcaggtgtccgttatggtcgcttcgatgcttcagctgtttaaggcattgcttttgccgcttatttgtcttctcattgctttgtcctctttctagatcccgatgctcagttattcttccacgggagttgagctcagtgagaggccaaggtggattttggcatttgactttggtatttttccctcccctttcattccttcgtcagatttgcctatttctcgcgcgttgtccct

SEQ ID NO: 81650 - DNA, 1195 bp, Heterodera glycines
  Genomic contig location: Contig_ID=SeqID_2798; Location=168..1362; Strand=+
  SCN-specific regions: Sequence locations=1-47,85-476,499-555,593 -692,723-820,856-1101,1134-1195
atgacagaagcgaaacggacaaaaagaggagaaagagtttggcaaatggggaaggaagagaaagagagaaagggacagagagaacggcggagggtcagcggatgagtgccgacggaggaggaaaggccaacggaacggtgccgcacgcgcactccccccggaggacggacatggacagcccaatgcgactgattctccggaagatcagcggcgaattcgccactttcctttgatctcttctcaaagtccaacacaaacattcggattgtccctccttttgccttgaatttggccatttattttgatcattgagtcccatcggcccattgcgcccgcggattacgaaaatgttgccataatgaggcaatttcgcatattaattgggtgtgtgtcatcgtcatcagactttcccctcccctcaatgcgaccatttccaaaatcattcaaatccgtccccctgggcaaacaaaacaaagcctttcctttcccttttccgaatttattacgcaacattttcagcagtcatttcgtttctatcattttttgatttgtacctttaaatttaattttaataaataaaaaaataattatagagatttgtttggaaattcacttcaaaggaattgtcagtgaatttggagttgctaatgagcagaacataaagtaactttggatgaatttgaacgatggacaaagaaatgaaatgaaaagaaaagaaaagagggcgaaagtgtgggcttttgaaaaacattgggggaaacgaaacatttaagaaaaacgaaaaccaaaaaaaaaatagtattagcatgctgagaaaccatgaaaatataagttttaaaaaattccaaacaaaagagcaattttatgatcaaaggggggggggtcattttcaagagcccacactttcggccttaatagcagttttctaacttgtcgggtgcaaaaaatgagcattcattgaacgactgtcctcccctcgcccccgttgtccccccatttgccccccttgtggccaaattgtccttttcctaattgtccttttcctaattgtccttttccggtcggtaattcatccccagatcagttgcaacattcgcattctcatccattcattcattcattcaacattcattgagttgatttgtccttctcccatcgcctttcaattcaattggtcaatgaagcattacaacca

SEQ ID NO: 81651 - DNA, 2201 bp, Heterodera glycines; identical to SEQ ID NO: 17192
  Genomic contig location: Contig_ID=SeqID_17192; Location=1..2201; Strand=+
  SCN-specific regions: Sequence locations=1-410,432-899,928-1038,1061 -1073,1135-1147,1180-1362,1384-1740,1798-2201

SEQ ID NO: 81652 - DNA, 223 bp, Heterodera glycines
  Genomic contig location: Contig_ID=SeqID_17192; Location=1741..1963; Strand=-
  SCN-specific regions: Sequence locations=1-166
agaggtgggcaaaccatcgttctgaattcgttcaatggcgcaaatgggggcaatgggatgaggagaagcggaaacggagcgaacggaggggcggaaaggggggcgcaacggcaaacgattgcctcgagaagcattcccgtttagagacagcgcaacggcacaagccaattaaggaattaattaacgaattaattaattaattaatgaacaaattagctaatta

SEQ ID NO: 81653 - DNA, 879 bp, Heterodera glycines
  Genomic contig location: Contig_ID=SeqID_17193; Location=261..1139; Strand=+
  SCN-specific regions: Sequence locations=1-226,400-657,679-691,716 -716,738-754,783-879
atggtgattaaaagtgctacaacagtgatcagaagaggtacaacagagattagaagaggtacaacagtgattagaagaggtacaacagtgactaaaagaggtaaacagtgatcagaagaggtacaaccgtgattaaaataggtataacagtgatcagaagaggtacaacggtgattagaagaggtacaaagtcattagaagaggtacaactgtgattagtaaattcattaaattaaaatgaaaatattttttaacaaatttaattaaaaaatacatgaaattctatcaattaaaaaataattaatttaaacttataaaatgtattcatcaaaaaaaaaattaatttaaatataattttttatttattaactcaacaaaatattttaaattaattaaaaacagtcaaaataacccaaaaatgcacagaaaaataatgttacaccgtccggattcgaactttgcaccaccccccccccccaaaaaatgatgcctcagaatccccaatcacacagggattctgaggtcttgactatgtctaaagtaaaatctgatcacgtattcgtgatcagcggcccaaataacccctaaagacatgtttttggaagatttttgttgaaaaaaatttttcactcaaaaatcctggtcacccccctttggtcccgattcccaaaatcacttttatttctataacttttttcaaaaaagtgataaaaagctaaaataaaatttataaaatagagcaaaaaattgcggatttttgtattattttacttttccaaaataacttttcagaagcgagttatgaatttttttctgaaaaatcgaaaatttccagaaattctggaataactttttttcttttgaacattataaaaccaa

SEQ ID NO: 81654 - DNA, 65 bp, Heterodera glycines
  Genomic contig location: Contig_ID=SeqID_17194; Location=1..65; Strand=-
  SCN-specific regions: Sequence locations=1-65
cacaccgtttcaaaaaacgagacatgaaacaataaatagagagtgcagagaaaaaaacatctctc

SEQ ID NO: 81655 - DNA, 445 bp, Heterodera glycines
  Genomic contig location: Contig_ID=SeqID_17194; Location=1468..1912; Strand=-
  SCN-specific regions: Sequence locations=1-121,143-445
atggctggacaactcctcgaaggaagcgcggcaaaaaataatggctatgatagcaaggtttatttaaaggtcagcaatttttggcacccgatcaaagtgccgaacaaatttgtttagtttattagttttgttgttaattctaagtcaaattttattgtcgtctttttagttttcaaaagcatcagttgatagcatcgttggttcactcttaacgacaatggcgagttcggctgtgcctttgcccaagtgtgacaagctatttgttaatagttggtttacagtaacaagttcactttgttcgtttggatagttatatggattttcattcattcaaaccatttcgagcctacggcgaatttggtcatgttctgatatttcggacatttctagaaaattcaacaatttccttaacaaataatgagcttatacatcggtaaacaataaa

SEQ ID NO: 81656 - DNA, 510 bp, Heterodera glycines
  Genomic contig location: Contig_ID=SeqID_17195; Location=377..886; Strand=-
  SCN-specific regions: Sequence locations=1-158,191-359,382-408,455-510
atgaacctttttgagctcaaagtaagttaattttgagaaacccgagttctaaatgattgccaaaaagcgaaataaatgttcataaaaaaaaatggaaatccatacaaaatatggtctatcttttatatgaaacaaataactttttcggtgaaatactgaaataaaaaatatataaaaattattttatattgtagtgcgggctctcaaagtgcctggtaggcagagtatttctcattgctctgatgcaaaagggcaattgaaggttgtaaagggcgccttgtgtagcacagcacggaaagctgtggtcgttggttcaattcccaccacaggcttaccttttacacctccgccatcaaccaaattcctacaacatattttttaagcaaattaagatttaaaaatggacgcaaaaaaattaatttaaaattaaaaaattttttttttattaattaaacacaaaactttgcagtttataattttttagtaattgtttataaacttttgaataaa

SEQ ID NO: 81657 - DNA, 326 bp, Heterodera glycines
  Genomic contig location: Contig_ID=SeqID_17195; Location=1002..1327; Strand=-
  SCN-specific regions: Sequence locations=1-96,128-144,185-203,247 -256,278-326
atgaaaaagcggtgcaaacgtggggctttgcctatggtgaggttaatggataaatttcttattaagtgattttttttttaattttttctcttttttctgaatttattatttgaaaaacatttgcaaattgatttaaagggtaaatttaaaagtgtataatttattgtttacattaatttttaaatctattcttgattacaaggatttatataaagattaagttagaataataatttaaaaattttaggtcttcaaggcataacaatcaaaacaaatcggcatcagaaatgtatttcaagaacgatgatatagctaaatttccataa

SEQ ID NO: 81658 - DNA, 207 bp, Heterodera glycines
  Genomic contig location: Contig_ID=SeqID_17196; Location=1534..1740; Strand=+
  SCN-specific regions: Sequence locations=1-207
atgctgaagttgacccgtgcccagctgaacgacggggtgccggatcaagaacaacccccggttggggagcagcaatcgacacaaaattcggacatatcggtagacgaattgcctcagcgattgaaaatttggattgtgccatccggagcgggcgatgtcagtgccgttggatacttcctggtcaagcgcattgacgcacggatatgg

SEQ ID NO: 81659 - DNA, 407 bp, Heterodera glycines
  Genomic contig location: Contig_ID=SeqID_17197; Location=900..1306; Strand=-
  SCN-specific regions: Sequence locations=1-354,388-407
atgattttcttgaaattttcttctgagaaaatttcccaaggtttttccagcggaaaaatttctgtcagccaaatgattacatttttcatgaaatttttttacttcattggggagggaggtacgtaatccacttaccccttcccactgggccgtacttgcctcaaatttgatttataacagcctaatggcccaacagaccgatgcatcattaatcccgtagagtttggcccaacgtttgacagcaaatcccagcggtgacacgcggtcatcaaaacgggtgtacagtcggagcagctccgtgttgtgcaacgccagcccattctcaacacttatgcttgagaataaagggaatgcataaaataataataatcataaaattaataatttccagacccgtaaccattaaa

SEQ ID NO: 81660 - DNA, 1424 bp, Heterodera glycines
  Genomic contig location: Contig_ID=SeqID_17197; Location=126..1549; Strand=+
  SCN-specific regions: Sequence locations=1-493,515-794,828-1162,1184 -1210,1232-1247,1275-1280,1309-1424
atggtcaccgccttccacgaagccaatcgcctgtctgatgagcgacgaacatccatccagcaatttgttgacgaactgcaacagggctttcgcaccgagaccggcgttgactcgttgcaaattgaactgttcggctccgttctgtccggattcggctccaacgactgtgacattgacctttgcctgatcaacaccggcatcaccaagcaggaaaaagtgcagccgaacgggatcatctctcaagaggtttggattgaaaacaatgatatgagaggggcagaaacgggaagagctcgtttccccatcggctcattttcagtcccccccgttcttttgggaaattatttgaaaaatcttagtaattcgctataaaattttccaaaaaaaattttcttggaatttccaacgatgagggaaggggaacgtagtgcacccggtacaaacaatgaattgttgaaaattttgttgtaatattatgattaacgacagagacattttcataatattttaaaacaaaccatcatctaattttttattcagaagcgtcgagaatggttaaacaaacttgtacaatatttgcgtaaaagtgagctttacacggtgatctctgttgcggatgcgaggacgccaattgtgaagtttgaataccacggagaggaaggcttccatggagagtaagggaagacgtgggctttttttgtacatttacatacactggaaaaaaaaattttgccgaaaaccaaaaaaatttggattgctctttttagagatttttttaatggttacgggtctggaaattattaattttatgattattattattttatgcattccctttattctcaagcataagtgttgagaatgggctggcgttgcacaacacggagctgctccgactgtacacccgttttgatgaccgcgtgtcaccgctgggatttgctgtcaaacgttgggccaaactctacgggattaatgatgcatcggtctgttgggccattaggctgttataaatcaaatttgaggcaagtacggcccagtgggaaggggtaagtggattacgtacctccctccccaatgaagtaaaaaaatttcatgaaaaatgtaatcatttggctgacagaaatttttccgctggaaaaaccttgggaaattttctcagaagaaaatttcaagaaaatcatttctgaaaatttttttaatgaactactactaattgtaagtataagtttttccaaaaaaccactggatttttcttaaaatttcttattaaaataccgaagattttaaaaattattgttaattttttttcagggagcgtgaacgacctgctccgttagattatacccttggagcctcaaaaatccaaattccgggatcatccctaacaattgaaaaaaatgttatctgtgattatttacttgtcg

SEQ ID NO: 81661 - DNA, 1580 bp, Heterodera glycines
  Genomic contig location: Contig_ID=SeqID_17198; Location=668..2247; Strand=+
  SCN-specific regions: Sequence locations=1-49,71-172,194-216,255 -340,363-750,780-955,977-1353,1378-1580
atgtctgagaacacagcggaagcggagaggagacaaatgcaaaatgaaatgtgtgtgtcttttttagggttgcacgggtacgagaatttgtgcaaaaaccgggtccagatattgccagagggtccagaaaagccgagtttgggtccgagcccaagtttttcaaccgggtccgagtacttaatttaaaaactaaatattccacgaaatagtttgtacataattaacaattattaaaataaaattttattttttttggaattgatagcaaatcaaaatcagaataccaattttataattttatagaagataacgtggctatcattttttttttgcttttcatatcttttttcagtctttttaggaaacgggagtgatccggcggtgccgacaggcgccgctggcaagatttttttaaattttggaaagatttattaattgctttttatcaaaaaatgaccattgatggatatttggatcaaatttaagaaaataaggtagtttggttacagcagaaccataaaggcagctctttccatacttaagacaaagtggaagttttacaaaagtcgtaaaaaaaagtaaataaaatccaccggtataagagtgttttccctttccctcaaccttgatcatcaatttgacgctcacacccattcgtactaatatttttctgggcccggttagacccggacttaggcccgggttttcttgaaaaaaccggttatccggctctggaccgtgtaactctagttttttaaatgaaattttaaaattaatttgccatttttcagtttcatttgtgccgattgttggctttcagtcttccatttgctgccgccttctcaacttggccttggcattgcactgctcagccaccgatttgactgtttggtggacgagcacttcaaaacgcgcaaatggatgatgggaaatattgaaattctatataaaattggagaaaatggccaaaaggaaatgaaacttcatcaaagtgcaaatttttgggaatggagaaaagtgccaattccgcaaaatccgttgccgaacaaattcatcggatttcgacacattctgattacgtaaaattggccgattaaaatgatttatgataaattactaccattttcagatacattgattccaatgtgattgcttttcttcagcgttttcgttctttttttgcttctcatcagacaaatttgtcaattacaacaaaaagtggcgacagccattttttggaaattgttgtaaaaaacatttggccaatgatcaaagacaaaatttgtgccattggttttttgtctcccgacgaattttgccgttttcaacaattggtgccgtccattctcagcgacaattgttgttgttgttgtccatctcttcgagcaatgtttttttacactggcgttttgccaaatttacccgctaatgactgtgccaatatgtcggctgaccaatcggttgtcaaatggctgttctcgcctcgcgcagacggtgctccaaaggtgctacgatacagtctccaaatgaataataaatttccgagaaaaattgacgcatttaaaagggtgattatttaa

SEQ ID NO: 81662 - DNA, 1102 bp, Heterodera glycines
  Genomic contig location: Contig_ID=SeqID_17199; Location=259..1360; Strand=-
  SCN-specific regions: Sequence locations=1-321,348-1064,1086-1102
atgactgcgccgcaaaagttcattatgccaaagacaaaccgaattgtgtgctacaactgcaacaaaacgggacacatttctcgccattgtaggttgtcctttacgcggaagcaatctaactgtgcattaaaaccgccacaacatctaaattttatgaaaaaaggcgccgattttcgaaaaaattcagaaggtgagaagcactcgaaggaacaactagcggcaccacgaacgaagatggaaactgttattaaaccaaagggaaattcgtcgtcgtcatgcaatgtaaaaggaggaaagagcgaggaaaacccgaccgaaattccaaattgtttttaaattaaattgttgctgcgttggttttgttcaccggtgcagtgtcgaagcaaaagtcaaagtgcggacgagtttggaaaagtaaaggctcaatgagtagcaccgatgaagtgcaaggacgcaaaaccgatgtcaaattgagggcaattttttcgccgaaggccggggaggaattcgcggatgtcgcagcagacaatcttgaaaatttgttgaaaatcggcaaaaggaattttctaattgctgatcgcaaatgtgcgcaagaagctgccactgatggaattttaaggccagaaaaaagggcatatctccgttttgtccgttgtttttacaggtcagagcctgcaacgcgacttcaagctgaaccgatccgctgctgaattcacccttgccgcccctttcaacatcgaattagttgatgcagtcgtcatttttccctattgatttgtgttcgccttattttaattggaattaaacgaaaattgtcttcgacactgttttgtttttttgctgtatgctttgggctgttgtctttgccgtgtgctgtgcaacaacaatattaaagccctcgacaacatcccttatttcttttacgactcgtacgaaaacgaccccgaccgttcttttactacgggtcccggcagcacgctgtactgctttgctggtgtggtgactagagaccgacgaaaggcaccaaaaatcgcgaaaaacgcatttaataggcaccaaaaaagtttttggaaaaaggcagaaaatcccgaataagaataaa

SEQ ID NO: 81663 - DNA, 754 bp, Heterodera glycines
  Genomic contig location: Contig_ID=SeqID_17200; Location=424..1177; Strand=+
  SCN-specific regions: Sequence locations=1-471,493-654,676-754
atgaatcagacggattatggcccaatggttcttgctcataatggcacatctccgagtgatcaggataaaattcgagatgaagagactgatcactggctaacattaacgcaaactgatcaaacaacaactgatcagaattcaacattgagcatcgattggatgagcaacacaataatgaaagccgatcatgacgcaactttgagcttgggagaagaccatggacagactttggaagccaaaaacgatgatgaacccaatttggaaaatggtcattatggcacaactccgaccgattacgagccaaatgaggagaaaaatgcagtggataatgctgatcataatgatatggcagtggacggcgcgcatgatttatcctcagcagaagattatgacgggaatgattcaattagcgctaaaaatcagcaggagaatgtcgaggtattaaatggagcaaaagccaaattaaacgagaaattaatttaaattatatttgtcaaggaggcactcgatgacagcaaaaatgccgtcgatgaaaaacaacaaaaggtggaatcagacaagcatttggatgagtacacgtgggagcaaaccttgacaaaaaagtgcccgctgaattgcagtgaaaacaatttgcagtgttggcgcttatcagggtaaaaaaaaattattaaaaatctcgggtcagagactagcagtggttaattaggcgaaattttctcattatacaattaatcttggaaattcaaaaaagaaa

SEQ ID NO: 81664 - DNA, 1832 bp, Heterodera glycines
  Genomic contig location: Contig_ID=SeqID_17201; Location=451..2282; Strand=+
  SCN-specific regions: Sequence locations=1-97,119-354,378-578,629 -730,780-881,936-1170,1192-1370,1392-1415,1464-1569,1591-1598,1620 -1648,1672-1740,1762-1832
  Gene Ontology: Biological process=signal transduction
atgaattcatcttcatcaactgctagtttcgatgattttgatcgaaatgaaaacggtaatattttattcttgtaaattatttcgcaaaaattgataaattcattaaagaagaaaaagatgatgtgattattttgaatgacgatggacaaaatgagcaaaatgatcattccgtcgctgacaaacagttgaaaggtaagaaattaatggaaaagttgtaactcattaaactataacacaacttcttttttcaattaacatatgtttaagcttcgatcagtcaaagcaaaaaaatgcaaaatgatcagaaggagaagaagccaaatttggaaaaaggcggtgaattggagaaggagcagaaaaagcaggaagagaagaaaaacggtaagaaaggaatagcattacaactaattagcaatattaattaatcggtattgatgcgattaattcccacggcatcgaattaattaatcactttggtatagctgatgttttatagttagctacctaattggttttcttcattcagaactgtcaaatgccattccgcctggttttcagatgaattccgctgaggtgggaaaataatttaaaaaataaagaatatttaaaaatcaaattaagaaattttcaattccgcaacaaaattattggaattcttgtgcagatcgtcttgaaataacttgtggtggtttgactgtacatcattcaggaaatggaaattgtaaccttcattttaattaagaattaataatgtcttatttatatttttataatattttcataagggtggctttcggcgttcgcaaaatgtgccattccgagcaataatttcggcattgtttattttgagattaaatttgttcacttgaaaaagtaagtggatttttttattataattaaaattttactattttattaatttcaaatattaatttgctttacgtttttagaagtgccgcaattggatttgccaccaaagcgatgccatttgatggacgagtcggactttatggcaacagttacggatacgaaagcaatggcacactttgggttaacggtgcttaccaaactgggcatgcaaccttcaaattttttgatgtcgtcgggtgcggaattattttggaaaatcgacagttattttttaccaaaaatggacgttgtttgggttggtaaatttaaattttaatttatgaattttcattttcagatcacactgatttgttcgcttcttcttcggttgttccgttgtttccgtgcctttctttgcatgacaatggcgacaaaattttgacaaattttgggcctaatttcgagttcgatttgaacacacttttctgctgaaggaagcaacaatatcagaattgataaccaaattatttggtattttttaccacaaatatttctaaaattgtttattccatttttggaatattatttcaaattatttcattttgtatgatttctcttttgtgaggcagaagaaaatatgtcttggtccctttattcccataattttgtggatttttttgccaaaatattatgggacagacgaaatgattatgcgccgcaggtagaaatattaaaatttaaatcggttatccatttctgacaaatcttcatcagattttctcggctgctcctaatctagtatttttatatattttttaaaatgtgatgagtatttattcgagtttacgaaaaattattatagttcattttttacaaaaccgaggtctacaaacctagaaaaataatatgaattctacaaaaagctattgctagtatgtactttgtactttttgtttttctcgggtcctacccgggctttaata

SEQ ID NO: 81665 - DNA, 202 bp, Heterodera glycines
  Genomic contig location: Contig_ID=SeqID_17202; Location=710..911; Strand=+
  SCN-specific regions: Sequence locations=1-202
atggaaagcgatgacgctgaagctcacgctgtggacaatgatcagaatgaagttaatgatgtggttgatgccgatggcatgggcaataaaaatgggcaagatcgccaacaggaagatgaccatggcggtggtggaccaatagaagtgtcgatatcagggatggcattccgagccccaaaactttcggaatcggaattcgagg

SEQ ID NO: 81666 - DNA, 928 bp, Heterodera glycines
  Genomic contig location: Contig_ID=SeqID_17203; Location=371..1298; Strand=+
  SCN-specific regions: Sequence locations=1-173,201-207,274-280,302 -445,467-469,491-504,526-556,594-771,793-847,886-904,927-928
atgcattggatgaattttttggatcgaaaaatgatcagttttataaaaaggggattgaaatgttgcctgaacgatgggggaggatcattgatcaaaatggtgagtacatcattgattgaacatttgttttttgtgaaataaaaaattgtttaatgttgaagtgcttaaagggtcagaactttttcatcaacccaatattttgttttgataattttaattgaaatttaaaaaagaaaattttcttacattaatttttttcgttattttttaaaacaacattaaacccataaattaacaaatgattggacattttttggacaaaatctgctaacaaatcgaattaaaaatagaaaatttttcccgatggtgcctattggcaccacctgttctgccccctgtactcgaaaagtttttgaaaaacacgccgcaaaaaaaagcgttacctatatggttggtttggtttctttaaaatacttttgtttatttttccagcgattaaattccgttttttgttaaatttaaataaaaaatcggtaatagtttagatggtatgacaccttttttgaaaaatttttcaaaattttcaagtcttaaaaacatgtttctaggggtttataggtacgccacaccgtgaacacatccgacgcgtgtgcagaagccccaattgctcaagccaagcaaaaggcaatcgcttcaaaattggctacatgacatttcgccaactgacatttcgccaactcagccaaaaacattcatttcgccaactcagccaaaatcagacattttgccaactgacatctcaccaactttacatctcgccaacttttcgccaactagtcgaaaattgaattttaactatataatgatattaaatttattataaaagtgcttcaagcaaagaaatcttcataaaatatataaaatatca

SEQ ID NO: 81667 - DNA, 613 bp, Heterodera glycines
  Genomic contig location: Contig_ID=SeqID_2799; Location=2669..3281; Strand=+
  SCN-specific regions: Sequence locations=1-59,81-351,420-454
  Gene Ontology: Mol. function=structural constituent of cytoskeleton; Cellular component=insoluble fraction; Biological process=epidermal differentiation
ctataaaagggagggccaaacggagcaaagcacacatcgatcagtgaacattcactcatcaaaggaacagcagcaagagcgcaggtgacagactcagcggaagcaccgcttaaccatccgttcagccgcttcacctccccccccccccattcggttcagacttcaacaatgacgaggtgtagtgtgttcgtgcttacccttttgggcgtcggaatggcccactctctgctgatgagcggcggttcggagtgagttggcgcggcacgcgttgcgcaattgcaggcgtaaacttacgcgtttcgctttagccttgctcccagcgccaaccgcgtgagccgtcaatgcggatgtggaggaggatgtggtggaggcggcggcggatgcggaggcggtggatgcggaggaggaggaggcggaggcagtattacgcttggagtcagctgcggtgggccaagcggaggaggtggcggcggtggatgcggaggaggtggcggaggaggttgcggtggaggatgcgggggtggcggtggatgtggcggaggatgcggagggggttgcggcggtggtggaggatgtggaggcggctgcggaggaggatgcggaggcggttgcg

SEQ ID NO: 81668 - DNA, 1386 bp, Heterodera glycines
  Genomic contig location: Contig_ID=SeqID_2799; Location=838..2223; Strand=+
  SCN-specific regions: Sequence locations=1-311,333-370,414-613,635 -726,748-1386
actttcttcgaccgctggtcctcaaacggtgtcaagtcgggcgccccgaagaaccgtgccggaggcagtgtccatttcccggcaactttctgctataatcctcagtttgcgtttgaaatcagcgaagaagacggaccagcggaagtgatgttggcattgtgccaaagagaagagggatgtgcatttgatggcagaccaaaaaatgccaaaaaattaatgaaaaatggtgaaaaaatgggcaatcggagaagagaaccttttgtggttatcggactgcacgtgatgaaagtggagctaaacagaaagcatcgcattcaccaggtgaaaagaaatgccattttaaagggaaggcaatggaaaacactgaccacttttaattgcataaattgctttttaattactaattgcattaattcccccctcccgtaggccattgagcccgtgtcgaccagtgactatcagtccgtccgttccgttcatttgcatatcgacggactttcgcccggccgttacatcgttctgccgaccacttacgcaccgcgagaagaggccgactttatgctgcgcatttactccccgagtcagctgagtcctgtggaacttcgcgacgatttgcctaccctttcggcactttcccttttgcggtgccgtccccaatttgttatcgctcgagtgcgaattatcgaggttcatctgctgaaactgatcactttcggaggtgtgcctttcttccatttaaatccatttgagagtccatagctcattcggttgggttttcccaatttcatttacaaaaaaattatgagacaccgtatcactgatacttacttaatccaactttgataattaggtgtaaaatctattagcaaataatttaattttttttccggtggcaccgatggactcaaatgaatgccttttgaatatttaaaattagcagccaacaccgaaaatagaataattttcgccttattttttctccctctttcacaatgttcagaatgcgatgtgttctgcgtgttctcctcttcccaagggagtgatcggtgccgcacatttcccgcaaaatttgtgccgggccgacccgtgaagttcaacgcgctctttgttttccatgcttttgcctcgcagcaatggcttctcaattttgaattgattgaactgagaaagcctttccaacgacaaaatcgccttttgggcgttggaaggttggctctaattagcaacaacgaatcaattgagatggaaatggaactgatcagaccaattgaaaagcgaaaggcaccgatcggaggagagggaaaagggcgagggaaagtcggagaagaaacaatcggaaaagcacggattgagatcagtgcttatgatgatccattttatatctga

SEQ ID NO: 81669 - DNA, 652 bp, Heterodera glycines
  Genomic contig location: Contig_ID=SeqID_2799; Location=2648..3299; Strand=-
  SCN-specific regions: Sequence locations=178-212,281-551,573-652
  Gene Ontology: Mol. function=protein binding; Cellular component =actin cytoskeleton; Biological process=actin polymerization and/or depolymerization
cgcctccgccaccaccaccgcaaccgcctccgcatcctcctccgcagccgcctccacatcctccaccaccgccgcaaccccctccgcatcctccgccacatccaccgccacccccgcatcctccaccgcaacctcctccgccacctcctccgcatccaccgccgccacctcctccgcttggcccaccgcagctgactccaagcgtaatactgcctccgcctcctcctcctccgcatccaccgcctccgcatccgccgccgcctccaccacatcctcctccacatccgcattgacggctcacgcggttggcgctgggagcaaggctaaagcgaaacgcgtaagtttacgcctgcaattgcgcaacgcgtgccgcgccaactcactccgaaccgccgctcatcagcagagagtgggccattccgacgcccaaaagggtaagcacgaacacactacacctcgtcattgttgaagtctgaaccgaatggggggggggggaggtgaagcggctgaacggatggttaagcggtgcttccgctgagtctgtcacctgcgctcttgctgctgttcctttgatgagtgaatgttcactgatcgatgtgtgctttgctccgtttggccctcccttttatagtgcccccccccccccttggcc

SEQ ID NO: 81670 - DNA, 89 bp, Heterodera glycines
  Genomic contig location: Contig_ID=SeqID_2800; Location=903..991; Strand=-
  SCN-specific regions: Sequence locations=1-89
aaatgttatctcaatattttgcacaacaattttatttgtgtccgcataatcgacagcgttttgataagaaactcttatactgtgaaaaa

SEQ ID NO: 81671 - DNA, 1714 bp, Heterodera glycines
  Genomic contig location: Contig_ID=SeqID_2801; Location=176..1889; Strand=-
  SCN-specific regions: Sequence locations=1-2,36-499,523-536,558 -1216,1238-1564,1589-1637,1659-1714
atggaggaagaggaggaagatgaagaggaggaagacgaaggatgcgacggggacaatggcccagtgcatccgatgttggccatgatggacgccgcctccaaaggggcggacgaactcgcggaaatgacgcaccatcaaacgcagcaaagaattccagcagcggaacgaacggagacggcaaaaacgcacaaaaatttcggtgagaaaggtcaattactactcattgtgagtcgagagaccaatcccgactcaacaaaaagggggagacgattgctttcatttgcttgttttcctcgagttcagttccaagtcgcgcgggggacccgtcttcctcgtcccatcagcaccaatactcgggaagtgatgcgatggtgggccaaccgcgcacagtccgaccatcgaacggcggacaccaccaacagaaccaacaacagcgggtaaaccgaggatgaatcccgacaaaattacaatgtaatcgaaattcaagcacatcagctatgttggcacagatgagaaagtgccgtgcaaattgtgcggggaaatggtgtggaacaaaatcacgaacagactcaatcacatcaatgttcggtgggcacatcatttgttgttgcttaattacgtaattaccatgcttaattgtccccagtcatctccaactccctctccacgagtgcgccatctgtcacaaatctttcgcgtcgtacagccgttccgcctgttattcgcacgtccaattcgcacataaaacggagatcgaatcgggacagtgcagcagtgtgattgaggaacatatcatttacagaaaagtgatcattggacggacgagtaattaattgggcaattaatcaaagccgtttaggaccgctacaacactcagccgatggaagccgcgagggattatttctaagaattggctctccaccgatctttgattgtttaaacttcgacgctaaacttctaaaatgttatctcaatattttgcacaaaaactttatttgtgtccgcataatcgacagcgttttgataagaaactcttatactgtgaaaaattttgggcttgaactattttgtcttactgctttataagaagtttatttggaatatataataaaattaagtttatgtagaataaatagttggcgaaagagttgcggaaatgtcatttcgtctgttttcgtgtctcaacggacaaacgtcaactcgtttaattaagccattttttaaatggtcactttaatttttgtctgaccgtgacgacctcgaatatcaaatttacaagagagcaattgaatgatacaatggaatattaatttgattgaatttaagccaatttatatatgaatttatatttgttacatttttgttttcctatcccttggcggtttttaggaaaatcccagcatgtttttcatccataattagtagagaccgacttttgaggcaaatgcctttttttctgcattttcgtgcatttttatagtgcctttttcgcgatttttggtgccttttagtcggtctctaataattagtcaatctttgaagcacaatttgaaatattatattatgattttctgaaatttcatcaaaaattccggaattccgttcccatctctgatttacagtatatgccgttttattttattatgtcaaatgaaaatgagtatacatcaagttatagtacattaagaatatagcattcgattagataaataaa

SEQ ID NO: 81672 - DNA, 696 bp, Heterodera glycines
  Genomic contig location: Contig_ID=SeqID_17204; Location=273..968; Strand=-
  SCN-specific regions: Sequence locations=1-495,518-696
atggcattcgcaattccctacatcgagtcggtgcttaacccatgatcaagaaaaaaatgccgaatcccaaatagtttggatttggtgattatggcactgatcaggctacaaaaaaatgctccacgataaacaaagcgggcacggagtcgatcagatttgaaaattttgaatttcaatttttctcttttttaccattggattccagtgtaaaaacctttcgccgatgggtacagcagcgcgctgcgacggaacagcacgcaatgtagccgcacaaggacaaacagagcagcgcaaggacaccaattagtgctttaattatgtacatgcgtaattaattcatttaaaaatggaatttttaattgggttttaaacgccaattagcgctttaattatgttcatatggtaattaattcatttaaaaatggaatttttaatcctattttaattaggaggcaggccaattagcgctttattaattatgaagggaattgattcatttaaaaatggttatttttaattagaattgaattaactgatataaatcaattcacgatgctgcaatgcaatgttgttgagtctctcggaccacacaaatttgtcggcaaaagatgataatccaccagcacattctgtgtaatattgttacggatcaatttaaagcctattcaataatcagtactgatcatagataataaa

SEQ ID NO: 81673 - DNA, 1137 bp, Heterodera glycines
  misc_feature (1094)..(1094): n is a, c, g, or t
  Genomic contig location: Contig_ID=SeqID_17204; Location=1726..2862; Strand=+
  SCN-specific regions: Sequence locations=1-216,238-267,288-378,401 -512,549-864,937-1137
atgaaatgggcacatgttggtggcggtacagcatcaacaacaacaacaacattggtgacaacgacggacggcgacgaccaaccgttgtttcagttggaggaaatggggggcgacaccaatgaaatggtggtggtcaccagcagcagcagcagcaccaacgaaagtgatgatggtggtggtagggatgaagaagaagaagcagtatttgggaggcatggaggaagacgaagcggaagaaaaatgaggacaaatcaacaacaaaaattggatgatgatgatgatgatgacggattatgattgattgatttagtcatgtctaattcatccaaacccaactcatccacgggagagcattcgtttcaccctcccccgaaaaaattttaagaaaatttcaaaccttgaaatttttcaaaaaaaaaaaatcataaagaattatttcataagaaaatttcaagaaaaaatttttgaaaatttttcagcgattttttcaaaattttacgatgaactactagtttttttaaaaaaatttctagatttaaattttttttgggagaaaacgacgggggaaaataagtgcacccctcatccacacagctcgatgcggtgtcctggaatttcttgaattgcggaatccgtgccgcggcatttattgtggtgcatggatgagttgggtctaccccatatggtcggataatcattttcatttaagagccctaataatttctattatccagcaacaattacgaaaaattgtttttttttgaaatttgcaggataatagaaattgggttaatgaatgttggttgatatatgtagtaggtcagtgtgttcagtgttcaactcacccacttcctttcgaggaggaaaatttcataaaattcaaaaaatattaaaattaacaaattttctaaaaaaatctttaaattttcattttttctgttttgttgaagaaaagcatattatttgtcattcattaaatgtgatattaaaaatttttgctgttttattgaaacatttttattgttatttttgttgtatcaatttcattcatcaaattcacacattttgtaatgttttgctatccaattgtttanatctattcttatgttgaaaaaaaacagctgagaaccctgaaaa

SEQ ID NO: 81674 - DNA, 506 bp, Heterodera glycines
  Genomic contig location: Contig_ID=SeqID_17205; Location=659..1164; Strand=-
  SCN-specific regions: Sequence locations=1-119,145-363,385-506
atgcacaaaatctcgcatattttttgtttttcaaaaaattcgcttctgttgttaaatcagtggcaaaatcggttcagtgttggaaaatgtatagcgacaaacaaccacaatgaaataaatgtagaagacataaagcaaaaatgcttaaaaagattatccacatcaatgaagccgaagccgaagccaatgatgatgtgccatcgcttaattccatgggatttgcaaaaaagagccaaatcaaatagacaacaaacaccacacaataaatccgtatatccgaataggccattcgttcttgactaaacattttttcaattaaaatttctcaatgttcttccatttttactatgggattatatttcactaaaaatatgccttaatttatttttcagggttctcagctgttttttttcaacataagaatagatttaaacaattggatagcaaaacattataaaatgtgtgaatttgatgaatgaaattgatacaacaaaaataacaataaa

SEQ ID NO: 81675 - DNA, 1038 bp, Heterodera glycines
  Genomic contig location: Contig_ID=SeqID_17207; Location=1336..2373; Strand=+
  SCN-specific regions: Sequence locations=1-197,238-254,289-301,323 -420,448-497,532-667,690-848,870-1038
atgaaccagaaaatgatcaagccatacgtaataaactgctgtaatgagtgagtgctgtgcacccaacgacggcaaacatcgccaaattccgacctcattagctcattcatttcgacggtcccccgccgccccaattgccccgcaaattgcttcaaactgaaaaagtgggccatacatcgcactttattagccgccgtggcccggccggggggattttggattgtttgtttgtgtttgacgggagaattttgagtgggagggcgaaaaaaggggaagggcgaaggggagaacttcaaaagcaccgggggacaactgctggccaaattgtgggccaaattagccaaatcatcgcatcagtctcgtgacgccgtacggcgggggaggacggagttccgtccgccattcggcagaacttttggaggcggcgctggtgggggcgggaggaggacagatgagctggaatggaacacggagcggaattggaatttgattgggagtaattaactaattaattaattaactaactaattatgacaaaccgcgtggaattaattggggagaggagattaattgatgatacggtacaataattaccgaaactagacaaaggcttcgagaaattcgaatctctgaactggggattcttcgagaaaagcgacaaaaataacttttttaattggggaaatttgctaggggagatacctttcctgtcatttgttgatctcgattttcgagttttaattgttggtctcgggttttgcttctccgatgaaatcatttctcgcaaccaaacggaaaataaaatatacggagaacaaacaaaaaaagggaaatgccaatgggaacaaaaaataattaagaaacaaaaagaaagcgaataaaatgccatcccttggggggggggggaatgaatggcagtaaaaaaataaaaataattgccatttatttcgaataaattacatgtttttttgaattttaattgaaattttcagaatgaaaaaaatgtctccgtgggaattggacaaagaaacgaattga

SEQ ID NO: 81676 - DNA, 327 bp, Heterodera glycines
  Genomic contig location: Contig_ID=SeqID_17209; Location=1..327; Strand=-
  SCN-specific regions: Sequence locations=1-327
ttattcatctcccttttcgatagaaaaagcatcagagtgcctaaactaacatgtaaataaaatttggtgcgtttcagagcaatttctgaaaaaatatttatgaaataaaaaaatcgattttttcaagtgtccgtttggggtactcacacaattatggggagcaaaaatccaacgcagaattaaagtacagactatagggaagctattcccgaaggattcggtctccccataaatctgggcgcatcggttcggggggactgccccgaaaacaaaaaaatcgatttaatcaagtgtccgtttggggtactcaaaccagattatggggag

SEQ ID NO: 81677 - DNA, 1556 bp, Heterodera glycines
  misc_feature (1016)..(1016): n is a, c, g, or t
  Genomic contig location: Contig_ID=SeqID_17210; Location=1077..2632; Strand=-
  SCN-specific regions: Sequence locations=1-481,503-881,903-950,973 -1204,1252-1556
atgaggaaaagcattcaggagaacacggaagacaaagtgtcctccatttgtgtgatgggctatctgttgaacataatcgacgacctcaacgagtacatccgcgaaactgcagctgatttgagcagagaaagcccggaaaacggtcggtcttactcatcccaagttcctttttcttgcctaacaatcgaaaaattgcagcagagtctgcccggctcatttcgaattcctctctcttggaaacgctcaatttgcgggtcgtcggacgaaagattgagtcgatcgccaacacaatcactttgacaatggaagacgaaatacgcaaattggttggtggtgatgcactaatcattctcccctccgagtgaattggagtgaaacgcttcccaaattaaaaaaaaaatttggatttagattttcaaaaacacgaatctaaatcaaaagttcggttcggccgatttagttttcattgcttttcagaaacaatctgaaaatgagacggaaacgccggagggaatggccgcggacgaactcagccgttcccttcctagctttagcgttgcccctcacaattacgcgaccggcgttggccacggtcttttgtcccaaatgagcacaatcggcgcctacggaaacgaccgaaacttcgttcgatcgatcgcttccgctgcttctgaaataaattcatctttcaatggtaagtgtgaagcagtggtgggccaatatatttcattaataattccaattccaaccttgcgctttctccaataaacgaaatataaccaattttggaaattcatttctttaattaacctaaaataagaactgggtttttttgacgatttgttaacaaattcgtcaaattttaagaagttttcctattgaattttaaaattatttattttcttttgacctactcttatatagaaaacattacctaattgtaagtcaaattattacaaataattttatgcagatgatgaagcggatttgtggcttttgacggaagtgagtgccgngagtaaattggcatttgccgcttcaccatgtcttcttcattaaactctttttaaggtcgctaaactcgtccaaaatgtcttttgtactcaagtgggaaatgttgttaatttgtcgttgaaactgaggcgtcaattcaatgctgacatttgtttgtttttttattttatttgctagaatgcacaaaaacgaggaatttcaaaataatttttcagtgtttttgatggaggctttggcggaccttcgcctgcagcccaccaaacaaatgtcaaaattggcagagaaacttaaagagaattgttgaaatttgtgatttttcagtctaaaattacatgtgatttttgatccaatgtctttcatcttactaatcatttattggtacaatatagtaaaataatcaattagccttttaattctgaaaaaagattacattttagcttggggtgaaacaatcgttttgtatttgttctgtacgattcctttaatcaatatcattcaggattttcattaaactattaacattttgaatggattttaataaa

SEQ ID NO: 81678 - DNA, 54 bp, Heterodera glycines
  Genomic contig location: Contig_ID=SeqID_17210; Location=57..110; Strand=+
  SCN-specific regions: Sequence locations=1-54
aacaccttcctggactggctgaattcctttgaaaagacgccaattgtacgaatt

SEQ ID NO: 81679 - DNA, 1209 bp, Heterodera glycines; identical to SEQ ID NO: 17211
  Genomic contig location: Contig_ID=SeqID_17211; Location=1..1209; Strand=+
  SCN-specific regions: Sequence locations=1-182,205-838,860-974,996 -1127,1154-1209

SEQ ID NO: 81680 - DNA, 1523 bp, Heterodera glycines
  Genomic contig location: Contig_ID=SeqID_17214; Location=1800..3322; Strand=-
  SCN-specific regions: Sequence locations=1-120,147-1108,1136-1523
  Gene Ontology: Biological process=pronuclear envelope synthesis
atggtgctcttcgcattgctccccgtccagctgatgctcgtcgtcgccgccgtctgcctggtcatcatcactcaatgctgcggcggtggacagaaggtagcgatgcttctgtcgtgactgattttttaaaataatttccctttttcattttcagaacacggaagagccgcaaatgccggcgggaccggaaggggcggaggccagcgccaaaccgacaggacagagcgcagcacctggtggaacttcagcagctggtggaacttccgcggtgggacagcagccagccgaagcctccaagaaatcattggctccagcggggaccgcatcggccggtgagaggagagggacgggcgggcggggaagcgtttttggttcactctaatactttcattcccatttttagcagttccttcgacgtacgcggcgcccggcacggggacgactttgtgcaccgcatcgcagaagacggcaccggctggaggaacatcgacactgggcaccgcatcgcagaagacggcaccggctggaggaacatcgacactgggcaccgcatcgcagaagacggcaccggctggaggaacatcgacactgggcaccgcatcgcagaagacggcaccggctggaggaacatcggcactgggcaccgcatcgcagaagaccgcagcggcaccggctggaggaacatcggcactgggcaccgcatcgcagaagtcggcagcagcaccggctggaggaacatcggcactgggcaccgcatcgcagaagaccgcagcggcaccagctggaggaacatcggcactgggcaccgcatcgcagaagtcggccgccggaggaaccaccctgaagtcggcaccggttggaggagcgtcggcattgggcactgcatcgcagaagtcggcagctggaggagccgcgtcgcagaaggcctgaacaaccaccggacagcacaagaacaagatgctctacaacccgcttcaatgatgttcatcgacagtgatcagaaatgattttaaatgatcccatattgttcccccatatgtgcctaatgtgctctattgtctgtgatcaattgtcattgtaaaaccgttgtgtgatcattatttgggtatatgtatatatatatgtatgtatgtataatggctaatcaccggatatcgataaacgtgataattcaagtatacatttccaaaattcaaattttatgtccagttcaaaagcacgaaatggctatttttcttttggaaaaaacgtattttgctgtgttattttcaagccgtaattgatcgtttgtcttcaaaaatttgattatgagcctaggagtaaatgaattggagctgctacatttgcgcccctacatttgcgccccgcacatttgcgcccctacatttgcgcccctacatttgcgccccgcacatttgcgcccctacatttgcgcccctacatttgcgcccctacatttgcgcccctacatttgcgccccgcacatttgcgccccgcacatttgcgccccaattgtgaataaa

SEQ ID NO: 81681 - DNA, 210 bp, Heterodera glycines
  Genomic contig location: Contig_ID=SeqID_17214; Location=4043..4252; Strand=-
  SCN-specific regions: Sequence locations=1-210
aacccgcttcaatgatatttatcgacagtgatccgtcatgatgtttaaaagaccccgtattgttcccccacatacctatgcctaattgctctattgtctgtgatcacgtatatcatttgtaaaaccgttgtgtgatcattatttgtgtatatgtatgtatattgtatgtatgtgtttggctgatcagcggatgtcgataaaaggaactaa

SEQ ID NO: 81682 - DNA, 2658 bp, Heterodera glycines
  Genomic contig location: Contig_ID=SeqID_2802; Location=3389..6046; Strand=+
  SCN-specific regions: Sequence locations=1-216,238-262,284-479,502 -517,666-686,725-867,889-998,1043-1163,1186-1519,1543-1588,1622 -1680,1703-2045,2068-2105,2127-2137,2158-2622
  Gene Ontology: Mol. function=acetylglucosaminyltransferase activity; Biological process=gurken receptor signaling pathway
atgcaattttttggtgggctcgtttttttcttcgtgatttttcatgccaatgggaacccaattgtgcttaccacaaccttggccaaggccctaaaggccacgctcacggtgggagcggtcgcagcttataccggatggagggctttaacaaaaacgaacggaattttggacggatttggtgaacagatgaaggaaaaggtgagcagattttcaagccaaaaatgtttagcatttaaccaattcttcagcctcatctgtttgcgccattttttcccctaatttttgcgatcgccggaggggaagtcttagtggagcaagacaaattcgaaatggactacatttttgatttatttgaaaggatgacagaacgcgatcagctcgacaaaatctgctttgatggggccgagggagaaaaaaatgtgatcgaaaaagctgaagggaatctaccgcttttcattttctacgctgcgatgaatgacaaaaaattagatgtttatttatgtgattgaataagcagttttttattttgttcatttattaataaattgaataaaaaataatttaataaattttgaaaataaaattattattttttaaacccaacaaataaatttgaattgatttaaaataatttaaaaaattaatttaattagtaataaatttttgaatggatgaagcatattccgaaatttgaaaatttacttaaaattttgtagcttcattcattaaaatggcataatggtaagaaattcgtcttttctcatcaaaataaggttccgggaaaaatagttttattggcttaatttctcggtaaaaatcatttctcgcacaatccctaccatgggcaggggtctggcggggcgggggtttgtcattttaaataaatttctgctgaatgcaattgtcccacttctgctgttgaagttgcactcaatttgtaatttatgagaaaaacagaaattaaatccggaaatggcgagaaagctaatggcaaaatgtaaaatagaaaataaaacttatattaaactaaatttttataaaaggtgataagatttatgcatttttattgaattgatcagaccaaacatctgctgatcattatggtcatttatcattgtatgtgatcatcatcatcattaataagcgattagagcagcttcatttgttgcaataaaagcaaatacttgtgacaaatttcattattccatgaattgctttttttagcctattgtttttgtttgtttagcccacaatcggaggcgccgccagcagtgcccgctcctgcggttggcaccggcggtgacacttttttccgcttgcgtaccatttttgtgctcggccgtccggcggcggacgacgcagcgcaaatgaacgcgttggaaagcgaggcggccgcgcatggtgacttattggtcggcgactttatggacacctatttcaacaacacgttgaaggtggttttagactggcgcgaaagaccggcgaatgcgacgccaatttaggcgctaaattcaaattgtctctctttctcatcccacctctctattcggcccactatctctttttactaatccaatctcaaaagcacttttaaatattttttctaaatttataaaaaattcctccccaaaaagtttgtccattctgtgcgctttgctcgtcactattgtgcgctgcccaattcggtgccttttgtgcttttgttggacgacgactttctgttgttcccgtggaatttaatcaccgaattgcaaaagtgccacaaaaataaataaacaattattttggcatttttatttttttaaattgtttttggcatgtcccaaatgaacgcctttacatgggctggcgctttgacacttcgccattccgttcacgactgttcaaatggagggtcggagtcaataatcaactaacttattaaataaatttgaatacagtataccaaaaaattgaaccctaaaaaacgtttgaaatttcaatttaattacaaagataaaataaagcaggctcgtcaccagtagaagccggaatcttgaaaaatacagaaaaaggatttgaaaaagctggattgaaaagcagcggaaaaaagtcctaaatttctgagaaaaactgaaatttaaataaattcgggctctaattaattaattaattaatcttcaattaaggtgtcgctggacgagtttccattcgccgcctttcccccgtacatcgccgctggcgcagtgctcttaacgggccaaacaattgccgaattttacgcagccattccgcacgtgcgactgtttcgcctcgacgacatttttgcgggtgggaaatttttcgtcaatagtttttgaaaacaatttttttaaattttacccattttattccgtttttatttttttgatttattatttcgacatcccatacaattgttctattgctgatttccctttccttttaggcattctctcccatttgttggccattacgcctcaacacaatgccaattttgccttctatcgccaatcatttgccgacgattcattggcattggcatcttcagaaacactcaccacattgatcgctgtgcatgactatttgcccgaagaaatgcgcgagacgtacggaaaggcagtgaaacagcaaaatcagcagaaattgaagctgctctga

SEQ ID NO: 81683 - DNA, 1035 bp, Heterodera glycines
  Genomic contig location: Contig_ID=SeqID_17217; Location=539..1573; Strand=-
  SCN-specific regions: Sequence locations=1-155,178-186,208-332,354 -430,479-558,580-844,869-963,985-1035
atggtgggagagaaacagcgaagcgatcagcaaaggcaccacaacgaaaggcacctgaacgaggggagggaaaagcactcgaacggacggaagagcaaaacgaacggtagtgatcagaagagggaggagaagcaggggaagatgaaagcggacggagaaaagtgccaagagaagagaaaaagcgtaagcggcgaagaaaggcacgaattggtggaccaaaagggagaacggaccatgcaaagcgtaaaggacggagccgtacaccacgttggacaggagaagggccgaaccgatgtactgaaaaaggtggggaaaaggaagataaaaacgatcagagacggagaggaaatacaatttgatgtaaacttggcacaaaagcagatcccagtgaaatgtggaaaatgccatttaaaacgacactttcactacctttggttttctaaaaatattttcagttttttgaaaaataatttattgtttctctaaactcaaatacctccatgtgtttttcaattgataaatttttattgagcaaaatctttcattgcttttagcaaattcttaattttcattttctgtccttggattaaatgcttttctaaaaaccattgctgatatcattaagtgtttctctcttaacaaatgctttttagcatttccccgaatcaaatgccaaactttgcgggcagtgactgaatctgaggcaacagaaggagaaggcttttgaggggtcaaagaaacggcagagaaatgaccatcagaagaagaagcgggcacagaattgaggggaggggaaaaggcacttttaaccattttaagtaaaacagagacttatggggcaaatgaaagggaaaagggaggggaaaagaggggggggggggattaatgggatggaatattcattaagagaccatttaaagacataaaattaattcttcgaagggtgaaatttgagaaggggcggaggagaggaggagaacgaaacgaatgctaagggaagaaacggaaatattggcaattaattagtcaaataaa

SEQ ID NO: 81684 - DNA, 3403 bp, Heterodera glycines
  Genomic contig location: Contig_ID=SeqID_17218; Location=1..3403; Strand=-
  SCN-specific regions: Sequence locations=1-1083,1105-2144,2168 -2430,2461-3029,3051-3131,3156-3182,3204-3228,3250-3403
  Gene Ontology: Cellular component=cytoplasmic vesicle; Biological process=regulation of synaptic growth at neuromuscular junction
gtcagtgcgcagggcgaccgcacggtggtccaagtgcagcgtcagcttatttctcgcgcggaattggccgacgggcgaatcaccgcctcgggcgatcttttgatgcttttgccatccgctgggagggcacaacagcagcagaaaaacggcactcgaggctattttatggttcgtcgaagcaactgtggagaaatcgccacgggcatcggaaggacggaaatgggcagatttaggcaccgaaattggcaaacgcaacacagagaaagtgccgaattggagttggccatgtgcaggtgaagcaaaggcatccaactgaccgatccttcgaaatgcttcctcttttagtttttgtttcgatcctcgccatttgagccttctctgggcctatgaccccgtccaaatgcgtgtttttgccttatccgacgcttctgagaaaggcgtccattttgatcagaatcggcttttcctcgccaaacatcgtcaaatgattctcagaagtactgagctaatggtgccatcgttaatggaggacgaatgcgaatttgaccagcaaggatcgaccgaaattagccaaggcaaaccaatgaaaatttgatcagtttgacatgctaattcgtcttcgcttttagtccgtttttcggatgcccaaatggccctttttctcctttccatcgtttattccctttgccttgcaattcaccaaatgccgaatggaagtgaacaatgtgccgaagatgaagtgcaatttgatggattgggctcggaaaacgccgatgaaaattcggacggagtgacgcgaagtgcgaacaccgttcggaactgtcgcgtggtccgtcgcttccaaaacttcggcggcagttggggatattcggcccattgtgtggaggctatccaatttatgacaaagtgccaaccaaatccatgcattcagtttcttttgaaattcaaattcggctctttctcagttgcgaaatcactttttgcggcgtcggactgttcggcggacgcggcgaatacaccgcgcggctgaaactgtacagagccattgacaaagacgaagtcggcactgaggcacagcagcagtgcgtggaactgctggccgagacggacgaagtgctttacgaatgcggcacaagggaaacggcgacgctccaattggagcgaccaattgcgatcataaaggacgtgtggcacttgatatgggtgcaaatccagtgagaagggcgtccattttgggactgatcaccgatcagtccaccgttaattcccccaatttgtcaaggggtccgagttcggactgcgggacgggaggacgggagacggtgcgcgttgaaatatgcggcggtgcggaggactcttccgaggcatgctgcgcggaattccgtttccgcaccagcgaactgtctaacaacggaaccaacgtcgaggtgggacagattcccgagctgtacttccttcccattgcgacggacggcgacgaacgctgtcaaaaacaagtcgaaggcgacggaaatgtcgctgcccgagggcaccgtccaaaaaatatgggcgacgctcccttttacggagagagagttcacctcgcgaccgataacaatgaccatcggttggccgagtcgctttgtccgctcttccgtaaattctgtatgtccggcatccatcagctgttgctaatcgttgaatgggctttggacggcgctttccgcgcgggggccgaggaaacggacgaactgatcaattgcgacgccttgtggcgccaggagagggcggcattcgtcgcggtgctgtcaatccgattgatccgtcattttttgtgcattccatcggcgggaaaaaacgcggaggaaatggtcgaattccatcggttgctcaaaggcattttgtgccgaaaaagtcatggacaagtgcgactttctcaaaacattgtttaatccataaataatctcaaaggatcgcatttccgcttttgtaacggcggaggccgctttgacatgcacaattttggccagagaatttgcgccaaattcggcattggtccgaatgcgtctcgtcgaacagctcagacggaacaacgaaaacggagcaaaagccaaaggaaaagccaacgattggtggcttttcgctgttttgtgttcaatgagtcggctggataatgtgagaaaagaataattaaaggactaattggctaattactggtgaactgaccttttaattcctttaaggaccttttgtcaatcattcgaatttcgtccaatgaaaatgaaaatggcgacaaaagacggaaacgaatgaatgaagcggtggagagaatttggcgatttgaagaaaatgcgaattttgccgctgggcaatcggacgacgaaagttcgccgctgagcattttgaaatttatatgtgaaattgcatttggcgaaatgactaatgaaacggaaaatgaaaatgattcaaaaaatgaactgatggacagagacgacggaggatacgacgcgataagcgcagacgaaaatgagcggacgatgcgcgggccgatcacttcgtcggggggagcgcggcatccgacgccgcccctcttcgacggcatttcccttcggttgccttccgtggcacagcgactgattacttcactcgcccatcgtctgatcagccgagctctcccccagccaaaaacgattggcgaagctgcgccgctctttcaaagtccttcccgctttcggcacatttcggcccacgcacaatgggaagtgggcgggaaccggcacgcgtccgcttgggacgcagtcgctttccgcgtcgatgggcccggaatcgcattggcaggcgttggcattttctcgggaagtgcggcgacggggccggaacactttgagttggaggtcggtaaacttggctttgactaatttgtgccaatattttaagttagtaaaaacccaatccatcaacgacattccctcgggccaacaaaacgaatggcattcggtggaacgcgtcacaggacaaaccgacacttttcccactcaaattgtgcattttgcgcacgcgtttcctttgagaccgggcgcgtgttatgcggtcaaagttcgctttgaaggaccgggaaaaacacttttcggagaaggtaaagccggggaaaacgcggggcggggggggggggggggaattaacattgggctatttgatcagttaattaacattgggtcattttgataagtaatcatttgtgcccctctgctctctcaggcggcctcctctccatccaaatccgtgatcagatccgtctccactttttgccgtgcgatttgagtcgaaatggcactaccgtatcccgtggacaattccccttttttctgcttacggtcgccgacccaaaggaaaaatttggcggaacagcaaaagcagaaaagcc

SEQ ID NO: 81685 - DNA, 1815 bp, Heterodera glycines
  misc_feature (1795)..(1795): n is a, c, g, or t
  Genomic contig location: Contig_ID=SeqID_17220; Location=1..1815; Strand=-
  SCN-specific regions: Sequence locations=1-50,76-201,275-292,314 -565,601-1262,1284-1298,1348-1514,1536-1665,1702-1815
gcaactggcgattttgactacagtgcaccaccgaatgccatgcatcaaaatcaccaccaccaccacaaccatcattcggcaccctcatataatgttgaacatttggcatcatttgcggtgctttttatacaccaattaaatttaatttttttagtattacccatttttatcaattaaattcaagttttattattacccaactttttatcatttaaatttaatttttttttagtattacctaattttattaatcaaatttattttttattattatccaactttttctattagatttcatttttaattatccatttctatcgattaatttaattcataattaaccaattttttcaattacattttaattttttaatgttaaccaatttgttagcaattaaatttaatttttgatagccaaaatatgaatttgccattggatttcaaaaaatttattcgttattgttgtgaacatattgtcaggttggaagtcatttctcagtgctttcgcctgcggacggtgtgcgtaaacttaagcaaatggagcagaacagtgccatttggtgggttttttatttttaaattaatttatatataatttatgattttggttacggaggcattcaattgggaaggacagagctgggactaaaaatctcttttcaaggacaattggacttcacttgggaagggcaccgggattgtgcccttttcaaggataataaatgcaccgagactatgcccttttcaaggacattttagtcctcttttcaaaactgaatctttttcaaggatatataaatttttaactgatttttcttgagtacaatgctttcattttctactgatcagcgggatttgtatatctaatttcctaaaaccattcaatcgcacagtaattaattaacggcatcaacaaaaatcctaatttttcccgcatattaaaatttcaacaaaatttccagccccgtgccaatgattttctcgcttttccccaaccgaatttcggtgtccgagttgaacggaaatttggtggaggaattccccatggatttggtgtccgacccaaccgcgcacacatcgtccgacccgcgtgacacgttcaataacatgctttgtacacactatcaaattcaacaaattagacaatttgatcattaatcactgatcctgatttacagtatttattgtgctggaacatgttgtttccgatggtggcactgtgcccaccgaacttcacattttccaggtggcattttcggttattattttaattaatgaacattctatactggcacggcactctttgtatgtattaaatttaaatggaaaaattaaaaaccaaagaaaccgattgtctaaaattgacaaataaccaatctggcataaatttcccaattcgtaaaattaggtttagtgtgcatattaggaatttttttcaaaaaaagtcctttattagaacggctcactctaataaaaatttatatcggattttctacttgattttcttcaaaattcatatctatattttagatacattttttttcattttctaataaaatgtttttaatacatatttagccctttagaaaagtttagcttatattttgagaatttgaagaaatttgagaaatttatcaccaatttgattttgcttccctatatacgatttaaaattatttaaaaaaatgaaatttatttaatgatttcatttttgcttaattagtgtatcaatgtgcctgggaggcgaagttgccgaagatttgtataactgtgagtaaaataaccgacgctattngcaaattatataaatttaat

SEQ ID NO: 81686 - DNA, 258 bp, Heterodera glycines
  Genomic contig location: Contig_ID=SeqID_17221; Location=432..689; Strand=-
  SCN-specific regions: Sequence locations=1-4,26-41,162-199,221-258
atgaaaaagagaatggaagagaaaatgaatgaaaaacgacaaaaggaagggaagagacgaggggaagggaagagaaaatggaaaaaacgaagggaatggaagaaagacgaggggaagggaagagacgaaaggaagggaagagacgaggggaagggaagagacgaaaggaagcgaagagacgaggggaatggaagagacgaggggaaggaaacgacggaaggatgggacgctgtgttatattatctgttgatggcacag

SEQ ID NO: 81687 - DNA, 405 bp, Heterodera glycines
  Genomic contig location: Contig_ID=SeqID_17221; Location=2036..2440; Strand=+
  SCN-specific regions: Sequence locations=1-76,98-134,156-405
  Gene Ontology: Mol. function=transcriptional repressor activity; Cellular component=nucleus; Biological process=negative regulation of transcription
atgtcctcaaatgcgaacgaaccgattcatagtggtcattttatgacctcaaatccacactcggaaatcccaccagatgacgaggacgaagatgttgaggtttgaattcatcttcggattattcgagtaaacgccaaacccctaaaaaccaaaggaaataatattatttcaatcgtaaccaatttgaagtttcacttcacgattccacttgccattcattttaaggtcgatgttgtcgatgtggacgacgccaattcattgtcagccgcgcaaactgccgacaaaagcacggccaaaggttcgctactaaaagacgaggacagaccggtgaccttctacaaattcggctctcaaaaaacgcaatcgatcgtcatcgaccaatcactgaacaacctgcctcaataa

SEQ ID NO: 81688 - DNA, 572 bp, Heterodera glycines
  Genomic contig location: Contig_ID=SeqID_17222; Location=88..659; Strand=+
  SCN-specific regions: Sequence locations=1-377,414-526,550-572
ctcaaatttcgtctcaatgcgacattaactccgaatttaacgaattccttacttttgagagagcaccaatcaattctgacccgtttgaatggtggaagaagcatggaccaaaacttccaatgttatcaaaattggcgatgaagtatttgtcagcccctgcaacaagcgtgccgagcgaacagactttcaaagtggcgagggatgtttatgattatcgacgttcgagattaaagccgaaaaccgcagaaatgttgatatttttgaacaaggccatcccaatgttggactacaaatactgatttaattttgttggatgataaaaagttcataaaattttccataaaattttggtttagaacaaagaaaagaaattacgcaatttttttatatttataaatgcatttttaaaatttgaaaaaagcccggtcccgtacgggcgcccggtcaaaattttggaccgggcccgggacgcccggtaaaacgggctttttttgaacgggcggcccgccccggtcaattttcgaagcccggtcccgggcccggtcccggtaatttcaaaattccggtctcta

SEQ ID NO: 81689 - DNA, 273 bp, Heterodera glycines; identical to SEQ ID NO: 65910
  Genomic contig location: Contig_ID=SeqID_17222; Location=161..433; Strand=-
  SCN-specific regions: Sequence locations=1-273

SEQ ID NO: 81690 - DNA, 496 bp, Heterodera glycines
  Genomic contig location: Contig_ID=SeqID_17223; Location=346..841; Strand=-
  SCN-specific regions: Sequence locations=1-243,265-496
atgtttctcatttcgattgctttggcattttctattcaattccattcttctgttgccgaccccgaaaatcaacttggctttaaatgcacaaatgtttcaaattcgcaaaattatggctgttctgcggagggaaatgttttgcgcttttttgtcatcggtgacatcggtggggaggagtatacggtagagggcaaacagcagcagtgtacggtggaaggacacggtaagttgaagagggagaacaaaatgcatcaattgacttttgctcacatcgaattgtgttgatgaagtggaagacacttggatgggtacaatcaaatgcctgttgaagttttctatggaatgcttctgcgtaattgttggttctgtctcctccatccaacgtccgttgatgcacactccattcttccggtgcgaaccgtggcactgtcaaaccaccattgaaccacggccttccggtgtaattgtccatgaacttttgaggacattaccatga

SEQ ID NO: 81691 - DNA, 730 bp, Heterodera glycines
  Genomic contig location: Contig_ID=SeqID_17224; Location=191..920; Strand=-
  SCN-specific regions: Sequence locations=1-730
atgccacccgaatttccgactgtcccaaatggtaataaatccgtcgtaatattttttatttttccaattgattcaaaggatcggtgtggaggacagagtgcacgaattcacgtcggatttgagtgaaatggtcgcttggttggccccggaagtgctaatgcaggtgggcacagtgaaattgtggggaaacattggcgattctttctttcgttgattgcttactgtaaggacctcaacggatacggtgccgattccgacatttacagcgttgggatatgcctttgcggtaatccttcgcaaaatcattagaatgattgtgtgtcatgtttttgaatttgagaattggccaatggcgtcgtgcccttccaagaaatggaaccccttcgcattttgtacgaaaagctcagcggatcggcgcccgttttgttggactcgacacactgtgaggggacggagtgcttcgggcggcggacattttcaaaggaattgcacgaattattgggcgaagtgttggaacagaggcggtgagtgaagaaaacgcaaaacaaaataatacaaaagggaggggcaattagtttagttaattaggagtagttaataaatgaattccagcccttctgccaccgaacttcttcacaaatatgagaattctctgttcgcttttggccccgacttttcacttcgtaaggcattggccgattatttgccactggcaaaaccgatcgtctga

SEQ ID NO: 81692 - DNA, 1510 bp, Heterodera glycines
  Genomic contig location: Contig_ID=SeqID_17224; Location=1217..2726; Strand=+
  SCN-specific regions: Sequence locations=1-408,431-1434,1456-1510
atggccaagatcggcacggaaggagcagcggaggaaggtgcgttcggcatggacaaaggggtcgcagaaaaggagcagagactcgtgggacatggacaaatgggcgacgattttggcccgtttcttcaatttttcagttccgagcgttccatggaatttgcgtccacctttgctacgacggtggatgcgctggcggggcccaactcagccaaaagtacgcgacgccccgttgcagcggaaacgccccaaaggaaagtgccgagccgcgcttaaaacgacagagactccaagacggaatgaacaaatgccgcattagggcactttacccgggttcttcggaacagagacagtgccagacgctgaagagttgcccatcgttacggcatcagtgtatggcatttatggggccacagaaaaaagaggggaaaaatcgcaattggccaaatgtaacaaaggaagccttaacggttaattatcattttattttctcgaaaatcaattttataaaattaaatgatacacaaacaaaataaaaaaatctatgaaattcgtaagcaaaaaaattgaacgccaaatcagccataacaaatttacgaacaaaatcaaaatgtctctcagagacgagcattggaattgtaaaaatggcacccaaagaaagggcaacacacaattttattaactcattcagtgaaaatgttcataaatctctcaattcaaagaatctccatatttgaagaatttgtaatggtgcaaatttttggtttttctttgtgcgccgattctttggaaataacacaaaaaaggaaaatgaaagattagcttcgtaaaccggtagaaaggagcgcaattttggctgaatgggctacaaaataaaagtaaatgaaatcaaaattcatctagaaaatactataaaaatatgcaaaaatggaaattttgcagaaaaagagacagtgaagtcacaaggaggaaagaagacaatatgaaccagtggaagacaatgacagctaatttagccattcttttaatgagtaatcacttatcaatggattcattccccgccccccgcaatttgtcacgagacggggacgtccttcagcttggcatccgtcaccaattcctgcataaggggcaatgccgagactgtatgggcgaggagttgagccggagcattggcggcgttggacggtcgaatgattgtgcaaagattgggctttgccgagtcacacgcgacggtgtaagtgacattggaaggcgatctgagcaaagggaagtcaaaagcaaaaggaatttggaagggcacaaagggatcggaatgttcagttgtccgacgggcaacggcggcagctccaaattccatccgacggagccgaaactgtgctccgactcgtcatggccatgcagcacagaagtggccacggtgaaggagacatggctgaaaaaggagagaatttggaggaggtgagaagaaaagtggaagaaaagcaatgggaccaaagggggggggaaggaa

SEQ ID NO: 81693 - DNA, 1324 bp, Heterodera glycines
  Genomic contig location: Contig_ID=SeqID_17224; Location=2324..3647; Strand=-
  SCN-specific regions: Sequence locations=1-37,61-634,708-775,797 -976,998-1324
tccgaccaacactcgtttggtggccacctccgcagcctttccaatcccagtccaacctcagccggtctttctttacggctcgacaccgccgtttggttctccaccgcttctgatctcccaatttacaaattggttactgtttatcttgggtgtgacttatttgcacaattcccttttaggacttctccaatggaatccggtggctttatgagtggggccggcttctacaatatcaacgcctttaacaccgccaacgccacggcttcatctgaaggcaaatctccccaaaaacagtccgaaacgtcctttgaatcagaggaggagcacagcaaaaggtgtgtccggtggtagcctttggttggtcacaaatttacgtttcattcgaatgatggttcaattgtcagtgacaaaaagtgtcgtcactcttccagaacgaccgctgaagaggacgattcggaatggtaagccttcgttcgtaagggttctcagtctcacaatcgtttgttcatattgtatttgttgttcatggtctttacttgaacaattttagaaaaccgtgagaatgttattcaatgaagtcaaagcctcgagcagaaatgtctttcccactgactttttcatctccacaattgcttttctctatttattcatttttgcttttctctatttattcatcttttcatttttatcaaattattcatttattttcgcttttctcaaattatccattcttttcattttcctccatttgtatcaaattgtcccccccccaatttttccattattattttctttttactctattaacttttctgttatgctttgtattatccgtttatttttggactcccatctgcgttattcgtatcgaataaactcagtttggatggacttctttagagtgtgtgttctttcctttatttccttccccccccctttggtcccattgcttttcttccacttttcttctcacctcctccaaattctctcctttttcagccatgtctccttcaccgtggccacttctgtgctgcatggccatgacgagtcggagcacagtttcggctccgtcggatggaatttggagctgccgccgttgcccgtcggacaactgaacattccgatccctttgtgcccttccaaattccttttgcttttgacttccctttgctcagatcgccttccaatgtcacttacaccgtcgcgtgtgactcggcaaagcccaatctttgcacaatcattcgaccgtccaacgccgccaatgctccggctcaactcctcgcccatacagtctcggcattgccccttatgcaggaattggtga

SEQ ID NO: 81694 - DNA, 1072 bp, Heterodera glycines
  Genomic contig location: Contig_ID=SeqID_17228; Location=216..1287; Strand=-
  SCN-specific regions: Sequence locations=1-275,384-480,593-840,863 -864,926-1072
atgagaagaggtacaagagcgattagaagaggtacaacagcgtttagaagagtgattagaagaggttcaacagtgattagaagtggtacaacagcgattagaagaggtacaacaggaaatagaagaggtacaacagcgtttagaagagtgattagaagaggttcaacagtgattagaagtggtacaacagcgattagaagaggtacaacaggaaatagaagaggtacaacagtgattaaaagaggtacaaaagtctaactttttatgagatgtacaaaaataatttcataattttaaatataattttatagaattaggtttatttaaaaatttaaaaaaaactaaataataaaaaatgtaaaagtttatttttaattaataaacggaataatttattttactttgttttgaaatgaattattatgcaaccaaatttttaaatctaattttgcttaaaaataaatctattcatcaaaagaaaaattaaatttaattaaaattattttgttattaataaaaacaaaaaataatttttttaatttaaaaaaaaataaatttaaataaattaaaacgaatcttcaaattaattaaaaaatgtaaaagtaagcaaaaaatgcatagtaaattaatgtacaccgtccggatccgaacctgcccccccccccctcaaaatgatgcctcagaatccccaatcacacagggattctgaggtcttgactatgtcaaaagtaaaatctgatcacgtattcgtgatcagcggcccaaataacccctaaagacatatttttggaagaattttgtgaaaaaaaaattttccactcaaaaatcctgtcacccccctttggtcccgaatcccaaaatcacttttatttttgtatctttttttaaaaatgtgataaaaatgtaaaataaaatttatattatagagaaaaaaattgcggatttttgtagtattttacttttcccgaatagcttttcagaaggcagctacaaatttttttctgaaaaatcgaaaatttccagaaattctggaataacttttttcttttttgtgataaaaaactcaaataaa

SEQ ID NO: 81695 - DNA, 476 bp, Heterodera glycines
  Genomic contig location: Contig_ID=SeqID_17229; Location=1520..1995; Strand=+
  SCN-specific regions: Sequence locations=1-161,184-246,268-476
atgtatttgtttaatttttacagtaagcagtacacctcaggtggtcccaggcacatttggacaccagcatgtttttggactataactaattttctttgtccacctaatacaaaatgttgctatttgagagctttcagatattagccagaaaattcaaaaaagccattaattgttaacaaaatagtgaccaaaaacctgaaaatcttttttttgtgttcttctggtcataactcttttgcaacacaaataaaaattaataattttgcaggcctaatagaccacatttacatgtaccgaatgataccaacaatgtcggattaggatgataaaaaaagttataaccaaaaaacggctggggtccaaatgtgccggaacccaactgagcaactcagataatcacaccacaaagtcttatttgaagaagaaaggctataaaatactctgcaagttaattttcgcacataatttttgtgaaa

SEQ ID NO: 81696 - DNA, 980 bp, Heterodera glycines
  Genomic contig location: Contig_ID=SeqID_2805; Location=437..1416; Strand=+
  SCN-specific regions: Sequence locations=1-237,259-672,695-862,884-980
atgcctgttcgtaagagcaaatggacaacgctcggaagcgtaagtccatacgatgcctgttcgtaagagcaaatggacaacgctcggcagcgtaatgtccatacgatgcctgttcgtaagatcaaaagtgcaacacttggaatcgtaatgtccatgcgatagctgttcgtaagagcgaaagtgcaacgctcggcaaaaaaaagcaaagtcaaagtgaaaaccttaaaaatcacaggtgcgtggacccgggcaaaaaattgccttaagaccaacatgccttcgcgaagaaaagtttatgtcttgtgttttaccagccacgcaccacgacactcccttaacttcagcatgagggtcacgggacatactgtgtgcaggcaggagctcccttgcctgagccggccgctgccagtccacctcgctcggctcccttgccttcgccggccgctgctcgctcggctcccttgcctgcgccggccgctgccagcactcaacacaagggagccatcgctgccttcgcgggccgctgccagtccacctcgctcggctcccttgcctgcgccggccgctgccagtccacctcgctcggctcccttgcctgcgccggccgctgccagtccacctcgctcggctcccttgcctgagccgtccgctgccagcactcagcccaagggagccatcgctgccttcgccggccgctgccagtccacctcgctcggctcccttgcctgcgccggccgctgccagtccacctcgctcggctcccttgcctgcgccggccgctgccagtccacctcgctcggctcccttgcctgcgccggccgctgccagtccacctcgctcggctcccttgcctgagccggccgctgtcggctcccttgcctgcgccgatagctcccatcgccgtccgctgccagtccacctcgctcggctcccttgcctgagccgtaccatttcaacacgcgcgcgcgcgcgcgtagaaa

SEQ ID NO: 81697 - DNA, 2023 bp, Heterodera glycines
  Genomic contig location: Contig_ID=SeqID_2805; Location=1..2023; Strand=-
  SCN-specific regions: Sequence locations=1-704,726-893,916-1329,1351 -2023
ccggcggaggagacacgttcgtggtgcgaaagaaaatcttcaccattcgctcgtatgtgagtaccctgactgcgcagcaggcgaaagcgtatgcttgagtgttatggatggactcaatgttgaactagcgaggcaccaccacatgcccgtccgccgcttgcggacgccaggcccgttcgatggggtctgtggcgctggtgctgatacattgttacatacggttcacagtatgtcccgtgaccctcatgctgaagttaagggagtgtcgtggtgcgtggctggtaaaacacaagacacaaacttttcttcgcgaaggcatgttggtcttaaggcaagattttgcccgggtccacgcacctgtgattgaatgaattagatttcccaaatttccatgcccaaccacttcaaaaagccttttaaataccgaacactaccaccacgcccctcccccacccatcttatttttaccatccaccatacccattcccctttccacgcccatcatcacccgtaaccatctcatttttaagcctattttttgcctattggctcaatttattttctacgcgcgcgcgcgcgtgttgaaacggtaatgagctcaatttattttctacgcgcgcgcgcgcgcgtgttgaaatggtacggctcaggcaagggagccgagcgaggtggactggcagcggacggcgatgggagctatcggcgcaggcaagggagccgacagcggccggctcaggcaagggagccgagcgaggtggactggcagcggccggcgcaggcaagggagccgagcgaggtggactggcagcggccggcgcaggcaagggagccgagcgaggtggactggcagcggccggcgcaggcaagggagccgagcgaggtggactggcagcggccggcgaaggcagcgatggctcccttgggctgagtgctggcagcggacggctcaggcaagggagccgagcgaggtggactggcagcggccggcgcaggcaagggagccgagcgaggtggactggcagcggccggcgcaggcaagggagccgagcgaggtggactggcagcggcccgcgaaggcagcgatggctcccttgtgttgagtgctggcagcggccggcgcaggcaagggagccgagcgagcagcggccggcgaaggcaagggagccgagcgaggtggactggcagcggccggctcaggcaagggagctcctgcctgcacacagtatgtcccgtgaccctcatgctgaagttaagggagtgtcgtggtgcgtggctggtaaaacacaagacataaacttttcttcgcgaaggcatgttggtcttaaggcaattttttgcccgggtccacgcacctgtgatttttaaggttttcactttgactttgcttttttttgccgagcgttgcactttcgctcttacgaacagctatcgcatggacattacgattccaagtgttgcacttttgatcttacgaacaggcatcgtatggacattacgctgccgagcgttgtccatttgctcttacgaacaggcatcgtatggacttacgcttccgagcgttgtccatttgctcttacgaacaggcatcgtatagacattacgctgccgagcgttgtccttttgctcttacgaacaggcatcgtatggacattgagattccgagtgttgtactttcgctcttacgaacagctatcgtatggacttacgcttccgagcgttgtcctttttctcttacgaacaggcataacatagacattacgctgccgagcgttgcactttcgctcttacgaacagctatcgtatggacttacgctgccgagtgccgagcgttgtccttttgctcttacgagcagtcatcgcatagacattacgctgctgctcttaggaacaggcatcgtatggacttacgcttccgagcgttgtccatttgctcttacgaacaggcatcgtatggacattacgctgccgagcgttgcactttcgctcttacgaacagctatcgcatggacattacgattccgag

SEQ ID NO: 81698 - DNA, 196 bp, Heterodera glycines
  Genomic contig location: Contig_ID=SeqID_2806; Location=2605..2800; Strand=+
  SCN-specific regions: Sequence locations=1-196
ttgaacggtgatggctgctgctggggtgccacctttgtcgtggcctcagtttctccagcgtttggcagctgtcgaaatgaataaaacatgcagctcgtctgtgtgttaaagaaatttggcgagttaattgacttgtgtaaatgtggcctaaggcacaaatgctgtggggaactcagcactatggatcctgtgattg

SEQ ID NO: 81699 - DNA, 2291 bp, Heterodera glycines
  Genomic contig location: Contig_ID=SeqID_17231; Location=187..2477; Strand=-
  SCN-specific regions: Sequence locations=1-151,174-225,247-713,761 -802,836-961,1012-1154,1177-1212,1234-1692,1734-1785,1807-2191,2213 -2268
atgcgaaagtttagggcggaattctgcacaatgttaaaggaaattctgctgatcggaatcgcattgaaaaatgatcagacaaataagataaaaagtgatcgaaaagtaaataatatggtaattacaaatgatggcaaaatgccaattaatcggatctatcatgaaaatttaattgataatcagcaaaatcatacagtaactgatctaagtgaccggaaagaaaatgggaaaagtgatgaaaaaatgcataaacaaagtgatcagaagttaaggaaaagtcatcggaaaaagaaaacaccactgcctctaattacgttaaattatcaacagcagaatacagttggtgagcaacgaaatgatacagtaaccgatgcaaatgatcagaaaacgactgtgccagcaactgaccaaaaaatgaatgggcaaagtgatcaaatcgaaagcgagccgcaactgatcgcaattcgtgatcaattgcacaggaacaactttgcccgactgatcagtggggatgacgaaacggcacgcgcagcgtggcacaatttgacggacgaggtgcaatttggcgtcattacggtactgttgggacgaagaggtggcagagacggtggcaaaaagtacagtaacactcgggcacagttcctcaaatatttggccaaatggaagaagttgcgcgaccagactgagttgggtcagtgttcggttattttctttaattaattaaataaataaataaaaataaataattttttaaataaatttacaatttttgtggccttttttaatatttgttggcacattgtaaataaaataattattaaattaattaattttagatgaacgtttatttgatgaatataacaaacaaaattcagaacaaattttggacagaaattacgtacaaaatatgcagcaaatcaaatataacactcaaacggacatttacacaaatttggtgacgaaaaaaaatcttaataattaatgattaaattaatttttgttattttattagctcatcaagattctgcgggcaaatggctttgatggcattgaaatgcataagcaaaaacaaattgaagaagaattggaaaaaatcagagacactgtcgccaaatgggtgagatttccaaaacccattccttcgtggcttaattcggttttaaaatgccagaaattcccaccaactactcgcccttcccccattaaaatgccaattaaattttaatttaaaatgctgaataaacagtgaactgtttttgtagtcaaatggcaccggtgccctgctgttgggcggctcctctctgatgggcgtccaaacggcggactcggacattgacaccgtttgcattgtgccggcgcacattcatttggacgccttttttggcactttgcactgtttgagcagcggcgaagaaaaggaagggcaaaagtgtgaagatgactcattgttttacatgcttggtcaggtaatatatttccggcaattgatcattttgcttttgttgggtgaggggattttcgtttgttttgctcattttcgctcgcctaaagacaagcttcaccttcactgtattgcaaatcgagacttacatctgttgccaaatcgtgcctgaatcaaaaggccgtaaaatacggttcagattttccgcttccctccgtcgtttcccccaccatttccgccccctccccacgaaaaatttttaaaaaatttaaaaaagatttacaaaaaaattcacagggaatttttcataagaaaatccaaaaaaaaattttttaattcataacgatttttcagagaactactaagatttttcaaaaatttttttccaaaaaatagaaattaaaaaaatttcttgaaattttcttatgaaaaatttcccttagttttttttgaaaaataatagtttaataatcccgaggggttctcctcgcttaaaagcatgcttcatctttgcttcatcctgcccgttcttcagcttgccgactttggctctgtccgtgccattgccaacacttcggtccctttgatccgtctcatttcccgctccggccaccaatttgacatcgttttcgcttcagttgcgcagatggaaagcatttcgatggcacaactgctgaacggaaatgccgagacatttggccaattagcgcaaaaaatggccacagaattgatggaagagggcgatggcattttggagagggaggaggaggaaacggtgaaaattgcaagaatggcacggtcattgtccggtgattaggggggggggcaaaaataattttaaaaaaataaa

SEQ ID NO: 81700 - DNA, 493 bp, Heterodera glycines
  Genomic contig location: Contig_ID=SeqID_17232; Location=9..501; Strand=+
  SCN-specific regions: Sequence locations=1-457,479-493
  Gene Ontology: Mol. function=3'-5' exonuclease activity; Cellular component=nucleus; Biological process=aging
acgttggactgttggccgtagacgaggctcatttcatttcccaatggggccacgagttcaggccgggctatcgccaaattgccgatattcgcaatgttttgaccggtgttcctgtcattgctttaactgctacagccaccgacccggtgagaaatgacatcgtccaaaatttgcgactgagaaacccaaaagtgactttgtccgcatttgacaggcaattttcgaattctttttttttgtgttttattagagaattataggaagaatttgttcattgaagtgcaaaaacgaactcaatcgctgaggtggcgtttatcatcattaatttctaatatgaggtcgaattcgaactttagtttcgaaaaatgcgtacagaatgacttggaacgtcttctcgaggatgacccgaaaaccgggccgaattttggtggtccaacaattatttattgccaaactcgggaactcgtcaaccaactgacccagcaactcagaa

SEQ ID NO: 81701 - DNA, 1159 bp, Heterodera glycines
  Genomic contig location: Contig_ID=SeqID_17234; Location=432..1590; Strand=+
  SCN-specific regions: Sequence locations=1-425,470-494,516-604,635 -1159
atggaaatggtgccatttgaattggtgaacgaatgcacaaaggaaaagctgacattggccaaagcaaatgaaaatgaattggacaaaagttggataatgaaacgctgcaaaattggagagacagcggcggtcaattgggaagacggaaattgggacaacaattgcaacaatgtgttcttttggctttttagtggcactaattgcatcgggtgagcaatttaaaaacatttgatttttatccgaatttgaattttgcgcttaatttaggcctttgtctccgccaccaccagcgagaagacgaagaagcgggacaaagcatcacaaagggcgaaaccaacgcattgaaacgtggcgaaagaagtgccaatttgaggccgagttgaggacggtcaaaactggggaaaatgtccatccaaacgtcgttgcaaatccaactgaaatggaaaaacagtttagttaaataaatgatgaatagggatcggatttttagtgataaaaaatcccaaaataattaactaaatagtgagaaaaaaattccaaaatagtggcaaaaatagtggcgaaaaagttccaaatttaggggtgcaattttttaaataggctgttttttaatttgaaaataatttaaaattaaggaaaaagattttattcactgattgcagttacaaaatattttcttagaaaatattgaacaagaaaaaaaaatttgggggaagaatttttgtgaaatttttccaattcttagggatgtatttttgaaaatttttaggtcgattcttaggggtgtatttttgaaaaatttttaggtcgattcttggggtgtatttttcgtttttattgcattttttgggaaattttccaaaaaatgccaaaatagtggcaaaaataatgacgaaacgccaaaatagtggcaaaaaattattttagtggctaacttccgaaatagtttttttttagtggcgaagctccaaaatagtgattcctagtgatgaatagtggcactaaaaatgaaaaattttcgaaaaagaatgtgtttttcgtgcatttttcgtcgagttaaagccgcagaaaaaatagttaaaaaactaagaatccgatccctagtcataatcatcagtgatcaaatgccttttttgatgaataatgtctaaattggtaa

SEQ ID NO: 81702 - DNA, 100 bp, Heterodera glycines; identical to SEQ ID NO: 54598
  Genomic contig location: Contig_ID=SeqID_17234; Location=766..865; Strand=-
  SCN-specific regions: Sequence locations=1-100

SEQ ID NO: 81703 - DNA, 377 bp, Heterodera glycines
  Genomic contig location: Contig_ID=SeqID_17234; Location=2922..3298; Strand=+
  SCN-specific regions: Sequence locations=1-377
atgaaccgacggtaaaagaatttcaaaagtcaaaaattcttatttgccctaatttactttcattatttcagttggatttgcaacgacgtttggatggacattttgcccagttttgaccatgcccaactcggcctcaaattggcacttctttcgccacgtttcgatgcgttggtggacaaacatttcgatggcaaaagcgaattgacaatttggagatcaatcgaaattcgtcgcaaggacaaaggaccagaaacgaaactatctgtgcggatggatgacaaatttgtggaatttccattgccggaccgtccgttgcccagcaaaatccgttttaagaatcttcggattgggtaaatcaaaatcagagagctatgaca

SEQ ID NO: 81704 - DNA, 372 bp, Heterodera glycines
  Genomic contig location: Contig_ID=SeqID_17235; Location=18..389; Strand=-
  SCN-specific regions: Sequence locations=1-64,87-93,115-372
  Gene Ontology: Cellular component=proteasome complex (sensu Eukarya)
atggccgaccaactgatgctgtcttttaagcagaaaatcaacgctggaaaatatgctactgccgagccttttctggccaaacttggcattcaaacaacttctgaggaagagaagcgatttatcacagagaatttggatgattggcgtgtgatcaccgcaacatggtttgaaatggcacggcacattggcacggtgcaaagtcttgcgactgtcgatggattcgctggcagacacaaagcttctctcctttgttccaaaattcattactgtcgcgagcaatacaacttggctttggaatatgccttgtctgctggaaatgagttcaaacttgtgccgcgggcggaagataagaagggcatgacactttggtga

SEQ ID NO: 81705 - DNA, 965 bp, Heterodera glycines
  Genomic contig location: Contig_ID=SeqID_17237; Location=95..1059; Strand=-
  SCN-specific regions: Sequence locations=1-439,461-646,670-965
atgggcacggatggacatccgacggagaacggagtacgaactgagcgtacaaaaggcaagggactgtctgcagaagtactaccgactggtcgaactgtacaaaaaggtacggtaagagagggaccataaaatgaaatatttgcaatgcaattgcccttctgattcttttcaaacattcagcgtgccattgaaattctggaagttattttgaaaatgtccgacggatggcttgtcacaattcccctccgagacgaagatttggccgacgaagagattgtggagcgggcggaggactttattaggattcgcaaagattacttggccagtctactccaaaaactcattgacatttaccatcggtcggacatgccaatgagcgttttggacacagcgacgcttatcatggacccgctttactgtttgtataaggcgagaatccatataataataacaatctaataatatttcaataaatcaaatcattttcaggcattggacaaagaaaagctgcaaaaactgttgaaatcgatctcccaagcaggcgcatctctcctctgaactgttacacttcacaattaatttttctgtttttaaataaatttcccaattctttgctttgtttttccccttggttttgcatcattatttatctttgaatttaatcactttattttcccattattattcggttttttcctcagttttccaatggagcgttctttgtgcagtcggaacggtgcgggaaatgacagtgtggtgaatgtgagggatgacgaagtgcaggacgacgacgacgagttcttccacggcacggcatttgaaagtgacgaaggataggacggcatagggaaaaggcaaacgaaatactgtataatttgattaagcggttcgcggagaggacaaggagaaccgagagacgacggacacggcgaaatatggggttgactatgacgagatggacaaag

SEQ ID NO: 81706 - DNA, 1624 bp, Heterodera glycines
  Genomic contig location: Contig_ID=SeqID_17237; Location=1164..2787; Strand=-
  SCN-specific regions: Sequence locations=1-456,495-1044,1066 -1104,1127-1257,1279-1624
atgcacgattttgcacgaaatcgtttattcttcaaacaaacggctcgtgaattggtacctgtggtaagtaaagaggaattatttcttaattggcgaattaatgcttttaggacgatgaccgtgtccagaaaagcgaccaatgcatttgggccacatttggtggcgacttggccacactcctctctcatgcgctgtccaccgaggatcggttgtgggcctatttgagctgtgccgctgaggcacttttggacgaagaactgttaaaagagcacaagaaaaaggatggcgaactcatggcattggcgacggacattcagcggagagagggaatggacttgccgaaggatgtgcccgcgatttttgctgaattaagaaatgtgagtggtgagcaaagacaaattgccatgacattgtctaaaatggcactttatggaaagtaaccggtttgattttatcaaaaagtaaaaacaaaagggtgacccttttggtttgcaaaatttaatgtatagtcatgaaaatttactccctggggtttttaatctaaatttaaacaaaaaatcaaaatttgaaaaattcaaaatttcgattaaaccaaaagtgccttttgtttttgataaaattgaaaaacggtagccttttcataagcgcctctaaaaattagttatttttagttggtaatatttgcgtttattgctttagaatgagtctcgtccctattacactctctttgaacatttggctttggagcgatgggacttcgccgtgcgatccatcggcgaatatttcaatgccaaaaaagagggccaaattgctgcggatgaactccgtttctttgttcatcttgtaattctgctcagactcagtggcaaatgtttcactgatttgccaattttcgacgcgctcatcgaacagtacagcaagttactgcagcaaatgcgactcattaccatcgtgccgttttatttgtaccatttgtcaccggaaaagtcaactgaaaagatgcttgacttccttatgagttgttgttcattgaatttgttatttcttaattaacccaattaaactcagaactcacatttgtctcggaacaaaaggaagtgttggaaaatgcgatgaaaattggtttcgatgtgcccaatttgtgccgcgatgtttacagacgcttcaaagacaaacacaattttgggccaaacgtcgcgagagaggcgcttagaaaagcggcggaagagctaattttggcatggaaatggttggcattttgcgaaactgaaactgtttgggatgccattattgaagcaaattttctgttgcgtaaattcttttgtgagtttttcttaacagaaataatttgaattgtgagtgtttcgtcatttcaattttattagattattgattttgttaattttacgatttgcttttatttagtgtacggtttaatgtcggaagcacttcaattgatgcaattggcacccgaaaagctgcccgaaattgctttgagaacattccaaacggaatttccggacaaagaaattcccaccaaattaaaagacgcgcaacgcgaattcgactgttaccaactttattttgtcagttgaatggaattggcatgcatttgccaaataaa

SEQ ID NO: 81707 - DNA, 790 bp, Heterodera glycines
  Genomic contig location: Contig_ID=SeqID_17238; Location=1218..2007; Strand=+
  SCN-specific regions: Sequence locations=1-200,257-274,303-386,440-790
atgtgtcgcaaatacaatgaaaaatgggctgaagaacacaacgatttgacatgcgaacagttcgccaaacaaaaaaacgtgaaggatattttaggtatttgtgtgttacgcatttttgtatgtaaaattagtcttaaaaaagaacaaaataaaatttttctaaattttttacgtttttatcatataaaaaacaactcgggaaaatataaataactaaaaaattaattatataattaatttaaaaatttaaaaatatgtagatgcaatcaaatttagagacaaacagaaaacagaagaagaaatcaaaaaaagagaatatgccaaatgtccgggatgtaaaactcatgtcgagagaattgaaggatgcaaatttgtaatttgggaggattatttttaaatttaattttttaaattaattttatttttcattttttaaattgtaagttgaaatgtcgctgcggtacctgtttttggtattgttctggagagaaagctgatccgaaggctttgaaatcgtgctggggcgtttcataaaatccgccattttagtgagtttttcgacaaaacatggcataactttgcttaaaggcaatcaatttttacattcgttttggtaccattcaatagccaagcttttttgggatttttatttaccgatttttaaaatttcgagttattagcatctattttctaggtttttatttttaaaacataaaaaaacctaaaaattttgaacaaaactattttaacctggtttcgcgttttgtgtaaaattatttacaaaaatgca

SEQ ID NO: 81708 - DNA, 749 bp, Heterodera glycines
  Genomic contig location: Contig_ID=SeqID_17240; Location=954..1702; Strand=-
  SCN-specific regions: Sequence locations=1-21,51-98,140-151,173 -340,364-473,495-673,702-749
atgggagcattgaaagcggtgattaatattatattaattaattatttataggcataaaaataggcaattaattttttttattaacgctttttaggtaacaaaacacataaaaacttaattaaaaagacttaattttggtcatatttcacttaaatgaaattattaaatatttcaatttttttgaataaggacattaaggacatttttaaacaaaaaaaatcattgacaagaaaaaaataaataggtttttgggaatcaatttttctggaaaatttttcaattcttatggctggcaattgcctaaaaatggaaaccttactaaataaatcaatttgaattgttttaattttctatttctaattttagtcattttcgattgcttcttatcgtgtcaattttataattttcgtttgcttttgttcgtcgtcttttgctgatgactcaatttttgaattgaacaacaaattcactggagaaaaattagcaatgaaaaagattaacaacgatggatgctttttgctggtccgttgtcccatttcgcgatatgaaaacaaatggacgaaatgggaagaggaggcgattgagctgaacatttgtggccaatggagcaaaattgacattggcattaatgaggagggaatcggagacgggtgcgtaattcgagtacataattaactgaatattttattttaattagccttctctatgaaactctcgacccaatcgatcagcagaaataattcaataaa

SEQ ID NO: 81709 - DNA, 1690 bp, Heterodera glycines
  Genomic contig location: Contig_ID=SeqID_17241; Location=199..1888; Strand=-
  SCN-specific regions: Sequence locations=1-127,157-237,331-383,405 -471,512-671,694-858,881-935,958-1000,1024-1082,1115-1122,1182 -1194,1216-1632,1660-1690
atggcaggtcatgtgctgattgtggagcgaatttgcgcaacaatttacgttagtacttacgagcagtacagtagctggaaatttacgatcgtttggcttttcattatggtaagatagttggtttagcaataattttcattattataaattaattttgttgttaaaagatacaaagtagacattattactgaatcttagagctcaacatccgagaccattgaccttgaaaaagcatagaaaaattattacaaattaaaattttacttacatttttaaaaataaattaaagataatttattaaatattcttcctattaattttataattattgtatagattaccacttctttggcggtgacaatttgtcaaatcagcgtatcaaattccttttataaattatcttatattgctattgttctttattttggcgcaactattgccagtttgattgaaatttttgtaagaaatatgaaaatttaattattaattatttataataataataaaaaatgcaatttcaggctctttcaatgatcacaaaaattaaccaaaaattgtttaattcacgtgttggtggtggcacaaatcagcaactctctgttcgatatcaggtaaattaaaaaattaattaactttggtaaattttttggtttcctagatttcgaaattgcttaaaaaatcaaaataatattttatttggacctgagatgccaagaaattttcaaaaaatgttttcattctttttgattaattgaaaagggaataagccaaaaatacattttgcatttcaatttagttaaatgaaaatattcggacgggccgacaattggcacccaattttttgtgccattttatcaccgtttttattacatttattgtgacaatgaattcccagtttggtattataacaaatattgaaccaatgaccatgttttaccaagttttgtttctttcacatgctttcaatgaccttgcgcttcccgttgcaatgctttggtatattaattaattaattaatcaattttattattttttaacaagtgtttggcaaattaaattagtaaattttcagtatcaaatagcaatcattttttaaatgaaataataatttgtgagaatagcattaaatattattttaaaaacatttagaattaataatgttaaatttattttttaatttagttatcatccattactgaacagaaaagccaaggcgtcattagcgaccattaaacaattgttgagaaattcgtccaccgtttcgccacaagaagaaacggcacaaccattggacaccgacggaaggccaattagtgaacgaattcaacaagaaaatcaggacaacgaagcgtactttaaacaattggcctcagcttggggcgacagagcatgaacatgtaatttctgggtacagcaaaaatgcctgagcagaagagcactggcgggcggacgaacgcagaaatgagcattttttgaaaaatgacgtcatcgatcttattaatttttgacacctaataagcgataaataattatctctctcatccttttttcagcttgtaaaactttcccattaacctattaattatgcttctggttgagaaacattaaggggaaatcaataatcgtcaaatgttacagaaaatttttaaaaaaccaaagttgaggaagcgcttgaaattgatgcattaaa

SEQ ID NO: 81710 - DNA, 198 bp, Heterodera glycines
  Genomic contig location: Contig_ID=SeqID_17241; Location=285..482; Strand=+
  SCN-specific regions: Sequence locations=1-198
tgtttctcaaccagaagcataattaataggttaatgggaaagttttacaagctgaaaaaaggatgagagagataattatttatcgcttattaggtgtcaaaaattaataagatcgatgacgtcatttttcaaaaaatgctcatttctgcgttcgtccgcccgccagtgctcttctgctcaggcatttttgctgtaccc

SEQ ID NO: 81711 - DNA, 312 bp, Heterodera glycines
  Genomic contig location: Contig_ID=SeqID_17242; Location=106..417; Strand=+
  SCN-specific regions: Sequence locations=1-63,99-312
atggcttcagcttcagccaggattcgtgggaggacgaggcggccatccgcgcggtaagaaatcattaataatttaattattatataaataaataaaaaccaaataaattccagcaagcgccattgatatatgcggcgtgggaggccgcccacgacgcggggcacacaccggaacacggcactgtcttcccattgcggccggcgccgtggatgaccaacgttcgagtgcagagggatttgggagaggccgaaagggcctatcccgggcggcgcacggcggtgcgacaaatttttggtaaaatgaatttaaaaa

SEQ ID NO: 81712 - DNA, 817 bp, Heterodera glycines
  Genomic contig location: Contig_ID=SeqID_17242; Location=461..1277; Strand=-
  SCN-specific regions: Sequence locations=1-170,193-333,370-609,631 -660,682-689,718-817
atgttcggcatcaccatcgacccggagcagatggcagtgaacaaaggaaagcgttcaatcgccaagctatgcttgaataacctttgtgagtgtcttaatcggcttatgcctagtttgagctcattattttaagggggccgtttttctttgcgaaactttggcctggcccaaacggtgatcacagatgaccctgcagttttggctgagtacttggacaacaaatccatcgatgtgatgtccatcgacgaactgaatgagacaacgattctgatcagttacatgcagaaaaaggaatgggttgaagaacatgaatgtaaaatattggtgagagacaattaaattgaaattttaattgaaatttaaaattttcagttatttctctttggacaacatctgcagctcggcttctccttttgagagcgatgcaaatggttggtcgaacaccagaatgcagacttttgtatacggacacggactcgctcatatttgctcatctcattgcaaattgccctctacaaacaggtccacacctcggtcaattcacggacgaatatcccgaccatgaaattgttgagtactgcagtgggggaaccaaacaggtagtaaaacaaattaataaaacaatttaaatgttaattttaagtacggtctaaaactcaaaagaaatggatcagtggaacatgcgttggtttctgctgctgctgttgttggtgctggcgcatcaatcaatgcctccctccttccaccaatggcaccgccgccgcatctccctctgtcaatggcaccgccgccgcttcagtcccggcattcgcgtcca

SEQ ID NO: 81713 - DNA, 427 bp, Heterodera glycines
  Genomic contig location: Contig_ID=SeqID_17243; Location=127..553; Strand=-
  SCN-specific regions: Sequence locations=1-194,217-427
gaaattcagatgcctaacctgtgcctggatatttgagctggacttggatctatggaaaaaaccagccctggatcctagtctaggtagaattctaatttacagtaatgtttagatattatttatgtacaacaaatccacaaacccctttggctcttcggctttcgtcgtttctggaggaaaaaaaatattcgatatttttgtgtgtgtgaaattaaataagtttatttttttgaacttatcgtaaaactggcggaacgggccaactccgtctggccaactccgtctgagccaactttgagtcaatataactcttgaagttattgaccgaatcaaacaatcttgatatcattcgaaagctcttcacaggctctattagcctactaaaaattacagaaaatttcgaactataaaaaaagatagaaataaa

SEQ ID NO: 81714 - DNA, 309 bp, Heterodera glycines
  Genomic contig location: Contig_ID=SeqID_17243; Location=1..309; Strand=+
  SCN-specific regions: Sequence locations=1-309
aatcatggtatcataggaaagccctagatgtttagaagatatttataaggtatttctcagtgattaatcagctctcaaaatagttgtcagtttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccgccagtt

SEQ ID NO: 81715 - DNA, 1586 bp, Heterodera glycines; identical to SEQ ID NO: 17246
  misc_feature (1538)..(1538): n is a, c, g, or t
  misc_feature (1571)..(1571): n is a, c, g, or t
  Genomic contig location: Contig_ID=SeqID_17246; Location=1..1586; Strand=+
  SCN-specific regions: Sequence locations=1-315,337-988,1010-1143,1165- 1586

SEQ ID NO: 81716 - DNA, 1115 bp, Heterodera glycines
  Genomic contig location: Contig_ID=SeqID_17247; Location=45..1159; Strand=+
  SCN-specific regions: Sequence locations=1-1115
atgtggaggtaattaccgcttaaatttcgattgttttaatgtaccaaaaaaaattattgtagtaatatctgtcaacttaaaacagaaatttccgtggacaagtatgcaggtgaaatgcgtaacaagggaattgtttgtaaacctccggtgcgtgtctctatttgctggtttacgtccgtgaacaaggtcttggaggttttgcacaaggaagctctgaacggcggcgttaagttctgtctcattggtcatgcgaaaggctctgagggtgatgacgtgcatggtaccatttattagccgttgtaaaattaggcccctgattgtgagtttcttatttagctacgatcaaggcgtttgaacaacagactgaaattgtcactcaagcaattacgtttgacgttctcaaggatgtgctcgataaaggcagcccattgactgttgcgaattgcattcacaaaacgaacgtgaaaatgggcggtctaaattatgctcttcatgtggatgatccatcgtgcgtcttttttccccttttttatatagtcaatacaattcattttagtgttgccgaattgttcgacggtcaaacactgtttcttggttttgcaatgaacttcccggatggattcgctccttccgaatctgctgcccctatcaacggtgtgaatggtgctgtgccttcaggaagtaaagctggaccaacgctgcctcctcctcctttgtgcattggggtaataaaaaggagaggagctcattaactcaattttgaaggagtaagtcaatttcaaaaatttcagtgggccgcgacaatcggaaaacgacacaaggatgaatacattggtgactttgtctactaccccccgcaccaatcgaagaaaaatgatgttattggaagcgttgtcaggagatgcattgagtccttcaaaaaaaacaggaacaaaatactgtaagttttggacaatttgcattttatttgttgcaatgattgcttagacaacgcgtggtcattttgcgcaacagatgtaccgagggacaattcgaagatgtcatgaagtaatttttcaaaatgatgaaattatttgaaaatttctattaaaatagtgaaactgggctcttcgaaa

SEQ ID NO: 81717 - DNA, 527 bp, Heterodera glycines
  Genomic contig location: Contig_ID=SeqID_17248; Location=3114..3640; Strand=-
  SCN-specific regions: Sequence locations=1-527
atgcatgacattgcattagacgagaacatggctcccggcaactatgtgtatccgtcttatgaggagggaggagacagacaacggcaatcccaacaacagcttcaaggacaccatccgtcgtatgaatccaacgaaaccctacgacaacagcaacaagtaatgaacccagacttgcacagaattgcagaagtcggtctaaaaaggcattggttgtgtggacaaatacggttattggcattttcaggaagtcggcgacgattgggattcgttggagtcgttcagtttcgaaatgctcggttttggcgccggtcggcaaatggaagcaccgccacgacagaacaacgcgtctggtgccgttggtcattcgccaaaaccgccgtcgtgacggcaaatgtgcgtattcgttttttggcagatgtaaaagggcattacgagttcatgctattttctccaatggtgtttttctgcaattgttccccatcttgtaaatctcgtgttccggctgaattttgttttttgttaataaa

SEQ ID NO: 81718 - DNA, 2315 bp, Heterodera glycines
  misc_feature (2290)..(2290): n is a, c, g, or t
  Genomic contig location: Contig_ID=SeqID_17248; Location=1..2315; Strand=-
  SCN-specific regions: Sequence locations=1-886,908-2315
  Gene Ontology: Mol. function=sodium:chloride/potassium:chloride symporter activity; Cellular component=plasma membrane; Biological process=transport
ttgtccgacagctgcggtcattgcacaacagtcgcccccaaatgctgagcccgattcgctgttcgcccagcaaagcgtcgcgggcgaagacattccgtggtggcaaaggtcggtcgggagtgagtctcggccctttggtggtagtcagtctcggcattttggatccggggaattgggattttttcttggcattttgacaaccactttttgcatgtgtttttacctgcaaatcccctcacaaaaaaggaattttctgctgcaacagcccactttggtgaacgcttggaatgccgtctttcccaccgttgtcgtcaacattttcggcattgtcattttcctccgtatgggttggatcgtcgtgcgtttgcctttgattcggtgccattggttctgccgttctcccatttgtccagggcactgccggtctcttccaggcatttgttgttctcgccctgtgcacccttttctcctcagtgactgtcctttccgccattggaatttgtgagcgatgtcaggtgagcatcggctgatcggcacaaaaaacacagaattgggtgattgaattgggctgatcagcattctcaaaactgatcggaatgaccgcccaattggttgtccttacccttccgcaaatattcctttctttctttttttcgtccattcacttttctctctgcgtttctccaacccaattgttttcctgcgcttagattcgcagtggtggcatttactttttggtttcccatgtgctcggaaaacgaatcggtggtgccgttggcctcatttacacctttggtcaagcatgcgcaactgcactggtcgcgctgggctttggcgagtccatggccaaattggccggcattttcagccccgtggccatcaaaactctctctgtgttggtgctggtcgttctcaacggtcggtcggttgttaaacggacgggcacaacctcgccttgaggcgtttaatttttaaaagctcttcgattgcgtagttacggtaaatacagtaattctcggcatttctctcattagcaatgaatttcgctgggcttcgcttcatcatccgtcttcagctgcttctgatgtgctttctggcaatagccattggcgatttccttcttggcgccgttctcttcactccattggactcaggtattttacccttcgaattctcggaagaaaataatttggcactccttaagaggccggcatcggcgaaatgagtgccgaaagactgtcgctgaattggcactcccattacggcccggccaattgcacgccgttctccgaattatcggcaaatgagtgaacgaatcacagcgaaaaaggaaaagaaccgaactcaattcagagaacaccaaaacaacgcaatggctcttcttggccaggagagtttcttcagtgtttttggcattttgttcgccaatttcatcggagttttggccggtttttcgtcacagaattcacttttaccgtttctctttcgtaaaaggagtgaatatgagcggcaatttggtggaccctctgagaaacattgccgagggcgaactcagtgctttggggtgagcgattcgatttgattcaattgatttattgtttatttgattccttttgatctcagagcaagcttcgccctctgctttctgatcatgcttatcctcggcgcttccgtcgatcggtgagtttagtaactaatcaccacaattatcagttgccctttgcctcactttccttccattttggccactctttgctttgcgatgttatgatttcggaacgactttcgctcaccaaacttttgttcctcggcggcctttacatcgcttgtctctccgccattctctcctccaccctcggcacttctcgcgttgtgcagggcatcgcctccgaagggctcattccacagctgagcaaattgcttcaggaggtggcaaattggccgagggggggggggggcagatcgccaaggagcagcaaaatacaaacaaatttgactaatggctaatcgtatgacaaatgactcccatccgttgcattattcggcatttccaattggctcttttctcgaaggattcgccctccaaagaccctctaaaggccaccgttttggtcactgcggtcgctgtgctgctcgttctactcggaaacctcaaccaaatggccattctctcctccatgccctttctgctcacttatgccttcgtaaattattcttacgtttcgttggcaatgagcgacgatttggactcattgggccgcgaaagcacgcaaaagtgagcaaaacgganaaggggggggggaaagaaaaaaaaa

SEQ ID NO: 81719 - DNA, 664 bp, Heterodera glycines
  Genomic contig location: Contig_ID=SeqID_17249; Location=112..775; Strand=-
  SCN-specific regions: Sequence locations=1-12,42-49,72-169,192 -560,589-664
atggaaaaagtctcatactattattattattattgtgaaaaatcgaatttgaaagagctaatgacattaaatttaggcaaaagtaattatcgcgatcaaaaaagagtataatgcattaaatcaacgggaaaaataacactttttatatgcattcaataattacctgctgattttaaaaaagttaaataaaacatgtaaaatttatctatgctaatgattgttattcgacagatccctcaccattatataaatacaactgcataatatacaattacaataacattatgtttatttgcttttgcacaaaaataaccggtttcgaaaaagtgaataaaatttgattttatccaataaaaaataaaatttatacatattcctttgttcgagaacttaaatggaaaaatgctaaggactaatagaaataaatttatttaaatatgacgaattatccctaaaaaatttcatacaaatatcagttatgctaatttcaggaggtccattatcattatacaataaaaatacaactgcatattatacaatcattttcgactaattaacagtatttaaaattttattttttattttaatgggttttaacctacgataaattatttctactcattacagcaaaaacacttgaaacaaaatagttaaggctaataaa

SEQ ID NO: 81720 - DNA, 115 bp, Heterodera glycines
  Genomic contig location: Contig_ID=SeqID_17250; Location=1972..2086; Strand=+
  SCN-specific regions: Sequence locations=1-26
atggacaaacgaagaaacgaacgcccgaaaataatgggagagaaaaacaaaaaaaaaaagagtacagcagcaagagaagaaaaggacgaagatagagcggaggaagagaggaaaa

SEQ ID NO: 81721 - DNA, 648 bp, Heterodera glycines
  misc_feature (562)..(562): n is a, c, g, or t
  misc_feature (570)..(570): n is a, c, g, or t
  Genomic contig location: Contig_ID=SeqID_17251; Location=280..927; Strand=+
  SCN-specific regions: Sequence locations=1-77,99-128,282-429,459 -469,491-648
atggactattttcgtttttcaattcattttttggtattgcggcaacgaattccattgtcagaaattgtgccgatgagaaatttgagcaataaggaaatattaaccgaattggtggaattgcttttgctgaaaaagagccaaaagaatagagaagaacaaacaaatgggcaaaaagaggataaaaaaggcaaaaaaggagacaaaaatggagaaaaaagaaacaaaaatggggaaaaaggaaataaaaatggagaaaatagcaaatcgggaaaaaagaaaaatgctgataaagccaaagagagtcgattgttaaggcttatgaatacaatggtgaacaatttaaatggcacggcaaacttaagaaagggaggtaaggacaaattcttagaatttaagaagcaattaatttgtgtgctaatgatttatcaaattcttttcttgtttgttttttgagatgatcaacggaaacggagaaaaaagcgaatgcccgacaatttattacgttttatattgaatttgttattcgtcggcataatcttttgcctggtgatgatgctaattntcatgtcnggagaagcgatggttttgacgggaaggaatttgaaagcaaattttgaggaacaaacaagtaatcaaaacgagaattaa

SEQ ID NO: 81722 - DNA, 345 bp, Heterodera glycines
  Genomic contig location: Contig_ID=SeqID_17254; Location=245..589; Strand=+
  SCN-specific regions: Sequence locations=1-239,263-321,343-345
tggggttggcatgatgcctatgttgcaccaaaacatgggagcaatgggcatgggcatgatgaatgttggcagtaccagtttcggcaatttgcaacaatccaatatggttcagtttcaaaaggcgatcggggaagacattgtcggggatatcctggagaaatattttaaaaattgttgtggacatttttcattaaatgaaaaaatcgggaggggcccggcagtgccgaaatgcgtcgccttgggaaaaatagaaaattttcatgtttttagccgaaattaaacaaagaattttcgtgcttattcgctaaacgatagtcgctgaacaaattaagaaattataaaaaa

SEQ ID NO: 81723 - DNA, 387 bp, Heterodera glycines
  Genomic contig location: Contig_ID=SeqID_17255; Location=556..942; Strand=+
  SCN-specific regions: Sequence locations=1-190,213-387
atgaaattttgcgtattacaatccccgaaaatccattttacatttgccaagaaaccaaaaaaacacattcatgttcctaaaattcagacattggcccgttcgatattcattgacgcgctctatggacgagcatttctgttggcagtgttgttatttgggaagttggaacgtctgtattggtctgcatcagaaaaatggccgaaatggcagaaggcaccaactgataaaaccaaagaattgagtgatgcgttcaacgacgcatcacgtctgttcctgttgcatggccctgttcagctgtgggaaatcagtcaagtgtacagtgatgccatccaaaaattcataacggaagaaagacgaaaattcacaaaagcaaaatcggaagtataa

SEQ ID NO: 81724 - DNA, 684 bp, Heterodera glycines
  Genomic contig location: Contig_ID=SeqID_17257; Location=763..1446; Strand=+
  SCN-specific regions: Sequence locations=1-122,147-684
atggtagtcttgatgttgcttaaagccatgataattattgttttaatatgctatgtgattagtaatgacaaagaaaaggataaagcccatacgagcattggtaatagtaaagctcataaatctgatctatattctgataaatctaatcttcaacctgatgatgctcaaattaatcaacaacatcttaatgctaatcgagatagtaacaaattcgatcataatcataataatggaactaataccaattatgatgctaatcaacatgaccaacatcatcatgctaatggagttgatggtgattcggatgataatcagcttgatcagctttatgcaaatcaccaactcgttcaattacatgcaaatgggaacaatgatcaccccgaaaatgacaatcttgatgataacaataacagtgataagtcaaaaatagttgaccttgacgatgaattttgggatcagttgcctgagctcaccaaattgccagaattaaatggagtagagtttgttgggaatcatataaaatacaccaatcaaccaaaaagcgacacgcataaagacaaggaaattaataacagtaaaagaaccttatcttagagaaatttaataatttaattaagtttcggtaaagatggacggaacacagcagaaatcaatttgacattgaaaaggcaagaaaatagctga

SEQ ID NO: 81725 - DNA, 1185 bp, Heterodera glycines
  misc_feature (1163)..(1163): n is a, c, g, or t
  Genomic contig location: Contig_ID=SeqID_17258; Location=5..1189; Strand=-
  SCN-specific regions: Sequence locations=1-618,647-1185
atggccgcagacattgttccgttccatcgacgaccattcgcgttgaccatcgaggatgaatgtctgctttacgcggacagagttgtgattccggcatcgcttcaaaaagatgtcctacaacttctgcatcgaggccatcccggaatgaagcgaatgaaaggtctcgccaggcagtacgtttactggcctgggatggacgaacaaattgagaattttgtcaaaatgtgcaacgaatgcacaatggaagcaaaagcgccggtgaagactgagcttcactcgtggccaaaatctgacggaccatggaaacgcgtacatttggactacgccggaccgtttatgggaaaaatgtttctcataattgtcgatgcatactcgaagtggcctgaggtcttcgaaatgcgttcatcgaattccgcggctacaatcgacaaattgcgatcactctgtgccagttatggccttcccgaaattttagtcacggacaacggcacacaattcgcttcaaaagaatttaaggaatttgtgaccgaaaatggcatcaaccatctgttctccgctccgtacaatcacatgtcgaacggacaagccgagcgttttgtcgatacgttcaagaggacatgccggaagatcaagggagaaggagcctcggaaatgttgaccacatttttggcaacataccggaccacgccttgtgaggctttgccggagtgcaaaagtccggccgaattgttcctgggaaggaaaccgcgcacgactttggacttgttgaggccaaagccaaaggcaccgataattcgagacgaggccatggagaagcaatttaataggcgccatggagccaaaccgagatcttttgccgtgggcgataaggttctcgctcggcatcgtctttctcagccttggcgccccggaaaagtcaccaaatgtaaaggtgtcatttacgacgtcgaattttttgacggaaaattcggacggttccatgccaatcagttgcttgtgagaagcactgacgaaaacggcacaaatgcattgaacgtgttcaatgatgcgtttgatttgccattggcaccaccgctggttcagcatggtggacaagcgcaattgcctgtagtggcacccgctgctgtcatcgcaccagccgtggctgaagaacccgtcgtggnagaagctgatcgagcgcccgaa

SEQ ID NO: 81726 - DNA, 818 bp, Heterodera glycines
  misc_feature (319)..(319): n is a, c, g, or t
  Genomic contig location: Contig_ID=SeqID_17259; Location=1188..2005; Strand=+
  SCN-specific regions: Sequence locations=1-107,129-172,195-522,544 -553,575-613,645-818
atgaaatatttggcctgggacgaaaaatcggaggaaaatggagggaatgaaactgatcaaaatggaacaattggacaaaaggatggccaaaatgtgacaaaaaatgatcaaatttttgatgaaaatttggaaatgaaggaagaaagtgcaagaaattgtgatcaattggaacaaatgcatttttcaaatgcaattgacaaaaagaaaagagaaattgtgaaaaaatttcatagaattaaagagaaaattaagcaaattggaaagaaatattcaaagaaagaatggcaaaaaattgaaagaaaaattgcaaaaaaattgngagtaaatcaaaggaaaatttacaaatggaaaagagaatttggaatgatgaagaacaaaaattattcagttgaagaaaaaagaataatgtacttcagcaaatttgatcaaatatatgcaaaattaaaaatgaaattacatgaaaaattggagggaaaaagagaaaaatgcaaaaaaataatagcaaaacatttgggcatacatatcaaaacaattttttattggaagaaacaattaaaagttggaaaatattttataaatcaaaaaaatgatgatgaaaaaacggaaattgttgaaaaatatttagaaataaaaaataaatttatgaaaaatggaaaacgaaaagattggaacgaatttacagcaaaaattaaacaaatctttggtgtgcataataaaacaattgaaagatgggccaataaaattggaattaatcaaaagccgctaagcgatcctcatagtttaggaatatgagaatttggaaatgaacaaataattaa

SEQ ID NO: 81727 - DNA, 799 bp, Heterodera glycines
  Genomic contig location: Contig_ID=SeqID_17259; Location=2068..2866; Strand=-
  SCN-specific regions: Sequence locations=1-189,211-211,233-273,760-799
  Gene Ontology: Mol. function=protein binding; Cellular component =axoneme; Biological process=N-linked glycosylation
atggaaggtacaaatggagggttaaatatggtacaaaatgagggggcgaggggcacaatcatatggaaaattgttagtaaataagagtgattaatcgttaaataagccaaaaattggcacaaataatggtgattaataaaaaatggttaaaaatccaattctttccaattcgttcgtcacagcggtgacaaaacataaataaataataattagaatttccccaaaaattaataaccataattttagggttcggcagtgccgacagacatcgccaagaaaacaaagtggaagagaaagtggaagaggaacagaaagtggaagaggaacagaaagagaaagcggaagaggaacagaaaggggaacaggaagaggaacagaaagaggaagaggaacagaaagtggaagagaaagtggaacagaaaatggaagagaaagtggaacagaaaatggaagaggaacagaaagtggaagaggaacagaaagagaaagcggaagaggaacagaaaggggaacaggaagaggaacagaaagaggaagaggaacagaaagtggaagaggaacagaaagtggaagaggaagtggaagacgaacagaaagtggaagagaaagtgaaagtggaagagaaagtggaagaggaagagaaagtggagaggaacagaaagtggaagaggaacagaaagtggaagagaaagtggaagaggaacagaaagtgtaagaggaatagaaagtggaagaggaacagaaagtggaagaggaagataaagttaaatagctaagctatttcaattaaaaaaataaa

SEQ ID NO: 81728 - DNA, 503 bp, Heterodera glycines
  Genomic contig location: Contig_ID=SeqID_2808; Location=113..615; Strand=-
  SCN-specific regions: Sequence locations=1-366,394-464,488-503
atgatggctgctgcaacacaatcagcaacggtgggttcaacaccggcgccacctgtacaacaccacgtctcattcatcacgccattgatggccaacaataatgggacaaaagcaatgattgatgataacatgctggtggcagtggtgggcgaccatggcgaggtgggttaattcacgacaactgcgtggtgtactgcttggagttgtcgagtgcattttatatccccatgacgatatttacagggtggcagcggcggcgccgtcggatgctttgaagagccggcggacaagcggtcgcggcacgcgtcgcgcgactcgtgcggcagcgtcaacgatcaggagatcaagcagcttctgacctcgcgccaacaacagcaacaacaacaacaacaattggccgagaaaaaacaacttcaacaacaccagcaactaccgtatgcgtcgtctaccgtaggcgtggttgttcaccaccaacaacagcagcagccaaaaacttttccgag

SEQ ID NO: 81729 - DNA, 3158 bp, Heterodera glycines
  Genomic contig location: Contig_ID=SeqID_2808; Location=1088..4245; Strand=+
  SCN-specific regions: Sequence locations=1-3,157-206,231-463,486 -873,895-1023,1047-1066,1088-1142,1168-1871,1893-2067,2093-2548,2570 -2799,2865-3023,3046-3158
atggctgctgctactgctgtgaattgtgccggtgccgtccaccaacagttgctcctgcttgatgtttatgccgccgctgaagttactgtttttccgactgttgttgttgctccgctcgtcgccggtgccaccggcgccgcttcggctgccgttgttcagtcgtcgccgcagttccgttaccgtagtggtggtacagttactggaactgttgttgttgatgtgagtggtggacgatgccgaaatggccaccggttttggcaaccctattatacaaacagaattcattttttgtcgaaaaactgtggtggggttttttaacttttttggtgccccgggactgatgtgtccgtgccaaaatgcactgaataatttgatgccaaaaagttgcccccccccaaaatgtgacacttttctaaattaattactgttcttctaactcaagtaaattaaatattttcaatttgtggggaaatgattttaaaaaacgtgtccaattttgggggtttttgagccatacataatttcttttgcaattaaatgaaatttttgaatttgtaggctaataaaggaaaaaaacatattatcagttaattaatggtgaaataatacctacgaggggaacttataaacagagcgaaaatatttaccaattaattgcccaatgcgattgtaaaattgttaaaaaaagattttcttggcaaaatgccctcgagaagggacagaatgcgtgcgattgggggaaaaacaatttttggcgaaatgccacctgctgttgacaatgaaccgactaattggttgattgaggtgacgaaaatgtgaattatcattacaaattgcttacttgtctaatgaggcaattatgggtgtgtgtgatggtttaaaccaacattttttggcgaagtgccctgggggaggggggggggggggacgcgcgttaataggaggaggcaggcaaaattaattagccaattaacagatgttagttattgccccgagagggcgcctcaggcaataataacgaacaaaaataaatttaatataaaaaacagcacattttgggttaaacggtccagcagcaggtgcactatgtttcacgcccgggagcaggtcgttcccccccccccccgtcgtttcccctcccgaaaaattttttttttaaatttttttcaaacctagaaattttttcataaaaaaaatcgctgaaaaatttttcaaagaatttttttcttgaaattttcttactaagaaattttctaagaatttttttatgaaaaaatttctaggtttgaaaaaaaattttggggggggaaacgacggggggggggttttttttttgccggcccggccgagtcggacagtgccgccgactcagtccctccggcagccatcgatttggaggcgcctcgtcggaagctcaatgctcggccattgccgaacagcagctgctgtactcggtggtcaatttcgatggatgtgcttaatttgcttcaatgagggacaaaggagcgaatcattcggaaattgaaccgaccgagcgccgctttcgcaatctttgacatttcgcatcagcgattcgctatgctttttggactgcaaaaccctaaatgatttcagtcagcattaataggcaataaaatggtttgctttgagcagggaaaaagcgacggaagcgtttccttaattaggcgattaggagcgaaatgcgtttgaccgaagttacccagcaaagcaccaccccgggccgttccatccgaagcacccacgggagccaatacagcagcagggcgcgggcctgacaaacagagaaatcggccgtccgttcatttcccaattttcatttcaaagtgccattccctcccccgtgccagttccaaaatttacctttctttgttcccaattcatttctcccacctttgttcccatttcgtgtgtttcgggcgtccgatagtgcaaattcagcacataaacagtgaaaacggtggatgctgtgacgatgagcatgcaactcgagaagaaaaggccgaggaggggcaccgcctcggaagtcggcggagacatttcggaaagaatggagagaaagaagcaaatggacaacaggacggtgatctcttaaatactgtcattcttttgagtagccaacaccaatttagccataatttgccaattactctttccctttgatcactcctcagtttggccacccgccaagggtttagccggaggcatttcccgagaagtggggctgtcatgggacgccttcttcccccattcattttcgcacttacgaagtgttattttctcccccgcttcaggtggtaaggtgaagccgagaagggacattgtcgtggtgagaaggcacggcattatcaagttaaagccgtagtaaagagtccgtctgaaatgtcaacgaatgggcttaaatggtcgactttggcattggtcaccttcgcatgtgtaaaaagaaagtcaagtcggggtaaggctcgttaggacaacaatcgtaaaatttctcagttctggctaccgtagtcactgtaatttccggaaaagtatggcattttaacaaaatcaaattgacttggcaaagcccattctccgtttggcaaatattcgctggtgtcgaagccgccttccgcaggttgcaaatcgacgtaaaagcctggcaaaaaaaggaaagttaaccaaggatggattggagaatggacggcggacgaacctgaatatgtccaagagccgaatttgaagaagcaacgctgctcatcaaaagggaacctaagaggagaaaagagagtgcggggaagagagagaaagagtaggagagagagactgaaatgggacatagagggagagagagagaaagtgaggcccaattggaaggaaacaccgtccatggccagccgacaaacgaaccaagtgatgtcgattttgcagctgattttaaagatgcccgggggaacccaagacacatttccatcattgtacacgatcatatttgtggggaaagtcgagtcgaaactggcgtccacagaattgtacaacagaacatcgggcctccaaattttgccaacgggaaatcggacattgctacaagaaaaaacgcgaaagattggagaacccgcggagaatgggacaaccgaccttatgttaccgtactctga

SEQ ID NO: 81730 - DNA, 1891 bp, Heterodera glycines
  Genomic contig location: Contig_ID=SeqID_2810; Location=1404..3294; Strand=+
  SCN-specific regions: Sequence locations=1-263,293-406,428-442,512 -515,537-649,671-1136,1160-1230,1252-1891
  Gene Ontology: Mol. function=cystathione beta-synthase activity; Cellular component=cytoplasm; Biological process=cysteine metabolism
atgccatatgacccgagggcacgggaagagagttgttggcacgaggacagtgttgaggacagattcggccgatatcccttcagaaagtacccgtaagtacttggctgacagagggtaattagatctaattggctttacttaccaggaatgagaatccagcaaagattatggactctgttctcgatgcaattggacacacgccaatggtcgggcaaagttttggggtgataggcaaatcgaaaaagtcgcaaaaatatttaaatgagatttttatttattttgaagaatatgagagaaattacatttttgaatacaaattttaatcccttttattctttccttcgaaattatttcttcaattaaaattccctaccacgcaaaacaaagctcggcattcaaatgtaataaaatgaaagcgttttatatttataatgtgccattgaatttttatttttacaaaattatttatattgaaataattaaattaaaatacataatttacaattttattgcaactttttggttcaccttgggaaggtccctaacccaatcctgggaattgcgtatttcgacagtcgcacttcaaattgaataggcgtgtcgtgtcgtctttcaaaagtttctaagagttaaatttttccagcaattttttgggcatttcgttccattgagactttttcggttcggcttacaattagcagctttttgcgtgtgttcttccttttctttgatcattgttttttaaaggtaaagcttcagcgaattccggcggaatttggcattgagtgcaatgtttgtgagttttttggcatttctcaattagtgcacaacaacaaaattcaacaatgaatatgagctaaatttctgaaatagagaagaagaaggaaacattcccgagaggaaatcccatggatcaattaaggcgataattgaccctaatgaaatgatcaatcaaattaagctggaactgtagttcattggtaattttatactcattaccaatattttgagacggaaaatgcgaatttttcaatgccggcggttcggtgaaggaccgaattgcgctgaggatgttggaaatagcggagcaaagcggcagactgcgtgccgggatgacagtgattgagcccacctcgggcaacacgggcattggccttgctttggcatgtgccgtcaaaggatatcactgtgttattgtgatgccggagagaatgagccgagagaaggagctgacgctgaaggcactcggggcaaagattgtgcgcaccaaagacaaagcgcggtacgacagcgaacaatcgcacatcggcatggcgttcaaattgagaaaggaaacgcccaattcggtggtgttggaccaggtcaatcgcaacggaacgggtgccaaaaggggagggagcagtcctcggcacttttagtacaaaaacatcgccaaccctttgacacacttcgaaggcaccgcggcagagattctggacgcgttggatggcaaagtggacatggtcgtcgtcggagtcggtacggcagtccaaactcagctttgtgccattcattggccaatgaattgccttaggcactggcggtaccatcacgggcatctctcgcagaatcaaaaaggccaacccgaactgcataatcgttggcgtcgaccccatcgggtccatcctcggcggagaggacgaacacgcaggacataagtacaatgtggagggcatcggatacgattttgtgccgacggtgttggacatggaagatatcgacaaatgggtgagtggcatttcgctgctgtcttatcggacggaattgcaggaaaaagttggggacctggacacttttcaaatggcgcggaaaatccatcggatggagggaattctcagcggaggatcttcag

SEQ ID NO: 81731 - DNA, 1182 bp, Heterodera glycines
  Genomic contig location: Contig_ID=SeqID_17265; Location=132..1313; Strand=-
  SCN-specific regions: Sequence locations=1-79,169-436,466-534,573 -657,689-934,957-1182
atgtgctggcaacaggcacgggacagcaacccggagcgccggttccagtacgagaacaggttcagctggacaatggacaaacaacaccaccagcaacagcagcaacaacaacccgttgaaacagttcaattggtgcagcagcaacaccaacaaccgcagcagcaggagaaatttgtgatggtgtgtgtgttcatttacttgatggcataactaggggacacattggcatagatataaaagattttaaatgccattgaaaagagtcgtgaaacatcgcaaattgaaacggggtcccctcccccctcttatacatgcacaattaaacaccacatacaacggatgatttgacctaaggctgggggttgcatggaaaaatgttttcatacaacatccgccaaagttgctccaacaattagaaccaactattttttgattcttttatttatttatttaaatgattaaaaagcaattttattttagccatgcttcaatcttcgtgccagtgctggtttgccaattggagtgccgcaaatgcaacaatatcatcatcatcaacaacaacaacaacaacagtttgttgcgccatcacaatttgttcttcaacatcagcgtcaggcgtattgtacaaacggtgtgcaaattgttttcatgtttggaaaaacattaatggaaaaagaagaaaaaacttaaccgcaaaatcttcgatttacatcgcttgaattgttcaaaaaatgggagcagcttgtttccatacgccgttccctaccatctcagtcccacaccctcccgcatcgttccgctcccccccccccccgaaaattttttttgattgccggtttagagaatttttgaaaaaaagcttataaaaaattcactaagtttaacagtttaaaaaaaattcgggggagggggtgaaacggcgggtcgggaggaaccggcggggggggggggggcggaacgtagtgcacccaaaaatttggttgacttcctccccctacctttgacatttcaacatgatcgctatttaaaaaaaaacaaattaaatgttcagagcacatatctccggctcatccgataggcattgcaatgccaagtaacaacgttcagttgccggctactggtcctactgtagcccacagtcattatatgctattaccagcaccggcggctcatcatcacact

SEQ ID NO: 81732 - DNA, 1629 bp, Heterodera glycines
  Genomic contig location: Contig_ID=SeqID_17266; Location=901..2529; Strand=-
  SCN-specific regions: Sequence locations=1-254,277-463,485-620,661 -838,874-894,916-1241,1264-1281,1329-1334,1356-1435,1457-1629
atgacgtcaaaggtcggccgggaggagatcatccaactgttcagcaattatggaaaattgttgggcgtcaccgtgttcaaagggtacgcatttgtccaattttcgtacggcaccgaggcggatttgtcggtctccgcactgaatggatacaattggcacggcgcaacactaggtaatgacatttcttttaaatttttaggcctctgtaatcagcagaaattgcctttaattaagattttgggccaatttcctaacaaaaattttgaaaattcttatcgccatcgctaaagtatatatagtacagagtagggttatacgggcccgtatgcccgaccgggtcaaaaccaggacacctgactttttcagtacccgggcccagtaaaaatttgggccatcggacccgagcctggtttttctgtatccggtagtacccggacagttttttttttgccaaaatacccggacccgcttaattctagaagaaaatcagaatgggtgcctccaaaaagcgactacctcgtcgtgttcaaaaaccgtatagaggagattcgctggaattttatttccttttttttgttgtaaaattggcgtttcaatagtgcaaatattaactcggttttcccatttaaaagcattcattttttcacatttgacagatgtgaaattggcaatgcatgggcaacaaccgacgcccggtgtgccgccgcctgcgcaagcgctgaaacccatttttggcgcctttccaattggagctcctacaaaaagcattgtcgggttagaaatcgaataattaaaaaaaaattatggactatgggccttaaaaaaatcaaaaaagtccattttaattgaaaattttcaaataaaaaaaaaattgtgtcgtccccaatttaaggaagcgcaacaaaaatgaacagccacaacaggaggcggctgccaaggacttgaagcgcatgaaaattgacacggccactggtgggacgggcgggggagcagcagcacctgctgggtcggtgaccgaaagcgtgccaaagaatggcgcaaacaaagcattcgctgcgcaaatggacagcgctggcattggcactgttgtgccgccgcatgcgaatgccggtaatggcacggtttgcacaccgccgccccacttacgtccctggagtagggaagcctcgccgcaaagaaaaaaaaaatttttttcgttacctagccttcggcaaaaataattaaggaattttcagggcaacaaaaaaaaatttatttttttttctggacatttccaaattcttatttaattataatacacttaaacaataaattttttattattttttgacaatttttgttttatatttgctgtattttagtcggtgatatttggagggtggggaatacaccgtttccactcatcaaaaaaattgctttattcaactaacttcaaacaaaatttttcagaaattcttgacacattgatttgcggagggtgccgtttcgtgacgcacagtttggccgagtttgtggagcaccgaaagcgtccttgcaaattgccatccaaaataggtcaattgggaaccccagaaattattgaaattgaaatttagacaaattgtagactttttcattgataaaaataaa

SEQ ID NO: 81733 - DNA, 138 bp, Heterodera glycines
  Genomic contig location: Contig_ID=SeqID_17267; Location=442..579; Strand=+
  SCN-specific regions: Sequence locations=1-138
atgactactaattttgtttatatgcttaaggaacacccaaaaataactaaggacaagtatcaacaaatttgggagttggaagaaaatccgattgtgatttggcacgatggttcagttcatttcaacagtgttcgattg

SEQ ID NO: 81734 - DNA, 1840 bp, Heterodera glycines
  Genomic contig location: Contig_ID=SeqID_17268; Location=75..1914; Strand=+
  SCN-specific regions: Sequence locations=1-227,249-378,415-433,455 -622,648-703,726-885,908-1002,1024-1102,1126-1150,1172-1297,1319 -1363,1386-1591,1620-1727,1750-1840
atggatccaggcctggatttttccttgatcaagatccagaccaatcatttttgggctacctgggtttttcctggacctggattttcctgggtttttgtacaggaaactccaggtaaaatatgaaaaaaatccaagtcttggtccaaattaggcacaaaaacctggatttcctgcataattttgcccaggccaggcaattttttggcagctgggtttttcatgggattggatttccctggatttttgttcaagaaatccggtccaggttaaacataaaaatccaggtctaggtccaggttaggcaagaaaaaacctggatttcctggataataatgaagaatttgttatttcgagtgaccatgtttcatttcaattttcaaaaaatagttaaatagattaaaaaaaattattattgttggttatccaggcctgaatccaggccatgaaaatcctggagttttcatggacctgggtttttgtccaggaaatccaggtccaggctttttttctaaatgacgaactctaataatatcctttattttgccaaagtcgttatccggcattcttgtacgtttaaaattactatctcaatcagaaaaatgtgatccaaaaattatttccaatcaaatcattttttaaaaatttttcggcattttaatatcaccaagaattttcaggtggattatcctcagcaagatgacactgatgattcagcagatgatgaaagtgacaaagagaaatatgactttttgtcatggcaaaaaaaattgcgtcaaccgcaacgatcatttaaattgccatcggagagcaaatacaatccgttccaaagatttgatccatttcaaagattgggtccgtttcaaagattaggagtttacggtagtcgaaaggaaatggaaaattatttggacatttttggcaatgaaccgtcctcttccgtgacggcaccgctaattggttccatcaaaaatgcggtaaaaaaatgacgggaatgaaattaattagttaatgaatataattattgttgatataattgcttttaaagcccggaatagggctcgttggtactgagatgggctttttgctcgaactttcttagagaaaaattttggaaaacatctcaaaaaatgcggcaaaatttttccgctcctggccttaaaatttagtttgtaggaaaaagccgtcaggcaacagcatgccaaaaagcccgttttggccaacggagcgccgaacgggacttttccacggctttttaaaacgggcttttcgtaataaatttctttaccaagattgggtattaatcaaatttggcttacaaattagcattaatgttagcatgagagatatttttgagaattacaaaattttcaaaaatttgataaaaaatacgcttaatccaattaaaaaaaatcgacaatttgaaaaggcctaagtctattcgataattctttaagataatacattttttcgaaaatttccgagatgtcagatttgcagaaaacgttattaggtgtacaatttggcaaaaaaaaaattaaattttccaattacctaactgaaaattcgttggatcaataagggcaaaaattcaaaaattaaattccaaataattttttaggagattgatcaacagaacagtgaggacgagaaggggagcagcaccagcacaaagcgtgtaaatccattcctaaagccggatggaagcagctacaacaaagacaaggatgaataaacagaatgccaaacattcgaaggaattgatcaaattcaaaaaaaacgattgtatttatagagccctcacccaacaaatattggcacatgttatgaaatgaattagtta

SEQ ID NO: 81735 - DNA, 1671 bp, Heterodera glycines
  Genomic contig location: Contig_ID=SeqID_17269; Location=1844..3514; Strand=-
  SCN-specific regions: Sequence locations=1-393,416-804,826-928,950 -1383,1405-1531,1556-1671
atgtctgacaaccgaaacgaagcggagcaaaagatggcgaaagcaatgtaaaattaaaatgccatttttaaaatttcaattttaaattttgttttcctttttttcagctttatctccgccgattgttggctttgtgtgtacgatctgcttccggcttcacaacttggccttggaattgcgatgatcagccaccgttttgacttctacgtggatgaacacttcaagactcgtcgctggaatctgggatcgatgaaaatcaaaatgaagttcgaagcggatggcaccaaggaaatggatgttgtcaatgccaatttggaatcgtttggaattgcgcaaaagccgttgccaaagagagtcgtcggattcaaagccatttcattgaagtgagatagattttgatgcttttttgtttgtaaacacgattccatcatttttcacaggtacttcaacgacaatgtgatcacttttctcggccgttttcgtccaatcttcgccgcccgtccaattaatttgaccatcgatacattcaaggacatggaattgattttgcgcaacatttggccaatgatcgcgacaaacatttgtgccatccaattgtccaccacatttttccgctatttgcgtgaattcgtcccgtcatttctcgacgactgtccatcgcttcgcgttgtcaatgcctattcctatggtttcttcgccgaatttccatgcgatgacagtgccaatgcttcgaatggacaaactctggccaaatggcttttcactccccgttcggacaatgtgccaaaggtgttcaaatgctggttgtacatgaattttcagaattggtcgtcaaggattgaagccttcaaatcggtgatttcgatttgattgttttatttggcatttttatggtctttgtggggttcgttgagaaaattattttggacaatatttcaactcgtttttggcaagttttttggcacacttttaatttggcggcgccaaaatgtcgcgctccaaagtgatcccgaccctctctgggttttcgtgcctcctcccccaaccgtaaattgtcattatcttttattaaccaatttttccctattttaggcttttgccaatgcttcatctccagtcaatttcattgccatcattcactttccgtcgccttttggtttctccgttgtgccatttgatctgatcaacgaattgacccgggagcaattgacgatgaagaagatgaacgatatcaaccgtgttcttctgatccgttgtccgattgtgcgcgacgaaagcaaatgggccaaatgggaagaagaagcgattggatggaactttatggaccagtggaatcggatcgacatttgagatgggtcagtgaatgaataatgcttattcaaatatccaaatttattgcttttcgatttttaggcctcttgacgcaatgatcgatccaagtgatcagaagcagaaatgactgaacgatttgttgagaaatgatctatttaattgatgtggagttggataatgaatttgagcccatctgatgtatataaaattgttgttttgttgcgatgatcacaaattgtattatatatatatatttgcccttaggataaattgactgaaattccaggctcattcttttgacttaatgataaagtcggttgtcactttccctccaataaa

SEQ ID NO: 81736 - DNA, 505 bp, Heterodera glycines
  Genomic contig location: Contig_ID=SeqID_17272; Location=631..1135; Strand=+
  SCN-specific regions: Sequence locations=1-223,245-505
atgggctattatgcaaccgtaagctgtccgatcagagactttgttcgagttgcggttttgctaccaaaaatccaacagatgctgttatccttcgacttgaacttcaagatctaatggataaagaatgccgccaaaatacaacaatgttcaccagcagtgctcaaaagtatcttggccgtaaagcaagcgaaatccggatgatggaacaggacggagacggggaagggttggctaggcttttagattccttcattggaaagaagattgtagccaaaatagctattaaggtattatgctctataataataatcgactaaatttaacttgttcacttaaaaaaaattatcatatcgataatattaaggaaaaagacgccaattggggaggtgaaggcagcagtttgaataaatttgattgggtcgttacttctgttttcgtgcaatcattggagcctgctgaagcgtacgctaatgatgacggtgaacaacagaaaaccgaagaatga

SEQ ID NO: 81737 - DNA, 1017 bp, Heterodera glycines
  Genomic contig location: Contig_ID=SeqID_17272; Location=1372..2388; Strand=+
  SCN-specific regions: Sequence locations=1-209,231-1017
atggcttctgaaagaaaaaaagcgaaaattacggaaaacatctgtgggcagagacagcctcatccaaaacaaccgaaatgggatttccgttcaattgcatattttgaacaatatccaaccgagtcccaaatggatgaaagtgtgccaacacagcattcggcagctgacattcgtcaaacaggcatgggccaacacagcatatcgacaaatgccgatggtggacaggaacagaaaccgttgtacgaggaaatcaccaatcatatacacaagatggagcgtttctcggtgcaacgccatgtcactgaatttgtgcttaatgctcagcatgaacagccagatgaagcgctacgtcaagcgttacatcaacttgtcaatagagctgtacaaaatgcggaaaagcaaagcggacgctctgtttcaaaattaggaataatggtggctggaaaaggattaaccgatccggtagtgctgcctttgaggcctccagcacaaaacaatattgacgttgtaatggccgagatggacaaacttggccaaagcgagggagacgaaggaggcgttaacaaaaaaactttgctactcagcgagccggtggagatcatcgttacatgtttaactattccggcaggatcggcaccacgattctttccacatcagaattggggctacaatcaaacgcaaataattcatatatccaaccgagacaactattgtctctttcatgctcttgctgcaggccgagcttatcatgattatgaaatttttcgctccagtcgtagtccaccagataaccaagctccactttttgcagctataaagaatagaacagacttttgcaaggattatgaagcgtataaccgtctattatcaaacaccgggcgaatggaatctgtagttgaagatctgatgaagaactcaggcatcattattggccaagattcttatggaattgaccatctgctacctgttcagcaatactgggtaatttttgtctacaattttaatattttgtgctga

SEQ ID NO: 81738 - DNA, 2512 bp, Heterodera glycines
  Genomic contig location: Contig_ID=SeqID_17273; Location=346..2857; Strand=+
  SCN-specific regions: Sequence locations=1-37,60-246,268-478,500 -657,679-1447,1470-1624,1646-1811,1836-1862,1885-2325,2348-2512
atgaaagaagacgtgaaaatgctaatcgaggcatgtgaaaagtgccaaatgaggaaaatccagccagggcaggccaaatcggctccgagtgtccctatcgaaccatcaaatagcccatttcaaagaattcattgcgacttaatgggtcctttaaagagaaccgaaagagggaatttgtatattttcttggcgattgatagtttttcaaaatgggtcatggccaaagcaatcccggatcagaaagcgaatactgtatcagaaatttttgttgaaattgtggtccatcaacattcaactcctgagattgttgtgactgatcagggaagacagttcacttcgggaatttttaatgatttggcaaaaatatatggttttgagcatgtcactacaacaccatatcatcaacaggctaacggaatggccgaagggacgatgcgtataatggctaatattatttctcaaatggtcaatgaaaaagggaataattgggatgaaattctgccgcacgctattttttcatataatgtttcaatacattcggctaccaaattttcgccattttttatcattaatttacgacagccaaaattaccaactgatcgattacttaaactcccatcccccgatgagcttgtatcagatatttcggtctataccagaattcagactgaaaaagctgctaaagcatgggaaatagtgcgaaatgaaattttaaaagcgcaggaaaggaacagagaagagaatgatcgaataaggaaagcaagtgaaagagaatttgaaatcggtgatttagtgttgtttaaaaaagaagttttaagccataaatttgatcagcgttggctgggaccaatgcgttgtgtaggcgttgaaaaagaaaagaaaaatgtcattttacagtcaattgatggaagagccaaattaagaaaagtacaccaagaaaaagtgaaacattttaatggaccagcaattcttcctctaaggcagtcagatgaaccattaaattgggaaaagtacgtagatgatccgaatttagaacaggaagaaattgaaagtgaaagtggcgaaagtgactgtgaaaaaacgcaagagaatgaaaatgcgcaaccaaaaaacaaaatgggattaaaagtttcaaaatatggctttgagagttctgacgatgagaatgattggaatattgttgcgtttgtaagagaaaaccaaaattctgaggatgatgaaggcccggaagttataatggacagaaaccccgaaatcgaaataatgccaattttcacaatactcgaagtccttattgagggttcatttactgaagtatacaccggatggagagaccccgtaacaatctcattaatctcaagcatacctgaaaacctagtaagggaaaattgggaaatttatgttaatggaaatggctcacgatttgttatggcatggatttttggcgaaagttttgaaattttcattgtcaacgaatttgatcaaattatgttgggaattgatgcgcaaatgttgttgggtgaaagatggcgaataaaaaccgaaaatgaaattgagacatattgggaaatttacttcgatgaaaatggacgcgaattcgaaattcccagaattcctgaaatccttttttcagaaaggaaaacttggaaattgggtatgggccaaactttgtaactctccgagattcagaaggaatgataagtgatcaggatgatttagaggaagtaaatgatttttcaagaacagacattaatgtgataaattatgtaaaaccgtttaaaaatttattggatttttcaaacgaaattgatgaagatgaaggaaatgaagaattagtggaaaatgccggagaaagggagagaaatatgaataattctctagaaattttaggaagaatggaaaacgaacagttgaatgaaaaagggcggctgaataaattggataaaaaacaaaataaaagatatgaaagccattcgtttttcaaggaattggaccgaatgacatcaccggctccattacatttcgaatctttgattgaggacgaagaagaatcactgagacgtttggaaagacgtctgcaggaacagctgaacaaagtgaggcagacgttggcccaagaacaactagaggagagccacgtgaagacaagggaagaaaaatgccttgagcaactgaagcaacaaacggtacagagtacggtaaaccaaaaaggaacggcggaaaaagaagaaaaaagtggagaattatgtaaaaaaagagaaagtgaggccaaaaaagccgaaccggaagcaaaagaccgaaaaacggatgaggaaggacttgtacaagcaaaaatggagaaagagaaaaatacggtggaggatgtgtgtctttaggagatgaagaagaagactctccttatgaagcagcgaaggtattcgagacggggacgtccttttttgagagcgcgggggtgcgagtgaattcacgtcgggaacttgaggaattgacaaaatcccgaaatgaagcaaaa

SEQ ID NO: 81739 - DNA, 391 bp, Heterodera glycines
  Genomic contig location: Contig_ID=SeqID_2811; Location=1675..2065; Strand=-
  SCN-specific regions: Sequence locations=1-30,52-73,95-391
atgaaaattagacataaatcctactggaaatttgtcaaaatgattaaaaagttaaagacattatgccaaagagatatttttcaaagaaaaatgaacaaaagtgaaggtttttggttgagaccgagtcggaccggatccggtcaaaaattctccggaccggaccggattggcattttcaaaaatgaccggattccggatccggtctctcataatccggtcaatccggtaatccggtcaatctggatttttcccaaaatcgccggaccggattgccggatccagaaaaatccggtaccggatccggtccggctcggtctctaattattatataaaaatttggacaacttttcagaaggaagaccatctttaaagcgcatgaaaattaaataaa

SEQ ID NO: 81740 - DNA, 1059 bp, Heterodera glycines
  Genomic contig location: Contig_ID=SeqID_2811; Location=2121..3179; Strand=+
  SCN-specific regions: Sequence locations=31-45,70-144,169-315,344 -417,484-562,592-613,778-808,958-979,1002-1005,1042-1059
atgagttctatatggcaaattggtctatttaaaaaaacgtccaagactacagcaatttgtctcgagtgtgaagcaaatgtatattagttttattatgataaaacattcgcttttcataaatttatctctgccctcacttttcttattaaattatgaaatacttttatggaaattgtcttaattattaattatattggggtggaaactaagttctgtcatagctgggagaaattgtttattaaaatttataacaaatcaaaacgaaacccataaatcactcaaagtatctcccctaattctccacaatcttctgccatttttgagattttaaaaatgatctattgattaaatttgtgcagctagacaaaaactagaacagcagaagtgtttttcgtacaaaaaaattacagtaattacaaataatataattttttaaattaaataattgcataatattttatttcatttagatattaattttttgcagtataaggcctaagtctggaaactttttatgaatcatcattttattaagcgaaataagaaagaatttatcatttgcttttatttttaaattataacatttaattagtattgtcattaatttgcttgcaattttaatatttttttcttttatttttataattatatattaatgtttatattatttgattataaattatttgtgtttgaagtcaaaatgattgtttttaataggttaatttattttttatgaaattttttaaattttttaattatttttaattattaaattttgactgggtttttaatgtgaatattaaacaccatttttttatataaatgttttgaataatttgaatttttttttatttggtacatttcttctaaattttatgaaaaatatttttttaaaaatatttttagcaataatattatgaaaacatgatttaatattttgtgtaaaaattttttattggatttttgagcatttaggtttataattttaatttgtttccaagaatgatttataagtttaaatttttttatttatttaattttctgctagaatccctataa

SEQ ID NO: 81741 - DNA, 1420 bp, Heterodera glycines
  Genomic contig location: Contig_ID=SeqID_2812; Location=1954..3373; Strand=-
  SCN-specific regions: Sequence locations=1-279,309-484,517-671,694 -866,889-927,969-998,1035-1159,1181-1333,1355-1420
  Gene Ontology: Biological process=protein biosynthesis
aggcaaaggaattgcacaaagtgagcgcacttttgcggggccaaagtggactgatgttcaccaatgcgaaggcaaacgaagtgcaaaggtcggcgggggataattccaattttttcgtaaattgatttctttccgtttttggcgggggcgcatttggtggaaaattttttaaaggttctacgaattagaagcatctcccttttttccattttgtttgcatttgccgtcccaatttttaaaacagaaaattttttcacttttttttttactttgcgacgcttttttaaattctttttttttttaaatttcagaggcacttacacagaagagacagtaaatttatagtcagtcgtatgtcctcataattctatgattattcatcttgtagcaaaatttaaaaaatttctgagtaaaaaattttcaaattttttagttttccaatttcgttccggcgaatggaatgcttttgggcccaaaaagcggcaaaaattaaaaaaatcttataaattaaattttctaaggtttttcgccgagcacaccgaggctgagtttgcccaggcgggcgccgtcgcctcggcggacatttcgctgccggccgggccaatgccggcggaattgcacttgcacggcgccatggaaccgcagctgcgcaagttgggcatgcccacacggctggaaaatggtgggcattttgggggaaaatgggacgaacttttaattgcaatggcccaaggttttgaaggtgttcgaatgcaatttgttgctctattgttgcagttaagcgtcctatcaatagccatattttcattttctttggccataacctttctttttcctacttggtcaatccataccaagcacctagcctgggaatttcaagaaaaaatgtttttttgaaaattttaagacaattttcttaacaaaatgttttaaaaaataaattctttttaaaaatttcttataattatgctcatttgtcagatgccgccgtcaagcagaaattttttttttttttgtaaattattttaaattttcatgcaaaagggcgaagaattcccttttatctggcagccatcgccaggcaaaatttttgaaattttcctgcactttgtgcgttgcgtaataatgtgccgtccctttcccctgccatcgacaggtgcgtgccattgagctgttggaggagttcactgtgtgcaaaacgggtgaccaactgtccgcggaccaggcccgcattttgaagcagttcggccatcggttggcccaattccgcgtgcgtctgctcgcccgatggagcaaaaagaagggatttgaacagatagacggaggagcggaagaatgaatgaataattgttgtgttttttcggatggacccatctaccaatttactttgttaaatttgtttttttatttaaattgaatt

SEQ ID NO: 81742 - DNA, 1296 bp, Heterodera glycines
  Genomic contig location: Contig_ID=SeqID_2812; Location=2574..3869; Strand=+
  SCN-specific regions: Sequence locations=1-107,130-284,317-492,522 -815,841-978,1000-1132,1156-1296
atggctattgataggacgcttaactgcaacaatagagcaacaaattgcattcgaacaccttcaaaaccttgggccattgcaattaaaagttcgtcccattttcccccaaaatgcccaccattttccagccgtgtgggcatgcccaacttgcgcagctgcggttccatggcgccgtgcaagtgcaattccgccggcattggcccggccggcagcgaaatgtccgccgaggcgacggcgcccgcctgggcaaactcagcctcggtgtgctcggcgaaaaaccttagaaaatttaatttataagatttttttaatttttgccgctttttgggcccaaaagcattccattcgccggaacgaaattggaaaactaaaaaatttgaaaattttttactcagaaattttttaaattttgctacaagatgaataatcatagaattatgaggacatacgactgactataaatttactgtctcttctgtgtaagtgcctctgaaatttaaaaaaaaaaagaatttaaaaaagcgtcgcaaagtaaaaaaaaaagtgaaaaaattttctgttttaaaaattgggacggcaaatgcaaacaaaatggaaaaaagggagatgcttctaattcgtagaacctttaaaaaattttccaccaaatgcgcccccgccaaaaacggaaagaaatcaatttacgaaaaaattggaattatcccccgccgacctttgcacttcgtttgccttcgcattggtgaacatcagtccactttggccccgcaaaagtgcgctcactttgtgcaattcctttgcctaaattggggagtgcgttatttttttttaaatttaaatttacttccgaagggggggggaggaaatttctgaaaattgctattattttttttatcattcaaaaatcactctttttgttacaactttcaatttattgcccaatatgaaaatgtccttaagagaaagtgggaattttttgcgtaatttattttgaaaaatttttgcattaaacagatgcacgaccattagtttagagggagggcgggagaggcacgaattttaaacaaaatgctaattaattttttctggcatgtgtcaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggtcagcgtcagataaaccaaaaaaaaaaaaaaatctgccaa

SEQ ID NO: 81743 - DNA, 627 bp, Heterodera glycines
  Genomic contig location: Contig_ID=SeqID_17274; Location=1682..2308; Strand=+
  SCN-specific regions: Sequence locations=1-228,250-289,325-627
atggaaaagagattgaatccatctgcacttcctacgcttatgttatcgaatttcggtggttattcggtggagacactttgcacgcttgggaaggagttcgtattggaacttatgactcggatgattaggtaagtcgtcacttacagtttaatagctaaatttatttttcatactcttattgaatttggaattcggtcccacccttggagaaagattaccgataaccaagcaattaattttaaatcttttcagcattgtgagcactttaaaaatggatattaaaggagacaataaaaaagtaaattttaattttgatttaaaattcatttgcctttcaaggatctagacattgttcgaattcaacttgattattctcgtctcatttttctctgtcttactgaggttttctcattttgtacactgatatttctacattgaaaatcgtttttattaggtccgtcttcgcatcgatttaaaacttgctgagggaattggagagaatcagaatttgaaagatgttcgtccttctgatgaacggctgttggagctcctttcagagccgaatcaaccggaagaaaatgcgaaaaaggcaaatttggcagagagattcgaacaaaacagaaagga

SEQ ID NO: 81744 - DNA, 133 bp, Heterodera glycines
  Genomic contig location: Contig_ID=SeqID_17275; Location=2378..2510; Strand=+
  SCN-specific regions: Sequence locations=1-133
aatcaacaattttcctgtttttttcccaagggttgtcgccaataacgtggagcagccggccaaccgtgccaagcggttcacctcctttggctcattgtccaccattgggggccgcgttggatgtgttgtgtcg

SEQ ID NO: 81745 - DNA, 304 bp, Heterodera glycines; identical to SEQ ID NO: 51570
  Genomic contig location: Contig_ID=SeqID_17276; Location=81..384; Strand=-
  SCN-specific regions: Sequence locations=1-304

SEQ ID NO: 81746 - DNA, 304 bp, Heterodera glycines; identical to SEQ ID NO: 51570
  Genomic contig location: Contig_ID=SeqID_17276; Location=587..890; Strand=-
  SCN-specific regions: Sequence locations=1-304

SEQ ID NO: 81747 - DNA, 1419 bp, Heterodera glycines
  Genomic contig location: Contig_ID=SeqID_17277; Location=621..2039; Strand=+
  SCN-specific regions: Sequence locations=1-597,633-982,1004-1419
atggccgatgatgatttggaaattaaatttaagaatcttcaggggaaagtcagggacttggaagataaattaatgggccataaaataataaatgtaccatcggggattaaaatgcctaaatttgatgggaacggtgacttttataaatttttgagggaatttaatatgtatgccactgcggcggggtggcatccgccggaatgtgtgcgattatttcctctcttcctagaaggggaagcaaaggaaatataccagaacattccaggggatgaaaaaaagaattggcgaaatttaactgaaaaaatggcagatcagacaaagcgtctggacggaccaatgtgggcacgccgaatgttggcaaaaataaaaatgggaaaagaaacggtaacagaatttgcaaataaagtgcgggagttggtagagcaggcatctccgaatcctgactacacaaacgatgctcgtgaaaatgagagcatccactactttttaagtgggctcccgacaaatttaaaacgcaaattgtttttcatggaaaaaccagatacgcttgtcgaagcgatagctcaaacaaaaagggtacaacaagtcagagaagagttggaaaatgacgaaaaaggggatgaattgagaagtcaaattgctgagctcaaagagcaagtcaatgcaattgaaattaataataaaccgaataatgaaataaacggaggcagacaatttatgaattcgaattggaggggaaacatgcggggcagaggcaattttcgcggattaaacagggaaaatcattggagaacgaaccaaaatgttcgccaaaattttgcaaatagtagaaatatcggaaattatagtaataattacccgaggaatcccaattatatgcctctgggaggaaaccaaaattggaataacaacatgggaaacacaagaccaggaggattttggaaccaacggggcaattttccgaacaatcgcggaaatttcacaaatttcagaggaaatttacggggacaaagaaatgaccaacagagatacagaataaatatggttggtgaagaaagtgaatctaaaatacaaaaaagccgttcaccaaccccggcattaacttttttaacaatttctacaattttttgcttattatttgggggatcaatggcacagtaccaattatgttctgaacgagttgcaatgaccaaagtttcattaccaaatatttcggactgtaaaataccggaacagcaaaaagcaacagaacgaaaggtgaccttatttttgcctgtacgaatgcctaaacaatttccgatctataattgttatcaaaaaattacaaaaacatgtacgggaaattttttattcatttggtaggaagtaaaaagtcaggaaaaagttaagaagggtgtcggtgcggaaagatgccgaaaa

SEQ ID NO: 81748 - DNA, 431 bp, Heterodera glycines
  Genomic contig location: Contig_ID=SeqID_17278; Location=4..434; Strand=-
  SCN-specific regions: Sequence locations=1-185,229-431
atgcgaattccgtccccacttttggccgctaattatgtgcttgcaactgttgcaatttgtgctgcaatttttgcactcggcttatggtttttcgtgttgaaaagcaatcagtacaacccaactttggctattgtggaagatgatgatactacggtgacggattcgcccttgcatactgtacctggaagggcacaaaaattatatttatttcataccaattttttgaggtggaagaattttttgacacggatggaatggcatcgaaaatggttgctagtcgtgccgaaaatcagctgatcagacaaatggagcagccgatcaagttggacgagtacggcatggcaccgatggacgacggcacgaaaatggtcagcaaaaaactatttcgcgtcaatgacacacatttggcacagtcaagatttgaaagctaa

SEQ ID NO: 81749 - DNA, 606 bp, Heterodera glycines
  Genomic contig location: Contig_ID=SeqID_17279; Location=287..892; Strand=-
  SCN-specific regions: Sequence locations=1-239,261-289,363-545,567-606
atgcaattttatacaattaagatagcgtcgaccggaagtgaggtgtgcagccgggaagatgctccctacttttgtcagcttgtccgccaatttggcgaacagttttacaacgaatcggcaaagtgggcaaaaaaaaacacacaaataaataatggcaactttttcgtcttttaccttccaaattttcaaaaatttatttctaaattttgggagcgaatttggcactttttcttgaatgtcaaagaaagcaaaatattaaaattggtattaaattttggaaatctttgggaatatatatatatatatattaaaaaaatggtaattcctgttattttttaattttaatttttaatttaatttttgtcagatcaatcactgacaaaatgcgaattggtccgtttgggccggtggcaccgattgtgccggcaaaagtgaacaacgggcagcagcggaaaaagcgcagaatgcgactacgaaattgaaaaatatacaatatgtacaaattgtatgagaaaacttttgagaaatggtgtaaaaattaatggataaaaaattaaaggaaaaatgatttttttattcaatgattattgcttttttcaaaataaa

SEQ ID NO: 81750 - DNA, 324 bp, Heterodera glycines
  Genomic contig location: Contig_ID=SeqID_17280; Location=95..418; Strand=-
  SCN-specific regions: Sequence locations=1-81,108-175,206-324
gcaattaattattattattattcaaattgaaatttgagtgattgcaaatggaaatattaattacattgagatgggatggacaataaataatttaaaaataatttaaagtcattcagtcaatcgaatggtcaatttggctttggttgttctccttctcctccgcgtctgtttttatgccgcgggcgcggcggaggggcgggcgcggaagggaacggtcatttggtgcgcgagacggacgagggcgtccacatttcgcgctttgcgcgcggacgacgcgagtttgttggcgcggtcggcgttacggtactgattggtgccaaggtc

SEQ ID NO: 81751 - DNA, 797 bp, Heterodera glycines
  Genomic contig location: Contig_ID=SeqID_17281; Location=402..1198; Strand=-
  SCN-specific regions: Sequence locations=1-576,607-674,701-759,784-797
atggccgattctgttggctccaaactgacgcggaaactgctcttctttctcaagcacatgctgatcgaaccggtgagtggacagtccactgactgatcggacgcaattggcaaattcattgctcacatggggggggggggcaattgcaccaaagtggcactttcatcgctcgcgcatcattcccccgccgagaaaatgccccggcagacaaaagagtacatttgaaaggccaatctttggccaaatgcacacgtctggccctccctctcatttagaccacaattaatgcacgcacgcattaattacacgccatgccaataaaaagtgccatttcctggggatggatgggtactgtcttttcccatcctccgttcattactgtatatgttagtgacacttttgtaatgtgtccattcaggagaccgccgcggaaaacgttgtcttttgcgtgttgcacgaccttggcaccaatcagtaccgtaacgccgaccgcgccaacaaactcgcgtcgtccgcgcgcaaagcgcgaaatgtggacgccctcgtccgtctcgcgcaccaaatgaccgttcccttccgcgcccgcccctccgccgcgcccgcggcataaaaacagacgcggaggagaaggagaacaaccaaagccaaattgaccattcgattgactgaatgactttaaattatttttaaattatttattgtccatcccatctcaatgtaattaatatttccatttgcaatcactcaaatttcaatttgaataataataataataattaataacgcatttgaataaa

SEQ ID NO: 81752 - DNA, 324 bp, Heterodera glycines
  Genomic contig location: Contig_ID=SeqID_17281; Location=418..741; Strand=+
  SCN-specific regions: Sequence locations=23-81,108-175,206-324
attaattattattattattattcaaattgaaatttgagtgattgcaaatggaaatattaattacattgagatgggatggacaataaataatttaaaaataatttaaagtcattcagtcaatcgaatggtcaatttggctttggttgttctccttctcctccgcgtctgtttttatgccgcgggcgcggcggaggggcgggcgcggaagggaacggtcatttggtgcgcgagacggacgagggcgtccacatttcgcgctttgcgcgcggacgacgcgagtttgttggcgcggtcggcgttacggtactgattggtgccaaggtc

SEQ ID NO: 81753 - DNA, 942 bp, Heterodera glycines
  Genomic contig location: Contig_ID=SeqID_17282; Location=24..965; Strand=-
  SCN-specific regions: Sequence locations=1-96,118-492,514-942
  Gene Ontology: Mol. function=actin cross-linking activity; Cellular component=actin filament; Biological process=actin cytoskeleton organization and biogenesis
atgcggaacgaccctttcggacaacgctatctgagggacgaatgtgctgtgtttgactacaatgcgtgggacgacgttgactggccagaggagaaggaagcagaaattcaccaaaccatccaagcgcaaatggccgacgccgttcccgagagtgtgtcgttaagtcttctcgagaacccgaaggatcgatgggaggccttctttgagactcacaacaataagtttttcatggaccggaaatggctgtcacgggaattctcggaactgttcgttcggccaaaggtttgttggccttattccggtggttgccgcactctctctcctcgctttaacttgtatttggtcttctctttaggacagtgccaaaatcaatgtgctcgatgttggctgtgggatgggcaatacgacaattcctctgctgcaaagtgctgaacacctcttcttgtacagctgcgatttttcgaagaaagccatcgaaacgctgcgaaatgaccaaagaatttcatctgaacggtgtcgtccattcgtttgggacattactgagaatgctcatcagactcaagtgattatttttttaattgagccatttaatgcgtttcattggcgtgtcaggtggctgacggcactttggactttgtcctttgcattttcgttctctccgccgttcggcccgatcggttgcgtgccgccgtttcgaatttagtcgcactgttacggcccggcggaatgctgttgctgaaggactatggtcgtcatgaccttacccaactgcgcttcaagtcaggcagactcatccaacacaatttgtaccgccgcggggacgacactctcgtctatttcttcaccaccgaggaaatggacgaattatttcgcgaagcgggcctcgagaagattcaaaatttcatggacaaacgacttgtgggaaaagagcaaaacgcgtga

SEQ ID NO: 81754 - DNA, 97 bp, Heterodera glycines
  Genomic contig location: Contig_ID=SeqID_17282; Location=1158..1254; Strand=-
  SCN-specific regions: Sequence locations=1-97
agtaaatgaatttttttcatgcagaggctgcagaaatactcaataaagcagcaaaaaggaggatctcttcgcagattcattacgagagcaaatgaag

SEQ ID NO: 81755 - DNA, 1301 bp, Heterodera glycines
  Genomic contig location: Contig_ID=SeqID_17283; Location=148..1448; Strand=-
  SCN-specific regions: Sequence locations=1-219,241-334,371-409,434 -741,764-1301
atggcaaaaatcgcgaaatatggacataaatggcaaaaatgccaaaatatggacataaatttttcaaaattgagtgcaaaatttcttcaaatttattggttgaaattgcatatgagatacatttccaaattttttgactcggtaaggcgctctgacaaagacggctttcgttttgcaattagtcggtcaacattcggaaattggtctcgaattttttcggcaattacgtgcaatcattttaaaagaaaaaaaacataaaagctaaaatttattaattttttagcgcaaaatcaacaacaaaagcgaaattttcgcttttttgcttatttttgacataatttattaatttttaagaaaatttaaatttattcaatattctcgagaaattttggcgaaaaaaagattttttgaaaaatttttcgggttttgggctcaaaaaggctaatttagctgctgggggccgttctaatagagttttttttgaaaaatgccaaaatatggaccaaaatgccaaaatatggaaatatggacataaatcgcgaaatatggaaaaatatggaaaatatggatatagaaatccttcctagaagcttcaaaccaagctaaaaacatgtttttcgtgcgtttcaggcctcccacagtccaggaaaaaaatatggatttccatgtaattctattccctaatcatcactcaatgctgcggcggtggacagaaggtagcgatgcttctgtcgtggctgattttttaaaatcatttccctttttcattttcagacggagcctcgaattgaatctccagcaactctttcgggcgtgacagtgccgttggagcaagacgaagaagagcagaaaaaggacgacgaggggtaagtgcaaaggcggcggatcattttttacacattaaaatttaccatttttagtggcgaccaaacagcggagaagaaggtagaggaagcggcggcagcggacgaacaaccgaaagaaggcgccgcggaggcagcggaagcggagaaaagtgcgacaaaggagaagacgaccgaggacacggaggagaccacggaaacgacggaaggatcgaccacagagacttccgaacttccggctcgggatcgtcttcagcatcgggctctggctcggtggaggagttttgtcacctgggggccaacgcaccgcctcgtcccgtaagtgaattgtggcatgcgtgtggttgattaaaattccccctttccagaacgattcgtacgtctctggctcagaggggagttctgggacttaggacgccgcttctgaaagcacagtag

SEQ ID NO: 81756 - DNA, 149 bp, Heterodera glycines
  Genomic contig location: Contig_ID=SeqID_17283; Location=1218..1366; Strand=+
  SCN-specific regions: Sequence locations=1-149
gcacgtaattgccgaaaaaattcgagaccaatttccgaatgttgaccgactaattgcaaaacgaaagccgtctttgtcagagcgccttaccgagtcaaaaaatttggaaatgtatctcatatgcaatttcaaccaataaatttgaagaa

SEQ ID NO: 81757 - DNA, 1319 bp, Heterodera glycines
  misc_feature (21)..(21): n is a, c, g, or t
  Genomic contig location: Contig_ID=SeqID_17284; Location=1071..2389; Strand=-
  SCN-specific regions: Sequence locations=1-491,645-1319
atggcattctgttcagataancccgaagtgtcccgaaaaagtcgtcgctattacgcgcttcgctcggaccatccggcggaattggagtgtctgctcgaggccaatccgttgccgactttggtcaaatggacgaaaaatggccgaacaatcactgagcacacggagaaaaccatcgatcgtatgaaaaactgggcgatcaaaggaattcttcttattgaagggaatttgctgcgaagtgccgtgcgtattcctttcgtaaattttcgcgaatccgccggcatttacaaatgcgaagcggaaaatatcatcggagtcaccgagccaaatttggaaattcatgtcgtggtggcagaagcgccaaaattcacgagaagcccggcaccaaaatatatagtgaaggcgggggaaagggtggagatcgaatgcgagggatttggggaggtgccgatcagaagagtgtggagccgaaaggaggacggggtaagcggaaaagagagagagaggggagagagagagagagcaacagagagagagagagagcaacagagagaagagaaagcaaccgagagagagagagcaacagaaagaaggagagagagaggggagagagagagagagaacagagagagataaagatagatagatcaacagagagagtgccacccaattcagaggcaccgctcattctccgaggccaaatttgcgattgccaacgccgcccactctgaccatggcaattactgctgcgttctgatcagttccgttgccactgtttcgcgtgaagtgcaactgatagtgcatgtgaatgccttctctccctctcttctcattttgccctcatttgatttctccaggaaacggccccccaatgtgcaacaaactttcgcgtccaatgcgaaggacagcagcgactcgcagtgtattggatgccgggatatcccggcggagatcactctcagagttttcggattttctaccagcaaattcggaatgacacaccaccaattactgctaatgaggcatggaaggtgactggccaacgaactgatcagtccaaactgcacgtggatcatttggaattgtttggcgaatatgaatttaaactggaagcaagcaaccgaattgggacgaccaattgtaccatacccggcactcattacagtaggaaggggcgggtgagtcaaacaaagaaagaaggcgcttaattaagcgtgctcaaaattggacagacccaccaattttcttctcgtgaattcaacccccggagttctgattttaaaatgggacgaagtgaaagaggcgaattcgtacagaataaa

SEQ ID NO: 81758 - DNA, 376 bp, Heterodera glycines
  Genomic contig location: Contig_ID=SeqID_17285; Location=104..479; Strand=+
  SCN-specific regions: Sequence locations=1-169,218-376
  Gene Ontology: Mol. function=translation factor activity, nucleic acid binding; Cellular component=eukaryotic translation initiation factor 2 complex; Biological process=locomotory behavior
gtttcctaccatttgcttcgacgtcttcttggagtgcgcactgaggcagggaaaaaagcggcgaaagtgagcaaacttgccaagggcgaagtgctcatggtgaatattggctctctctccaccggaggtcgtgtaattgcagtcaaaggtctgactccttctccattccaatttatatttaaattatgcatttcttatttaatataaattaattttaggcgatgcggcaaaaatagcactgactgatccaatttgcactgaaagtaaccaaaatattgcattgagtcgacgcattgaaaagcattggcgtttaattggatggggcaccatcagaagggggacgaccatcgcagtgccccaaccatcgatcggataa

SEQ ID NO: 81759 - DNA, 2509 bp, Heterodera glycines
  Genomic contig location: Contig_ID=SeqID_17285; Location=739..3247; Strand=+
  SCN-specific regions: Sequence locations=1-212,234-298,321-750,772 -832,854-1242,1281-1473,1496-2509
  Gene Ontology: Mol. function=protein phosphatase type 2C activity
cgcgtcccaaaagtgttggcatcggatttcccatcaccggcacttcacactccgtcgtgctgccattgaccaattgttaaaggccaacgagcgtcgcttcatcctttctgatgaccaccagcagtcggtattaagagtggacgttgcccaagtcgctgcaaaccgaccaatcgaggacttttactccgcttcaaagtgtctccattccaatgcctttttgtttggcatttttgatggccatggcggagcggcgtgtgcaaggcacgtgtgcacaagggtaagaggagaaggaaaggggcaaaacagaagggtttttattcatttttggtactcgaatatttagattttgtgggtcacaaatatgaaaatggtaaaataccttctttccatgcactttcagttgttcgactatatttgttgctctgcgctggacaaacaccgagtggtgcaaatccccgtgggggaacaaatccaatggcttggggccaatgccccgcacagtcttccacaagagaaggacgacgcccatctccgaaatgtgcgcgagtatcacagaaagttgttgcctgccccaagtgttgtccatgccattgccctttaggttcagaagcggcgtctcccccgccaccaccgtccgttcgtcccttcaggcggcctttttggcgttggacgacgacctttcgaagggtgcgatgcctgaccaaagcgggcgcatttgcaggtgctttccgaatttgcccacagcatccaggattttctgcacgctttctgagaattatcttttttgtgtccccctcattttcggtagaatttcttcctcttagttttacaatccttccaacttttctcatttttctccttttcagaatgagtgtcaatgttgcggccagcggttcgtgcgctttggtggtgcacgtgcgcaagaacaatctgtgaggactgaatgacacgtgccccgcccccgaggaaaaatggcaggaacagattctaaaatttctggtgaaatgaccctgggacaaatactctccgatatatttgccttccgcgagtcattcgtcctttcgttaattgaagtcatgtggccaatgtcggcgactcttccgctgtcctcggcgtttgtcttcccaatggcttaattgctcgccaactgactcgcccgcacacttcagaaaatgtcaacgaaattcataggatccgatcggcacatcccgccactgaaaatcggactattctgcgtggtacaataaattttcttaattatttaattttgatttttttttgctaatgttgaggtgatcgccttcttggagagctttaccccctgcgggcgtttggcgatgttcgttacaaatggccattggaattgcaaagtaagccctcccccctcacaaaaaataggtcaattcaaacgcgggagccataactgcgaacaaaatagacaaccgaatcgaaatttaacaaatttacaggtattgtattttctatttttgtaaaattttcataacaatggcggattttctgccgtttttgcatttttaagaagtcaaacgacgctcccctagtcgaaatcccttaacaaaacttttgcgtatacaaatttgagaatttaagtgtttatacattcatttccgtaccatttaactctccccgtcagaagtcgttctcgaacccctcggaatgcccgccccctccaatctgttgagtccgccttatctcactgctcttccggaagtgttttaccaccaattgaccaacaatgacagttttctcgtaagaaagtcttgtcttataaacacttttgaatttttcagatattggcatccgatggtacaattttttggaaaaaaaaaactaaattcacgttttaggactttgggagttccttgacccggatacggtaatcaacggaattttgtgactgttacataaaagttgtaatttaggctgtacggttagttcatgtaaggaatggatgtgctgcactttccttttggaatttgcagtttttctttattttttcaaaggatcacgcacttggtgcacaaacgttgagtgatttccgacccgattctcagcaatcactgggagaagtaagtttttggtggcacaaaacccggaaaagcagaaattgccatgtgccagttatatgaaacggccaaccccatgctttttgaaacaataaattcaaaccattagaatagaaaaattcggcgtttttggactccgcacaaaacgaaatttattatagatactcgggagccttgaaacgagaaaacagggctatgctagcaagccgctggatgaaaattcggcgacccatttgatccgaagtgcgttgggcggttgttcaggcggaacggagctgcaatacgcgcggttggaagaatcgctgatgcttccccctgggatggcgcggaattaccgaggtgaaatcgccttggaaagcaattaactgttgctttaatttagacgacataacaataatggtggtgcacttcaaaacaccgtg

SEQ ID NO: 81760 - DNA, 749 bp, Heterodera glycines
  Genomic contig location: Contig_ID=SeqID_2814; Location=248..996; Strand=+
  SCN-specific regions: Sequence locations=1-267,293-426,453-512,534 -677,703-714,736-749
atgtccccttgtaagcagctgtagcctaaaaatggtggaaagttcctccttttttcgtcaaactgtggtgccgaccgattggacaattgaattgtctttgtccatttcgttggatcgcactgtcgcgcatccgttctcctctggcggtgcaaatgccgaaaggcatcgcattgtcagggcacgaggggcaacagaagccgttggactgacaacggaagccgggcggacaaacgccctgcagcaatggcaaattgaaagttgccgaagaattaaatttttttaataattttttctagggtaattttatgcgctgaacacatatataacgtttatttttagctcttatgctctttacgtgtgttacgtgaaattttttgactagtcaactacagtatttcgtcggtaatttgtcccccctatttttcgaaaaaataataaaaatttaaaaaaatcgtgaaaacacctgccctgggggttttcgaggtcgctgatcacgaatctgacatccattcatattaatttcattgaaacatcaatactggttatattctgtacatattctaacataaaagtaaatttttaaaatttgaatttcgactttttgttcgagttcgggtcagggtttcggaatcggccaaaactaatgttagattcatgttcagcgcataaaattagtctaaaaaaattatttaaaaaaaatttcaggggggcgacaaaaggataagaaccaagcaagctctgtaacttaa

SEQ ID NO: 81761 - DNA, 692 bp, Heterodera glycines
  Genomic contig location: Contig_ID=SeqID_2815; Location=23..714; Strand=-
  SCN-specific regions: Sequence locations=1-255,277-577,599-692
atggacccaatttcgaaggccaaagaaaatttgcgggggcccgagaagtacaaagtgatcaacgcggtcagaaagaagcgaaagcatttgctgcagctgaacttcgaccacattccaattattgtgggactttaatttttgctttgttttgtcactgctccaattccgttcaggaccaagttgttctgatgtttccaagccaaggggcgcaacacttacaaatgggcaaaaaggtgggcgtatttgccggtcaaatttattttgacaaacaattttggcaccaaagtttacattaaatcatttttgacactttaggtcattgacaatccgagcagtgcgcgactttttgaggaggcaaacggtgcgatttaaaaaaccaaaattatcggcatttaattgtgtttaatgtcagaatttctcaaattcgaccttctcagcctctgtcttaacggaccaataaacaaattagaccaaacattctatgctcagatggctctgttcgtttcttgtatggccgcttttgagaaattgaaagttgaacagcccgacttggtcgaccgactcaccggtgagtaaatgtacaattttgatttttgtatattgtaaaattcctttctgcacagattgtgccggctttagcattggtggaatttgtgctcttgtcgcagctgaagtactttcattttctgatg

SEQ ID NO: 81762 - DNA, 1598 bp, Heterodera glycines
  Genomic contig location: Contig_ID=SeqID_2815; Location=4507..6104; Strand=+
  SCN-specific regions: Sequence locations=1-876,903-1176,1206 -1312,1339-1384,1411-1598
atgcaggagaagttcaagcagaaccaattcaatctgatggccagtgaccggatcagtatcaacaggacactgccggactatcgaattgaaaagtaagtgaccgacaaaagtggcaattgcaaaaataataatttaattttgtccactgaacataattaaggaccttaaatgcatgtggacgattggcattcttaattattgatacatattatgtatctcccccctcacgacagatgcaaatctgtcgagtcgtccttggccactaactccgcaactgtgtccatcattattgtgttccacaacgaggcatggagcactttgctgcgcacattgcactcggtgctgaacagaacgccgttgcatttgctggccgagattattctcatcgacgacttgtccgagcgcagctatttgaagcggccgctggagctgtacacacgccgtttcccattgcctgtccatctgctgcatttgccccagcggtcgggactgattcgagcgcggttggccggctcagcgatgtccacgggaacagtgagtgatgatttttggattttaaatttattcaacattttcgttgtccaaggtattgctgttcctggatgcccacgtcgaagtgtccatcggttggcttgagcccttggtggatcgtgtggtcgacaatcggaagcgtgttgttgcgccgatcattgacgtcatatcggacgacacttttgagtatgtgaccgcctctgataccacctggggcggcttcaattggcacttgaacttccgctggtaccccgtgccggaccgggaaatgaacagacgcggctgggaccgttcaactccaattcagtgagtattttgcgtgattcgaattcagagaaatgggtcgaaatttaaaattaaattgaaaattgtcagaactccaacaatcgctggcggtttgttcgcaattgacaagaaattcttctacgaaattggctcttatgaccaaggcatgcaggtggaaacatcaaattattcactttttgtttaaaaaaaattgtttcaacaggtttggggcggtgaaaacctcgaaatctcatttcgggtgcgttttctccatcaattggctcatttacggtggcatttttaggtttggatgtgcggcggcacattggaaatccatccatgctcgagagttggacatggtaatattacaatttattttttatttaattccataaatttactttttttgtttgtgttcgttcagtatttcgcaaacaaacgccttacactttccccggcggtactgccaaagtgattcatcacaacgccaagcgaacggcagaggtttggatggacgaatatgcacagtttttctacgcaatggtcccgggttggttcagcgtttatcttttttaaattatattattatttattcgatgaaggtgccaaacacgtcgaacttggcgatgtgaccgagcggaaagaattgcgccaacggttgaaatgcaagtcgttcaaatggtatttggagaacatttacccagaatcgccggtgcctgccagttttttgtccattggacaagtaaaaaaaagaaaatgcaatttttttaactgctgggcca

SEQ ID NO: 81763 - DNA, 1620 bp, Heterodera glycines
  Genomic contig location: Contig_ID=SeqID_2815; Location=1866..3485; Strand=-
  SCN-specific regions: Sequence locations=1-236,258-950,972-1045,1068 -1258,1281-1620
atgttccctttcaacactccctacaaccatttgcttaattggtcattggtttgctttctgatcccatggttctacagctattacaatgagcaacaccggctcagcagcatgcccgtggagcaggcgatgctcaaatcttgggacaccgtcatttcacagccatccataaaatttcggaaaattatggtcgggtgcgtctcccattcttttatatttttttctctttgctttttcacaatattttaattttttatatacattttcagcatcaattgcaatgttgatgtgatcgttagcggagtcagcatggtgaacaagctgaacatctcgtcaccaaatccaatcgcggacaaagaagtgctcaacggatttgaggatttgtacgaggcgtttgtgcacttttttacgcgtggtgcgcctgccgagcgatgtatggtcaatgacgcggcatttgaccggatggtccacaccgttgaagacaaacatctccgtgcacaggtgacttactgattccaatcaaattttgagtgattttagcattatattggtggcaatgccgcattaatggctcagaaaatcgcctcttcgttccccgctgcaacggtaagtttcttttttatataagggtctagcatgtgttgcattggtgatgccctttattattttgtctccttttggtaaggcttatttggttggtccgattggcccgcgaagccacgcgctgttacacccggccatcgttcgaaacaattccacacgaattgcggaggacgaattgcacctcattttggagtacaaacagggcgaaatcctcggggagtacgtttcgcccgcctcttctcgtttcattgtttcccatgaccaattcaggtctcacaaaaacactgtgggaattattgttgtatctttaccatggttttcccacgtttagtggcagtgcgatgatcatcgaaatgtttttcaaggcaatcatgcaattccgtcccgacctgatcattttgtccggaatccatggtctggaagcgcaggtatttctggcatctcaattttgttttatctttatttatatacaatttgcagaaccaagacgtgcgattggaaaagctgcgactgatcaaacggtcgctgatgcaagtgaatccgctgattccgattcatttgcaattgggcagcatggcggacgaccagcaagtgcacgacattttggagagggttggtcaaatgcaatgaattggtgaacttgatcatcattttcagatcattcccaatgtggacaggtgtgcgttcattagttttttgagtttttctttttgctttagccttgccatcaatgagcaagaattgacttatctgtccaaagttggcgatggcccatacaaagagcgttatccgatcattgccggcactcttcacgctcataaggtcggatggcccattaaaaattgaataaatttatggggtattctgtttcaggctgttgaaatgctttactggctgttgaccacctatggacacgaccgaaccaatccggaaagcaaacgttacaaccagcgacttcaacggatccattactattctttgacatatcacattatggtcctttttgcgacaacaaagtaa

SEQ ID NO: 81764 - DNA, 475 bp, Heterodera glycines
  Genomic contig location: Contig_ID=SeqID_2816; Location=140..614; Strand=-
  SCN-specific regions: Sequence locations=1-39,62-96,118-328,352 -378,401-411,433-475
atgggcggaggagcgaatggaaatgggagaaaaggcaaatggcaaaatgaaaacgcgaaaaagcgacacaaagtccgacccctcccccaacgcacaaaaacgcctccatttgactctgaatttcaaatatgtcacaattcagcggctacagtaccgcaccttccattggctactgtttccgctgctgtcacagtctccccactgatgacgcccaatgccaaattggagctgtgctgtcagaaacagcagttgccctccacgtgccaacagttttgcaatttcgacactttcactcaagaaaaggtggagaaatcgaaaaagcaatggcatttttatttttaaaaataatttgttatttcagctgctaatcgctctgctcggctcccattgtccgtctgctcagctgagcaaagcgttcgactgcgccacctcaaaagtggaccattccgagtgttgtcgtcaggaaggaatgtga

SEQ ID NO: 81765 - DNA, 1961 bp, Heterodera glycines
  Genomic contig location: Contig_ID=SeqID_2816; Location=1..1961; Strand=+
  SCN-specific regions: Sequence locations=1-81,107-182,204-214,237 -263,287-497,519-553,576-632,654-677,699-807,856-945,970-1031,1053 -1491,1519-1799,1827-1961
  Gene Ontology: Mol. function=structural constituent of cytoskeleton; Cellular component=insoluble fraction; Biological process=post -embryonic development
acataacccgcaccatttggcggtgtttttatgtgcgttcggcaaaacaccatacattggccgttgtgaattcgatcactgaattaattaattaatcagttaattatagttttcatccaattagagttccattttgtgctcacattccttcctgacgacaacactcggaatggtccacttttgaggtggcgcagtcgaacgctttgctcagctgagcagacggacaatgggagccgagcagagcgattagcagctgaaataacaaattatttttaaaaataaaaatgccattgctttttcgatttctccaccttttcttgagtgaaagtgtcgaaattgcaaaactgttggcacgtggagggcaactgctgtttctgacagcacagctccaatttggcattgggcgtcatcagtggggagactgtgacagcagcggaaacagtagccaatggaaggtgcggtactgtagccgctgaattgtgacatatttgaaattcagagtcaaatggaggcgtttttgtgcgttgggggaggggtcggactttgtgtcgctttttcgcgttttcattttgccatttgccttttctcccatttccattcgctcctccgcccattttccactgcaaaaccatccgaaggaacaacgggagatggaaacattttgcctcttcccccccaacacacataaatacatatctctccgttccaatctaatcgctatttttgcatttattggccggtgagcagcaaattttttctcatcccccgccgttaaacaaattgtcgtctcctttccccaccgctcattccctccgccccctctccccctcatccttttattttactcattttttctccactctgtaccttctttcttagttcaaattccgataataaatcatttttacaattttaaaaatgctataagtaaaaaaagaaatacttcaaaaatgattattttttaaaacgatttcattgatttcgaaattcataaaaaaaaaattgcgtacataaaagaaaaaaatctgagcatttcaccattccaactttttctaacactttgcccgcttatttttactcgcccgtataaacttaacaagcaaaacaaattttgattgttttttataaaaccgactagaacctcaaattcttagtcaacattttagaaaacccacttatcagtttttaactttccatttccaatgactgccccaaaaactagaagacatgtctttacaatatttctacgtacacaaaatacaggaatagcaagctttagtaatttattaaacgacgatgtcttcgatggaatgttatcgctgtcgcgagacgggtcacattggtcgcgactgtcctaacagtggcgggggtggtggacgtggtggaggttagtaaacgaatagtggaagattcacatccgttctatttaggaggcgatagcgtctgctacaactgcaacgagccgggtcacttctcgcgcgaatgtccgcagggacgcggagggggcggcggcggatcgcgcggtaaaacatcaaatgatggctggcagaagaatgccaaaaattggaattcctcgtaggtggtggaggcgacatcgtctgctacaactgcaacgagtcggggcatttctcgcgtgactgtacgcagccgcgtggcggtggtggcggagggtcgcgcgggggttcgtttttcagcttcggaattattttcaaccccatatatatattaaggaggcggtgacaatgtctgctacaactgcaacaaaccgggacatttctctcgtgagtgtccgaacggtcgcagcggtggtggtggaggcggcggctcgcgtggtattagctcattttccattcactgggttacttatactgttcatttccttaggtggcggtggcggcagtgtttgttacaactgcaacaagcctggtcacttctcgcgcgagtgcccggacggacgtcgt

SEQ ID NO: 81766 - DNA, 1126 bp, Heterodera glycines
  Genomic contig location: Contig_ID=SeqID_17287; Location=560..1685; Strand=-
  SCN-specific regions: Sequence locations=1-343,366-497,523-1126
atggcactcttgagcggtcatcgaatgtcactcttgagcggtcatcgaatgtcactctcgagtcggtcaccgaattgcactctcgagtcggtcattgaatggaactctcgagtcggtcatcggatgacactcttgagcggtcatcgaatgtcactcttgagcggtcatcgaatgtcactctcgagtcggtcaccgaattgcactctcgagtcggtcattgaatggaactctcgagtcggtcattgaatggccctttagtcggtcatcgaatggcactcttgagcagtcatcgaatggcactctcgagtcgttggctacacatatttactccaacacttctttctttttccaaaatggccatggcaacaatatttgtttattgattcgcccatgccgaaggagaaaaaaaaggaaaatccacaaaaaaaatttgtctaaaggcgagaaaaagaggaaaatccacaaaaaaatttgtctaaaggcgctatcgccaccgccagacccccctcccccccattccaaatttttttttttgaaaaaaacgtcgcaaaaaaagctgtttgaaaaggaaaaaaatgtcaatggcatgaccccctgcgcaaattttgatgtcgtcaacccccccccccctccttaaagtattttgccaaattgtgctctcaaagactccaactagggctgcaaaaaatatgtacaaaaaaatggtccaaatatgtacataaatatgtaagaaaaagcccaaaatttgtacaaaaaaccccaaatatgtaaatagaattttttttaatggtattttttgggaaagaaaatccccgtaaagtatgaaatagccacaaaatgacataaaattacttttttggtatttttaggcaacattttcaaacttattttttctttagaaattttcaaaatatgtaaaaaaattaaaatatgtacaaaaatatttgccgaaattttggattttttttttgaggatttccaaaaatttccgtaaaaaatactcaaaatctgtaaaaaaatgaaaatatatatgaaaaaatccaaaatatgaacaaatatgtttgaaaatcccgatatatgtaaatatgtataaaaacaccgaaatatgtaaaaatatgtaaataaa

SEQ ID NO: 81767 - DNA, 1677 bp, Heterodera glycines
  Genomic contig location: Contig_ID=SeqID_17288; Location=1312..2988; Strand=-
  SCN-specific regions: Sequence locations=1-432,456-697,719-1677
atgaactactcccaaatcgaaaaagagggattagctcttgtctttgcagttcagaagttccacaaatatcttttcggaagacacttcgtcctgcaaaccgaccataagccattgttgaccatttttgataacaaaaagggcattaaagcgtgtacagcaaatcgcttacagcgctgggcactcatacttttggcgtatgattttgagatcgaataccaaaacactgccgattttggtcaagccgatgctctttcgcgcttaattgcaaaagcgccagtgcccgaagatgaatttattgtggcaacaattacagaaagctcaaatttggcaactgtgaatgcctttacggcacaatttccaattgtccacgaggacattgtcaatgccactaaagccgataatttgcttcaggaagtgaagggattcatcatgaaccaatggccaaacaaaatggatatgtcagatgacattttacaattccatcgaaggcgagaagcgctgtcattcgaaaacggatgcatcatgtacgccgaccggattgtcgtccctgcatcgctgcagacggaagtgcttaaaatgctacatcgtggacacccgggcatgaagcgcatgaaaagcctcgcacgccagcatgtttactggcccggaattgatcaccaaatcgaagaagtggtaagaaaatgtgagccttgtgccaccgaagcgaaggcgccaaggaaaacggagctaaattcgtggccaaaagcggaagggccatggaaacgtgtccacatggactacgctggtcccttctttggaaagatgtacctgatcattgttgacgcacactccaaatggccggaagtgttcgaaatgcgttcgaccggatcagcagcaacaattgaacaattacgttcattgtgcgctcgttttggactgccggagactttggtcactgataatggcacacagtttagctccaacgaattcaaggaattcgtcaaagaaaatggcatcaaccatctcttctcagcgccgtacaatccgatgtcaaatggacaagcggagcgctttgtcgacacctttaagagggcatgtcggaaactgaaaaaagagggcgcgcaaaatgtggtgaacacatttttgacgtcataccggacgacgccgaatgacgctttgcccgacagcaaaagttctgccgaacttttccttctgcgaaagcctcgcacaacattggatttgctgagagcaaaaccatcggcaccactgatcagagacgaggcgatggaaaagcagttcaatcgtcgttttggtgcaaaacctcgaaagttttgtcttggcgataaggtttttgctcgtcatcgccaatcgcaatcatggcgcgctggaatcgtcagccaatgtcagggagtcatttacgaggtaaagttcccgaatggcacttccaaccgattccacgcaaaccaaatgacggcccgtcacatggatcaccaaggcaatgatgagttgaacattttcaacgatgcttttggtcttccgttggcaccgccggatggtcccaacgaagcagctctgccagctgatcaacaagcggcacctgcacaagagacggacgaagcaaatgcttcacgaggccatgtccgtgtcgatcgcccgcaacgcaatcgagatcctcctcaacgctattctccgagttga

SEQ ID NO: 81768 - DNA, 381 bp, Heterodera glycines
  Genomic contig location: Contig_ID=SeqID_17289; Location=533..913; Strand=-
  SCN-specific regions: Sequence locations=1-260,282-356,378-381
atggtcgtccgtctccctgctgctcccatcgcggtcattttggtctttgctgcctttgtcatcgctgtgcatgccgataatgaccattatcctgcctatccaaaagggccatcaccacattatccccctcgtggtaaaatcccttcgtggatgcattcgcagccattggagccgcccggctacaacccttcggcgcaaaacgatgacaaacacgagcagcagcaaaatgatcaacagccgcatcagtcccatgctcgacctggacgttcagctgctgcagttggagcttccgctgcactcgacggtcgttctgttgctgcttctggtcgtgcttctgctcctgcccttccaattggtttagcttctgcccaaaagcaatga

SEQ ID NO: 81769 - DNA, 821 bp, Heterodera glycines
  Genomic contig location: Contig_ID=SeqID_17290; Location=1641..2461; Strand=-
  SCN-specific regions: Sequence locations=1-48,70-77,144-343,365 -493,520-821
agaacattcggggagaggaattattattattattattggcatggcatatttaaataaaatagcattcatggaaaaagtaaaatattttttttgaaattttttataaaattaataaaatattttttaaataaaaaactatttttcatccattttcatgctggatggtcccaacattttttttttcgatttttagcacgtttttttaagaaagttaaggattttcagggtcctgggtgcattaggcactatcgagaaagtttttgtatattttctctcgattttttttaacagattttcagcaaaaaattggtacttttgcgaactttcagaaaaaatcgagaaattttttgggcaaatttaggtgaggtaaatattggaggggtacaaacaaaaaaaatcgaaaaatttctccaaaatatactattttttcctctaaaactttgggtacggaaaagtcttggggcttactcaccctgcgtaaaaccgagaataatttttgaaaaaatttaaattttggccaactaaataccgtaaccctatgcgacccaccaaatgtttcacagagttacgacctgcggctcagccaataccacgacagcgtgatcagcatccatgggcccggcgtgaagcaggaattgcatcgccaggtgccacagccgaagacgggtgccaccgtggtcaccgaggagttggagctgctcaaccgacggtttgccgaactgtcctccgtgatcctggagcgcaagaacattgtgaacgtgctgatccagaattggcgccgcaaacaacaggtgggtgacatcatcaaacacatcaatcgc

SEQ ID NO: 81770 - DNA, 541 bp, Heterodera glycines
  Genomic contig location: Contig_ID=SeqID_17294; Location=250..790; Strand=-
  SCN-specific regions: Sequence locations=1-203,226-541
atgaccgtccaatcatccattctttgtaaatgttccagtcacatcaaccgaaaagtgatcgcttttctccaccgcattcaacgccttttcgcaacagatatcacgttggaattggccatattttttagacaacgccaaagttgggatgttgtgacctacgggatttggcccgcgctgaatgccgccgggattgttaaaatccgtttccataacatcaacaatgtcaccgctttacaaacacacatctcgccaaccattctgcacgattgtgccaatcttcgttcaattgatgtcaatcacatttaccggcctctgactgggcaaatgtaattggctaattaatgggcaaaaatttccagttacagaaaaaatttcaaaaataaaaaaacgatttagtggggatgaatttaacggcgctgatacgcctgatgaccaagcgttgtacgaatggctgagcacgccccgtgcagatggccgtcctaaactgctcaaaacttacttcagtcgatccgatgtcaattggaccgctcaaatgaaaact

SEQ ID NO: 81771 - DNA, 1060 bp, Heterodera glycines
  Genomic contig location: Contig_ID=SeqID_17294; Location=1791..2850; Strand=+
  SCN-specific regions: Sequence locations=1-67,89-343,366-465,487 -507,531-580,602-723,745-784,808-1060
atgaatcgtattggttcagcactttcaaaggtattttttgcatcagttttcattgaaaatccagcaaatttttggttgttgcttttgtacttaattaagagattttcgttttgggactttaattggaagccatacatttttttgccattcttggatctaaacttgagtttggggagattgagatcgagattaaaagcagtacggtgaatctaaaacatagtagaaaaaatagttaaattggaatttaaatgcgtttctcctgttttagtcggttttcatccctcgtttgttctgtcaccgtttcttcgccagtggacccaccgatgcgcgacaaaatgtgctcgttgtcattgtcgatttcaacggcgaacagcaattgcttgtcaacggttaccaatttcagatacttagaaaaccaacaatttttcatttttctaggaaagtacagcgaattgctcggccgttcccccgactttccatttcctggcaacgtgaaaccgttggctgaaatgcaacagcaacaacagcagaaagtgaaccaaccatttattaaactgcaaataaaaaaaggcacttttgcctgtttagggcccccaaaaaatacaaaaagtggacccttttgtagggacttggaattagttgaaatagatttcagacgattcgccgtaaatcaccaagtacagttttcaatacttatgacacgaaaaaataagaaaaaatagggtcttcccttttggaattttttgcgggccttaaacagcaaaaatgccaaaaaaatgcatagtaaatttaaaaaaaaatttttttcagtttccattccctttggacgccttgccaaccaaacaactcggcaatggcttgggtgctgtcatgccactccacaaaatcgtcgagccttcatttgttgtttcggacgatcgtaccgccataccacgagcgttaaggcatcaccgaatgtggcaaatgggtgaaaatgatggacggatgacggctaacacaaccaccgccaaatatgaatggaccgtggccggggtggatgggattcgaatgctgtgcgaag

SEQ ID NO: 81772 - DNA, 385 bp, Heterodera glycines
  Genomic contig location: Contig_ID=SeqID_17295; Location=76..460; Strand=-
  SCN-specific regions: Sequence locations=1-385
atgtggtttgttggtgacgtcggcaagaccatttattttgtggtacggcaaagcccggcacagttttggatttgctcttgcctccaggtgggattgtacaggcaattctcgagggcaaaagactcgggattgaatttgattgaccgattttatgattttcgacagtagatgtatgtataaaaattagatttcgacattttagcatgagcatggtggaccttgcttccgttttggaccttgagctttaatttcttgaccaaaaaaaattcgggaaaatcgaaaattcaggccaggaacccccaggttcgagagacggacctcgcgagtctcgggataaagcctaattacctaatgcatatttaattgccttgcctcccgaaataaa

SEQ ID NO: 81773 - DNA, 165 bp, Heterodera glycines
  Genomic contig location: Contig_ID=SeqID_17297; Location=16..180; Strand=-
  SCN-specific regions: Sequence locations=1-165
atgctttcttcttccgcctgctgtactctgttggccgcgctcatttcggcggcgtttttcgccgcggctaacccaccaacggtgaagcagtgcctgtgctccgaaattcagccctgcacccaaaagtacatgaacacgtggaaggcgtgcatggagcagtgtaag

SEQ ID NO: 81774 - DNA, 1326 bp, Heterodera glycines
  Genomic contig location: Contig_ID=SeqID_2818; Location=152..1477; Strand=+
  SCN-specific regions: Sequence locations=1-44,205-354,387-456,490 -753,778-1173,1195-1224,1254-1326
atgaagccgaagcagcaaaaactggcaaggattgaatggacatcggaggaggaggaagaggacgaggaaaagccgccctccggggatgaggcggaagcggaaagcagtgaggaagaggaatacgcacaaaaacagcaggcgaaagaagtcgaagttgtacaccgagacagggatgaggaggaagaggaggaggagccagaagagacacaattcgcttcccatccgtcggacgaagcgctgctcaaaacgccggaggcgctgccgtcgaaggcgggcggcccaacgaggatgtccaagagtcgctcgttgcaggagatgattcgccactactggagcttgggcagaaaccatggcacaacatcagcaacaacaacaacaaatgcaaatggcggcattggcacgccaaaccgaaatgaggtgagtgaagagatgcatacagctaattgggctaattagttatattaatttaattaattaatgataaattaagcttctcttttgtaacaaagaattttgctagggtcaaaagggttaaagaaaagtgccgcttaatattggacatttaggcgtgtgtttttgttctaaaatatacctaaaatcacactcaaatttcaggagtttccagtacaactaaaatggttgattaggcatttatattttatcgaaaaattccagaataatgacaaaatccaaaattagaaaaaatatacaaaaattcgacaaaaatcattcaaccatattatacaatttacgtatttaaaaaatatattaaatatagaagctagaaaaaaaagttaaaatttcagttttgctataaacattcaattttgttaatgattcagtccctatcccaacgccgtcggtcccggcattgtgccgccaccgctgttggcatttctgctgccgccggcagtgctatgccacgtgcgcgttccaccgatgagcgactgttcgctgctttggccagccacacacagcaattggtagtttccggggaaaacatggtctgcataggtgtgctgtttatacccgagatttcggtgccgatactcaagactctcgagaccgacatcaaccccaccacttggccacactgaccgtgtcaaattcattttttcaatcaaacaaattgttttttttgttgatcaaaacacagtatcttacaatttagggaatattaaaaagtcacaatatttagttatgagaaattgagattaaaaatgtgagaaaagaccctccaaaaaccccaagaatttcttagtcgagacttgaaattatagtggcaatttcctgggcattcgaactcaacaccgatttggtacttca

SEQ ID NO: 81775 - DNA, 149 bp, Heterodera glycines
  Genomic contig location: Contig_ID=SeqID_2819; Location=127..275; Strand=+
  SCN-specific regions: Sequence locations=1-35,57-64,86-149
agctcgacattttgaaaaaagcctggacctggattccatgttggacctggacctggatttcctggacaaaaatccaggaaaatccaggctcctcgagacctggatccaggcctggacctggattttttgaatttttttttaaaaagcaa

SEQ ID NO: 81776 - DNA, 1195 bp, Heterodera glycines
  Genomic contig location: Contig_ID=SeqID_2821; Location=139..1333; Strand=+
  SCN-specific regions: Sequence locations=1-139,160-438,460-535,559 -857,895-985,1007-1195
atgggtggcggttgggtgtcgcagcccgcgtcaccgatgattccgcgcgatcgcccgtcctcactgctgttaccgcctccaccgttgttcagcgccggctcatgctcgccactacccaccaccaaccattatcatggcaatgatgatgatgatgatgatcaacaggacgctgcggctcagcaacgccgtctgcgtcaacagcacgcggctgcggttcggtcagagccgaatgtgtgcggaagcggcaagcagcagcaatcgatgctgcccttcttacgctcgctacgtcagctgaagctgttcaagcggcgcagtgcgtctgagctgtcgctggtgcttgaactgctccgaaatgttggcggcggtggcgacgacagcaacggcgccatggtcaatggctgcgccgaagatgcgaatgggtatgacagcagcgccctaacggatgacgagcagcagcagatggaggcgggcgacgacggcggactgtcggcgcggcaccggcatcgccacaatgctagccagcgctatcggcatcggacagcatcgccagtgccggccgccaccgggtcggttgaacgtattcagcggcaccacacgactgtccgtcgtacggccacaacattgtcgcgtcgcaccacccaacgcagtcagcagcggcggacacggcgccgtttcccatgggcgcactattcgcccgccgccatccagcgtcgttttatgaatggtcggtggtcctccaattagatgcaggctgggaacggggagcgagtagacggggcaatattgcaggcaaattacgattacggtattttggtagtaaaaaaacacattttattttttctcaagagcttattcacaaatttattttttgttttattttttgtaaataataatgtctaacttaagccctgttatttttaattacaggttactgattttttaaggaaatccgtaattatggattacggatttccgtaattaaaattccaattatgtgcaacctttgtacggggaagggccaaaagggtgttcggggcagaggggggcacccgaaacggacgggcctaactgcgtcacaggtacaaatgtgtactttattcttgtcctttttctcgacattggtcttgtttcattttttaaaatctttttagcgttttcattttttaatggatttttttttttgctctttcgataa

SEQ ID NO: 81777 - DNA, 1128 bp, Heterodera glycines
  Genomic contig location: Contig_ID=SeqID_17301; Location=909..2036; Strand=+
  SCN-specific regions: Sequence locations=1-989,1016-1128
aaaggccttcgaatcctccgagccgaaacgaacccgtgacagtgcagcaattgacccggtcgacctgaaggtgtgtttcaaaaggaaaggcttacatttgtgtccttatctgtgattttttgataggacgatgaggagttttcttggaatgaggagtttataggtttttttggaatttttgagttttttttgaaacaaaattacccgttttctctcaaaatgctaatagtgtcaaaaaaggatggatttttcattgactttgatttgcctaaacccaaccaactacccgttattttagaacccggatgtttttaaatttccttctcagttcaggctaaaaaaggaggccacgggcgacccaaagcgacgccgcggggtgtggcagacaacgctttcgagtcgcggctgacggacgcattggacacggcgaatcggcacgcaaaagcggcagccaatgcaaagtatcaaactgttcaggtaaaatgggagcacagaaaacatcaatgaaaaagggggtggcggaagtcagggatggacccaggatttcggctcggtgagggcggcgtttccaaaaaaattatgacaagtgggcctggtaatgctgccaggcgccgccgtgggaaaaatttagaattttggcactattttttaacaatttgcagcaaaattacttttttttgtgtatttttgaaaatttagcaaattttcttggaaaattatgttagggaggtcggtcttggagctgggttcaaggtttatcattggttaagcctgccgctctgtccaaattaggccaaccataaatgcctgggttatggacagtaaaatccaggcggagaaagtaattgtctacaaaattgcatgagaatgtttacaggctcttcaactgcacaccaaactgatgaaggaagcggtggacagcgacgtgaagcaaaaagggggcgaaagaggcggcgattcggccaaatgggacgaagtgatggaaaagcgaaatgggaaaacaaaaaatggattttaaatggtgcccttttcaaggtgaaacgcgcaaaagcggaggcggaccgacgtgccaaattggacacggaaaaggaaggcacggcacgcgacgcaatcaaagaattggagaaa

SEQ ID NO: 81778 - DNA, 792 bp, Heterodera glycines
  Genomic contig location: Contig_ID=SeqID_17302; Location=371..1162; Strand=-
  SCN-specific regions: Sequence locations=1-237,262-297,348-372,422 -430,469-480,598-792
atggtgattagaagagtcacaacagtgattagaagagtcacaacagtaattagaagaggtacaatggtgattaaaagaggtacaaaagtgattagaagaggttcaacagtgattagaagaggtacaacagtgattaaaagaggtacaaaagtgattacaagaggtacaacagtgattaggagaggtacaaaaattgttggaatggtacaacaatggttaaaaagggtacaatcatggtattaaaattaaataattaaggaaatcgtttattaaaaagtaagattaaaaattgaatgcaattaataaatttttaaaaataaaataaatttccttttattaattaaaaagagtgtttgaaaagtacaaggattgaatatttatttgaattgaaattaatattacaaattctaatttaaaaatacaggagttctttaataaaagtaaataaattattattttaatttaaaagatttttcacaaaaaataatttaatttaaattaaaaaattttattttttatagattaaacaaaactatttatatttattaaaatgaaaattaataatataatatttatttaatttgaaatgaaattaaacatgtaaaagtaatcaaaaaatgcacagaaaaataatgtacaccggccggattcgaacctgccgccccccccctcaaaatgatgcctcagaatccccaatcacacagggattctgaggtcttaacgatgtcaaaagtaaaatctgattacgtattcgtgatcagcggcccaaataacccataaagaccaaataaa

SEQ ID NO: 81779 - DNA, 742 bp, Heterodera glycines
  Genomic contig location: Contig_ID=SeqID_17302; Location=1344..2085; Strand=-
  SCN-specific regions: Sequence locations=1-66,88-377,401-692,714-742
atgcgcctcaaaaagttgtaagacccttccaccactttcagacccgtcccattagccgttaagctcaaattagtttttgaaacgaaactccttgtcaatataacgtatatattaactagcgggtgcgtgaaccgtcggctatttagctgggaaaaagcgcttcgcgctttgggagcttcgctacctagactgtgaagcgattcaaaaaattcggtgatttttaggctgcttcgcggcctcagacgggcgcttcgcgcccgtttctaatttttgttgtgcttttcggccgcttcgcggccgttttttaaattgtgttgagtcggacgggcgcttcgcgcccgttattaaattttgatggactcagacgggcgattcgcgccctttttgtggcctttttaggccgatttgcggcctcgaacggccgcttcgcgccgttttttaaattttagaacagatacaaaagtgattagaagaggtagaactgtgattagaagaggtacaacagagatgagaagaggtacaacagtgattagaagaggtagaactgtgattagaagaggtacaacagagatgagaagaggtacaacagtgattagaagaggtgcaacagtgattagaagaggtacaacagtgaaaaagtgatacaaaagtgattagaagaggtgcaaccacggaagggaaaggcacaacagtgatttgaagaggtacaacagtgattagaagaggttcaacagtgattaaa

SEQ ID NO: 81780 - DNA, 624 bp, Heterodera glycines
  Genomic contig location: Contig_ID=SeqID_17303; Location=1091..1714; Strand=-
  SCN-specific regions: Sequence locations=1-345,394-624
atgaaaaacgcgggaaaaaaacgattaaataatgtagaaaagtaaaagcaaaaactttctcacaaacaaaaacgggaatcaggggccttatgctcgtctcgcggtttagagctaaaccacggttaacggcgttaaccgtggttaaaaatccttaaccggtatgctcgtccttccctttttaaccgtggttaaggataaaccacggttgagttaaccgtggtttactcccttcttaaccacggttaacgcaagttaaccgtggtttatttccaaccggtatgctcatctaaccgtggtttaatctttcttaaggaatcttaaccacaactcgagttgtggttaacgtaaatttatttaataatttaaatagtaaaataaataaataaattttttctagggtaattttacatgcagaaaaagaatctgacttttatttttgtctatgatataaattattgacggattagtgttatttcatcaaaaaatttgcacacgcccaaaccgctaaaatagctttttaaaaaaggtgacaaaatttaggtacaggccattttttgaaacaggtacaactacggttttgaatctggtaaatcattttctcagatttggacccaccatattaaa

SEQ ID NO: 81781 - DNA, 381 bp, Heterodera glycines
  Genomic contig location: Contig_ID=SeqID_17304; Location=2..382; Strand=-
  SCN-specific regions: Sequence locations=1-145,167-381
atggatatggtgcggacgatgcttaagcagatggtccaggacgggtgggagacgcaggagaagaagaagcattgcccttttgatgttcagaaaccaaaacctgatggactacgtgttcggcatgctcgagcagtacgccagttcgctggagcaggaggtggaggagcgcaccaaagagttggtggaggagaagcgcaagagcgacattctgctctatcggatgctgccgcggcaggtggcggacaaactgaagctgggcgaggcggtggagcccgagtccttccaaatggccaccattttctttctcgacgtcgtctccttcaccactttggccggcaatgcacgccattacaggtgacaaaatcagtgatcactgtctga

SEQ ID NO: 81782 - DNA, 554 bp, Heterodera glycines
  Genomic contig location: Contig_ID=SeqID_17305; Location=602..1155; Strand=-
  SCN-specific regions: Sequence locations=1-281,303-465,487-554
atggaacagttcgactcaacctcaaaagatttgttccgcaacggatcgttgatgaataccgaaactgccggcacatttcagggtgaagcaaaaggggggcaaattaagagaaactgagagcagttcaggcgagaccggacgcatcactttggactcggacggcaatagacagccgacctttttcgtcactatgctaaacgcagcgaatgtgccgacagtgacaatgacagtgaacatcagcaaaggagtgcttgtaagcagaggaggaggagggcattttgccaatttttccaacattttgtgccaatgttcagaatttggaccgcctttacaccagcgaagcgtccctttgggtcaattggggcggcgttcggccgctgaccacgccgttgtgcggctacaacggcacgcaatgtggccaaaatgcgactgtgtacattctgatcggaagtgcgcttgtgcttcttctcctcttcattgctttgctcggcatcggatacgcactgaggtcgaattgccaaagcactgatcaaaccattattggaaaagactaa

SEQ ID NO: 81783 - DNA, 91 bp, Heterodera glycines
  Genomic contig location: Contig_ID=SeqID_17306; Location=271..361; Strand=+
  SCN-specific regions: Sequence locations=1-91
ggattatttttcaaaacacctcgtagactgggggataattggagactgagggattaatagagactgggctataattagagcatatacggta

SEQ ID NO: 81784 - DNA, 886 bp, Heterodera glycines
  Genomic contig location: Contig_ID=SeqID_17308; Location=686..1571; Strand=+
  SCN-specific regions: Sequence locations=1-26,48-83,105-116,142 -305,327-386,440-474,496-574,628-670,692-854
atgcttttctacccaatttctgtttctttgattttgttcaccttttttgccggaagcgctgaagcgcaggtaaattcaacaaaatattaatgttattatttttggtatatttcctcaattatattaataaaaaatatatatgcataaaaatgaaattaatgccaaaagtaaatccaaaaatggaaaattttcggttttttcttgttttgtatttttttctgaaatggttttttcataccatatttagctatttttgagattttagcttaaattaaggaattagaagaaattttgagaaattatacccttatttggaaaattatctgcatgttttacagtttttatatgcatattttgcgatttttcgtgcttataaattaaagtcctaattattttattattttttaaaattaataacttttgtttatttctttttttagctttagaattatcccttactatatattaagcgagtaatagccccgccccttttttggctttttgaattcgcgccgaaatcgcactttttgtgaagcgcccaaatttgcacttttttttgaagggacctagcaccggagagagagaatatagattttcttctatttaaaaatcatttgagaacaaatacagagcgttttaattatcgcttttctcttcaaaaactatgatttttaattcaatttgaattggcacagaatgatgctggcgttttgggacccgtcgaggaaactgctgggcaaattggccgcaatttaagctgttccgctatacacgcggctgtccgcgccatcattacagcacatccggattggcaccagtggttctacgaggcgaggcacgaatctttttttgtgttttaatatttaaaattataaaatattattta

SEQ ID NO: 81785 - DNA, 1078 bp, Heterodera glycines
  misc_feature (880)..(880): n is a, c, g, or t
  misc_feature (905)..(905): n is a, c, g, or t
  Genomic contig location: Contig_ID=SeqID_17309; Location=179..1256; Strand=+
  SCN-specific regions: Sequence locations=1-104,131-205,239-562,584 -780,802-804,828-916,938-1002,1044-1078
atgcgttggtcagtacaaacatttgtttgtcttctccacggagaatttgcgctctgcaaggctggcggaggtaaaatttaaaaaaattgcattttttttgtcataaattgttttttttgggtgggggcataagtgccacgatggggggggggcaatgggcgacagtccgatgtttttgagtattcctctttttgtagttctaatttctctaatgcctgcaaattttaaaaattacattgagtttcaaaaagttacgcccgaacattttcgggaaatcagtttttgctacctcacgaaaaacggactcggaaaaccattttaaaaattttgtaagcggatagtaaaacattaaatgataaatccccgagtttttcgtactcttccttgaattgtataatttttcattatttttggaaaactcgaatcaaaaaagaaattttttttttgtaatttttgtttttcacaaaggtccgccaacatttcaagcagaattcgcggattttcttcgccaaaaacaatttgatggccgtggcattgggcagatcggcacaggacgaacaggtggagagggaaactgaaaacattgacttttggccatggcaaaacgcccatttttagcgggacacataccagaaaaacaaatgactttaatcgctggttttccacgaccctaaaaaatgacaaaatgggagggtaaaaattaaatttggcaaaaaattccacccttttttcgccatagacctttcatataaagcgataaattggaaaatgatatcaaaaagataggtttttagaatgctaaaaaatggaaattttaatgaattactcccctccgatgttaattaaaaatttacaaaaaaaagaacccatttcgtgcccngaaactttttgcgccctttgtccanaatcggattcaaaattatggttttcaatccccgatcacctaaacagctttaataagcgattgaaagtagttgcatccgatcatttgattataaattaattgttgaaaaaacaaataaattttcaagcagcagaagtaatgctcctaacaaacgagaagacagtgttttcttaa

SEQ ID NO: 81786 - DNA, 289 bp, Heterodera glycines
  Genomic contig location: Contig_ID=SeqID_17310; Location=184..472; Strand=-
  SCN-specific regions: Sequence locations=1-289
atgcccaacttgcgcagctgcggttccatggcgccgtgcaagtgcaattccgccggcattgggccggccgggagcgaaatgtccgccgaggcgacggcgcccgcctgggcaaactccgcctcggtgtgctcgtcgaaaaacctttgaaaatttagtttttttttaaattttttggcggtttttcagggtcaaactccgggaaatgctgaataatcatagaatacgattgactacaaatcggatgtgttgttattgtgtcagcggccccgaaaaaaatttaaaaaataaa

SEQ ID NO: 81787 - DNA, 152 bp, Heterodera glycines
  Genomic contig location: Contig_ID=SeqID_17310; Location=772..923; Strand=+
  SCN-specific regions: Sequence locations=1-152
atgccgtcccctttctcctgggcaggtgccattgagctgttagaggcgttcactttgtgcaagacgggtgaccaactgtccgcggaccaggcccgccttttgaagcagttcggccaccggttggcccaattccgcgtccgtctgctcgcccg

SEQ ID NO: 81788 - DNA, 1188 bp, Heterodera glycines
  Genomic contig location: Contig_ID=SeqID_17312; Location=386..1573; Strand=+
  SCN-specific regions: Sequence locations=1-231,256-819,842-938,960 -1188
atgactgtcgttacgcgttcgaagcacattcatgcgcccggtgttctgagtctagcgatcgatcagagcggaagcgacgctcaaaccgtgggttctgtttcataaaaataagcaattgggatgaattctcatactcatgacataataggtgtcattaattaaagcctaacgggtcagcagtagatttttacaatgtgttagagacgtgaaaatagtaggggaatggataggaaaaaaattaaaatttttataattccatgactttctagcaacccttaatttgctcttaaaaacataaactctcggtgtgccttctatttattggtccatctcatcttttttgggacggggtggttaaataatgatgtttagtaggacaatatttatgatacgacccaataatgtcggcaattattctgtcctttgctatccctccccatttcacttaacttaagtatttgcaggtgttctgctgcagttccgatgaaacgctcggcttgtggacgtgtgccggggctggcgcgttggaagtggacattcgcaacacggccaacaattgtcgcggagtcatagcagtttttgtcagtcttcttctcctttttgctgcctaatcggtcaattttgcctaatatttgcctcttttggtcagggcgaggacatttatgttgcggagcagggccaagacgtgatcaccggcaacgaccaacacgtggtggtcaagtacgggttggccgcctttctgtcctcgtccccgttgctgatgttttctctggaactgaccgcgttggcctgtgacggcacccacctgatcgccgggtcgaggtcactcatttcaaaaatagcattgacccaatttctgaccgatctcaacgggacgggcccatggattttttgtgttatggtctccaattaatcaagaacatcccgataatatatttggtttatggctattttttatttggttgaataccacttgggtaactctttttggttttatttggatgactacgacggtcacggaatttaggatttttgagggatttggctacctgtgattagctgcttgtgttttaactttgaaacgtatacgctcttgcagcgatttcaccgtcaaatgttgctcattgggaagcggcggagagaccaactttgaccgatacgaatggcgacggtttgtttcgtatctga

SEQ ID NO: 81789 - DNA, 606 bp, Heterodera glycines
  Genomic contig location: Contig_ID=SeqID_17315; Location=285..890; Strand=-
  SCN-specific regions: Sequence locations=1-18,41-62,99-155,177 -236,293-606
atgccggtagttgctgataacttaatgagttaatatttttcgttatcttttttcactttttcaaaattatgttaataaaaacaatcaaaaaagttttcggcggtgcctttcggtactgtttggcaccaaattatttatctatctaacgaacaataaaaattaagaaatttaaacagaaaaacaaaaaaatatatatgttttgttaaaaaccatcctggtctgattgcaagaaattctttataaaaatttaaatattgatttaatttttactactttttaatattctttaatagtcaaatatatcaaacttgtcaggttaaattctggagttgcacgggaccgggaattttgacaaaaaccgggaccggacttaccgggaccagaaaagtcgagaccgggacctcagttttcgtccgggtccgggaccgcgaaaaagccgtgaccaaccgggaatttattttccaatagaaaaaattttgaaaattccaaaaattttcatcaaaatgcataaattagaatgataatttaaacacaaaatacatatttctctatgtaaatgattgagtatttttttatttaatggtgtttttcaattgttttaataaa

SEQ ID NO: 81790 - DNA, 161 bp, Heterodera glycines
  Genomic contig location: Contig_ID=SeqID_17317; Location=1420..1580; Strand=+
  SCN-specific regions: Sequence locations=1-72,95-109,132-161
atgccggtaaaatggtcgcaatcacatttttgtataatacgaataaaatggttttggccaattttgggaaggagaaagaagagatttgctgaaaatggttccgactgctctgctgctgttggtgatggtgggagcaatgacgacgggccggggatggaggg

SEQ ID NO: 81791 - DNA, 114 bp, Heterodera glycines
  Genomic contig location: Contig_ID=SeqID_17320; Location=248..361; Strand=-
  SCN-specific regions: Sequence locations=1-114
atgtccactgcttcaacttttggcttacagaattttttggctcaaactgcttttgctgctgctaccgccaccaacaaagagcactcttcgcagaaaagcgaagaggaggaggag

SEQ ID NO: 81792 - DNA, 310 bp, Heterodera glycines
  Genomic contig location: Contig_ID=SeqID_17321; Location=142..451; Strand=-
  SCN-specific regions: Sequence locations=1-140,162-310
atggtacttacacgtaaaaaaactgaaaaattcaaggaaatgagaaattctagcaccgaagcaaaccgaaaacggaaggaatggcgcaggaagcgcgctcagaaaggcggtttgacgccaaaaagtgacgaaaattgaccaaaattaattttattttaaaacactgcatttttcagcgctaaagcagaccgaagccgtgccaacagcagaaggagaggggacatcaacccaagccaccgaaagtgggccgtcaacgtcaacttttgaccttcgtatgtcgaaaaagcactattttagaagcgaaaattaa

SEQ ID NO: 81793 - DNA, 840 bp, Heterodera glycines
  Genomic contig location: Contig_ID=SeqID_17322; Location=28..867; Strand=-
  SCN-specific regions: Sequence locations=1-146,178-203,225-430,452 -456,560-809
atgaccaccccccctggcccgatcgtacgtcgtatgacccttggaagtgaccaccccttgtacacgtatgctgtgcaggtgtgtgaaatgcgattttttggaaaaaaattttgaggaccgtcggaagggtgccgataggcgccactggaaattttaaaatttttccccacttttgtagcccgtgctgatgctcaacgccagcaaatggcaatggccacacagtgtgcgacgaatgcagcgactgttaacgaaagcgaccactgccaccaatgacgacaaaacagcaacggagacgacaacaacgacggcaccgcagcaacagtcgcaggacggcgccgcaacgacagcagcaactgcacagccgagtgtcaccaacacggacagccgaatgatgttcacgataaagtgagtggtgggagaagcggtgggaaaagcaaaaatatacatattttcgtgtttataaacaaaaaattttctgttatttttaattttaaatacttttaaaacacaaaaattttctgaaaaaatagtatttttttaaaattcataaaatattttagaaagaataaatgtacaaacgggacccacgcgtttcggcgccagctctttttctacgatagcttttttctttgacatccaaatacaacattgttggtatcactcgaaagctcttaacatgctctattagccttaccaaaagcgaaaagattttcaagcctggaaaaaattttattacgaaaaaacttcaaaaatttcgacttttcgcaattttcatgtataacttttttggaaattgtctaatagcgaagcaatagcttagaaaaaattaaaggtaataaa

SEQ ID NO: 81794 - DNA, 338 bp, Heterodera glycines
  Genomic contig location: Contig_ID=SeqID_17323; Location=87..424; Strand=-
  SCN-specific regions: Sequence locations=1-222,244-296,327-338
atggaattatttttcgcactatctcttctgcggtttttcttagccaattgttcattcattttggtcaatggagcgggcagcagcaataaaagtcaaggtattagcaacacttcaaaagcgaaatcttcatctgtcaaattagctgatctgttcgcattggatccgctgagagtgacattatctgatctgatcaaagaagagagaagcgggaaaatgggagatcgaacagagaaaaaaggaacattggcagaactgatcagaatggagaagatcaaagaggacgaatttgaccaattaatggaagaaatgagagaaaatcagcatctgattgaagaagt

SEQ ID NO: 81795 - DNA, 96 bp, Heterodera glycines
  Genomic contig location: Contig_ID=SeqID_17323; Location=768..863; Strand=-
  SCN-specific regions: Sequence locations=1-96
ggattatttttcaaaacacctcgtagactggggtgggggataattggagactgcgggattaatagagactgggctataattagagcatatacggta

SEQ ID NO: 81796 - DNA, 842 bp, Heterodera glycines
  Genomic contig location: Contig_ID=SeqID_17323; Location=2810..3651; Strand=+
  SCN-specific regions: Sequence locations=1-41,63-143,178-206,230 -494,516-567,596-783,807-811
atgccaccaaaccttggaaaaacaaaaaatgacaaccgtgctccaaaagcgaataattcttttacttcttcaaatgagaaaacgccaaaaaaattgccggaagattttgaaaaattgtcacaatttttgcaggtgaaagtcagaaaaataataaataaataatttatatattttttaggaatttatcaatcaccaagacaaaaaatcattgaagaaaactgtgcaaaaacctctcaatatttcaaaattaactgccgaagaagccaggaaagatgatgaacatcgagagcaaagaccaaagatggaaatgccaaaagagagtagcaataacaggcaaaatttcaataactatgtaattacaaagcgggcccggattaaaaaaaattcccagatcctaaccaaggaccggcatttggaaaattcaatgacagtaaaaaggacaaaagccgaaagatgctataggcaccgcgacttcccaattttcaagacttacgataataataataataaattccgttgaatatcaattgaatatgattagatttaagactagaccagacatttatgaaattaatttttaaaataatatttttttgccgtttttaagagcaatttctttgtttgcaaattcaacacggggaacaataattggcactgtgccattgtctgttgaaattggcaatgatagagatgaaatggaagagcagcgaaagttgacagatgaaatgtcccaggtggaagtgatcaaaaaagtgaaggaagaaggaattgacaaagtggacgaagcagaacatggaaaggtggacttttctatttttaattatttaaaaagaaatttttaa

SEQ ID NO: 81797 - DNA, 678 bp, Heterodera glycines
  Genomic contig location: Contig_ID=SeqID_17324; Location=688..1365; Strand=-
  SCN-specific regions: Sequence locations=1-420,442-678
atgctttgcaccaagctaagtcggcacatgatagatgttaaacagaaattatgggagggcgtctaccgtgaacggggtacgtgctaatcttgctaaaaattacaaaatgtttcccaggaggcacattattttcaacacagtcgaaccctaaaattccgctaattttttaaaatgatgaccgaaaaatcataaatatagatctttttgccacacagatgatgccatcatctgctcatgttgaggatgattattggatggactcgtacattcgatccgtttcagcaaagtgtgtacacataatcaaaatggacactcaacagaaaacgtggcagtcatttggggatttatttatagtacagtgttagagaaaccattaccgtataccaatacagtatatgctttaaccattcatagcaccaattcatgtacaatatctgtatagacaatattatagtctgtgtgtctgtgtattatttatctcgcccatagacggatttctgtaacagtgatgactcacccatacagtatccatacaattacatttcagttacgtaatagtgcttactgtaatagcgctaattgtatgcactcatattatgcaattagtgcactcattagcatttttatttattgctctgatgataattatttacccaaattaataatggggccaataaa

SEQ ID NO: 81798 - DNA, 2201 bp, Heterodera glycines
  Genomic contig location: Contig_ID=SeqID_17326; Location=74..2274; Strand=-
  SCN-specific regions: Sequence locations=1-240,262-369,392-930,999 -1498,1532-2201
  Gene Ontology: Mol. function=cAMP-dependent protein kinase, intrinsic regulator activity; Cellular component=cAMP-dependent protein kinase complex; Biological process=signal transduction
aaaaaaaggaattcataggaaggaaatttttttcgtcccccaaccgattttgagatggatggaccgtcgggcatttgactcaaaaaaagagaaaaaaattgtgacaaaaaagggctaatgtttgccaaccgcgcgcctttgtgtgttcccctcgacttgacccccttttcgagtccgcttcatctttccttttcccttctttcactcccatttattcgttcgttcgtcccaattgcttaatcccctcccacccatccccacaaattacctttgtcctgaccaccaattcccgccaaatgagcacagcaaatacttgaactgctgctgctgcagcagaagacagtcgcgcgataggccaatcggaggatgaaaataggaaaaacgaatttggaaagagtaggcggggggggggggggattaaacgaatgggcaaattctgtaacttttccattttccaatcggtccctttttcttttcttgtcattgtccgtttagcatttcaaatcgcttccatttgctgtgccaataattctttgtgcttttatttcgcccaaatgttcggttgctttggcgggggtcgtcccctctccccgccccttttcccacaacgaaatggcaccgatggtgccgtaagtgttgcgcgggaatgccctcccacgagcccaaatttcttgcaaattttcatccttcggttgctgaaaatattagagaaggaaaagaaccggaagaatgaccgaagaagggaaaaagagcgcacactaagcaaattcatcggcggaatgatgcggaaaaggaggtgttcaactgcggacggactttttggggatttgcggggggcaaacgattgggcacggactgatcaattaactaagccaagggcattaaagacccggtcgattaaagtgcctaaattggagaagcgaatttagaggggccgagagagagaggggagagagagagacaactgattgattactgactcattaaattttagtgctgaagcaaatgaacgtgacaccgccatgttgggtaatttggagttggcagaattgaagaccgtctccacgttgggagttggggggtttggacgggtcaatttggtcaaacacatcgacactgaacgggtgtacgcgctgaaagtattgaacaaacggcatgtcaaggagatgaaccaggtggggagatgctccgaaattggtccatcaaattccgtccttttggactttctctttcgtccattttttcactttccgtcgcttttccctcaggtcgaacatgtgctcaacgaacgcagcattttgctgagctgtcattgcgatttcattgtccgtcttcacaaaaccttccgcgactccgagagactttacatgctcatggaatattgtcccggcggcgaagtttggacaatgctaaggaattggggccgattcgacgaggcaaccgcgcgcttttactgtgccgcagcattggaagcgtttgattacctgcaccggcggatgatcatctacagagacctgaagccggagaacatgctgctggacatcgacgggaaccccaaattggtcgacttcggatttgccaagaaattgccgacggagggctcacgggcatggacattctgtggcacagcggtgctacatttggccaatgaagcgaatgccaaacgcaaattgtttaggaatatgtggcacccgaagtgattctcaacaaggggcaggacagtgcggtggacctttggtccctcggcatttttatgttcgaacttctctccggcagtccgccctttgcgtccaccgacccaatgcacacgtaggcagggattgtcagccggggaagactcccgaccaattagtcaactaattgccaaccaaccctctccccccttaaggtacaattccattctaaggggtgtccaattgttggcttggccccggtacatgggggacaacgcgcgcaatttgatctgcaagttctgccgacgcgatcccacgcaacgattgggctatgctcggatagaggatgtcaggcaggacatttggtgaggaatggcgccaattggcagaaagaaatgcctttttaatccggcacatttcgccaagggaacgcactgattctttccttttttaggttcaaaaacttcgatttcgcctcctttcgcaaccactcaatgcgtccgcccatccgaccgaaggtaaaaacgg

SEQ ID NO: 81799 - DNA, 809 bp, Heterodera glycines
  Genomic contig location: Contig_ID=SeqID_17328; Location=103..911; Strand=-
  SCN-specific regions: Sequence locations=1-809
aagccattggagtggccgatgttctctcaccagtggaccatatgcaatttgtatgtttaaccatccatccattgctgagagacaaataaatattggtttgttctctcaaaagggtcaacagaattcggcacaatttgacaatccatcggcgaagaagacaaaaagttatgccgaagccgtgcgattcgaattggctgacggaggaaacagtgacgaaccaatgatggaatgggagggacagcagaatcagcgggaggactcaacgcatgacgacggcactctgtcggacaatggtaagaaaaaatggggtatttatctgtcaccagacttcaaaaaaatttatacgggtaaactggtttggggtttttagggtcgggaaaacgattctttcggatcctgaacccaaactcgaacaaaaagtcgaaattaccccatttggtttatgctgacaataattagttttagtgcattctttgcaacccgttgcgcccccgtcactgaacttggaattgatttgtgtccaattgtttctgcaaaacaaactggagacaattttggcgtgcggaatgttcagcagcaggtaattcagtggccaattgttccagtttctaattaaactaaacgtttcaggaccaaagtcgtcgcaacgacgaatcagacattggacaaaaaaaaatgttttgcctcattggaaatccattggactgataattcgaaagagcgttgtgtcgtcaaaaagtaccaattcttcatggtgacggacaatgagcagcatcaaatgaattccgctgcttttgcaacttctgaac

SEQ ID NO: 81800 - DNA, 81 bp, Heterodera glycines
  Genomic contig location: Contig_ID=SeqID_307; Location=501..581; Strand=-
  SCN-specific regions: Sequence locations=1-81
atgactcgcgcttctgccggctgtgccttgctgtcctcttctgctgctctggcgttgcttctgcctgatcacgtgtttttg

SEQ ID NO: 81801 - DNA, 997 bp, Heterodera glycines
  Genomic contig location: Contig_ID=SeqID_307; Location=1358..2354; Strand=+
  SCN-specific regions: Sequence locations=1-123,148-216,240-472,494-997
atggcgattcaaaagttggagcaacagttgcgaatgctttccgcggagaatgagcagttgagggcacaaagtgcccggctcagcgcaatgtttggagttgtcggccaaggcaatgaaagcgaacagcagcagcaaatgcaaatgcaactccattttctgttgaatgagttgataccgaagaatgaggaactgctgatcattcaggtggagaaaattcatggggaaatggttttgaatttaaagaaaggggatcataaatccatgtttttctgaaggagaggcagcgaattgaactcgaggctcagtcggccaccctcgaggagcagcggacgcacatcgaagtgctcgagaaagccctttccaacgcgcaggagcgactggcggccaaagaacggtcggcggtggacgccgttgcggtggtggacaaatgcagccatttgcagaggttaggccccaatccaaacacactcaccaactcactgattatgccaatgtcagaatgttgcaagaggcactggaggacaaacagcggcaaaaggaggatcacggacgacaggtggcgcagttggagatggagctgacgcaactgcggctccaatttgccaaggactccaacccatccgcaattggaagcatcgggcgaaaaagcggcggttcgatggcaatttcagcagggacagcgacagaaggcggtaccattgtttagtgtaccatagggctcccaagtatactgagtttccaaatttgggttgacagaaaagttccccttggcgccaacaaatccgaattaaacaacatttaggacaaattttgatatataatacaaattattcattaaggtattggcgatgaaatgttgaagttgaggaaaacgatcagtctgaaggacgaccgaatttcgcaattggagagcggccttttggagatgcaaaaacggtacagcgacgagctgcaacttcgcgagacggcctcaattggcaatggattcaccggcgga

SEQ ID NO: 81802 - DNA, 2263 bp, Heterodera glycines
  Genomic contig location: Contig_ID=SeqID_308; Location=727..2989; Strand=-
  SCN-specific regions: Sequence locations=1-239,287-383,405-737,759 -1342,1364-1454,1476-1957,1981-2031,2053-2263
ttgcttgtgtacttttggccacaactttgctcaacccccccaaatttttgaaacataggtgagctaatagagaacccataggctatcggatgataccaagaattatggtatttgttgaaaattttcattgatggtttttatataacgccctttttgttggcttttatataacgacatagcaccatcgaataaatgggaaacaaattattatttgctaacaaaacattgagcaaaagacgaataaaaatgtttaatattaattaatacatttaattaattttaattaccaaaaacaaatgtagaaaattggagttgttaattttttgtacagataatgataaagtttaatcccattgaatgaaaagagaaaaatcatttctctataaattgtaaaaatttattttctatgcaaaaatacccggaaatgtcctaactctaaataacaatgatgaagagcaatattaattttcattggattcaaattggagccaaatcatatagacggcaagggcgtagacagtggggggggggggctgaaagacctaatacggcgtgccacacttttgccaaattatggattatatgctgaaaaagtgaatttatctagtgaattgaatgataaaatattcattgtcagtgtgccaaatgtatacatcgccactgatttcatttgtgcctttcctactgaaaccgatgccgactttgctgagagtgtccaattgctgtccaagtaccaattccccagtgtgttcatcaaccaattctacccgaggcccggcacaccggcggcccggctgaaaaaaattaacacaattgaggtgaccgaaagggacgaccgaacaacttggggcacttatattaaatttacacgcatttcttctggtaatttctttcagattttgctgaaagtgcacttacctctttaaggcgcgtcgtcggaccgccgaaatgacgcggtgtttccacgcttatcgacgctacactgacgaacggattggcgaggaacattttgttttaatttgtgagagggcatccgacgggcgccatttggttgggcacaacaaatgctacggtaggaaaatccgtcaggatacaggacaacatccaaataaaacgagtatgtcttttccagagcatattttggtgcctgacccctgcctcccccctagcaatgagtgtgtctccgccagcaaaaagtctctgcttggtcactgggctcatgttcggattgtctctgtgtcaaaattttacatgaaatccgaaatcgtcagtttccccgatttcgaggaggtaaagtaaaggaaatgttagtggaaatcaattcaaatttaggaccataagcagagaatggaggaggaacgaatttggacaaatggagaagaaagacgaaattccaaggacaaacattggacgaggattctccgaaatgccgtcgcagtgatggcattgattattgcactcaaattcattctcaaccatttgttttttgttgataggctcagtgaattatagtgtgtaattgttgaaattggtgaacagacccaaaaggtgtaaaccttccaatgatgtaatgaacaaaaattttagtctcttcgtagatgcaccggtaatcgttcacatcataacggcactgcaataaagggaatcgagcaagttctggcttcaatttcgtatacaaatgttagtttggcgaaaagaattaaggcacattttaaaatggaaggtgaaggggaaaaatggatagatatattaactaaacgaggaaaaacaatcgaatctggccgtggttcttcttcgtcaccctttggtcacttgatggcattggcattgcccagggaactcctcctgtacactaactgtcggtggctgttcaacgtgtccgagtcaccctcctctccctttacttccacgaccgttttcccagcatttccttcactgcaatttgatggaattgcattattttgggatttatcaaccaaaggctcttcaatgctttgtagaataattttatcaaaacaataaattacccatcaccaaaacaaaattgaaaaacgtcatcaaaatcattgatccacttgggggaaatgtctcttttttcttctgcgctcaatgcatcgaagtctttgcggttgtcctccggcattatcaccactttaaaacccgcttttttcactgccgccattttctctctgatgccgccaacttttaaaacttggccagaaagggtaatccgccccgtggccgtgatgtcctgcttcaccgc

SEQ ID NO: 81803 - DNA, 1383 bp, Heterodera glycines
  Genomic contig location: Contig_ID=SeqID_309; Location=344..1726; Strand=-
  SCN-specific regions: Sequence locations=1-154,180-233,255-814,837 -992,1014-1383
atggacattgaggattcaatcggtcggctgccaacagagttcgatgaggcaatttctgccgatgagaaggaaaatggaaaacgctttttcaatgtgcgcattatgcggaggaataaaatgagagaatctgaggaaggcgaagaaatgacgacggatggagggggaaggggccaaagggacgagtgccgggcggaccgaagcattctcccgtggggtaagtcctccttttggatctctgtccacttcatgcattcgtttgattttgtttagttcagattgcacagtttttctccgcacttggggctgttcccacaacaacagtgactcagagtacatggccggactgctcgttcaggtgggcgccatggaatatcagactaagggggatgggccaattctatttttcaaaaattgtggatgtttaaaaaagaattttcgaattggagtcgggcaatgctcatgtcagcgatcccgaacttccttttaggcaggctacagaatgactgcggacaaaacgttagccgacatttgggtgcttaacagctgttcgttgagatttaaattttagcaacttaatctgttttaaggattttaggcacagtgaagactccatccgaaacgcaattggccaaccaaattcaagaggctttgtccaactcgaagcgcgtcgttgtgtccggttgtgtgtcccaagtgatttcttgatgttgtttttttagtttttttttttgcacttttcttacgctctttcccttccattttctctcattgtcaggcgtcgccaaatgagccgtggcttaatggtgtttctgtgattggtgttcaacaaatccaccgagttgtttatgttgtggaggaaacactgaaagggaacgtcgtccgattgttgtcgaggcgaaaagcggcgactgcgaatacgccgcaaattgacttatcaatgccgaaaataagtgagaaaatggcaaacatcgaaaatgaactgccggttaaggaaggaatgaattcatcgaaattttggccataaacaatgggtgccttaaccattgcacatattgcaaaacaaaggtaaaacggcgtacaacaatccttagtcataatcaaaaaaacaatttgtgtcccgtctttcttgtgcttgtttttaatgcttcctttgaatttgctttttaggccgcccggggcgaccttcgcagtttttcgctcagttcgcttgtcgcccaggcccataaagcgttgtccgtggatgggtgtcgtgagctgtggctgacctcggaagatttgggcgcatggggacgcgacattggccacacaattgtggaccttttgcgcgctttggtccaagtgatccccgacggatgcatggtcagcccatttgtgctcacctaa

SEQ ID NO: 81804 - DNA, 999 bp, Heterodera glycines
  Genomic contig location: Contig_ID=SeqID_309; Location=2111..3109; Strand=-
  SCN-specific regions: Sequence locations=1-39,63-251,277-528,550 -924,946-999
aagaatgaggaactgctgatcattcaggtggagaaaattcatggggaaatggttttgaatttaaagaaaggggatcataaaacgattgcgacgactcatttaaacaattcgatgaactcgaagaaaacccagcgcataaatattcaaaagaggcccagaaggggttcgaaatggaggacgaggaagtcacaatccgagaaccttcggggacgaaggaatcgttcaaattgcccatcaatatgccgccagtgaaattttctttttggtttgttttggactttgtctaaaaacttatttatcattcttttagtgtctcatgtggttatcgccaagcatatgaacagtttgcgcagattttacgcgaaaaatatcccggaattgacatccacggcgaaaactatcctcccggcattcttcgcacggtgggagcgcaggtgagtggttaagagaagaaatttaatctaacaaatgttttggcgcattcgatttgtgtcttaggtcatcggaatggtcaaaattgcactgattgtgtgcgttgtgtccggaaggagtcctttccccaccttgagacttgaaaccccaactttcttccaatggatgctcagcaatcgtttgtctgctgcacttatgctttttttattttccaatgccatcgaagggtaaataaattttgttactttcactgattgtgagatatattaacaagatcaaattatttaggatgctccaatccacaggagccttcgaaatttacattgaaagcgaacgaatttggtccaaattggaaagtggtcgcgttccgtcacctccggaattgttccagatccgcacaattttacttctccgttaatacccatttactttcattgcaggccattgacagtcatttggcaattcgcgggggcggccccggaagggtcatcgctttctgaaagattttttaaattcccctccaaatttcagtttggttcgccttcctctttcggcatcgatgggtca

SEQ ID NO: 81805 - DNA, 328 bp, Heterodera glycines
  Genomic contig location: Contig_ID=SeqID_309; Location=3769..4096; Strand=-
  SCN-specific regions: Sequence locations=1-328
aggggccatacgaagaacagctgcaaaacatggttggagaactaccaaaaacacttgatcaggcagaagcaacgccagagcagcagaagaggacagcaaggcacagccggcagaagcgcgagtcatctgcagaagaggttctgaaaggcgaggaaaaattctttccctattttcactttttactaaaaaacccattctgattgtgagcatcgtccagtgatttaattttgttgttttttagaatgaacgcctcgcaacaatctcagatgagtcattcccagccgtgtctgctttcgtccagcgttggccaatcgcatcacaaaaatga

SEQ ID NO: 81806 - DNA, 2544 bp, Heterodera glycines
  Genomic contig location: Contig_ID=SeqID_310; Location=546..3089; Strand=+
  SCN-specific regions: Sequence locations=1-503,525-528,550-611,633 -684,716-1368,1390-1721,1744-1797,1820-1923,1949-1999,2023-2047,2069 -2161,2183-2319,2347-2544
atggttcgacaaaaacaaactttctttaataacaatgatcttccgacaacatcagcagcattgtctcatggaaaagacgggttccaagctcccgttcaaaaaagcggtcaaatgaatagaagggttcaaagctcccttaataaaaagcggttgcatgaaaacaatgacaatgaattgaattttgaattatcaagcaaacgaaaaaacacagttgaacaaattattaatttggatgaagtttcgaatgatttttttaaaaataatgattgcgaagagattaaaaaccagaagaagatcggagagtcagctattcgtaaagaattatcacgaatgagaatgtctgatgaaaaaataaacatcgttcagaaatatgacaggaaccgaaaaatggcacaaaaaaataaacatacctctttatatttaatagctggtgaatttcgtgtaaatgatttgagcagttataatcttggtgaatttgatgttaaatgcattcattgcccagctattcattttcaggaagaaaacaacaaaatcaaaggaacccaagaattttatgactgttgcaactatggtaaaaacagtaatttagaagaaatgatacaagaatacccaatggatttgcgggttttatttcaacctgaaatagaccaaaataattacacacaaattggagagttacacaatgatttcaaaaagaaattaagatatttaaattcctctttttcatgtgcgtctttgggatgtatgcgatttaaatttcctgataaaaatgtgccaattttcaaaatacaaggtagcatttatcattcatataatagtgttgctaggccaaatgaagaagaactaccgacgaatggacagctttattttatagatactgatgaagcgattaattatcgattaagtgcctacaaagaccaattaacgaaactttcaaatgataatactatagctttaatcgcttacattgagagttacctacgcgaaaattatgtttattcccagtcatataaaatgatgaaagaagtatttgaaaaagcagtagaaatttcaaaaaatactgactgtgaaattcctgacattacaatgttatttgatgtaagagaaggaacagatttaaggcgctataatataacgaaatcgaatgaagtttgtgctatcatttttcgtgatgctaatgatgatatacctgctgcaaatattgttgtacatttaaaaggaagtaaaaaaatagaaactattttccctttaagtccaatggtcgaacctatgtgttatccaattttttatccacttaattatcaaggctggcattacaatataaaaaatttagaagggaaaaaaatttcattgtgcgatttcaccaaatataaattatttttcagaagagaagggaaatttttgccgcaccattatagtaataaattgtttcaacaatggttagttgatcaggcggcgcgaattgaatggagccgtttgaattacataaaattacatcaaaaagaattatgtaaaggaacatataatgagatagataattttttgtatgcaaaagctgccgaaatcggtgcgcaagttaaaaagaaagtgattttaccatcaacctttagtggaggaccaagaaatttacatgagagtttcatggacgcaatggcaattgtaaacgaggttggccgacctgatttattcctaacctttacctgtaatcctaaagattttgatatacaaaaatgtttgcttaattcacaacagtcatatgataggcctgatattgtagcgagagttttccatttaaaagccatccaatttttaaaagaaataatagacgggaaaatatttggaaaagtggctggattttgttatacaatcgaattccaaaaaaggggtcttccccacatacatatgttattgacattagatccagaaaataaatggaaaaatacaaatgatattgataggtttatatctgcagaaatacccaatgaagaagaagacaaagatttatataatttagtttctgttctcatgatccatggtccatgtgggcctgattttactgatgcagtttgttggtgtaataaaaagaaaaaatgtagtaaaaaatttccaaaacaatttcgtgaaaaaacagaaataaatgaaaatggttaccctttatataaaaggccaaataatggacaaacagttataaaaaaagattggaaaacaggaaaaacaaaagtaatatcaaaccaagatgtggttccatataacagatatttacttaaacgttttaaagctcacataaatgttgaaaaagttgctgatattaaagcggtgaaatatatttataaatatatatttaaagggtatgatgctgccactgtacgttgtgtcacaactgaaaaaggaagtgtaaaagaattaatatacgatgaagcgggttcatttcttgacgcccgttatcttagcccggttgaagcatgttggaagatttttaagtttcctttacaagaaaagtctcattcagtacaaagattaccagtgcatttagaaaatgagcaa

SEQ ID NO: 81807 - DNA, 1105 bp, Heterodera glycines
  Genomic contig location: Contig_ID=SeqID_2824; Location=167..1271; Strand=-
  SCN-specific regions: Sequence locations=1-79,102-383,406-576,598 -1077,1099-1105
atgaagtacatttacgctgacggaacctttgcaagtgcaccaacgctcttttcacaactttacgtcattttggcggggtacttttttgtcaattttgttttacattcgtttttcaccaaatttcagtcgtggtggctgggtgtttccggtccttcattgcctgctgacgtgcaagtcgcagtccacgtacgaaaagatgtttgacatggtccgcaaccgctggccgacattttcaccaacaaacgcgtccatggacttcgaacaggcgatggtcaacgcactccgtgcaaaacatccacaatgctcaatcaacttttgcctattccatttggtgcgcaacatgaaatcacgtcttaccgacgagcaaactcacgtaagaaaaataaatttattgattttgaaattctcaaatttagcgcttcacaaccgacgcagcctttgcacaagctgccaaaatgatcacttcgctggcgtttgtgccgcttgaggaccttacaccggcgctggcagccctagaagattatcttccgggtgaacttgagggcgttctcgattggttggttgagtttttttccaatttccttattaattttaaaggttcataatcaactacgttggacggcttcgcaacaacggcacacgcactcgtccattgtttcgtcccgaagaatggagtgtgtacgagcgaacaatgaacggctccgatcgcacaaacaacttcgccgaagcataccatcgaacgttgcaacatgcgatcggacatggacaccccccaatatggaaatttatcaacattttgcgcgagcgtcagaaattaatcgacgtggacttcgaacatttcctcgccggaaatgctccgccgctgaaagcaaagcgttaccgtgaagcggacagacgaattttgagcattctgaagcgctacaatcaggaaaaagcgcagccgcaaatcaacgatgatcaccaatacggccaaaatcaaaataatccgaatttgtttaatgaaatgcttaggggatttccagcaattatcaaatggaatgaatgattattattgttttagcattttgttatttattcaaaattttattttacttttgcaaataaa

SEQ ID NO: 81808 - DNA, 1180 bp, Heterodera glycines
  Genomic contig location: Contig_ID=SeqID_2825; Location=123..1302; Strand=-
  SCN-specific regions: Sequence locations=1-86,108-888,910-1180
atgagccacccaatttggcaaatcggtctttttaaacgcattaaagaagattcagtcgattgcttggagtgtaagcaaaaaaacgttattaatttttcatcttcatcattttttggtttaaaaatatatttgaatacttttttatactttgaaaaacttttttattaatacagaattttttgaaatttcctaaaatccgcaatcctgcgcaggatcctgcagatttaaaatgcaggatttgcaggattaatcctgccggatcctgtcctgtaaaaaattttgaattccaatcctgcaacaggatccgcaaatttgaaatttccggtctctagtttcaacttcacaaattgcattgcgtggtgcatcttaacaattggccggggtattcgtggctttatgggattcgtagtttggacatttcgtggcttgggcactgtgggggggggggggggggttgatcgagcaggttaaaagccttctgattggttcttgtttggcattttattctaacttagtgataagtgccgaattgttggaccgaaggtcgttgctttggtttgcattcattgtcttttaccgctgaattatgaatgaaatgtcatgtggtagggcggtttagttcggaagcagttcgctgtcattaaccacggcagaagaaacaaatgtctctgactctgcccattcgcccggcctttttgcctccggactatgcttagctttctcggcatgcgcaaaaaaaaactcctcaaatgaagctgttgtttgcataaacggcataactgattttagcgacacttcacgcaaatgatgtcccttacggaggcaatttagagacaccggttctgttgcattaggccctctttcgcgcctccgtgtccgtactatttgaattctctaatgtattttttccagctaaattgaaaattaaattctccccctacggcgctttctatggcttttttagttgttaacatttagaaaagatgtcttttttttgcagagtcagtctttagctctcaatcatcaatgtgttgcatcgtttgttctcttaattgatgttcctttccgattatcagtgaactcaaatttcattgaaatgttgcgttcattgcttgctgatagaaccaagtcaaatggtttctgctggattccatttgcctattcccaaatggttcgttaa

SEQ ID NO: 81809 - DNA, 707 bp, Heterodera glycines
  Genomic contig location: Contig_ID=SeqID_2826; Location=1690..2396; Strand=-
  SCN-specific regions: Sequence locations=1-45,67-127,165-233,255 -618,672-685
atggaaggtgtatcgaccagcaatgatttgaacgtcggtgagagcgatgatgaagaaaattgtgagcctgttcatttccaacgtggcaaaacaatccgaggagcgctttgtctttggcaccaaggtgttaaaatttttttttttggttttaattttaatttttaggctttcgctttttgaaaatacgaagtgatggcagctggttcaggtgcgaacggcgtaattgtccagcgacagcaaaactggaggatgagggactgatgacgggcgttttgggtcccaaagaacaccatcatggccttgccccatcgcgttttcatgcggagtcaaaacgaaatcagatgaagcaactgatcacggagaacccaaagcaacaaccatctcaactgcgcgcacagattcggaccaacgtcaacgacgaagtctttgagctgcttggcaccaatgaagcactcgaccaaatgacgaacaggtagaaaacaattcagtcgaataatgatacaacatttactagggccaagaacaaattctcgggctcgtgatgcaaggctttgcggagggacttcacgtccgtggaaattcagagagtggtgaagaaactgaggccgatgaaaattgattttaaacattttcatattttattgttttttttgatattttatatattttatgaagatttctttgctttgaagcacttttaaaataaa

SEQ ID NO: 81810 - DNA, 969 bp, Heterodera glycines
  Genomic contig location: Contig_ID=SeqID_17330; Location=29..997; Strand=-
  SCN-specific regions: Sequence locations=1-752,774-815,838-969
atggccgatcaaaccgacgtttttggggttgcttcgtcaagcattggaaagccaatcagagttgaacttgggacagggagcagaaaaacaattatttccggcaatttactaacgacagacccggagagcggctcaatagttttggttgagaagcgtcagcaaaataaaacatcggatcaggggaaatgcagccaacgattcattctgattcccggcagttctgttcactctgccaaattggttacaattaatgaagggacaattgggacggtaaaaaaggatggacaattggaggaagggacgaagagtaatgccgaactgcgcgagaaggcggacggaattgagtcgggggacgaagcgacaatcgaaagccatggaaaaaggcgagcgaataagacgaacagaattcatggtcttggtttcattacagaaccctgtccgaaactgtgagaatctttgacgaattcgcactttcgaggcgcctttgtctgattgatgcactaaacaaatatggcatcaaattcagcgaaaagccacatgttttagtacaaaatattgacaatggacagactgagggacaaatgccatcgacggtaatttctctgcagagcagcggcatcaaaatctatccgccgtacggaaaggtaagaaaaggctagttttaagttgaaacatttgttaggttattgactccactttctatctttaaaaaaatttgaaaaattttgatgagaggtcagcggcgaaaattacggatattggggatgtcaaaacatttgttgtctttagtttttacactttcttggggtccgattgaaaaatattttgttaaattttaccctccccatcaatttacctcttaaaattatgtttattgtttaaattcagaatgatataatcggcggtggttcaattgtagtcaaagaattgttgcacaaactctccacagaaaatgtttttgatgagtga

SEQ ID NO: 81811 - DNA, 1436 bp, Heterodera glycines
  Genomic contig location: Contig_ID=SeqID_17331; Location=222..1657; Strand=-
  SCN-specific regions: Sequence locations=1-208,233-606,637-677,707 -960,982-1436
atgctgattgacaatgtttgggtggtccaactgttcagcatcgtcgccctgacttccttttcgctgtattccacttatttgttccccatcaactacttcgacttgctctatcgttgtgctgttcatcttggccattgggaattaattgagccgatctcacaacaaaacaatgccattccgtcccaacagcagcgatttggcattcggcaacaaaacgaacaacaacagcaaaatgaaacttacgagtctttcagtgagtcgtaagtgttttgccaaatgattttttatttgttaaaaatcgtgcggtttattgtcagtgcgtctgtgccttatcaagacgggacgcgactgcttttcaagggcaatttgtatatcgcgagaagtcatgcccattatcacactgtttctgctgaaccggacaacaaattgcattttcgactttttgtaagtaaaggaatgggaaaccgtaaaaatacgatagggccaaccgttgactcacaaaaatgtttaaattttccaacacaaaacagactaattgtaagaaatggtctacaatgtttggaatcactttaaagaatactcgcacatcatgtttattttaatacgtaaaaaatttagttttttattttttatattgctagaaattcttcggcattctgatcataaattttggccattttttaataatttcattcaatttcaaaaactccctcccataaaaatattctcaatttaagaaaattgcgaagaaccctgtggcattagcttcttacacttgtgtcttccaatgtgctttaattgccttcgaattttggcttcttttgttgacaaacgattggcaacaaattgtcactttggtccttcttatgtttgccaattatttgctgctcgcaaaaatgttcaaagatcgcatcataatcgatcggatttacaatccttctgaagaggatttgcagcttattaaacaattgcaggaggaaaatgaacgttcgcgcagagaaattggaaagcgaaaattggagaggaaccaaaagcgatgaattatatacgacgggaattttgcatggacgggacagggatttttggtctccggggcccgtagaataagagagtggtagtggttaaatgaccatgaccttgtagtaaaaaatggtagaataagagctcgtggtttgcaaccatgacctcatggttatttaaccatgaactttgtggttatttagccaccaactttaacccgtagaataagagacgaccatggttatttaaccctatgaccatggttgaaaaagctaccgcgcgagagggcatggttgcagaagtaaccaccatctttagccgcttataaaaattaatccaataattttaaaataaccaaaatgataattttagataaagcaagcttttctctttctgtatatactaatttcaataaa

SEQ ID NO: 81812 - DNA, 647 bp, Heterodera glycines
  Genomic contig location: Contig_ID=SeqID_17332; Location=270..916; Strand=-
  SCN-specific regions: Sequence locations=1-122,145-348,370-494,516-647
atgaccaaaaatatgagcaatttggtcgtccccatggtttggctcaacgaaagtgccctgatcgactcggccactcgtgcccaaatctcgagacctgtcacggcactttggggcacattcgtcgttggcattgtttttgtctgtgccggggtcgtctttctggtcacgttcgtcggcgttttcattgccaacaaaatgacaaatcggagctgtcccaatgactcactgaatttgatcgccgaccctccgacagagggcgacccaactgaggcccaaccattggcagctgctgatcagctcactacggatcagtgattattccctctgctgacgacacttattcaattcttttgctttgtttcattttttcaaatcccaaattgctcatcttaaaaccgtaccataattgaatctgttccaaaattagagactggtcatcaatagggctgggaatttaagtcaaatgactttttttgctgactctaaatggccttaaaatgacttaaaaagtgttctaaactttgtttgaagcgtctaacatgcacttttttgcgacttttttcgtgatttttttgactttttgaggcaaaatttgaattttagcgaagaaaatgccgaaaaatacaaagaaaatttagaaaaataaa

SEQ ID NO: 81813 - DNA, 972 bp, Heterodera glycines
  Genomic contig location: Contig_ID=SeqID_17332; Location=1183..2154; Strand=-
  SCN-specific regions: Sequence locations=1-972
  Gene Ontology: Mol. function=transporter activity; Cellular component= integral to plasma membrane; Biological process=apoptosis
gtgttcatctccgtttcggttgatgagctcctcttcaacggttaccaggacccgctgatcagtgaaatttgcagcaatgttttattcaaaatgatgtgcaaattggcgaatattccggacagaattggcctcttttacggggtattttttttactatcagtatgaattggccaggcttttctggcactgaaaaaaacctttcttttcttgaaaagtacttattttagtgtaaaaacttttgtttaaaactaaatttggcgattttctggaccataaatccactaagtaagtgcgtgtttttggatggtatttctactcattagatttactttcgttcagcaaaataacacggacgatggccaatatgcggtggacactggactgaacgaccccgattttttggaccgcgtgtactccttcaaagggatagagggaaaactgagcgacgaccattggtacggcgaaagggcgcggatgatcaacgggacggacgcggaactgtttggaccgaatttgatggatgcgccgaaattgcaaatgtaaaaaggccgatttggcggtaatttgagactggctttcgcatttcagattcattggccaactttgccggtgagtcgcacagtttaactcattcaaattcacacatattaatgcctttttatagttccttcgatttggaagttcgtcagcccgctctcaccgccggtctccccgtcttccgatacgcccaacccgactcggcgttggacatcgctgtgcagcggtcgcaaggcttttgcaacccgaattccccgcttttcttcaacgagagcgtccaaccgggtaaatgcgttctgagatgggctcttccatggtgcattttccatttccctttcagttggctgtgctccgtccggtcttctcgacatgtcctcctgtttccccggctctccccccattttcttttcggcctcccattttcgaaatgcccac

SEQ ID NO: 81814 - DNA, 3191 bp, Heterodera glycines
  Genomic contig location: Contig_ID=SeqID_17333; Location=85..3275; Strand=+
  SCN-specific regions: Sequence locations=1-723,745-927,957-1000,1023 -1082,1207-1469,1493-1944,1968-2064,2092-2419,2441-2889,2911-3191
  Gene Ontology: Mol. function=protein kinase activity; Cellular component=nucleus; Biological process=protein amino acid phosphorylation
atgaggaggaaaaagtggcggtccaaactgaacatccccgaggcgatgttgttgatcagtggtcaacatttgcaggtcgtcggcgcggcggtggaaagcggcggtggtggtagtacgtcttcagcggtcggggtgaaacggcgtcaaacttcgacgacaaagcatcgattgagggaaggcgacgctttcccaaaagcggaggattcggcggacacaccgccgtcgttgtcgcaggtcgccagcagttcgggtgacagttcgtccggcgtttcgtccagcgcgtccatccaatatttgggcactcgccgtccgacggccattaaagtgcgtttttgtgtcgaaaaagcgatggaaaatgagaaatgccaaatttgcttcacagattgaagaagaagactcgctgaccagcgcgccctcctcctcttcgtccacgtcagcgcgagcactcgctgcgcatattggcaatccgtcaaacggccgggcacagcgaacggtagcagcaccatcccatccaaagaagcagcagcaccaaacggaggacaaagggcacggcgagacgcacaaaccgcagcaaacgcatcagcggaaggacaaccaacgagacaagggacagggcattggtggaaaattggtcagtcatcagcggcgagtgggacaattttaagggcaaaaaagtaaaagacgaaggggaaaatggaaaggaaggcatagacattttagttaaattttcaaccattttaattgaaagagtggggcaaagggaagattggaagggatttgtttacaaaaccaccaccaaaacgaaaagctgggaactttttttcacaatttaccagtgataaaaccccagtcgaacttgatgaattggctaattttgacgacaatttcgggccgcaaatgtcaaaacaacattcgagaagttgtttgaataaaaatataatttaaactatttttttcacacgacgcattgtcacgtggcatttatcaaaaatttgttaatcacacttttacccactaataaatcacacaaacgtgtgatgtgtgcctctctacaaagtgcaaatgttgtacatctctgctcgtccctctctccacccccctccccctctctctctttctctctctccccctccccccccccctctctctctctctcctatcccctctctctctctctgtctctctctctcccccctctctgtctctgtttccatttttcgaattgaactttaatggggacggatgggaaatcttgtgcgttaacgatgcgtgatgacatacatatatattgacagggttgaaaattcattttcttttctttggtttacccggtctctccggcagaacgacggattccttccccactccctccccccgtcggtttactgctcgaacaaaaataaataagccatcatgggacggtcccacggggagggtgaggatggggaagtatattttacgcttggtagccccctcccccccccccccccccaagggggcattacaataaaccccaaagtcgaccctaaatgttttcccattttggtccttccatgtctccccgtccctaccgccgtcgtttcctgtttgatatccttattagcatttccaattgcagttgttcgtggacccgtccacctcgcatcacccgtccaaggcatccgtcgtccagcagccgttgcgcgacatcgaaatcgcggcagccgcggggaacggaatgttcggtggcgcaattttggggtttgtactttttgctattcaagcgaaatgttttttggcacgatattgcggcgcgtatacaacgccattttgaattttatattggcattctgttcctttcgaaattgtactccttgaccaatttacacattttaaatccaccaaattttagcggtggtttttctgtcgctggcaattcgtcgtcgtccgccgccgccgctctgtatcaacaacagcagcagcaacatttgtcgggccatggcttgggtgccgtcgcatcaaacggcggcggtgcttttctaatgaaaaatggcaccggttgcggtggtaatcttcgtgccgcggcacaccaccaccacaacaacacgaacagccatcacaatttcgtgcaaccgacgacgacggcactgctcaaaccgatgggcgggggaactcaaattggacaaacgcagcagccggggcagtcgaagcagcaccagtcgggccatcacaagtcacgacagagcacggagggcgagtatcaggtgggcagggattggggacgaattggatttcccggggacaatgggacagagcgggagacaaatccgagtgggacggaaattcccccaaatttagactaattagtgccaaaatggaccaattcatggctaattattgtgatcggattaattttgctgtttttagctgatcaaaaacgaagtgctctcctcttcgtacggcaatcagtacgaagtgttggaattcctcggcaaaggcacttttggccaagtggtcaaagcatggaaaaagggcaccaacgaaatcgtggccatcaaaattctgaagaagcacccgagctatgcacgccaaggccaaatcgaagtgagttctgttgcactttgtttctggcattttttgcatttatttattttttctttcggtgtccattttgtcccgtctgagcaacgaaaatgcggaggagttcaactttgtgcgtgcctacgagtgcttccagcataagtcgcacacttgtcttgtgttcgaaatgctcgagcagaatttggttggttttttgctttgccaatgggcagccggacgaatttcattaaaaaggcaccaataccttcaaaaatgacaaatttacttaaatattttggttggtacctggtgattaatttcgattttcgctatattttaaattctaaatttgccatatttttgaaacaatttgtcggcatggcaaccacaaactgaataattgaaacattttttgatagcgctttatcgggacccaattcccgacgcttttcacctgctgatgatcttttgcttgattaatgcctcctttcccaaaattcagtacgacttcctcaagcagaacaagttcacgccgctccctttgtcgtccattcgtccgattgttcagcaagtgctcaccgctctgcttaaactgaaacagttggagctgatccatgccgacctcaagccgg

SEQ ID NO: 81815 - DNA, 3499 bp, Heterodera glycines
  Genomic contig location: Contig_ID=SeqID_17334; Location=452..3950; Strand=+
  SCN-specific regions: Sequence locations=1-137,159-297,357-397,419 -436,458-528,550-564,586-761,783-1278,1300-2000,2022-2174,2196 -2774,2796-3012,3034-3370,3395-3411,3433-3452,3475-3499
atggcaaataaatttgtgcttgtaccacaagaaatttaccggggtctcacctctgcgacggacacgggtgacatcaatttggatgctgtacgacacgatttgacgcgtgccagggctgaacgaacaaacccttcagctaaaaatgtcagctacaatcaacagcttaggcgatacttgcaaatgagacgggaggtcgcggacaaaccagcacgggttgagctagtcaagggattgagtgttctgatgaggcgaggcggtgcggatgatgaagcagaagttgtagatacaccaccccgccctcctcgtcctcctcctccaccaccgcttcctggtcagcatcctcctcgtcgtccaccaagccctccaggcccaggtccgtccccgccggggagtcctccgccgcgtccacagcgtcctccgagaccacctagagctgctgcgccgccctcttggagagatgggcgtgtggaggaatggcgaaaaaagagaaacgacatacaacaacggcagccggttgtgcgggaccttcttgctgaagcagctgctgctccgctacccgaaagtgacgaagaggatgactacatgttggagagcgattcactctgccagcaccatcacaatattatggcgacttgcccgttctgcctgacaacgcggacgcaattgaggagatggacactgcacagcacaggattgcaaccagaagaaagttacataatggcgatgacgatttgcatcgcaaaaaataccgggtctattatcctcctcccccttctcgcccacccccgtctcgtccacagtcaaaaattgaaacacctcgacctccaccgcgtcctagcctcaagaaacaaccacaaccactgctcgatcctcggccatccacatcacaacaagttgatcgcaaacctaaaagggagccaaagttcgatctggatccgcgaccatccacatcacggcaagccgggtacaacccccctgcggaaccaaaacatgagcagaaaccgtcaaaaaagccacctcctcgcgccacaccctatcatattccgaaaagagagccaaaaattgaagaaacagtgccacggcaccagcaaccttctcctgctgccccacaagtgccgcctgttccgccgcctaggagagggaccaaacgtcgccaccccccggaaaatggtgatgagagtggtgagctgcgcatacgtaaacgagtgaggcaagcgcgaagagtacgagtgtattactcaccagagccgggtccatcaacatcagcacaaagcgatgaacaacaacaacaacaacaacgtgaactgtttgccattccgtcaaatcagctgaccatggcacagagaattgagctaatatacatcaaatgcaaccgttatgccaatcgtatgggtgtccggggaaacgcaattatcaacactcaaaatgctcaaccattggtgcgaagcaatttacgaacggccatcaggtatataattgacagaagagcgggtcgacctaccattagaccaccgggagcggaccaattggaggagcggcttaggcaggacccaattttgtattcattgacggctccaccaaagagaccatcgcagagcacaaacagcagaacgtcaataaagaaggaatttcagccgaaaaaatggaaatgatcaacaccactcttgacaagctgtacaacgatccatcctctcctgctgcgtttgccggtgttagtgcactgtggaaggaggcgcggaaaaagttaaaacaactacggaaaaaggatgtacaacactatttggagggacaccgcacgtacaccctgatgcgccccaggcgggtacgatttccgagagcaaaaactgtagctgctggcttcatgaccgacgtccaagtggatttggctgactttcaagcgctttctcgtcacaatcgcggtcaccgatacctgctggttgcggttgatgttctctcaaaacgcctgtttgtcgttccactcaaaaataagaaggccgaggagatgctggatgcattcaaagagcttgtcaagcaaatgccaatggtcccacaccgcattttctccgacaaaggcaccgaattcaaaaacaaattgctgaaggaattctttgaggagcaggagattgagaaacatgagcccgtgcattcgtcagtgaaagcgtcagttgctgagcgcgccatccgaaatgtgaaacagcgactgtacagatactttgccgaaagggagacgctgaattgggttgatgttgtacaacaaatagtggatggaattaacagcactccgtcacgggttcacggaatgcgaccaattgatgtcaattttgaaaatgctcagaaggtgtggaagcgaatttatgaatcaccgcaaaaacgcaagaagccacgtttccgtaaagatgaatttgtgcgcatgagcagagagaagggacagttcgagaaggggtatttgccaaactatggagacgaaatcttggaaattgacgaggtgctgaaggcggtgcgccccgtcagatacaagctccgggatgatcgtggtgaaaaattccggggcaccttctatgaccaggagttggcccgcgtgagaaaagatgccgacaccagttacagaattgaaaaagtgtacagaaagcgaagaaaaccggatggaaccacagagatgctcgtaaagttcattgggtatcccgaacgagaatggattgacgagtctcagattgtataaaagcgtttgaatttttgtgtatttctcatcagttgaataaatccataatgtcaaatagtttctttgtgtttttgcctagcaatgtgacggattatccggacaatcagccaaacaaattccgggtccggcttccaaaacctttgcatttcatcgggtcttgggtgcgtgggctgcacagcattagtcaaacgccgcatcgtacgcgtgccggtcccaaggtcttcacagaatcgagttgaacagctgagagactttttgacgacaacgctgagaaaccatgccaatgctaaactaaagccactcccgcgagaggaagaagcggaccgtaacaggacaaaaccactttactctccgccacctgcaaagcgtgcccggagatctctagcgctctcttcgcctcccagacatgaagaagctcctgcacgatcacttgaatcgcctcccagatatgaaaaagcgcctgcaaaaccacttgattcacctcccagatatgaaaaagcgcctgcaaagccacttgattcgcctcctaggcatgaacaagtgcctaagaagccacttgattcgcctccattgtatgacgaatcaaagctgcaaaaaccacaaaagtcacctgaaaaaccaacaacatccactccaactaaaccatctacaccacctgcaagtactcctcctcctctaccaaaaccagcaaccccagcagctgtttctaaaccgtctcaaccaattgctcctgcaacacctactgctaaatcagtagcaacacccactccagctaaaacg

SEQ ID NO: 81816 - DNA, 1867 bp, Heterodera glycines
  Genomic contig location: Contig_ID=SeqID_17337; Location=436..2302; Strand=-
  SCN-specific regions: Sequence locations=1-120,142-291,313-370,392 -445,470-546,568-670,692-723,767-915,961-1127,1151-1568,1609 -1616,1639-1867
atgctaacttttaccaatttgtcaacagaagcagatgaaggtaagaaaagaattggcattgaaatggataaataaaagatgaaatatataaaaaaaatattccattaaaaaattgaaaagaagggaatttattttaaatttcaattctgtctaatataaaaaatagctgccgaattttggtcaaatatcttaaattgacatatggtcatttgttgggttcgaaaacaaggcatatatatatatatatccgcaggccttcaaaaattgccgaataccggaatataggccttatgtatttcagaatggaatatgcagatttttttttaatttcttcaaaaatttcgacaatttttgtagcttttgcactttggaacataattttgaaataaaattccggttttgaaatgcttaaattcttttattccctaatgaatttcattcaaaatttcagaagtgtattgttgtgattcttcgattatttttggtcaaaaattggacaattcagaatcaaccagtgatcaacaactgatgaaggttgtctaaatatgaacagaaacaataaaaagacatttaataaaaaacaattgtgattattctaattataggaaattagtcaaaagcttgccaggatggaaatggaattgcgggaaacggaacaattgtgcataatggaggacctcagaattgaagaggcaagtatttatacatacaaatttcttattgtattaaattatttatttactttttgcataaatatttataatttgcttttcagtaggcacttcaagcagagttagatcaacagaagcagatgatggagcaattttggttgttgcatgaaaaggtggaaaaaatggaaaaggaaaattacggtaagaaagttgattacttgaaattataataattaggctttacttttaaaaattaatcatattttttttaatatttataaaattttttgcttcctaattcaagcttctgatgatcaattcacagcacacttgcacaatgatcgaaaggcaattttggaacggatcagtgaattggagaatcggcaaaaggaggtgaataaatgggagagggaagaactgacgaaaaagatgacaaaaaattcgttaatttcgctatttattacttttaaattaaaaatgaaacttacaaatttagaaattttcaaatgtaaagcagccaaattgttgggatgcgaatgcttgtcactacgaaattgaagtcactgatgcccaaaaattgacggcggcaattcaagaatgggaaggagaccgaaggagtacgtataagacaaaataacagataaaatacctagcactttgggtttgaactcgttatgggaaatgttttcttttgctgggggggctttaattcaggggggggggggctatattaaagggaatacggtatttattttgttatggcatttatttggaaatttaattttcttcagtctttcgttctgtgttcgccaaacatccgcttccatacgccaccaccactgactttcacaacattttttactttgaaattttgatcataagaatgcgatggtaacgtaatttaaattaataaaaataataaatatttaattaataaggcaaaggttttttttattatttttaatttggcactttcaggaccattctcttcggcttttccgtcaaacagctgatgccattgaatgagaaaattcaggactacactggcacttacgtattttcaaattgcggtgaattttgggccaatggctcgaggaaaggtgaaactgccaaattttcccgtgacgatgtggttggcattggcgttgactttggcactcatcaaatattttttacgaaaaatggacaacgattgg

SEQ ID NO: 81817 - DNA, 481 bp, Heterodera glycines
  Genomic contig location: Contig_ID=SeqID_17337; Location=3461..3941; Strand=-
  SCN-specific regions: Sequence locations=1-481
atgttaggcctcggatgggaatcgaacccactcgtgcaccctttccatgggcaagctctaccattgagctaccgaggcacatccgccctttcttttatggattatcaagcccgctttccacgttttaaccgcccagccagcttcttctttcagagctatcgaatgatactaagaatgtttaatttggatgcttctagaagaagttttgaagcgttaaagttgtcattctattttgtggtcatgtttatttttatgatcgtgtaaactgcaatagagccatttaattcaattaatcaagtgaatatcggcgcgactcgtgcggatcccttcgcgacggccaaattggacgcacgatgttcagaagtggtggcacggcttggatggtctcattaatgtcgaatgaatgccacaaaacgggctaactctttttcacagctgtttacttatattattgtacctatttaatttaaaaagtaataaa

SEQ ID NO: 81818 - DNA, 2742 bp, Heterodera glycines
  Genomic contig location: Contig_ID=SeqID_17338; Location=316..3057; Strand=+
  SCN-specific regions: Sequence locations=1-222,259-400,423-642,685 -1112,1135-1291,1468-1639,2180-2345,2368-2742
  Gene Ontology: Mol. function=myosin light chain kinase activity; Cellular component=cytoskeleton; Biological process=protein biosynthesis
atgcatggcttcgaccctagactcccaagtgaagtgacactcggaaaggtggaggataatttttcggatatggcaatatatgtgcaggagttgacaaaacgaatggaagaagttaagacaacagtaaaagaaaatctgaggaaatgtgccgatcaaatgataaaacaacaaaaatggacaaaagagatcccatggagggaaggaatgctggtactgaagcggaaaattgacaaaagaaataaactggaacaaaattacgatggcccttttcgaatagttactgtagagaagccaaatttgacactcaaagagatgcatgcagacgctatggggtttacggtacacatggaccagtgcaaccgtatttttcaaaagaagaacaaattctggtaccaaacgaagagccaaatttgggatccaaaagaaaaatcggggacaaaaacttggaagatacagacggagaggaagagaccgaaataaatgcaataagcatggaaatgcttaccgaatttgatgatggaaataatttgaacaagcacggattattatttttgatggaaataattttggatggtattgtcatcaccgccctatacccgaaagactcttttgaattttcatcaatcccaaaatctatggttcaatcccagtgggaaatacacaagaccagagaaggagatgaatatttaaccgcttggatttttgacgaaaacattcaacttttcataactgaggaaagggaagacttaattattgggaacgaaattcaagcgtggttaaatcaaaacggaaatgtaatttgcgaaaatagagaagcaacctactgggagacttatttggacatggacggactcatttataaaaataaaatcacccccgaattttggataacctataatgagcccgaaatgtgtaaagaatacgaatctcgatcatgctcctcttcaacgatttttttgaatgccgaagaatgttcaaattcaaatttacaggacaaaaaaatcaatatcctacccctgtctctaataatggctaatgctgactcaccaatactaatttctgatgaggaactaagcgacgacgaaatacatttgagaaaattactattgtcggaacaacagcaacaacaactacgtgagcaacaattcaatcccgatcggccctactcgtcgacagtgcattccctgcccaccaaccaggtccaaattgtgaccccagcacaaggacaacagctaaagcgtgaccaacagctagccctgattaatcagaaaataaaagagatggaagccgcaaaaagacaaattgaagaagaagaaaccgtcgaagaagaagcacgaattgtaagagaaaaggcatggaaagcggaagaacagaagaaaaggacaaagagggaattggatgaaaagatgaagaaaagggaagaagaaaagaaagcggaagaaagggcaaaaaaagacaaggaggaagtcaaagcggcatttaagaaaattggaatgagtaccgaagtggggggaaaagaagatggaaacaaacaaaaaaagaacaaatcgaagaagaaccaaaagggaaaggatacggaaagtggaaatttggaggccgaaaaactcaatgatggacatagggaagctaagaaagatgcagaagaaaaggcgacgagagaagcagaagcgaagaaagatgcagaagaaaaggcgacgagagaagcagaagctaagaaagatgcagaagaaaaggcgacgagagaagcagaagcgaagaaagatgcagaagaaaaggcgacgagagaagcagaagctaagaaagatgcagaagaaaaggcgacgagagaagcagaagcgaagaaagatgcagaagaaaaggcgacgagagaagcagaagcgaagaaagatgcagaagaaaaggcgaatagagaagcagaagcgaagaaagatgcagaagaaaaggcgacgagagaagcagaagcgaagaaagatgcagaagaaaaggcgaatagagaagcagaagcgaagaaagatgcggaagaaaaggctaacagagaagcagaggagaagagagacgctgaggaaagggcgaagagagaggaagaggaaaaggaagcggcagcagaaacaaaaagagacgcggaagcaacggcaaaaatacacagtgaaaaagaaaaaaagggaaaaagagaagggaatgtctcaatcaatgtggagggcgcaaagaagaaaattatggagacaattagcgaaaaatggatacccaaaattgtgggaagcatttttgacccgcgaggtgaagaattgggggacgattggacgatcaaaaaaatgccaagaaaaccgggaaaaagaggaccgactgagagagggaaaaagcgaagagcgaatgaaggcgtggaaggaatggacgcagccaaaaaatcaatgggaaagtggtggcacggcacaaggagggaaaagattttttgagaacacgctgaaatccgcagtgatctcggcgaatgagacacgagccatcccaccggaaggaatgggctggaaacgtcatgtaccatgctttcaagcagcgccgcctggccccggcttcaagcgccgacaccacgacgtgagcccaatcagaagaatggacagcacgggacaagggacatcggcggcgagcggaacggaagaaaagatcgtgaaaattcgaaaactgttgctgcaggccgccgacttattgggagaaatggcggacgaattgttcccgtataagaaatag

SEQ ID NO: 81819 - DNA, 105 bp, Heterodera glycines
  Genomic contig location: Contig_ID=SeqID_17340; Location=75..179; Strand=+
  SCN-specific regions: Sequence locations=1-105
acgggacaaatgcgtggccaatttcaactcgaagttctgcccaaagttgggcatgccgtccacgaagactctcccgaattagtggcaaaaattttcgttacgctg

SEQ ID NO: 81820 - DNA, 937 bp, Heterodera glycines
  Genomic contig location: Contig_ID=SeqID_2828; Location=6993..7929; Strand=-
  SCN-specific regions: Sequence locations=1-44,70-414,436-777,804-937
acttaattaaaaatcgacaatgtcaccacattcgcctcatacttctttactgcctgaagttcccttctctatattaataaatcattctccagaccttattggtcccagggtaatggatgcgacagacaggacatttataacttttcataatattctgtctaaatatatcaatcccaaagagcccaatttcgatgaatttctagacgcagctaccttctgttacaatacttccattcatgaatcaactggcgaaagccccttctttctcgtgtttggcagagacccaatctttagtattgatcaaattcttgatccttccgtccatctaccactccctcacaatgacttagctgagttcaaaaccctccttgtcctttccctaagaaaagcctggaattctgcagctgactcaattaaagaggctcagaataaatcaaaagtacaatatgataagaaatttaggaatcctaatatttccattggggaccgtgttctgttacggaattatactggaaaaccgggcacttcccaaaaatttcacaatccatggaagggcgttttcagagttattaacatagaagaactccatgtcaccatcgtcagttgttcctccccacaatccaacccatttaaggtccatattaatcaactgaagaaactttttgagatttccggtcctcccagcacctcccccgtcctctcttctgctgaaaaagctgctttagaagcagctgaagccaccgagataccaaacacgataggcttcaatcatacccctgatatttcaccaaaaaccctccctcctgatacccaaaaatccaatgtaccccaaattttacctacttctattgacaaagaacaagcggttttctctcagcgggatctcttgcataaaaataaatacaatctccgctctcgcccaaggtctaacagtttt

SEQ ID NO: 81821 - DNA, 2877 bp, Heterodera glycines; identical to SEQ ID NO: 17344
  Genomic contig location: Contig_ID=SeqID_17344; Location=1..2877; Strand=+
  SCN-specific regions: Sequence locations=1-415,438-1083,1105 -1169,1191-1271,1293-1377,1400-1787,1810-1954,1976-1987,2013 -2288,2310-2877

SEQ ID NO: 81822 - DNA, 487 bp, Heterodera glycines
  Genomic contig location: Contig_ID=SeqID_17346; Location=689..1175; Strand=+
  SCN-specific regions: Sequence locations=1-212,234-289,326-487
caaaagaattggtttccgaatttttgaacaaattccaaacactagcggcacagacagcagatgtcggcgcgttcatgggaaggatttccttggaagcgtatgccctactcaaagggtgctatgacgttagtcaaaaaccatcataatgggcgttagtcaaaaaaccatcaaatgaaaatattttttgatataactttgttcaaaagcatctaaatttttaattcttgatatcattaaatagcactaagagtttctattagcctacaaaaaaaggtttatacagaaaaacattaaaaaattgaatttttaattattaaaaataataccgatgaatcaaagtgaaaattttcttaactaatttgctttttatttttagaatgtgcatgttccatccgcacatttgtggcaacaaattgactttttctgggacccaaatgttgacaaaaacgctgacgatgtgaggcgttttaaacagatgcgctggtga

SEQ ID NO: 81823 - DNA, 920 bp, Heterodera glycines
  Genomic contig location: Contig_ID=SeqID_17347; Location=169..1088; Strand=+
  SCN-specific regions: Sequence locations=1-409,437-551,573-920
atggccagaaggaactcaaaaacccagtaattcgaactttttttgctcagatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttcggctgacgacgttttgtcctactccgctattttcatacagtcaaagattgcacaatcgtcgagtggcacagttgcttacgattttctttgatgagctggcgtcaggtggaaaaattaaaaaatttgattacattttcaattaaagggctacacctttggtttacaaaacttgaaaacatgtggcagaaaacgttttaaaaaatggaagaatccatacgtatatttttttaaatttaattttatttgagtttggatgtttgagtataaaggaggtaaattaaaaaaacgtcgggatttcttctttccatattcaccaatgttttgacttttggtctttttcgccattaaaattcctagtgattaaattttgagagaaacaacgataattggtgaattttcgattttagaaaaattgacactacaattcggcacaaaacgcatttcgtgatgtcaaaacaattttgattggaactggcactgaacctcaagaagtgccttctccaggacataatcagtgaaaggctttttcatcgcaaagcaatccaggaaatggaaaacatcattcggctggacgtgcttagaatggtatggacgtgccgaagactgagtccactgtttttttgaaaaattctccaaaattatccgtttatctcgtattttaatccatgttttggtgttttttaatcaatataaatcccggcctttaatatatgataatagatttattaa

SEQ ID NO: 81824 - DNA, 385 bp, Heterodera glycines
  Genomic contig location: Contig_ID=SeqID_17347; Location=1..385; Strand=-
  SCN-specific regions: Sequence locations=1-385
cggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatctgagcaaaaaaagttcgaattactgggtttttgagttccttctggccataacttttttaaaacttaacgaaaatttttgagattttgacaattaataataaacacatagagctatcgaacaacaccaacaattcttaatttgattgacagcgaacaaagttatggttcaaaaagttttccgacgacgtttcggccgacgacgttttggggtgcaccg

SEQ ID NO: 81825 - DNA, 488 bp, Heterodera glycines
  Genomic contig location: Contig_ID=SeqID_17347; Location=1161..1648; Strand=+
  SCN-specific regions: Sequence locations=1-278,303-369,391-455,483-488
atggcgttcaacggcatgttcgccaacattacttttgacggttctcagtcgagaatggactggtatctaaacaaagtaaaaaggcgagtcacggacatcattgaccatgttcagatatatgtatccactgaacttgtaagtcgctttttaaaagattgtcgaaataaaaaaataatgcaaaattcggcgccggaccgggagacccattttcttgattcgggtccgggttttgtttttcacaaaaaaccaaaaatgtttatggaacggagcaaaaatcgaatttaaattaaaaataatattatctttaatgtttgtcattagaatgcaaaaaataattgaaataagtagaataatttcagcaatttatagtaacacttacccaacttgactttttaaaaattcaatacccggtgtccaacgggtctaaaaggcgtggaaaaatcccagtaaaagttttcatgaaaataaagaaagaaagaaatttttga

SEQ ID NO: 81826 - DNA, 69 bp, Heterodera glycines
  Genomic contig location: Contig_ID=SeqID_17348; Location=145..213; Strand=-
  SCN-specific regions: Sequence locations=1-69
atggattatggggatgaacagaaaaggaacaaaatgaataaaatggtgaccaatcgaatgaagggaaaa

SEQ ID NO: 81827 - DNA, 1082 bp, Heterodera glycines
  Genomic contig location: Contig_ID=SeqID_17348; Location=465..1546; Strand=-
  SCN-specific regions: Sequence locations=1-358,380-556,578-730,758 -1082
atgcaatgctttcttctgttgttcgctgcaccgattgttcttttctcgctttttgtcaccacaaatggtggccaaatgtgcttcagcagttggacatccgtccaaagtgcgtgccatcggccatttatgaatttgtatttcaaagaaatggccaaccaattctgtgcaaatgtaagaggcaattaaataacttaattgatatttgccacatcagacgtaattttatatgtatgacttttcaatttcattttcgaccatttaaagttaaacggcgtgctatgcaaatcgccggtcaacgaagagcaaaacactgaacttttcagggaaatttgtccacatttgttcgctaaaaatggtatttttcaaaaataattaattttgtatgaccaaaataaaaacggataaaaaaaatacaaaacggagaaaatggacgaaattagacaaaaatgcaaattttgaaattcgaagtcaatgctaaaatttagttgtttttttagtttgtgaagtcgtatgattttgaaaaaaccaaatataaaaattttatggtatttaaaatcaaaatattacaatcaaattgttgttgcatctttttaaatgccactctattcacttattctccaggtggtcgttcgccggcgcaactttcggtgccgttggcgcacggcggaatggaagtgatgctttgcttccacggacagccaacaacgacgtgggagcaacaggcgtggatgatgccctcctcctcctcctcagctcatcaaatgccatttcaattcggcggcttttcggccgatgctacgcagccaaaggcgggacaatctgtgcaaaatgttgcagcaccacaaatggtaccttcagcagcagcaacaggggtgggtggctcaactttggagcaacaaccgatcgttgttggaagagtcagtcattagggcgggtgggcaccgctcaaagaatcggtctcgccagaaaagtcgagactttctcggaggttttggggtctttgtcgagactcttgaaattcaattctcgggcagttttatgataatccatgcagcaatacaaaggaagtcgttcaaattaaa

SEQ ID NO: 81828 - DNA, 1366 bp, Heterodera glycines
  Genomic contig location: Contig_ID=SeqID_17349; Location=211..1576; Strand=-
  SCN-specific regions: Sequence locations=1-451,473-779,801-1113,1142 -1207,1241-1313,1335-1345
atgaacagatatcaaacagttttcgcctattctcaagtgttggcagttgaaagtattctaaccgatttaggtatggaattggtggaaggctgcatttaaaaaatacccttttggtgaaatatttttgacacttttctatttgtttaatatttttttgaagagacggattccaaacctccggagcgtattccaataaaggcctaatataagttttatataacgtaatccaaatcttagatgatttggatttaattattctaaacaaggaacgcatacgtaaatacgcattccttgttatttggttaacatgaccggaaaattgtaatttgttatcaatatttactcctaagtccctaattgtatccacagcatttattgtattcccatcaaatttgtatgtttcttttgggttttttgaacccaaatataatacaaaagttttttgaattgaaacttttatttgccatttatttgcccattcgaataagttatgcaatgctttatgcatattttctgtgtcagatcttgctttatagcatatatatattttaacatcatcagcatattattttattttcactcctgatggcaaagcatcaggaagatcgttaatataaatcaaaaatagtaaagggcccaggacagagccctgggggacgccagaagtaactttttttacttgaggataaggaatccccaattttaactcgaaaaatcctattactcaaaaagccctttatccacaataaaagtttgccctttataccaattttcccaatttttataaaagtaaattatggggcactgagtcaaaagctttctgaaaatcaatataaatacagtcaacattttttccatttataattgctacacaactgttattagttgacttgtcgtagacctatttctaacaaaaccaaattggtattccgaaattttattgttttttaggaggaagttgtaaatattttggctaagaattctttccataaccctgcaaagtgagcaggttagagaaataggcctataattttcaggattacatttatccccttttttgaaaagaggaaaaactattgataatttagccaatgttatccatccacaaattggaaaatttactttatttatttatttttttgattatggtagagttggggctatgaccaatatatattggaattttctttgtactttacctatttagaatttttttttattatttttaatatttttttaagcaataaatcagtgcgcaagagtgaatcaacaacatcacaacactcaatggagatgcgtttggtgatcccatgctgtgtaaatgcactgattttcatcatcggtacatttttctcatttaaataaa

SEQ ID NO: 81829 - DNA, 1819 bp, Heterodera glycines
  Genomic contig location: Contig_ID=SeqID_17349; Location=1..1819; Strand=+
  SCN-specific regions: Sequence locations=1-93,149-190,222-242,264 -336,370-435,464-776,798-1104,1126-1819
aaagttgacctaaattaatttcagtataagaggaatattaaacataaatttaaaaaagacggaaatttttttgaaatcaataaaaattgacccatttaaaaaaaatattattttcaaaatttcataatttttaaagtaatatttaaaagcaggactcccattacaaaactttcggctaaattttcagatcaataatttaaaattacaaaatttatttaaatgagaaaaatgtaccgatgatgaaaatcagtgcatttacacagcatgggatcaccaaacgcatctccattgagtgttgtgatgttgttgattcactcttgcgcactgatttattgcttaaaaaaatattaaaaataataaaaaaaaattctaaataggtaaagtacaaagaaaattccaatatatattggtcatagccccaactctaccataatcaaaaaaataaataaataaagtaaattttccaatttgtggatggataacattggctaaattatcaatagtttttcctcttttcaaaaaaggggataaatgtaatcctgaaaattataggcctatttctctaacctgctcactttgcagggttatggaaagaattcttagccaaaatatttacaacttcctcctaaaaaacaataaaatttcggaataccaatttggttttgttagaaataggtctacgacaagtcaactaataacagttgtgtagcaattataaatggaaaaaatgttgactgtatttatattgattttcagaaagcttttgactcagtgccccataatttacttttataaaaattgggaaaattggtataaagggcaaacttttattgtggataaagggctttttgagtaataggatttttcgagttaaaattggggattccttatcctcaagtaaaaaaagttacttctggcgtcccccagggctctgtcctgggccctttactatttttgatttatattaacgatcttcctgatgctttgccatcaggagtgaaaataaaataatatgctgatgatgttaaaatatatatatgctataaagcaagatctgacacagaaaatatgcataaagcattgcataacttattcgaatgggcaaataaatggcaaataaaagtttcaattcaaaaaacttttgtattatatttgggttcaaaaaacccaaaagaaacatacaaatttgatgggaatacaataaatgctgtggatacaattagggacttaggagtaaatattgataacaaattacaattttccggtcatgttaaccaaataacaaggaatgcgtatttacgtatgcgttccttgtttagaataattaaatccaaatcatctaagatttggattacgttatataaaacttatattaggcctttattggaatacgctccggaggtttggaatccgtctcttcaaaaaaatattaaacaaatagaaaagtgtcaaaaatatttcaccaaaagggtattttttaaatgcagccttccaccaattccatacctaaatcggttagaatactttcaactgccaacacttgagaataggcgaaaactgtttgatatctgttcatggcgcataaaattgtttatggccgaacagatctgaaactattttctatttttaatccctcaacgcgctttaacatccccttttacagatttaactcaaaatataaactgggcaaaaaattcattccctttgctgggagggtaacaaaattgtggaatcaactcgataaagaactaatcaaaacaaattctttaaatcaatttaaaaccaaacttagaagttcactagggtaataaaaccggaa

SEQ ID NO: 81830 - DNA, 580 bp, Heterodera glycines
  Genomic contig location: Contig_ID=SeqID_17349; Location=2478..3057; Strand=-
  SCN-specific regions: Sequence locations=1-68,90-139,167-192,215 -219,283-435,472-558
atgaaaacgttagccggagtcgaactcatgacaaaagtactgttagtgttgaaacactatccaccaatccacaaataaaagaaaacacacgtaaaatttactttatttcataaaaatttctcaagatggttaaaaaaaattcaaaattgtataaattttttgccttatatcccacgaatatgccattcttaggggtgtgtttttcacccacgcgcccccgcgggggtgaaggtcacgggggcgggggttgcgggggtctgggtcgcgggggcgggggtgaggccaaaatatttgtcacgcccccggcgggggtgggggtgacgggggcggggctcgaaccctagtcaaaaataatgcaaaataaaaatttcggaaaaactttaagtaattttgattgttttagctttatgccagtatataataaatattgtacatataatttgtataatataattgagttttttcaccttttgaatgaattggtggcagatccaaattattggacggttcattatgttcaaaggctgagcgtcccaatgcaaagtgttgcatttccattagacaataaaaattaaataaa

SEQ ID NO: 81831 - DNA, 1539 bp, Heterodera glycines
  misc_feature (1367)..(1367): n is a, c, g, or t
  Genomic contig location: Contig_ID=SeqID_17350; Location=1259..2797; Strand=+
  SCN-specific regions: Sequence locations=1-9,31-125,148-825,847 -872,896-1539
  Gene Ontology: Cellular component=secretory vesicle; Biological process=cell proliferation
atgagcagagagaagggacaatttgagaagggatatttaccaaattatggagacgaaattctcgagattgatgaggtgttgaaagcggtgcgcccaattcgatacaaattgcgggatgaacatggtgagaaattcaagggcagcttctatgagcaggagttggcgcgcgtaagaaaggacgcggagacaagctaccgtatcgagaaggtgtacaggaagaggaaaagaacggacgggaccacagagttgcttgtaaaatttattggctatcccaatcgggagtgagttcatgagtcccaacttgtataaaagcgttcacatttttcaatatttatgcagataaacaatcatgtcgaacagtttctttgtgtttttgcctagtaatgtgagtgattaccctgacaatcagccgaataaattccgtgttcggcttccaaaacctttacattttaaaggctcgtgggtgtgcggactgcacagtatcagttacccctactcatggtcaaccattggcacattggatgagcaatggattgacattcacttcaccgaccgcagagcgaccgatgaggacagacagcgagtgatcagagtgccggtgcctaaggcatcgcatagtagggttgaacaactgagagaatttttgtccgtcactttgagaaatcatagcggtgcaaaactacaacctctccctcgtgaggtggaagagaatcggaatcgtactacaacaaagcctctcggctcgccaccgcctttgaaaagacagaaaagagatacggtgtttgacgcgagtagaaaacagattgcccctcctccattgcataatgaaaatgatgacgatgaagaaattattgaggagtcaccacctcatcatgaagaagaagatgatgaagggccaattgaggagtctccaccgcattatgatgaagagcaaaatgatacagtaacagctcctgtcacaccaaaagtgccggtaccagcgcctgtcacaagccctgcgaaaccaacaacagtaaaaacaccagctactccatctgtaacaacaccagcgcctcccacaactgcaaagctgccagtaaccgtcccttctccaaccacaaaaccaataacaccgacccctcctcctaccacaaccacacctacttcaaccacaaagtcaacaaccggtcctctacctaccacaaccacacctactccaaccacaaagtcaacaaccagccctccacctaccacaaccgtccctccagcaatcacaaagccatcaaccggccctccacctaccacaaccgtccctccaccaatcacaaagccatcaaccggccctccatcaacagaaaagccaataacaacggtccctccgccgccanagacaacaacaacaacaagtacgccagcaataagtgcagttcctagcccatctgttaagccgacgattccggtaccgccggcgcaactaaaaagctcgggactgtctccaaaatcaaaaaccccaatttctactgttaagcccgccacttccagcgttcggtttccgctaaa

SEQ ID NO: 81832 - DNA, 1897 bp, Heterodera glycines
  Genomic contig location: Contig_ID=SeqID_17351; Location=518..2414; Strand=-
  SCN-specific regions: Sequence locations=1-290,312-459,481-860,882 -1027,1049-1207,1229-1417,1439-1591,1613-1876
gttcgaaacccgaccatcttcacatggcggtgcttttgcattccgctacgatgttgaaatggtgcaactgactagaaacaaaagtttgacttcgggcggtggcgacgatgggaaaaatggattgctccgcggcgtttgttttgaattgatcaagttcgtgcacgactcgacgcagggatttggacaagcggtaattccctctaaatcgcattcaccatttaccttcattttaggcacaattcgtttacgacaaccgtaaaatcttattcacgaacaaacgaatcgaacaatttgtttgctttttgtcttttaacattatgtaattatataattttaggcattggaaattgacacggaaaaagtccaaggaatcgttcgcgatttcctgcgtgggtctccagtcaaaattgaggttaggccttgtcagactgataagcatgagctggatctcaacggcattgtttcttcgatttcgcaccatcctgatcaacaatcggacagatctttgcggactttccttgaaatgctgtcttcccagccatttctcaatgcgtaattagcagtatttaattttttttaagtttattcttagtgggacccatgacatcattggcgctggtcgtctttttaagcgtcagatctgcaaagagctcgaagatggcattgtcacgcgcgagggtattgctaagggagttcgcgtcattgacaacaatggtgaaccaaaggcggctttggttgctgacggtttactttgtattttgttggttgagtgcttaagtttctctttagtgaagacttgtgcattcttcgcaagtcgtaatcttgaggaaatcgtcatggagatggtgcagaaaagacggttcaacatcaacaatgcttcccagatggaccgattctggtcccacttcaatcacttgtttcgcggcgttagcggttatctgacctatgcaccgtcgcgcgtcattgtcattgatgcgatcagtcaacggaagatgtccgagattaggttttgagggttttatggatcaaataaaacatggttttagttttgacgttgatggtcgttctatgtctatggtcgactttttccgtactaagaagaacattccgataaacggacagttgccggccgttcgccaacagcaggaccgagaggttcttattttaacaaaattagaactgtttttataaccacattttctgttgtagacactgtttccaatgtcttgtgttatcatcttacctggtcagcgagtgaccatcgacaaaatgtccgaatttatttcgcgcgaacttctcagtgtaaacttattatgtttcttttaaatttactttgaattttaaggccaatacacagcctcccgcccgtcgttatgctgccattgaaatgacaatgaaacagattggtgctacttcgtcgggttttttggccaattttggtgtcagactcagtgccgagtcaaccgttaaaattggagtccatcaaatgccaaaggtgtgtttcgagtcatttgcattttttcaaccccattccttttcattgtcagatcaaattcggcaacactgtcacctctttccaggacagagttcgaaaaaagcaaacaattttaaattaatctttttttgaagatcaatccggctgttcggtttttggagccctccgacattttgtctcaatgggtcgtcgcttttcctggtcatttggaagaatcgactgtcaggtgggtcgttgagtttatagtaaaaggcaattattattttgtaggaactttgtaacgcaaatgatacgcatgggccaacagaagggaatggtccttccacagccgacgttcgttcgaattgaaattgatcatgttttgatggcctctgcagttgtagcattttttaaatatataag

SEQ ID NO: 81833 - DNA, 570 bp, Heterodera glycines
  Genomic contig location: Contig_ID=SeqID_17353; Location=164..733; Strand=-
  SCN-specific regions: Sequence locations=1-160,196-220,242-331,355-570
atggcagaagataatgctcaaaatgtattggtgttactgtgattttactgtcgatttgtcactgccatcgttcgaatgccctccctaatcaatcaattaatcgctaattagtttggttcatctgatcattgcggccaatcaattgattggtccgatttactttccatttgcctttcccctttttatttaaattatcattgccttttgattgttcatcctcattaattaattaattataataccattaattttcattttcctaaaataataattttctgtttgttttattttttgttttttcagctgcgcttatttattatttgaatattattattctttctcttctcttcttccatggattttgttctgtcgtggacggacggactgttcaagggaatgtgctcatgtggaagtgacgcgacaatggccgatcggatgaaaaaggacgggtgggtgagggggagggggggaaggctggcagagggaaatgaatggcacaatttggatgggaatggcacactttcaaattggatggcattggcatatttgaatgagaaatggcacaataaa

SEQ ID NO: 81834 - DNA, 1858 bp, Heterodera glycines
  Genomic contig location: Contig_ID=SeqID_2829; Location=216..2073; Strand=-
  SCN-specific regions: Sequence locations=1-22,74-419,442-703,753 -823,857-1027,1049-1106,1130-1858
  Gene Ontology: Mol. function=tRNA (5-methylaminomethyl-2 -thiouridylate) methyltransferase activity; Cellular component =cytoplasm; Biological process=tRNA processing
atgaagaacaataaagtgatgttcagagaggcgattgaggtgtttcctttcatttaccattttcttcctttttcactgatattgcaaaatcaggtttttggttcatagccaaaaattaattcttattaatgcttttaaaattggtttgaattcgttaaggcattgctttacaattggtgttattttgtggccttgccttattttactacattttcattgtctttttagattcttcgtgcacgaatggagctcctctcaaacaaaagtcctcacgaccagtcgtttttcgagcagcaaagtgattatattcaaaatcatccggtgtttcattcttctccgtattcatttaactttctttttaggccgtaaaacgtgttgacaaagacaaattggagcgggtttggcaatacttcagaccatttgccattatcagagatcagatggtaatttgcagaaactgattcccaattgataattcttttagctgttgtcaaaaacggatttgcaagagatcgaccgatacatcgaaggggccgacatgactatgacgccttaccgattggaattgcgtaaacagattaggcagttggaatcttcaagcgttgcgcccgctcggcctggagatgtacgtttaattagggtgcacccctcgcaatcgaatttcgccgggacataatttcaccagaattttttttttgaagtcataaattttcttaaaaaatttctaaatttaatttttttctaaattatttgcggcgaaattttgtcccgtccctgcttaattaatattattacaaagcattagccttactcaccaacctttaagacgaacagcagcaagagaatttgagaagatattgagggatagacatgagaaggaaatgcaacgattgcagaaacgaatggaggaacttaaggaggtcaaaagggtgggggaatattacggaaagagacattttcagttggaagaagagacacgaaagcgaacgaaggcatagacaacgcaacaggaatcattcacccatcgcttgttttgtttgcaattgttaggttaaagcagttttgattcaaacttaaaccatgttcgtttaaacatcacaacattatttgtctgttttgtttaatatctgttggaagttgtcttccatttgtattaacaaatgtctgtccgtcgggtcatttgtgcgatttcgggtggagttgacaggtcagtttttgtggcatttgtcaatttggaatttgttctaatgatttccctttttgctttggtgctgtgagtgcgcttttgctcaaacgccgcggatttgatgtcgtcggcgtgcatatggtttaaaaccttatccgtaaagtggaaacttgccaatttctagacgaattgggaccctcaggacgaagcgagtgactcatcgtcctgcccacaggtaaattgaattttcgggttgggccaatcatcctgaacaatcagtccggactaatttccattacccattcaaatgatctcgtacactgtcataaatcgcttttttcctatttttcagagcgaggaccttacggattctgaaaagttgtgcgcttttttgggaatcaaattgcatattgtcaattttgttaagcagtattggaatgatgtttttatgttagtgattttttcgggttttatcgaagtaaataaagttttagcaattttgtggacaattgctctttcggtcggaccattgtgcccgatgttggctgtaacaagaaaatcaaattcaaccttttgcgaaaggttgccttcgaagagcttggagcggatgctcttgctaccggacactttgccagaacttcccaagggggtgcgtttgacatgagcctgtga

SEQ ID NO: 81835 - DNA, 1357 bp, Heterodera glycines
  Genomic contig location: Contig_ID=SeqID_2830; Location=47..1403; Strand=+
  SCN-specific regions: Sequence locations=1-502,524-965,988-1357
  Gene Ontology: Mol. function=RNA binding; Cellular component=nucleus; Biological process=RNA processing
atgatgaaatgggcccgtcgtcaagaaaagataaatatgtcatttaaacttaactcaaacgaagtcgctgcagaatcgtgtgaaagtcaggattcgctgttgacggtagcccggagaaatctctgcgtcaactctgcagacgaacgaaatgtgaatgaaaagtcagaggcggctaaggttaaatttggactgattgcaaaacgttattcacatccgttttcagagactttgggacgatgacgatgaggttgaagcagcgcctcctcccgacgccgttttacccggcagaatgcgcgggcttacaaatcgccaagcgcgagttcgaattgcacgcgccgagctcagcggcggactggccgctgtcgatggtagaaattggatggcgatggactcgggacgaatcgattgttgttcttttgcgtccgactctctgccaatccctctctcctcacgggccaatgcggaaattgcctcttgctgacgcagtccctatttacagaccaacaacagcagccaacaccaattggtgatggcgccggaggacagcagcagaaacagcacaccgacactgatttgacttcttcttttgaccaagaaaaatttgttgaccggaacaaattctcatgcctcctttgccgtcgtcaatttgctaatagcgaaacattggacaaacacattcaacttagcaacttgcataaggtaacaagaaacaactgacaaattaaaacttggcagttcagagtaaggtcgttgaaaaaatacgagagctgcggaacgcgggcattgcaaaagcggcacagagtgacacgtcaacaatgcattacagggatagagccaaggaacgtcgggaacagcacggctatgatcccggtttagttgacttaaattactaattatcataggtatttaaggaataagcagtgggacgacgaatgaatcagatgcatcttcaagcatcgaattgacagccctagtgaaggcttctgtcccccttgatgcaacgaacatcggcaacaaaatgcttaaatccatgggatggacagaaggccagggactcggccgaaatgctcagggtttcaaatatttgtatatcccctcgatttttatttaataacaggcatcagagacccaatcagagctgaacaacatgtgcaaggagctggccttggtgcatccggctcaaagatggacacgaatttaccatggaaagtgcggaatagacaagcggccattcagcggttcagagacttggaagaaactactcgacaagactgatggaactcgaaagcaaatataccctcacatcctagatggccgttcataaattgctttgctttcttgtgaaatatttctttta

SEQ ID NO: 81836 - DNA, 670 bp, Heterodera glycines
  Genomic contig location: Contig_ID=SeqID_2831; Location=1..670; Strand=-
  SCN-specific regions: Sequence locations=1-197,219-472,495-515,545 -585,607-670
  Gene Ontology: Mol. function=chaperone activity; Cellular component =extrinsic to membrane; Biological process=reproduction
atggatttagtgcttattgtgcagcaatatattaatgaaatggtgcgattagcaggaccagggatgaaagccattctaatggacaaagaaacggtttgtgagattcttcataaactacctaaatttgtttaacaattctttacaccttaaagacgagctgtgtttcttgtgcctatgcccaaagtgaaatgatgcaaaaggaaatttacctgttcgagcgattagattccgttgtcattcgcgagcctatcaaatttttgtaagtttattttcgttcatctaatatttgtcatttagaaagtgtgttgtttttgtccgtcccacacaagaaaatgtgcaattattgtcggaggaacttcaatctccgaaatattcgcagtattatatttgtaagtgatttttttattggtacagttaatccccccccccccccccctccattgtttccctctccccacatcgtttcttctccgagaaaaatttaaaagaaattttctatctaacattatttaagcctaaatatttaaataaatgattttcttaagggggaataattacctgttccatctctgaaacatgttttattttaattaaagatttttcaaatcggattccaaaagcggacgttaaaatattaccggagtcagacgaacaagagactgtgagagag

SEQ ID NO: 81837 - DNA, 312 bp, Heterodera glycines
  Genomic contig location: Contig_ID=SeqID_2832; Location=157..468; Strand=-
  SCN-specific regions: Sequence locations=1-312
catcagttgaataaagaacagcggtcagagtcgttttcgtacggccttttccgtatggaatttgttcggaccgggacaaatggcgatatggatcaaggtcacagattaggacgacctgctcattgtcagttaccgtgtacaaaaatagcattcaacgtgacatgctaattaaaaatggcaaataccggtcagtctccaaactcaaaattatttaatgcggactaaatcgatgaaaatagaatttggggcgcgcttgcccttttttaggctgaaaaagtgccgggaatgaagtgtccaaatccagccgttacg

SEQ ID NO: 81838 - DNA, 416 bp, Heterodera glycines
  Genomic contig location: Contig_ID=SeqID_2832; Location=578..993; Strand=+
  SCN-specific regions: Sequence locations=1-416
  Gene Ontology: Mol. function=cyclosporin A binding
tacacaacaaatttcccgcacagtcggcaacgtacagtttatgttggaggtttcggaggagaggtcaatgaaaaaattctcacacttgcgtttataccttttggagacatcggttagataattttcatcaatacatatttaaatcttattagttggcgttagcattcctttggacaatgaaacgggcaaacatagaggttttgggtaagttttcttctttttcagttgaagtctttggttttaagatttgttgaatttgaacttccgagggatgctgctgcagcaattgacaatatgaatgacactgaaatttatggaaaaactatcagagtaaattttgcacggcctccaaaagtgaatgaacgaagtcaaagaccgatttgggctgatgatgagtggttgaaactatatggcca

SEQ ID NO: 81839 - DNA, 124 bp, Heterodera glycines
  Genomic contig location: Contig_ID=SeqID_2832; Location=1170..1293; Strand=+
  SCN-specific regions: Sequence locations=1-124
atgaagtctactggtggaaacctcgagccgatgccatttgttcgcaaatggggttcagcggttgatggcgaaaatggcgcagaggcctcgcaaccagttatttcagacgagcgattcgaaaatg

SEQ ID NO: 81840 - DNA, 2834 bp, Heterodera glycines
  Genomic contig location: Contig_ID=SeqID_17355; Location=660..3493; Strand=+
  SCN-specific regions: Sequence locations=1-94,116-356,464-547,573 -590,612-640,688-694,716-785,817-1019,1059-1168,1202-1388,1431 -1529,1711-1733,1757-1876,1899-2055,2077-2257,2301-2304,2328 -2329,2366-2427,2449-2465,2501-2575,2618-2834
  Gene Ontology: Cellular component=synaptic vesicle; Biological process=synaptic vesicle priming
caacagacaacttaccatttgatgttcgacacgtgctgtgaaaagtgcgaaccatcggaggagtcggtgaagttctggtccgaattcatcgagtacatgtgagttttgggagttcaaaaattaatttcgagagtctcgagagcctttgctttgattattttcaacaattcctgacatatacaaaagggttttcaatgaaaaaatgccaaaaatatcgtcaaaaatttcgggaatttttctatatgaatttaaaaaaattatctcatgctaacataagcccggaaaaaatgcccgcatggcgctcagttggcaaaaacgggctttttggcatgccgttgtgcccgccggcatttgcctttatttaaattaaattataaggctatgagtagaaaaaagtcgcggatttttttaaatttttttttcaaattttttcattaagatatttttgagtaaaaaaaaaaatccatttcagtactaatgagcctgttcgatctcgacttttttagactttttaagcaccccaattttatgaaaagcccaaaaaggcttttataatttaaaaaaatttttttgaaattcgctaaaaagaatttttaatgactataataaaaactcaaaaaaattaattgttcatcccaacgaatgacgaaagaattataattggccaatttattttattttgccaggatgggcatcattgaagatgacaaaaacatctacacaccagtgctcagtcaatttccacaagaattaaacggtgcaattctcgaatacatttctaattgaatttttattttttttaattaaaatttattacaaaattccattcgttttattaattttgaattttttttagttggccaactgtccgctgcaactctgtggaatttgtataaaacggaccttaaagatgccttattgggtaattttcaattttgattttttcacaattttttcctcgtctcagagcatgccaaaacgaagcgatgcaaaacgccagattatatggtacgggcacgaatttaaaaattctttttacattttaaattaaattttttgcaaattttagaacctctatttccgtgtcaagtcattctactcaaaatatgtggccgaactgccccaatacaaagaatccattcccgaatttcctgagtgagttttgcggaaaattataagtaatttttaaaaaattaaaaaactgtaaaaaacgaaataacaataattaatagggcgtcaattttctgtaaaaattgtttcgaattcatagtttaacattttaattctctatttaactcccctttttattaaaaaaatgtataaaatggtctaaaattaatatttaaagcatttataattttgcaattaagtttggatgggaaaatgagaaatttattaaaaaatgatttaaaatttttcaattttaattacattttgacatattattgcttattttgttcatattttagtattctatttatttttctatcgttttcattaattttcaattagcttttatgtttagattgtttttttaaaatagattatatatttttaaaatgctaatttaaatttaaatttttaatcgttaaatatttaaagaatgatttttaatttttctgccaattttcaattatcataggtatataaaattgattttttaaattagttacatatatatttttaaaaaggttaatttaaatataaattcttaatcgataaacatttaaaaatggaatttgaaattttttcagcccttaaaatctgtgccaaatgaatttttaatgcttcaaaatgccacccatcgcattttgtcccttttttcccgtgcattttcctctcttttctaatgagcatcgaatgggtgggcagacggaccaaaaagcttaaaaataaaacatttttctccactgtttttcccaagcgacttaatttgacgattttggctttttcgcattcatttcgacgatttttttagtaatttgaaatggcaaaaaaaaaacacaatgccaaaaagcaatgggaaatgaatttatgtattatttggaaaattgaattagaaaataagggagaaaattgtcaacattccaccatttgtttttcattgtttatgaattaatgagttttcctcgcttttttttacttttggcattctgtccatgccaaaaatcaattttgttcactttaggtggtttgttccgtttgtgatggattggctaaatgagaatgacgaacattcaatggtgaggcatttcaaaatttaattttttaattaaaagcaatttgaatttaatttaattatgctttttaattttttttttaaattaccaatagtaataataagaaaataattgtgcctaaaatttttctaattcatatcaaacaatttgaatcataattcagtatgttaattatttaatcaattcaaataaagtaattaaaagcaattaagaggttcatttgactaatttttaattaccttattataatttaataaattgcttattgaataatgtctataattattaaatttagttctaatttggcaccatttaaacaaattatttcatatgagttttattgtttttaaaaaaaatttaatttaaaatttaaaaaagcattttattcctaattaaggatattttgcgaaatgcatacaatcgggacaaagtggacaatttcccacaaacatcggagcacaccaaattcagcaactccgtggtggacgtgttcacccaactcaacgaggcgcttaaagtgctcaaacaggtggccaatttcaaacatttgaattcattggcaattttaatttttagcgccgcgaaaatttattt

SEQ ID NO: 81841 - DNA, 734 bp, Heterodera glycines
  Genomic contig location: Contig_ID=SeqID_17357; Location=130..863; Strand=-
  SCN-specific regions: Sequence locations=1-191,213-437,459-464,486 -657,679-734
atgtatgtctgtgtttttaagactttgaacgcttatcaaattactgataaaaaattgcacttgattctacgtgatgacgaaagtgcgatgaaattggcgaccaatttgctcggttataattccatgcaatgttttgcccacaaaattcaattggtaaataaaatacatttaattttgtgtatatttggctattttaaggctgttggagatggcttaaagctccttggtgggtttttcgatgtaaaggaacgaatgaaaaaagcaatccgtcgcataataaaatcgcgcataattgctgacgatttcaaagcattgcaaattgaaaatgatcttccactaaaaactttacaaaaagtaataaaattcaaataaataacaaggcaaaatctatgattaaggatgtcgaagtgcgttggaattcaacttatttaatggtcagccgttttcttgaaaacaaatcggccattgaaatgatgccagcccaagatgccaaattcccttgttttaccagtaccgagtggacaatgatgagaacgttatgcaaaatactccaaccaatttatcgcgcaacaatgcacattcagaatcggaaaagcggtatttccggtgttcttccgttatacaaagttttgaaacaaaatttgacacactggacggctgtggatgattttccagaaattagaaaaagaattgccgaatctttagaggaaagaatgaaaggtcttttgtattaa

SEQ ID NO: 81842 - DNA, 653 bp, Heterodera glycines
  Genomic contig location: Contig_ID=SeqID_17357; Location=249..901; Strand=+
  SCN-specific regions: Sequence locations=1-130,152-157,179-403,425-653
gaagaacaccggaaataccgcttttccgattctgaatgtgcattgttgcgcgataaattggttggagtattttgcataacgttctcatcattgtccactcggtactggtaaaacaagggaatttggcatcttgggctggcatcatttcaatggccgatttgttttcaagaaaacggctgaccattaaataagttgaattccaacgcacttcgacatccttaatcatagattttgccttgttatttatttgaattttattactttttgtaaagtttttagtggaagatcattttcaatttgcaatgctttgaaatcgtcagcaattatgcgcgattttattatgcgacggattgcttttttcattcgttcctttacatcgaaaaacccaccaaggagctttaagccatctccaacagccttaaaatagccaaatatacacaaaattaaatgtattttatttaccaattgaattttgtgggcaaaacattgcatggaattataaccgagcaaattggtcgccaatttcatcgcactttcgtcatcacgtagaatcaagtgcaattttttatcagtaatttgataagcgttcaaagtcttaaaaacacagacatacattttaagctttacccaaaaacaaacttttgaaaccatgt

SEQ ID NO: 81843 - DNA, 982 bp, Heterodera glycines
  Genomic contig location: Contig_ID=SeqID_17358; Location=713..1694; Strand=-
  SCN-specific regions: Sequence locations=1-77,101-346,377-415,437 -473,504-957,979-982
atgagcaatttgctgaaacgaaaaatggcggatggccaatcagaggaaaatgcggggcgaatcgaaactgttgatgaccaacagcagcagcaacagaaggtgggcgaatcgcattgttaagtggtgtttacattagtggtgtgacgcgaccgcgacgcgcgatcagtgaattacgacgtttttttctcgcgatttacgatgtttttttcacgatttgtggagttttttctgagttgaaaattcaaaacttttctcaggaattttgtgagaaatgtgccaagatggaaacggagctcagggagacgaaacaattgtgtaagatgaaggatctcgagaatgttcgtcgtttttaattaaaattattcatttaattattcagttttccaattttttcagagggcgcttaagtccgaattagaaaaacagaatttgatggctgaacgaaacgcgttgcaggcgaaaattgacatgatggaaaaggaaaaagagaagcaacaaaatgagcagcaggggaaatacggtaggggattatcaaaaaatataatttaaacagaacaaatattttgccgagtttaagcatccgttgatcagttcaaaaagttacaaaatttttcatttattggtttttaattcggcattcatttcgaccaatctgaatctcggaacccgaattcatgcaaaaagtcgggtttagcaattttgttaacggcttaaatgatctttcattgcagggtttatggcttttagattgtttctgtgcattgaaaccattgaatttgaaccaaaaatgttaaatccaaaaattggactttcgattttttagctgtcccggtaatctaacaaaaggcgataattttttgttttaattagcacttttcagtttctgccggccaaatgaaaccaattttggacaaaatcaatgagttggaggagaagcaaaatgagcagtcaaaaggcgagaagaattaaagcaaaaaataaa

SEQ ID NO: 81844 - DNA, 623 bp, Heterodera glycines
  Genomic contig location: Contig_ID=SeqID_17360; Location=555..1177; Strand=-
  SCN-specific regions: Sequence locations=1-407,429-623
atgagaatttatttgtaagatattttgcaagtctttgaattccaacatttttacctatttttttacagtaggattgccattggacttgccaccgagcaaatgccattaaacgaaatggtcggcacttacaatgggacatacgcctacggcactggcctattcgattgtgccaatttctggggccattctggtaattttactgaaattaaaattatttttttacgcaatttgccttttatctctccgaaaattacaggtaatcgtcggtttatgtccggtgatttgccatctttttctgctggagatgttgtcgggtgtggggtgaatttggacactcgccaaatcatttacacaaagaatgggcatcgcttgggtaggaatatcacaaaacaattaaatttaatcgtccaaattcattttaaaattttaaattttcagatacttccggactttttgtccgcaccgtttgcaatttgtttccgtgtgtctcgctgcccttccgccacgctgaaattgtagcatattttggtccaaacttcaaatacaaccttgctaatgagttggctaatgattatgaccgcgattagcggtagaaaaccaaaatttaataataaggaaataaa

SEQ ID NO: 81845 - DNA, 1498 bp, Heterodera glycines
  Genomic contig location: Contig_ID=SeqID_17362; Location=710..2207; Strand=+
  SCN-specific regions: Sequence locations=1-83,116-399,442-1236,1258 -1369,1391-1418,1442-1498
atggccgagtcgaagtccgaattgggcgacgaattgtggacgggcatggaagggcctccggtgaaggaaatgaaactcgagacgagggcggaggaggaagaggacgagttcgacgaacagtttctgtgagtttttacttttcatcatcgtccgtttacactttccattttttcagaaacgaacccaaaacaattccaatggacacagaaacactcactgccgcggattctctccgctcgcatttcggctcactgaccaaaggcaatcagtgccttttttattgcacttttgtaaatatttccgtctcttaggaatttcaaaccgaatgcatcgttcgtctcttctcagtgcctgggaaccgccgacttcgtccgcatctattctcaaaaatcccgaacaacagcagccttcccttttgtcggacattacagaagtgttcagtgcacaacaaaatgtactcggtccatcgacttcaattgggaaaagtgagcgaatggccaaacattgcgacaattttccattttgttttaagttacggaaatgactcacaatgttccgttccaattcaacgccaaagttaccgttaaagagctcatctcccaatcatttggagagacaaaaggcgaagaattggccaaaattgtacaagccaaaggcagaccaataacaatggcaaaagacagaagcaccgaacagtccaataaaagtggcgaaactcagaggcaggacaatttgagacggaaatcaggtgggaattaatcgaattgcttagttgtgattttgaaagaaaaatttaaaacagcaaccttccgattttcagggttggccaacgctcttctgccttccccatttacggatggttttgctggttcaaccaacaaccgattgacttcccatcgtatcgcttctcccgcctgcgcttcgacttccaattctttgtcagagccgccgtttgaggaaaatccacaaaaaaattatgaaatggtcttgacttcgacaccgtcgacacagtcactcccatgttacgaatcgctgtcggaggaaagcgacacggaaacgggcggcgaaggtcagtgtttaagtgcaataacttaatgacatttgatgccattcccccaatattgcttaattcgtttccacaattctttttttcatcctttggtgttcgtttgcagaagtgacgaccaaaaagagttcctccgtgctttgttctgcttcagtcgctgctgctccgctgaacttcttctccctgttggatctgatggacgaaaacgaacagcagtcgcagcggagaatggaggacgacgccaccgatgccacggtcgacacggccccctctttttccactgtttcaccgctgcaaaaccaacaacaatgcctttcattttttgcgacagcggggcaatgggcggaagccaacaaaagggacaaaaatgggaccgaacgaggggaagcggcggaatgcgtttatgagccgctgtcagaggacgaaacatga

SEQ ID NO: 81846 - DNA, 450 bp, Heterodera glycines
  Genomic contig location: Contig_ID=SeqID_17362; Location=2772..3221; Strand=+
  SCN-specific regions: Sequence locations=1-5,49-419,442-450
atgtctttggccctttgcgcagctccctttttcctttttgctctttcttcggcttctcctcccttcttggccactttcaacggttgtccccaactgatcgatggccaattgctcgactttgttaactccgggggcattcggctaacaaaaagcaaaacggggaattgcgatcggttgatcagctgcgatttgatcggggctccagtggaagtgagtgagagaaggaaaagggacgaaacaatgccaattgatggcactacggttcagctaacaaaagtcgaatggtacgtaaacggaaggaaaatccaacggacgaacgaagggacggaaagggaagagacagcggaaaacgcacaatcagaaaacgaacggacagaacgaagcgcaattggagtaggcgaggcgagtcgaacgaattttgagggaaagggaagcaatttggaggagtaa

SEQ ID NO: 81847 - DNA, 249 bp, Heterodera glycines
  Genomic contig location: Contig_ID=SeqID_17363; Location=182..430; Strand=-
  SCN-specific regions: Sequence locations=1-53,75-249
atgtccgtcccatcaaaaaacaaacaatttccaaaaaatatcgatgacggtattttatttttatttattactcataacacaaaattttgcataacttaagatgacgatgacgtggataccgatccgtcacccgaggaagttgagaaatggactcccgagcaagtgatagagtgggagaagcgaatctttgggaaaatgcctccggaagaggagctttggcaggaaattattgacagcggagacaaaaat

SEQ ID NO: 81848 - DNA, 442 bp, Heterodera glycines
  Genomic contig location: Contig_ID=SeqID_17363; Location=874..1315; Strand=+
  SCN-specific regions: Sequence locations=1-230,252-312,334-442
atggcatatgggcgattaggtagaccttacaatgttaatgtggcggcacatttctacgttcggcaccgtattaaacttcgccatccatttcttcattgtgtcatcgaacgctttcctgaaggacaagaggatcgattttatcctcttgagttatgcaaaattgaggaagttgatgaatcaaaatggcttggtcagattttcaccgagattgacaacaacaatattagtgcaactaattcaacaaattttgctgacactcaaacttcaaatgatgattcgaaaagtgttgatgggcgcgatgaatatagccaaaatgattgctactctttgtggtagattaagcattttccattttgtatcttctctctcttaattttgccatttttcacccaaaattgacctcttctattcctaatatttttcaatttatatttccatttaa

SEQ ID NO: 81849 - DNA, 1773 bp, Heterodera glycines
  Genomic contig location: Contig_ID=SeqID_17363; Location=1720..3492; Strand=-
  SCN-specific regions: Sequence locations=1-361,393-579,601-624,653 -963,1000-1288,1311-1612,1651-1773
atgcgtcatttccgaactaatcatttaaagcctggtcacttggctcttgttccggaaaaaggatacgatagctgcggcgacaatcaaagtgatttggcaatgagttttatgcagtggtacgccgaaaaatatgcggttcggattcaaaatgctttttcggctgaaggagagaaaaggtaattttagagtggggattctgagcaaaagttattctcaagagttggcaattttcgtttggacggttggattgagtctcaacgaaaaggactagaaatccatggctgtgtatggcatgcatgctcaaaatgttatccggatgataatgatgtaatgccttgtggcaaatctgcaggccgaattcgggagagaaacaaacagagaatggaatttatattgaccaaagttccaaatgtggaaatcttttggcaatgtgagattgaggaaatgctgtccaaggacagggaaatgaaacagaaattcaaagaatatacgggagatggcgggccaatcaatattcgtgattgttttatgggtggaagaacaggtgcattgaagctttaccacgagttggcagcggacgaagaaatcagttattatgactttaccagtctctatccattcatcaagtaaaattgaaaattttattttccccaaaaaaaaaaagttatagttgtgtaactgattatccggttggacacccaacacttcatgttccgtgtgaggacgttgattggcggagaccagaggacaatccttatccgcttgcaattctcaaagtgttcgtcattccgccacgaaaaatcgatgttccggtgttgccagttaaagtggatgatcggctatgcttccctctctgcatgagttgttgcaaaaaataccctaatggaggtgtaagggaaacatacaattgtcaacacactgataaacaaagaggatggatcagtacatgcacatccttggaggtattaaatattttattattttaattaatattttttagcttaatgccgcactggaggagggatacagagtcaccatgcttttacgcgttcttgaatacaacaaaagtgacaaccaactttttcgaccctacatgagtgaatttatggtccaaaagttacatgcatcagggtttgatgaagaaattcgcggaaattttgaagccgaggaacgattcataaaggaatgtcgggaaaattttgacataaaaattgaccgagcaaagatgataccaaacaaggggaagcgagccttggccaaattagctgtgaacaatttatgtatgttgtataaaaaaccaaaattttttaatgataaatttagggggtcgtttttccctccgtaattacggactctctcaaacttttataactgatgatccatcagagctgggaaattatcttgacaatcggaggatcgaagtgactgggctcgacatgttaactccggagcggattttaatcagctacaatcagaagaaggattgggttcaggaacacccctgctccaacgttgtcatttcacttttcacaacttctgcagctcggctgcacttgctaaaagcaatgcagaaagtcgcgcgaacctctggttgtactattttatacactggtaaatataatttattaatgaaaaaattaaattttttaagatacggattcgttgatttaagttcacccaaaaggcgcaaatcctttaaagacgggtcctcacttgggtgagtttacggacgaatttccaaaggtaattgatttttgattttaaagaaataaa

SEQ ID NO: 81850 - DNA, 319 bp, Heterodera glycines
  Genomic contig location: Contig_ID=SeqID_17364; Location=268..586; Strand=+
  SCN-specific regions: Sequence locations=1-256,281-319
atgtacggtagaaaaacgaaaggggaactcatcccacaactgtacacaatgtacggtagaaaaacgaaaggggaactcatcccccaactgtacacaatgtacggtagaaaaaagaaaggggaactcatcccccaactgtacacaatgtacggtagaaaaacgaaaggggaactcatcccccaactgtacacaatgtacggtagaaaaaagaaaggggaactcatcccccaactgtacacaatgtacggtagaaaacggaggaaaaagggaaggggaagtgccaaaaccgacccctactgtagttgaaagagtcctcaca

SEQ ID NO: 81851 - DNA, 433 bp, Heterodera glycines
  Genomic contig location: Contig_ID=SeqID_17367; Location=472..904; Strand=+
  SCN-specific regions: Sequence locations=1-213,236-433
cgatacttaagcacacatatttgtctactaattcactgttgtcagagctgccaatcaatgatgaataatcatccggttgctccgctgagttggcgcagaatagttgagcatctccagtacatcaaggtaagcaagcagcggacggacaggggggttaaatataatccccattgattgtcctgatttccgaatcttttccaggccgtctttccgtatttttaggtacacgttttggaggcatctttcgcccgtgcttgggtccatgaagttggtcatccaggtgagacaaattgacaaatcaattttaatgacccctttcttctccctcattaaggctgccattgtccgtattatgaaaatgcgcaaatcgttgaagcatcagctgttggtggccgaggtgctcaaccaattgacaacgcgtttccagccaaag

SEQ ID NO: 81852 - DNA, 2563 bp, Heterodera glycines
  Genomic contig location: Contig_ID=SeqID_17368; Location=720..3282; Strand=-
  SCN-specific regions: Sequence locations=1-314,336-854,876-1371,1393 -1862,1884-2479,2501-2563
ttctccgtgccgccttcgtccagcggaagtctccgtgccagccgttcgaacccggacatttcggccaactccgtccattatccgtttgcttcctgttcgtcggctgtgccctctgtcgcctcacatcggcacagttccttctccacaaactgtggcggcggtgctgcaggaacaaacgccgcttttggcggtattgttcagccactgcaaatgctcaaagtgtaccgagtggaccagaacttccgttacctccccgtgttggccgagacaagcgccaaacagttgatgctcatggcactgcaggtaaattcaccacaaaaacttattcatttcccattttaaggagtttggtctccccgtgggtgagaacgatggttggtgggcgctgtacgaatgttcggtcagtcgtgatggtgtgaccaagcagggacggctgcccgactcggccgccaatttggccgaacgtgtcggactgaacgcacggctttacctgcgtgacatgcgacggcccgatgagagcaatttgctgcccgacgaactgatcccggaattggtcaaacaaacgcggctcactttgtacactctgaacgcccaatgtatcgcggcccaactgacacttcaggtgaaattcctttgagcagtcaaattgagtgggatttaaggaggacgaaaatccatgttttattgttattatttactcttttcttgttgctaggatttcgccgtttttaccgcaattgaaccgactgaatatgtgaacaatttgttccaactcatcgacaacgaagacccttgctctcttcgatcaaaagggtggccaaagttggagcagttcgaagtgcattttagcttaacaattttattttataaaatttccctaattatttggtcggagcaatttgtaaaatcgttaacataattattaagttactattcaaccgtgaaatgtggtgggtggcaacggaagtgtgctgtgaaaggaatgtgtacagacggtcaaaattggtcaaaaaattcatcaaaatcgccaaacaatgccaatgtttttattgtttatttataatttcccaacacttttctggtttagtgttccgaaacctcaactcaatgtttgcaatcattagcggactcgaaaagccggtacacttataattaacaaaaaagcatcaatttaattgaatcaaatttacaaataggccgttcggagattgttgcacacttgggaacgcgttcctgggtatgaaaaaaacacaaaaattagaaaataatttacataaaattcaggaaatatttgaaagtattggccgacttgcaacaggtattcatttttactttcactaattcaactcggttttattgcattatttttagatgatggacccgtccaggaacatgtcccgttaccgccagcaattggcccaattcgcgcaggacccaccggtcattccgatttacccggttctgcgcaaggatttgatctttgcgcacgaagccaacccgacattttgcaacgacgcgcaacagctggtcaacttcgagaagctgcggatgattgcgcagattgtgcggaacatccaacgatacagcagcgtaccctacgaccaatcggtgctcatcggcggggcaaatgtgagaaatttacgggggaacagtcacaaaattcgaattggatggcaaagactctgtcgaggtttgtttggcttattacacttttttattggtcagctgttggacccgggcacaatgcgcaaaagcggcggaaatgtcgccgcattgggccacgggagcggccgtttcgcctcgagcagtggcggggcggtgtcgcgcaaaaagctgcacgaacgcacaatgatgcagatcagggtgaaggcgtacctgcagaacatcccaatcattgattcggaggtacgccgtttatatgaagcggtaggacgaatggccaacaaattgtacagattgacctcgaccgaatttcattggattgcgaaccgccactttcctctgcctcgggtgcgagcagttcttcccaacagcaattccatcacagcaactcaaatgttccttcccggcgtcggttgccctctccttcgccgagcagtctttcttcacagtccaaccaatcaaatatagttcattcgcacgaaaggcatcgaggcatgatcaatttaccaaaatttggtgagaaatttgcactcaaatcaaataatttaaaactcctccaaattcaggagtggagagtccccaagcaatttcaaagatgttgtcccttgtgcagaactcaaaaatcaaaagtcgaacgcagggctacgggcgggcaattcactcctcgaaagacgaattgccaccgtccggtcagttgaaagggatggttaacttacaattatccttgttgatcctcctccataagtccctaattaatctaccaaatctaatctattaggctttgatcagtcgaaaagatcttccgtggccagcagcggagagaacaacaacaacgaaagggtcattctgtgaccgatggtcgtctcacaatcagcagaacgaagaacagaagacccaataa

SEQ ID NO: 81853 - DNA, 4301 bp, Heterodera glycines
  misc_feature (4291)..(4291): n is a, c, g, or t
  Genomic contig location: Contig_ID=SeqID_2835; Location=2346..6646; Strand=+
  SCN-specific regions: Sequence locations=1-205,339-727,750-1101,1124 -1179,1202-2009,2031-2894,2916-3430,3453-3546,3569-3919,3943-4301
atgaccacatgcttgagtgaaggtcaagctccgcccacttgtgagggtataaatagccggctattaccagcaaaagtcaacttctcccattcattcgcgaaaattctacccacattcattgcttgcgcgctccgtcaaaaaatatttaaactaacaaatttgcaactacattaccctttcatccaatattttaccaatattcaacttataaaaaaatatattttcaataattttctattacaactataaaatttacatttttctaattcaaaatattctttcatattatatcatttataaatcataaagttttcattcatatattattcaaataaaatgaaacgtttttccctctctcaaaattcttcctcctccttccccaaaaaatcccaaccaaataaatgcattcgtaaaattgataacctcacttcaaaaagtaaaaaatatcaactggtgcgctcaaaatctaaatttgttattgatcaaattgaaaaatgtgcagatccacaggctgaattacgttcatgcgtgcacaaggcggtcgaggaggctattcaagacgcacagaacacacttggaggagcaaataaggtaggtgtcataatttcttcggaacttttagaccagggtgacatcatactgcctataactccaattacattaaatgtcgtggacgccgttttcaaccagttttgtaaagtggagcagagcaaatcgaaacacgtcaacttatatggggccccttttgttgtcaccgtaactgttctaaacactgtcggacttccccgacgacgaacaaccaaaggaagtgcccctccaattcactcttcccaatcacacatcttcaaaattaacaacaacgacaactattgccttttttatgcactggaactgatgcgctactactctttgtataaacgaggaattatcacgcgtgataactggcggtggattaacaacaaccaaacaacggttttacgacaaaaagcgcagcaactgctccgcgaggcggggatccctacaacagagacggagtacgacgcggaagtttatatacatcaagtgcaagggttatggaacgtcaaatatcccggtgagtacaaaatatttatttttaatgattatcagatgcgcccaatcaccaaatccgatatcaccgattaccaattccccattcttctctaccacaacaacaaccactttgacggcatcaaaactctttcaaaatttttcaacaaacgttactattgcatctcctgtgaatccgcctacagtcacaaatttgaacactcttcaaaatgctcttcactatgtcacgggtgccgtgaggtgggcgtcgactatccctgcgaagcccaacaaggctacttcaaaaaatgtttgcactgcaacaactatttctataacaacgactgctatgaacgccacctccacaaggatttgtgcaccaaatttcagcgttgcgaagattgtggggtaatttataatgttaaggttcacggaaatgtaggccaccaatgcggagaaaggttttgtcgtctatgtaagcagtttcatttaaaagaggaagatggcgagaacccctgcaaaagctgcttcatccaacccctaaaaccccataaacttaaaccatacaggatcatcgcatacgattttgaagcgacacaggataaaaaagtaggtaataaattcgaacacgaggtaaactttgcagcggctaccgttatttgcaccgaatgtatcaacaacgacaactggaacaaatctctacaaggaaatccctgcaaaatttgtggcccctaccgcacaatcaccttttcaccctttgactacacggagacaacagtcgaccaaaaaattgtcacacaacaaccactaagtgaattcgtccagtggcttcttttcgatcacaacaaaaaatttcccacggttgcctttgcacattttgggggccgctacgacatgacgatgatcatcaaggaggttttagcgcaaggaattcacaacccggacatcataaagcaaggaaatcgtctctacgagctgaaaatcaaggacaatgaacattgcccactcacaattctacacgacagctacaacttaatgcccatcaaattatctggcctcatcaaatcatttgggcttcatataaaagataaacaacattttccacacatgttcaacaaatcatcaaactatgacaacattctctcccatcttcctccacgtgaagaatactgtcctgatcaaatgaaaatccccgatcaacagaaatttgacaaatggtacaataataattacaaccaaccttttaaccttaaggaaaaactccctgaatattgttgcaacgacgtacaaatactcacccacgccctcgtcgaattacgccgggaattcaaacaactgacacaacggaacggaaaacacgggggaatcgacattctttggcaagccatgaccatcgccagcgcctgcgtcaagaactttgcactcaatcatttgaagcccaactcgctcgccatcgtcccggagaaaggctatacaccacaacagaaccaaagtgcactggctatcaaatacctcgactggtactcccacatcaacaatgtcaacattcaaactgcacactcccgctatggtgaatatgtctttaaacgcgagggtcaggtgtatcaagtggatggttatataaaagggactaatgggaagagggataaaattattgaggtaaatggttgtctgtggcacgggtgtgaggaatgttttgaggacttggacgacgaaacgaaaatgccgaacggaaagacgctaggacaattaagagagagggaggtaaggaagcacgagattcttagccggtacgtagacttggaggtgatctgggaacacgaaatcaatgagcagctgaagaaggacaagcaaatgagggagtttttcgacaactggaaggaccactcaccaataaaaatcagagacgcatttcatggaggacggactgggccaatgaagttactccacacagctaagccgggacaaaaaatcagctacaaggacttcaccagcctctacccatggaccaatttctctacagactatcccctcggtcacccaaaaattatcagctttagattaaatgagcaaactgtcaactggcgagctccatccgacaatccatacaagggacttttaaaagttttacttttacccccaaacaggaatatcaatgtgaccgtaatgcccataaaatttgatgagcgactactcttccctctctgcgaaaaatgtgccaaacacatcaccaatgaacacccgaatggcctcaaagacgacaactactcgtgtccacacttcaatcctaatgaccgtgcctttgtctctacctgcactcaccttgaattgaatgctgcattggaggccggctacaccgtcagaaaactcttccatgtcctgcaatacgaccaatggagcgacaacatcttcaaatcttacgttagcgaaatgatggccctgaagatccacgcaaccggcttcccttcatggtgcagcagcgaagaggagaagaaggaatacattgaggagaaccgtcatcgatttggaattttgttaaacaacgaaaagatgaaggctgaaccagggaagcggtacatcgccaagctctgcctcaactcactttggggccgcttctccatgaggaacctcctctccaaagcaataatcaacaacgacgaaagcctgattcgccaatataccgacgacaagaaaatcgaattagtggacttggaaatgatcgacgacgacaacgacgtattcatgctcacctacaagccgaaagaggagtttgtcgacgaaaataaatactccaatgttgtcatctccctcttcacgacatctgcagctcgcctctacctgtacgaagcactcaaaaaagtcgccgacacccccgactgtgaaattctctactttgacacggacagcgtcatctacgttcaccccgaggaaaacgacccactaccaacaggaaagggacaccttggagaactaacagacgaaaaccccgaccacaatatattggagtttattagtgctggctgcaagaattatgggttgaagctgcaacgcaaggacaccggtgaaatagaacacgatttgaaaataagagggttcacccttgatgcacaaactgttcaaaaaattcattacgatactgttaaggaccaaatcttacgctatggctccgaagacccccctgaccctatcattgtaaattacctccattttattcgccctaatnctaatccaag

SEQ ID NO: 81854 - DNA, 1270 bp, Heterodera glycines
  Genomic contig location: Contig_ID=SeqID_17369; Location=402..1671; Strand=-
  SCN-specific regions: Sequence locations=1-163,185-1270
ggtcgtttcggacggaattggtggctattccgccgagaaacaccaattttcattgattgaaaagaagcactcgtctgctggtttctcttaattttcattcgcttttctcgtgtcatctctttagataatttaccatgaatggttttcatttcaaattcttcgaatttctctcccaactctttctaaaacgattttccttttcaccgattcgcactttcccttaaatttttagatttgatctgcgtcaaatggctaatgattctcgcagttcttcgagcgcttcctcccgttctcgctcgcgtagtcgcagtcgttcgccacgccgtcgcgagcagcgtcggcgccgctcgcgttccaccttttcacgttctccatcacctggccaaaaacgactgcacatcggtttgctcactggaaaataggaatgcaaataattaaatggacaagggttgactttcgcctttatggtttgctgatgttttatgttaaggcaatttggacgagtcggtccgtcgtcgggacattgaagacgtttttggaaagtatggacggatcagcgactgttggatggccaggtttgattcgatgttgaaatatttaaattggcaattagcaatttaaaagaaatgcgggttgcaagttgtatttttcaaaaataatcagaaaaagatacaattgcatggaataaatatatttttcacccttttcggacacattatactacataactcagaaaacttaccaaaaatctgctatctactccaaatccccattcagttaccctcccttctacgcttttgtcgtgttcgaaaacaacaaagatgcgtccgcctgcatgaaagacttgggcaacacggcgtacatcaaagggtgtcgtgcgcgtgttacggtggctcttccaaggtaagcatttctccacgattattgtcgcgcaatagcattttcgtgttaagaaaaggatcttcacttgatgccaattcaatgttctacaaaattcagagccagtttttcatttttagcccaatattttccaggaatggtgcgacttatcgtcgcggaccgccgcctcctccgcgacgttattacgacgaggaggacagtcaccgacgccgtcgtcgttcgcgtactcgctcgccccgtcgtaggcgctcgcccagtcgctcgcgcagtcgcacaccgccgcgccgcagtcgttcgcctcgccgttcggcgcgtcgccagcgctcgccgtcgccgaagagagaacgcagagacagggaggagaaggtga

SEQ ID NO: 81855 - DNA, 310 bp, Heterodera glycines
  Genomic contig location: Contig_ID=SeqID_17370; Location=358..667; Strand=-
  SCN-specific regions: Sequence locations=1-16,40-107,145-204,226-310
atggcacagcccaatgaattcagaattcaaaaatataaagcccgcccaaccattcaaatttcaggtatataataatgccttagaaaatgaaaaatttagtgccattttcagagctaaaacattatttttaaaatttagatttttctttttgtaaaaatatcacgaaaagcctatgtaacgaagaataattttcgccattttcacacattataaacacagtttaattgctaaggtattattatagtaaatacacaacaaagtgagcagttaggtaattgggctttgggggtaattaggggcaattaataaa

SEQ ID NO: 81856 - DNA, 1158 bp, Heterodera glycines
  Genomic contig location: Contig_ID=SeqID_17372; Location=556..1713; Strand=-
  SCN-specific regions: Sequence locations=1-76,119-296,318-504,560 -692,714-775,822-1158
atgttgagcttcatttatacaggcgatttggccaaattgaacggatacaatgcaatggcagtgctttacgccggtgaatttatttttaaatttgatttattaattatttttttaattagccaaaaagtacaacatccctggcttggtcgacgcatctttgcaagttccagtttcatcactacgcaatgttttcttggcttatgcccaggccggtcttttcgaattggaggtgggaagaacaaattgaaaaaggccgaaagaatcaaaaatttttggtgtttaaccggctgggccagttatataactattttttattttcacatttcgaatttagaattttgccaatgattgtttggcttacattgacagaaatgcggatgatttgttcaaatcggaggaatttttacaaattgaccaaaaattgttgtgtgaaattttgggacatgacgaattgcaaatcgatggagaaatttcaatttggaaagcagtaattttagaaaacagaaattaataaatattaatgaatccttttatttattttcattaaatttttttttttggcactccgttgggctgacgccaaatgcttcgaaaatgccaaaaaatgttcagcagagaatcgtcgtgccatgctcggtcctgcgctttacgaaattcgttttccactcatctcaacagaagaatttacgaagaaaattggtaaaataaatcataattttaactcattcgataagctgccgattttaaacttttatttgtgatgaatagaatcttcattttattttattaattaaaaaaaacttttttattttatttttatagtaccatcagatgtattatcaaaagatgaagtgatcgccgtttatcagttccattcccttccaaattatcgttggatatccgatggacttttcccaatgcaatttccgactaatagaaggatttctaatcgcaaaacgggcacaattttaatggacattgaaaatgtgtccgaatttgcacgagaggacgttgagagcagtcggtacagcgaaaaaatgaccataaatggactatcatggaaaataatggcacaaataaaaacaaaaaacggaagcactgacaataacgagaaatggttgggcatttaccttttgggtgttgcaagagaagctcaag

SEQ ID NO: 81857 - DNA, 335 bp, Heterodera glycines
  Genomic contig location: Contig_ID=SeqID_17372; Location=1787..2121; Strand=+
  SCN-specific regions: Sequence locations=1-37,60-134,175-335
atggcaatgagcaaggttaattgaaaactaattaatataattagtagaatctaattgaatttttttattattgatttatgtgaccattttctcgttgttcttaggcctggatccagaaacattccaattttaccaattaattatttaatcttattataattaatattttttttaccgaattccgctttttcatttttagcatcaaaacggaacattgccgcaaatacttcagaagtgtgcttcaaaatcagtctatgtgctgacaaaagctgaagaggattaaagtaaaaatcaaacaaaaaaagaacaattcactaaaattaattttaaaaata

SEQ ID NO: 81858 - DNA, 422 bp, Heterodera glycines
  Genomic contig location: Contig_ID=SeqID_17373; Location=2284..2705; Strand=+
  SCN-specific regions: Sequence locations=1-350,383-422
atgccgacacttcaagctgagcaacatccgccaccactgtcgccacaaacaaacaatgtacagcagcaacaaccaactgtaccgagtccgctgaacgagcgccaacagagtgtacaaccaacgcagggtgaacatccacaaatccgggcaaacgccaccttgcaaccaaacgtggttcaagcgcagcagcagcagcagcaaagtcatcagtttttgggacttgaccacgacaatgacgatcagcttttgaaccaaatttttttggtagcaaaatttaaaaaaacaagcaattgacatgccaattacaggatctcaccacttccgctgaaatgcaacctatcgccttggataacaacaacaacaacaacaacaacaacaacaatatggttgttaacgatttttggttttgtctatttgtttaa

SEQ ID NO: 81859 - DNA, 59 bp, Heterodera glycines
  Genomic contig location: Contig_ID=SeqID_17373; Location=2757..2815; Strand=+
  SCN-specific regions: Sequence locations=1-21,51-59
atgccaatgccaatgccggacgtggccgaggaagaggaggaggaaccagacgcaaagcg

SEQ ID NO: 81860 - DNA, 143 bp, Heterodera glycines
  Genomic contig location: Contig_ID=SeqID_17374; Location=952..1094; Strand=+
  SCN-specific regions: Sequence locations=1-143
aaaagcgtggctacgattacatccgattcgggcgccgttcttccgctgtcgctgctatccccaaattggccaaacagcagaggaaaaagtcggcggacaccagcggcgcccgcaccgcttacgattacatccgatttggctga

SEQ ID NO: 81861 - DNA, 465 bp, Heterodera glycines
  Genomic contig location: Contig_ID=SeqID_17378; Location=117..581; Strand=-
  SCN-specific regions: Sequence locations=1-191,213-408,430-465
atgcatgtcaccgagtttttgccacaatcaccacgccgcgacaacattttgatggctcttgaactcttggcaaaactccaatcatttgccgtcgccgatttgctttctgctgatcaaatcgctgatttccgcgccactgctgatcaattccgtgttcaaatgttggagcactttcgccgccattgttcgacttcaaaatttcatcatttggtccaccatgcccctgaatttgctgaaaaccatggattttggggccttctcagtgagcatcaatgacgatctcgcgcgcaaagcaaacacaaagatctccacgatattttgatgttctgtgctagagaatctgccattcgaaacgccatttttgattcaaatgaactctgatcaatcttttgtagtttttttataagtttgttatgtttttgttgttattctaagcagttttctcaattttttatatttaataaa

SEQ ID NO: 81862 - DNA, 156 bp, Heterodera glycines; identical to SEQ ID NO: 57938
  Genomic contig location: Contig_ID=SeqID_17379; Location=279..434; Strand=+
  SCN-specific regions: Sequence locations=1-156

SEQ ID NO: 81863 - DNA, 805 bp, Heterodera glycines
  Genomic contig location: Contig_ID=SeqID_2836; Location=713..1517; Strand=+
  SCN-specific regions: Sequence locations=1-29,54-134,156-805
atggacgcatttggcctgctggacgatttaaaaaggaaaatcagcaattccgcgattaatttgtgtgaaaacatcaattcaagtgcaacatttacgaccgaggccgccgataaatttattcgggaattaaaggcaactttctccaccacttttgaggaaggactcggactctgcaccaaggaattggcacaccttcaattaaaggatggtgccactccaatttacagaaaggcacgaccaatgccacatcattcaaaggaaatcgtcgaaatggaattggaccgattggaacagctgggaattatccgtaaagccgaacatttgacttgggctgccccgattttggtggtcaagaaaggagacggatcagcacgattgtgcatcgattattccacgggattaaatgatgcactgctggattttcaacacccgctgccaattcctgacgacatttttgcgactttgaacggaggaaaatttttctcccaaattgatctcaaagacgcatatttccaaattcaattggatgacgattcaaagaaaatttgcggcatctccacccacaagggcaattattttatggagcgcctgccttttggagtaaaatcggcacccggcattttccaatcaatcatggacaaaatgctcgccggtctgaattttgcgacggcatatttagacgacatcatcgtcgccagccgaacattcgacgaacacaccgatcatttaaaggaagtgttcgatcggctgcaatcattcggattcagggtcaaaatttcgaagtgcgccttcttccaataggaaa

SEQ ID NO: 81864 - DNA, 1653 bp, Heterodera glycines
  Genomic contig location: Contig_ID=SeqID_2837; Location=37..1689; Strand=+
  SCN-specific regions: Sequence locations=1-21,43-329,354-434,456-1653
atggtaacaaagaacatcaatgccacttcactgctgaaagtcggagttttcgtcaacaaaaagaaaacaaaatttgttgccgacagcggcacggaagtgaacataatcgacgaagacgcctatgacaaaattggccgtccaaaaattcaggaatgcgaagaaaaaggcaaactcttcgacggaacaaaggtcgcattcatcggcaaaggagttgccacattccaatttggcgacattgccatcgaccaggagttttacgtcgcaaaaagagggtctttaaatttgctgagcatttcaacgatggacgcatttggcctgctggacgatttaaaaaggaaaatcagcaattccgcgattaatttgtgtgcaaacattaattcaagtgcaacatttacgaccgaggccgccgataaatttattcgggaattaaaggcaactttctccaccacttttgaggaaggactcggactctgcaccaaggaattggcacaccttcaattaaaggatggtgccactccaatttacagaaaggcacgaccaatgccacatcattcaaaggaaatcgtcgaaatggaattggaccgattggaacagctgggaattatccgtaaagccgaacatttgacttgggctgccccgattttggtggtcaagaaaggagacggatcagcacgattgtgcatcgattattccacgggattaaatgatgcactgctggattttcaacacccgctgccaattcctgacgacatctttgcgactttgaacggaggaaaattgttctcccaaattgacctcaaggacgcatatttccaaattcaattggatgacgattcaaagaaaatttgcggcatctccacccacaagggcaattatttaatggagcgcctgcctttcggagtcaaatcggcgcccggcattttccaatcaatcatggacaaaatgctcgccggactgaattttgctacggcatatttagacgacatcatcgtcgccagccgaacattcaacgaacacactgatcatttaaaagaagtgttagaacggctgcaatcatttggttatcgggtcaaaatttcgaaatgcgccttcttccaagaggaaattaaatatcttggattaattattgataagaatggacgccgacccgacccatcaaagatacaagccattgttgacatgcccgcgccgaccaatatttcgtcattgcgctcatttttgggtatggtcaaccattaccagcaattcgtcaggaacatgcgcttcattcgcaagccgctggacgatctgctcaagcacgaagcaaaatggaattggtgcgacaattgtcgcaaatcatttcaaaagttgaaaaacattttgacttcggatttattattgacacattatgatccaaaattggaaataattgtgtccgccgatgcttcggagcttggaatcggcgccgtcatttcccatcgattcgcaaatgggacaattaaggccatcgcacatgcatcaaagtcattcgcgcccgccgaaaagaattactctcaaattgagaaggaaggactggccttgatcttcgctgtgcagaaattccacaaaattatttatggtcggaaatttattctccaaatcgatcataagccgttctctccatttcggaaataa

SEQ ID NO: 81865 - DNA, 1373 bp, Heterodera glycines
  Genomic contig location: Contig_ID=SeqID_2838; Location=513..1885; Strand=+
  SCN-specific regions: Sequence locations=1-479,502-1163,1202 -1307,1329-1346,1369-1373
atgaagagaatgaagcagctcgcccgccaatacatattctggccgaaattggacaaagaaattgaggattatgtccaaaactgtgagccgtgccaattggctgcaaaggcaccgatcaaaaccgatctccattcatggccaaaaccaactggcccgtggcaacgaattcacatcgactttgctgggccattcttcggcaaaacatttttaattgtcgttgattcattttccaaatacccggaagtatttgagatggcaaattcaacagcatcggccacaatcgaaaaattgcgttatttatttacgcgccatggcatcccagaaacaattgtttctgacattggcacgcaattttccagttcggaatttgccaaattcgttgcggccaacggcatcacacacttattttcggccccatataatccaatgtcaaatggacaagtggagagatttgtcgacacatttaagagagcattcagaaaattaaaaggggaggggaagcctaacaaggagatcatcgacacttttctgatcacctaccgtacaaccccaaacgattcacttccggacttgaagtgccccgctgaactgctgctcggtcgaaggccaaggacaacaattgatctgcttcggccaccaccacaccaaccatttgaaattgatttggagatggaaaggcaattcaacaagaaatttggcaccaaaaatcgaagatttattttgaatgagaaagtcttcgctcgccatcgctcctcgcaacattggaagacaggagtgatcagcggcacatctggagtgatttttgaagtcaaatttcccgacggatcattcggccgttttcacgcgaatcaattgcgcaacaggaaaacagccgacaattttgatcagtccttggccatattaaatgaggcatttgagttgccattgcctccggccctgcccaatcaaccacccgacgcagaaaatgccaatttagggcccaatcaattggaaaacgaggtggcagaacccattcaggacaatttggctgctccaattgaggacgtcccaattcaacgacgctatcctcaacgccaacgtcgtaaaccgaaccgcttttcacccgggccatgaactgatcagcctaaaaggggaggtgttcgggcaggcacattttgcccccgatttatttatttccctctcttcattttccttcactgtttgcagtgtctgttctctccgtgttagagacagacacacacatgcatattgattgacctttgcccttcccaattattcctccccattcatggctgaattcattctgttgtttccccaatttatttgctccgctcccccgtttttggatttatttttaatttattatttgcgta

SEQ ID NO: 81866 - DNA, 1135 bp, Heterodera glycines
  Genomic contig location: Contig_ID=SeqID_2839; Location=2235..3369; Strand=-
  SCN-specific regions: Sequence locations=1-143,165-493,515-519,541 -796,818-1009,1032-1135
  Gene Ontology: Mol. function=serine protease inhibitor activity; Cellular component=cytoplasm; Biological process=regulation of proteolysis and peptidolysis
atgccctacaaaggcgaaaaggagttcatgttcgttttgttgcccaagaaacgctttggactgaccgaagtgttggctcaattggacggcaaaaggctggtgaaactgatcaaaaagcgggacaaatgcaaagtgaaggtagataaaccccaggaggaggacaatttctccgaaaaaatcacaaaaaatagagctgggctgaaaaggcagaattttgtagcgatttgtgccaaaaggcactaatttttccatttttgggccaatttttcaaaatataatgcttcaatggagtccagcggtgccgatggcgccgctggggaaattttttttaaaagatttaatggagcatgataagaatttttcaaaaaatttgccaaaattttaaaaaattgcccatttttgcttgaagaatttttctttttcatttcggggggatcccccccccctggatacgggcctggcctaaatgaactgtcctaaaacacaatgacaatcctcttcttttcacaggtgcagttgcccaagttcacgttgaaagccacgcacgaattgaacgaaccgttgaccaacatgggcatggccaccgcgttcaccgacagcgccaattttgagggcatttccaacaataaaccgttgctgatcagcaaagtggtgcagaaggcggtcattgaggtacggtgattgcccacaattagtgcccttatttttgtggattccatttatacaaatttgccaccatcgaattgcaaaataaaaaaaagtcaccagccggtccagagaaaatttatatatttttgaccagttttagctcaattctcaaaaaaaaaaactaatttaaacaacgaaatttaggtgaatgaggagggcaccgtcgctgcggcagtcacagaagaagaagtggagtgtggttcgagcaaagaagaacgttttgttgctaaccatccgttctgtgcctttctgattcgcgatgacactgtgcttttcagtgcgattttccgcaaatgattccattccatttatattaaatgtctttgattttaggatttggtgatttgtaaaaacattttgtgtatatttttttgtctgtttttggcctttttggatttggtcacaattaaatatgtatcgaaataaa

SEQ ID NO: 81867 - DNA, 1654 bp, Heterodera glycines
  Genomic contig location: Contig_ID=SeqID_2839; Location=60..1713; Strand=+
  SCN-specific regions: Sequence locations=1-746,768-833,855-1386,1409 -1654
atggtcaaccattaccagcaattcgtcaggaacatgcgcttcattcgcaaaccgctggacgatctgctcaagcacgaagcaaaatggaattggtgcgacaattgtcgcaaatcatttcaaaagttgaaaaacattttgacttcggatttattattgacacattatgatccaaaattggaaataattgtggccgccgatgcttcggagcttggaatcggcgccgtcatttcccatcgattcgcaaatgggacaattaaggccatcgcacatgcatcaaagtcactcgcgcccgccgaaaagaattactctcaaattgagaaggaagggctggccttgatcttcgctgtgcagaaattccacaaaatgatttatggtcggaaatttattctccaaaccgatcataagccgttgctctccattttcggaaataaaaagggcattcggcagtgcagcgtcaaccgattgttacgctggtcactcattttgttggcatatgacttcaaaattgaatatgtcaaaccacggattttggacaggcagacgcactctcccgtctcattgcaaaaggcggagaagaggaaaacgaacgcgtcattgccttgatcaccgccgaaccaattttggaagaaattctccattcagcctcgaaaaatttgccgatcaaattcgaagatttggtcatcgccagcaaaaatgactacaacattcaaaaagtcataaaattcatccgccaaggctggccaaatgaaaagcaaattgagaaagaatcggataccatcaaactcttccatcggcgcaaaagtgatctgacaattttgaaaggctgcctcatgtatggcgaaagagtcgtcattccgaaaatttttcagcccaaaattctccgactttttcacaagggccatccaggaatgaaacggatgaaacaactcgcccgacaatacatatttggccaaaattggacaaagaaattgaggaatttgttcaaaattgtgagccgtgccaattggctgcaaaggcaccgatcaaaaccgatctccattcatggccaaaaccaactggcccgtggcaacgaattcacatcgactttgctgggccattctttggcaaaatattttttattgtcgttgactcattttccaaataccccgaggtatttgagatgacaaattcatcagcaactgccacaatcgaaaaattgcgttatttattcacacgccatggaattccagaaacaattgtttctgacaatggcacgcaattttcgagctcagaattcgccaaatttgttgcggccaacggtatcactcattttttctccgccccatataatccaatgtcaaatggacaagtggaaagatttgtcgacacatttaagagagcattcagaaaattaaaaggggaggggaagccaaacaaggagatcatcgacacttttctgatcacctatcggacgactccaaacacaacgattgatctccttcggccaccgccacaccaaccatttgaaattgatttggagatggaaaggcaattcaacaagaaatttggcaccaaaaatcgaagatttattttgaatgagaaagtcttcgctcgccatcgctcctcgcaacattggaagacagataatttttttgaacgttccattacattataa

SEQ ID NO: 81868 - DNA, 321 bp, Heterodera glycines
  Genomic contig location: Contig_ID=SeqID_17382; Location=423..743; Strand=-
  SCN-specific regions: Sequence locations=1-34,56-321
atggctttgaccatcgagcaacttttgcaggaaatttcgcagcaaaatcaaaacccgtcgctttcaggcattgacgtatttgaattgtgcgacgaaaccaccaacatcgaagattggctgcaacaattctgctttgcgttggattgttcggcgcccaatctgaaagatgagcaaaaagtcaagctactgatgacgaaattgagcaaagcggcattcagcgagtacaagaagtcgtgcttgccgaaagatgtgaccgactccaattttgccaaaacggagcagcaactcaaggcattgttcgccaaaccacagtcggtgtag

SEQ ID NO: 81869 - DNA, 49 bp, Heterodera glycines
  Genomic contig location: Contig_ID=SeqID_17383; Location=1220..1268; Strand=+
  SCN-specific regions: Sequence locations=1-49
atgcaagtggctgggatgcaatatccaataaaggccgacttgggagaag

SEQ ID NO: 81870 - DNA, 1418 bp, Heterodera glycines
  Genomic contig location: Contig_ID=SeqID_17385; Location=271..1688; Strand=-
  SCN-specific regions: Sequence locations=1-322,404-495,518-746,770 -820,842-1169,1191-1233,1256-1418
atgatccccctctttctgaggatatcgcaaggttaatcaatctgggggggggggggggggtaattagagataatacggtacacatactccctaatccttgatttagcataaacttaatggagagatagttacctttatgcagttggaccaatgtgccaatcacatccatcaccattttgttgaatttgtctgtgggaaaattgcctttcacaagtgctaactcctcttctaaatctctttcgccaagttccattatggccaccaccggttcaaatatttttgcaaagtgttctgattcatccatcgtaccactaaaagcatcaaaaaatcaattaatttattttttattttttgtaaattaattaaaacaataaataaattaatgtgtttttattttaatttactggtccataaaggtgacaaagaattcttcgttcttcgaatcttctcttaatttatccgatacctctacgctttcacggtatatatttccaaatcctttttggtaaaatttgatgataacacatttatttttgggcagcttttcattttcagcagtaaatccgatgaagggagccggaaaatccgacactggaaaatccgacaccggaaaatccgacactggaaaatccgacacaagcggaaaatccgacaccgctggaaaatccgacactagcggaaaatccgacactagcggaaaatccgacaccgctggaaaatccgacactcgaaaatccgacaccgactttaatttttaaaaataatttaaccggcctgctttatttccgatgccattgtggaacatgtgcgagcggtaattacaaacaaacaaagaaaatgatcagtttgtattgaagattggaggctgatctttgcctcacaaacaatagcgtcgagtcgtggcatcgaaatctgaatgctttgtttcgttcacactcgcctcgcctaagcattttccttcgtaaagttgcacaggaagaaaatcattggcagcaacaattggaggaatttgtaaataatccggcacatggaatcagaggaaagggcatgaagcgtaagcaagtgtacgtggagcaagacatgaatctcacagagatttatgcgactcgcaacaatcgacaaccccttcaatatttgcgggcaatatcccatagaatggcggaaccaatttaattttcttaaattaaattcgaaaacttggctaacttatacagatattaactcaaataatcgaaaattatttttaaaatttaaagtcggtgtcggattttccagtgtcggattttccgctagtgtcggattttccagcggtgtcggattttccgcttgtgtcggattttccagtgtcggattttccggtgtcggattttccagtgtcggattttcctagagccgccgatgaaaaccttaaaaataaa

SEQ ID NO: 81871 - DNA, 339 bp, Heterodera glycines
  Genomic contig location: Contig_ID=SeqID_17388; Location=25..363; Strand=-
  SCN-specific regions: Sequence locations=1-273,295-339
atgaatgaaagcacttgcgaaaagccggtgaacagctccaaatcctccgcaacaattgagtcgggatcggagagaaagccctccggcaccggaaaagcgaccgaaagtgttagcaccaaaaaaaagggtagagaagtgaaacgaggaacggatgaccaaataaccgaccaaatactcgagggagtcgagactgatcagattcggacagagcagggcatcatcacggacaagctgaagaaggcaaaacaacaagggcagaacaaagccatagaaggcacttttagttttgcatccttaaaatatcataatcccaacgaaggaaagcgcttttctggggaa

SEQ ID NO: 81872 - DNA, 394 bp, Heterodera glycines
  Genomic contig location: Contig_ID=SeqID_17394; Location=110..503; Strand=-
  SCN-specific regions: Sequence locations=1-179,201-283,306-394
atggacttttgtgcttctaaagtttggaattgtttcgaaaaaatttcacaatcaacgaatgtacaatgcaatttatgtcaaaaggttttgaaccgaagcgatacatcgaccaaaggaatgtggagccatttgaagtcgatgcatttaaaggaatacaaagaattgcaattacaggagccgaaaaggtcaaaaaataaggtaataatttaaggctattttatttatttaacaaattcagacaattgattcctttttacttaaaaaacatgacgagcaaaaggaagttgaggaaatgttgactaattttatggtccagcaaaactgcgccttttcagtttttgaaaattcaattctaaaattaacgcaacgtgcataccctaattttgaggtttga

SEQ ID NO: 81873 - DNA, 1636 bp, Heterodera glycines
  Genomic contig location: Contig_ID=SeqID_17395; Location=1343..2978; Strand=+
  SCN-specific regions: Sequence locations=1-141,163-207,246-445,469 -570,594-768,808-832,874-1491,1514-1636
atgaactccttttctctattgaccgtctttctgagcttggtcattaattgctcaccgatacggtaatttcttaattgaaaataaattattatctttgtaaatttttcaaattttcaatttttcagccctttgtcatccgacgttggcatttggaaaacgtgcaatggcaaaaatgggataattatggtggaaaatggatgtacaaagtaaaataattgaaaaaatatattttatttatttttaatcattttaggctccttctctgctaccaaagcgaaatggccaaaaacaaaaaaattggaaaacgttttggggtgggcaaaggaaacattggcaaactgaaatttgtggaatgtgccgaagagattgccgaagaccaatggcacggtctgatcattgccaagcaccaagacggagtgatcagctacgaatcgaggcaaatttcaaatgaaaaatattttaaaatttggatttaattaattaagccatggattcgacgacattttcggcaccgaacaaataaaacaaacggaaaaatatttggaaattaatttgaccaaaagtaaagccaaattaataataatattttaatagtaattaccattttacagatgctgaaccacttggaaacgaacttcaagaagcgctttcttctgctgcatttttggacgattttatgccatttgttttggcatttgaatttggcgcaacattttgcgcagaaaacggcggcaccaacaaattgtgcaaagagaaagtcatcttttcatatttaaaattcatattttaaaataattttattttttagtgccttacattggcaccgtttgttggcacaaccaaatcccatggcaaaacaacagtaacaacaacttcaatcccaacgaccaccgaacggcaaacatttgcatttgccgaatttgtgccccattttggcacgaattgttcgaaaatcgttttccccgtggaagtggccaaattcattttgaacatcaccgcagtgccctaccgaattgcatgcaatgtgtatgaacaacattacgagatcggacaatcggtggaggattatttggtaaattcaaacaaaagttttttcatgcttgcatggaagtgccgacaaccaaatgcgcaaagtgattgaaattccggcaaaaaattaggtgcaaaattctcacaaattgtttttaggcatgtggaactgagcgcatgctataaaagcatgaaaacagtggggccaaacgacaatgtcgtcgccaaattatgccaagaccatcttaatgaatcgaatgttgccggattttctgtacaaatttgcatccatcgggatgaaaaggaacagaagcttgtctttgaaacattcttgaacctttccaccaccaacgaattgtatggccaaataatgagagattagatgatgtaattacttaattgggttaattaagcatcaaaatgacgcgcaatttcccaatttccgttgaacaaattatggagataaaagaaactgttcccattttctttctcgaatttggcaccgatgagcagcaaagcgcaatccgagaaaaagccaatgggaaagtgatcagcggaccattgaatgaaaatgtgaaaacaaatggatttttataattaatttaaa

SEQ ID NO: 81874 - DNA, 1224 bp, Heterodera glycines
  Genomic contig location: Contig_ID=SeqID_17396; Location=130..1353; Strand=+
  SCN-specific regions: Sequence locations=1-14,36-640,727-1100,1122 -1201,1223-1224
atgaccgagcacgcaaaagtgggtttgggaaagaagcataggcttactgtagttgattgtttacggtacaaaagtgggtttgataagtgtagtataaacctactgtcgttggcctttacattacaaaaggttattttgttcttttgattggaatgaatggaggggattacttactgtaatctttacagtcagtagaaaatgggtccgtttttcactgggggaggggcggttttggataaaattcgggattagtcccgacgcgatatccctcccgtccaacataatcttcaaaaaacggggtgttagcaaatggcgggacctaaataattatgtgatcaatcaatcaatcatcatcaatcacaaaggatgcgggctcgagcctgaaaatctgatcagccgtcggcggaaaaggcaatttcgtccgtttcatggcacacaaaagggcaaatggacttcgtttccgatcgtgatcagttttttggaagataaacgtaagtcgcctttaaaattgaaagccaaaatttatacattttaaaatggtttcagtgccaaaagattaccgagcatgggaagcggcgataaaagtcggtgccgacatgataatgtaggtgatcaaaatggaaaaatatttaatttggtgaataattttttaaattttaagaaagtttaaattttacaagaaatttcataaaaatttttatatgaaaaaatattttttgaaatttacaaaatcaaactatatcggaaaaatattcaatcttttcttaaaatctttgcttgaagacccagagtaagattctcgagagttttttctttcaaaattttaattttctctaaaaagatttttcgtcaaaaaagtctcataaaaatttataatattttgaaagcttcaatcaatgggttgcttttataaaacattttttgccgtgattaaggagcattttgtgctaaaaataataatttttggcgtcaaatttgttgtgtaaaaattttcagggcattttgtttcgcttaataatttgtgccgttttttgaatttctaatttaaaatttgtttatcctttttaattttcaaaacaggcaacacacatgcgttcaattcaaaattgttaatgttgaagcaaaggacaattacagtgaaggcattttaattagagaaattgagtttgccgaagctcacaaacttttaaagatttgccgtaagttttaagaaatgatttttaa

SEQ ID NO: 81875 - DNA, 939 bp, Heterodera glycines
  Genomic contig location: Contig_ID=SeqID_17397; Location=884..1822; Strand=-
  SCN-specific regions: Sequence locations=1-620,643-787,819-939
atggacacggcacaaaattgcaagaatctgtcggacgaccagcaagtggccgccttccaagtgttggcagaggagcagggtggcgatttgaaggcacggattgatcaaattttaatcatttcggggctaaatttgccaaataataagcaagtggcctatgactaagttttttaaaactgattgctcttacagaaaacttagtttttcaattgaggctcgcccaaaccaacttttccctattggtttaaagaaatttaatcacaccatttcgatcatttccgatcacaattttcatgaacaaggccatcctatttattttaaataatgaagaacttttaggcaaacattgacaacgtgctgatgaaagtgaatgtgtcggacgaccagttcaagcagaacattgaggaggcgaagcagaagctgagttcgtctaaggctaaggagaccgctgatcaggtgggcaaaattaaaaacaaaattaacgaagtaattaccataatttacagtgaaatattgtcctaaatcgaatttagctcgaagacctctttttggacggctccctcccattcattgacaaagtgaagaagtccgtcgaacttgttcaagaattgcccgaagaaatccgagtaaatcatttattttaattgttaaccaattaaatttatccacttaatatatttgtagacggaatgtgaacccgtgctgatggtgatcaattcgatcacgcgatgtcccttcaaagaacagtgcacaccgtcagaagaaattgggggcggaaacattggcaatgttggccagggaggaggaggaggaattgggctgcaacaggggcagaacaagcagggacagcaacaactgcagcagaaccaacaggaacagccgtgcttccacatcaaactgctcaaagtgtgcaccatttcgaagaaccaaaaagaatga

SEQ ID NO: 81876 - DNA, 93 bp, Heterodera glycines
  Genomic contig location: Contig_ID=SeqID_17399; Location=107..199; Strand=-
  SCN-specific regions: Sequence locations=1-39,61-93
atgggcaaagaaatgcacgatttgaaggcggaggccgaatccatcagaaatgttgcaatttttggcgtttgcatttgcacggtggccagtttt

SEQ ID NO: 81877 - DNA, 198 bp, Heterodera glycines
  Genomic contig location: Contig_ID=SeqID_17399; Location=3495..3692; Strand=+
  SCN-specific regions: Sequence locations=1-198
atgtaaaaattaacagaaattcacgggttcataaggtaatttggacaataaaacaaaaaatcacggttcattcgatagttgcgagaaattcccaggagaaactccaaaataatgtgaaattgattttttgaactcgcatctccaaaattttgtcatcccatcagaactcattttagcgaaggtgtgaaggtggccttc

SEQ ID NO: 81878 - DNA, 958 bp, Heterodera glycines
  Genomic contig location: Contig_ID=SeqID_17399; Location=1033..1990; Strand=-
  SCN-specific regions: Sequence locations=1-12,34-513,539-557,611 -740,763-886,908-958
atgctttttctcctttttatatttgtgttcttaatcataaacaattcaactgacaaaacattgtcagttaatctgtgtaaaaaatgtcgaccaacttttgctgaaatatttggcgaagaatggcaaaatgaaataataattggagaaaatgaaaatgagactgatcaaaatgcaaattttcatcaaaatgatcaaaatgaatcaactgatcagaacgatcagttggattttcaacaaaaaaacgaaattattcacaaatttcatgcaataaaagaaggaattaagaaacggggaaaatattcggcaaaagttaggaataaaactgagcaaaaaatagcggaaaaattgggaattaatcgaccaaaaatttacaaatggaaaaaagaaattggaatttattattataaaaagaaaaaacaggaatttattgaccaaattgatgaaattaaaagaatgccaaaaaatggaagacagaagcaatttgcgaaagagttgggcattagcaaagaaacattaagaaaatggaaaaaggaatttggcattgaaatgagcaaaagtaaatttgaaattaattttcaatttaattattaatattaaattttattatattcttaggtccaattcgattcaccgaagaacaaaaaatgagcaaaatgaatgattattatgaaatgaaaaaagcaaatccttctttaagtgacaaagaaattgctgacattttgaaaattggaactgccaccctaaagagatggaaaaaggaaaataattcgtaatttttcgtttttcttatttgtattggtttcaaatgatgctttttattctaattgttgttttttaaaattttttcgctcttttatatgtttgtttcttaattgacccgccaccatataaatttcgatttgacaaaacatcgaccaaaaaaacatgattgagtaataattaaatgcaaccaaataaa

SEQ ID NO: 81879 - DNA, 1620 bp, Heterodera glycines
  Genomic contig location: Contig_ID=SeqID_17400; Location=329..1948; Strand=-
  SCN-specific regions: Sequence locations=1-395,417-587,609-714,736 -937,961-1620
  Gene Ontology: Mol. function=intracellular transporter activity; Cellular component=intracellular; Biological process=Golgi to endosome transport
atggtgagggactaccgagaggcgtggattcacttcagaactcacaaaacgcccagaaaagcggtgatggacacaattgaggtagacagtgcagctgattccccttcaaattgttcaattaaaatttaatcgcatattattattgcctttttactctgaaaagcacttactctgttcacaggaggctgaggatgcgctggacgtgttcaacttgaacatcgcgcgacaacaagccgagttcgaaatcgacaaacagactgacctcgtccgtgtcgaggaccaaccgcaggagggatgggttggttgggccaaaaattggtggttcggcggttcgccaaagggcaaagaggcggctgctccggaagacgcacaaattttcgaaaaattggagaaggaattgacccctcaggagaaggagcgcctctttgatgccattgactaccaagtgagagtgaaaatggcaatttaaatgttaaatttggcaaaattatgtcaggaaaatatgccaccgacggactatccgaagcattttgtggaaaatctgttcaaattgaacctaaaaacactcatgctgaagttggatgatgtgatggaactgcgtttttctcaactgtccgctaaattggagcagagatcggctgcgagcgcaatgcggtaaaacaacattttgccacttttatgagttttttaggttccaaagctaattaattaccttttaaatacttcttattgttaatccttctaagttttctggttattcgcctatttagcttcacttccgccgtcaagtcacttgaaatgcatgctggcaccgagtccatgctgcacatgacagagactgatcgggcttggttgaccttggaatttgaaacaaatccgctagagggcgactttgatcaacgcgtttccctaaacattgctccggttggaacattcgtttttttaatttaaaaaatataacctagctaatttttaggtgatgttcaaataccatgccccggcggtgaacaaagcactcgacgtctttagaccgccaaaatctgtccgtcttcaccaactgactacgctggccattgcgcgttacgaggacgtcaaggcaattggcttacaattagcaaatttacctaatcataactcattaactaatgttatttttaggcccgttctgcgacagcccttcagcacatggttgacgtgcgcaagaagctgaagttgaaggtcaaaattgaccctgccatttttgtcgtttgttccggcggtgcttttgacccaacaaaaacgacattaatcgccgaacttggtcaattgaaactgaacactttggacgagccgtccacaaaggcatacgaacatgtgagggaattgctaagggcatcattaaatttaagaaaataataatatttgcagataaccgatcagcgattgcgttcattggtggccaaggcatacgacaatttccaactgcgcctctccaatctccgactgatcttttccgactcttttgccaattgcatgaaggcccggggggacaaatcgtcggatgaccatttgctgaaacccacggggatgtgcatcgacatgctcagagccaccatcgatgacgtccaaattccgatgtga

SEQ ID NO: 81880 - DNA, 623 bp, Heterodera glycines
  Genomic contig location: Contig_ID=SeqID_17401; Location=385..1007; Strand=-
  SCN-specific regions: Sequence locations=1-342,364-623
  Gene Ontology: Mol. function=intracellular transporter activity; Cellular component=extrinsic to membrane; Biological process=Golgi to endosome transport
cgcagaaaaagcgcacaaaaatgagcgtgaagccaagcagaaaaaattgttacgattggaggagaacagacgaagccgccaaagtcgacaaaaagggtcaattgttaaccaatttaaaatttcagagccaaatatgccatcggacgacacttttaccgagaaattaatagcacaaattatcaaaaatctccaagtgcatattaaacgggtccatattcgttacgaggacaaattctcgaatcgcgagcgcccatttgccacaggaattactttggactcgttgaattttcaggtgttgcgaaacgatggataaataatttactacagcaactttttagactacggatgagaatttcaaactgatagtgcagaaagaaactgtcaaaatcttttacaagtgagtacatcgttttactattatcattatttgttagttatgtgttcatttgtatcatcagttttgttttagattggtgtccatgagcagtttaagcatttattcaaacgccaactccaatttcatctccgacaacaaaggcaaagagaagataatcaactctttgcaacggacaatcgcagttaatgaggagaagcccgaggggtacagatacggtgggtactga

SEQ ID NO: 81881 - DNA, 371 bp, Heterodera glycines
  Genomic contig location: Contig_ID=SeqID_17402; Location=32..402; Strand=-
  SCN-specific regions: Sequence locations=1-371
atgcgcaggcaatgggaaaacaaattcgcgcgccttgccgaaacttcccggaagacgcgccgctcaaacaaagccggcaccgcctcccatgaggtcggccatagcgttatcatttggcttcttggggtgcgacaatttttgaaggttagtttagggcgaggcttatggggtcggggtcacttcggcgcagaccatttcggcgccgcaaattttgaaacgctataacttttttatttgtcattaactttagctaatctggcatcattcgaaagctctgggtgcgctctttttataaactgactaaattttttgaaattttgcaggctaataaagtatctcaaaagctatcgaatgataacaaaaatatttaa

SEQ ID NO: 81882 - DNA, 268 bp, Heterodera glycines
  Genomic contig location: Contig_ID=SeqID_17402; Location=953..1220; Strand=+
  SCN-specific regions: Sequence locations=1-47,72-268
cattcttggtattattcgaaagcattcgaaaaatgctattagcctgcaaatttttaaaaatttttatttatgcacaaaaaaatcagagcaaaaaaaagttcgaattaatgggtttttgagttccttctggccataacttttttgaaacttaaccaaaatttttgagattttgcaaattaataataaacacatagagctatcgaacaacaccaacaattcttaatttgattgacagtgaacaaagttatggttcaaaaagtcttccgac

SEQ ID NO: 81883 - DNA, 1409 bp, Heterodera glycines
  misc_feature (327)..(327): n is a, c, g, or t
  Genomic contig location: Contig_ID=SeqID_17402; Location=592..2000; Strand=-
  SCN-specific regions: Sequence locations=1-107,146-228,250-398,420 -429,453-642,664-977,1002-1409
atgaccttatcaaaaaagtttttgccaagaccatacgtttcggcatcggtaagggcaaatctattggatttattggtcataaatctgcggattatttttcttcaacggaaatatgtattgaaaaaatgaaattttatctttttatatttaaaagcaaaaaaaaaaaatgttggataatctgttaccttcagaggcagtaagggaacctgagagagtaaagtgttgaggaattaattttaaaaatgagagcatacatgtacaaggggtgcgccagtcagacccccatacgtcggacgtttggcgcaggggggggtgcgccgacgcacnccttgttcatgtatgaatgagagaatgccaaaataaaaagaattgctacacatgacatcatacagttgacatgaattagtgggaaaaagaaaggggtcgggaattaaaaatatgaatgaattttactgatccgacaatttgcgcttcgtcccttttttctcctcttccacagtgatgtcaacggccaatgtcactttgtccccgtctttgtcataaaatcctctgcttgggtccattaattgcttaattatgctcatttattaaatgagggtttacgaatggaaaaagctcaccgcaaaagtgatgaaagtggggaatcccaaattgttcaatttattgttgaaaatacggccattgaattgcccaattaaattctccgccccgcccttttgtgagacaatttgaatcgttgccgaacatttgcaactccaattttcaccttattgccaatttgtcggaagactttttgaaccataactttgttcactgtcaatcaaattaagaattgttggtgttgttcgatagctctatgtgtttattattaatttgcaaaatctcaaaaattttggttaagtttcaaaaaagttatggccagaaggaactcaaaaacccattaattcgaacttttttttgctctgatttttttgtgcataaataaaaatttttaaaaatttgcaggctaatagcatttttcgaatgctttcgaataataccaagaatgaaaagcaattgcattgtgacagggcgggcctcatcagtacagaccctgtcagaatgctaaagaaaatgtgtttcggccctttctgtagacacaatcaaataaaaacaaaaataaataaatgtgatccaaatgtgatcaaacctaaaaatggggaaaaaataagtgaaatttggcacttaattagaaagtaatttacaagtgatcaatgggatttactcaaatgcaaacttacgcccaccacgccgatccaatcattccgtcacggcttcttgaattggctggcacgctgtcggcggcacgcagttgacaactcgcggatttgcacccatcgtagcagcacctgaatttgaaaaacaataaa

SEQ ID NO: 81884 - DNA, 126 bp, Heterodera glycines
  Genomic contig location: Contig_ID=SeqID_17402; Location=2775..2900; Strand=-
  SCN-specific regions: Sequence locations=1-126
gatttctctcgtcgctgcttggattacattgaccaaaatgcggaatcgctgatccaatcggatgcctttttggaagtggaacaaaatttgctgtatgaaattctcgaacgtgaccagttgaaaatc

SEQ ID NO: 81885 - DNA, 309 bp, Heterodera glycines
  misc_feature (272)..(272): n is a, c, g, or t
  Genomic contig location: Contig_ID=SeqID_17403; Location=1516..1824; Strand=+
  SCN-specific regions: Sequence locations=1-245,267-309
atggcgctagtaagttttgacttattcccgaaaagagctgacattcaattggcaatcatggaaatggaacaagatggatatgcgaattttggaagaaaaggaaaatcatgggtgatcaatagggatgccaaaaaatatgaacataaaatcgtaaaatatgtgcataaaatatgcaccaaaaatcgtgaaatatgcgcataaaaagtgaaaaatatgcacataaaattttccaattgagggtgtaatttctcaaaatttcttttcaattgtanacataaagtaaaatcttcaaaatggctaaatgtggta

SEQ ID NO: 81886 - DNA, 682 bp, Heterodera glycines
  Genomic contig location: Contig_ID=SeqID_17404; Location=254..935; Strand=-
  SCN-specific regions: Sequence locations=1-450,472-682
atgcataggcgcccaaaggtcggccgcagtccgaaaacaaccgaacggcagcagcgtcagctcgtccgactcgtcaaaaccgacccgaagaagacggctggtgatgttcgacggcactcagctgatgttctcggcgtccaaatttcgcacagcacggcccaacgcattctccgccgccacaatctgaatgccagacgtccggcgcgcaaaccactgctgaaagagtgccaccgaatggcacgtctggcgtttgcaagggcacatgcacattggacagttgaagactggcggaaggtgatctggtcagatgagtcaaaattaaatttgttcaattcggacggggcaattcacgttcggcgaccacccggaaagcgattcgaccctaaatacaccagagggaccatgaaattcggagggggagacggtgtaatggtgtggggtaggtcggacaaatttggccatttttggagagaatgttcagggtgctttaccggcgacacattgggtccattggtgcggatagaaggcaatttgacatcggagggctaccgcaacattctcgaggaccaaatgctgccatttgcgcgtgatcatctcgcgcccggatggacttttcagcaggatggggcggccatccataccagccaacttttgatgggtcccgttcggcgacttcctggcg

SEQ ID NO: 81887 - DNA, 1118 bp, Heterodera glycines
  Genomic contig location: Contig_ID=SeqID_17405; Location=1159..2276; Strand=+
  SCN-specific regions: Sequence locations=1-99,122-301,323-1097
  Gene Ontology: Mol. function=alpha,alpha-trehalase activity; Cellular component=extrinsic to plasma membrane, GPI-anchored; Biological process=trehalose catabolism
ggatttcaaagtgagctcaatggactccaaaaatgtcgacaaactaaaaacatttgtgcgagaacactttggtagcgcggacaaatttcttgataggtaaaatgagtgaaattgtttaaaaaagaactgaatgtacatatttattcaatattattttaagcccacaaccggtcgattggaaggaaaatccaccgaaattgcaaaacattgctgacccagaattgaagacctttgcaaatcaactgcatgagctttggaagaaattggggaaaaaaatgccagaatcggtaaaacggaaagaaacgaaaagcattgtttggcaatttcaggcgaaagaaaataagtcgacgctgatttacgttccgaacccttttgtggttccggggggccgtttccgcgagttttattattgggacgcttattggatcgtccggggactgctcgcttcaggtcaaaataatgggctattggggtgggtgaattagggagtgattaggagtgaatgccaaagctaaagtgatcggagaaaggcaggaaagtgatcggaaaactgatagtgccttttgagctgccgtattcatttgtcagctggtcaaatgtccgtccttaaatggtaaagcattggaattcaattcacaggaatgaccgaatcggtgaagcacatgtgtaacaattatgccgagatggtcaataagtttggctttgtgcccaacggcggtcgcatttactacaacaaacgttcgcagccgccctttctcactttgtccgttcgtttcgcatagttttaagagtgcactttagttttattagtaagacaatgcttttggccaattttcagaataccgtatttactgaattagtacccccccccccccgggggttctatttttcaaccccgctcgaaagtggggtactaatgcagtaagtacggtatttgttaattttgaataataatgttttatttgctctctcatcagcatggtcaacgattattttgcggagaccggtgacacggaatacctcaagaccattttgccagttcttgaaaaggtccatttggaggggtgtcatggcagttcgtacaatggcgtttcgtgtacagacccatttggaggggg

SEQ ID NO: 81888 - DNA, 1110 bp, Heterodera glycines
  misc_feature (1004)..(1004): n is a, c, g, or t
  Genomic contig location: Contig_ID=SeqID_17407; Location=77..1186; Strand=+
  SCN-specific regions: Sequence locations=1-165,194-254,278-449,471 -772,797-1110
aaaccggcttaccaaaaccgatcgtcgagtgccatgccgagctggccaaactgctcaacgactcgaagattgaggtcagcagcattgatcagctgacggaaaagttctggatggtctactacaaggccaaagatgagcatgtggtggagcacagcacaagcaatgtaagaaaagttttaaaatatttaaaaaagacaattggtgtatggccctgcaccaggtgtagagcgctacgacacccgcattctctacatggtaaaattcagaaaataaaatgaaaatgtgaagtaattttttaaaatcaggacacggacagcatcttttacgactacctgacgcggctgggggacccacttccgggtggtgagcagctcggggaactcgcggacgagtacccgaatcatacgatcatggagtttatttgtggtaagattagttaaaatttgaccaaaataaatggaaactttttgtttagctgggcccaaggcgtacggcctgtggttgcgcaacaacgcgacgggggaggacgagtacaagctgaaggtgcgcggcatcacgctggattcggatgcctgcgaaagaatgaccttcgagaagatgaaagatatggttttgaacaagctgggccaagcagacaacaacgtccgcttcaactacccttcgaagaacttcaagataacgaagaaaggagaaatttttaccgtgccgctggtaaaacagttcaacccgaccgtcaataagggagtggtcagggacaaagggttgagggtggtgccctttgggttcagcaaccaagagtggtgtaagtggaattgcccaggcgcttgtacctgtctgttcaacccagacctcaatgtgaacatgttcacagaagaggagttaaatgaccccgatattatgccataactgtttttattgtttcaattgattttcttcatttagtaatatttttattcatttatttcttcatttgtcacccctatatttttccggaaagccaatanatttcaccaatatttcactttttccatctctcactcgttctttgtatttcttttcaatccgatacattgtgttttccttcacttgtactttttgtaattctggtaa

SEQ ID NO: 81889 - DNA, 1225 bp, Heterodera glycines
  Genomic contig location: Contig_ID=SeqID_17408; Location=119..1343; Strand=-
  SCN-specific regions: Sequence locations=1-8,36-416,438-1225
atggttaccgacgaagatgaagatgaagaaattgaagtgtcaaagtttttaaccccaacaagccagacgcagggaagcaatcgatcacccaggaccaataagaaagcagcaaaacagcaaaaattgatcgagaagaaggaccacctgttggccatcattatgtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaggaaactcgcacagaatccgcttgccagtagcctactcaatcgactgtttgttgggtctgggttcgtcggacaagtcaaacaaacgagaggatttgttctctcaaaatggacaagaaaataaacaaaatatacaccgacccggccaatccgggcgggtatgcgggtgcgagtgccctgtacgcggcggtgaagaagaagcacccaaagttgaagcgtatcgagtttgaagacttttgcagaggaacaccacctacacgctgttcaagccaaagagggagaagttccgacgcctacgcactgtgcctacgggtttcatgaccggtaagttgtactggggcttattgcgcacaattcagggttcagatgttcaggcggacttggcagatttccaggcactttcgcgcaagaacagcggctaccggtacctgctgttggcggtggatgttctatcgaggcgaatgttcggcgcgcccgtaaagagtaagcgcccagtggacatgaaaagagcttttgaagagctatttgagcaaatgccaagggtgccagacacaatgtacaccgatcgagggctggagtttgtggcaaaaccgttgaaggagttttacgcggagaagggcattcaaaagtttgagaccagttcaaagaaaaaggccgccgtggcggagcgtgccatccgcaccgtaaagactcggctgtacaaatatttttccgccaacaatacgtcggtgtgggtggatgtgctgccaaagtttttgagtgccatcaacaactcggtgtgccgcgcgaccggtcttagaccgaacgaaatcagcgacaccaatgcgagggaggtgtggaagagggtgtacggcgaagggctcgcacaattggacaagtcaccaaagatcagagccggggaaacg

SEQ ID NO: 81890 - DNA, 472 bp, Heterodera glycines
  Genomic contig location: Contig_ID=SeqID_17409; Location=821..1292; Strand=+
  SCN-specific regions: Sequence locations=1-3,27-63,94-161,185-304,354- 472
gtgacaccaaaaggcccaacggcgggtgtcttacttttatgcaaatttcataatactttcatcatttaattaaaatataatttaaattaattaccgattcatagctaaggatggcattaaaattgaatttggacactcaaattttgacacgccttctgtcattatgtgactgaagctgactacatccgtcaattggtcaaaatgcaacaattgcagtcgaattcgtctgtcaacaaagtcacaaaattgttccaaatgaatggaattggcgacaatgcaacacacagcgaagaagtggtcgtacttaattaattagtgagttaattaattattactaagaattaattaattaaaaagtttctttattatttaattcattcccaaattaccttctctgtaaagttagcagtcggaaataattggccccaattttcggagggatttgaattttgaatctttcggactttaatta

SEQ ID NO: 81891 - DNA, 2101 bp, Heterodera glycines
  Genomic contig location: Contig_ID=SeqID_2842; Location=2528..4628; Strand=+
  SCN-specific regions: Sequence locations=1-119,142-349,372-818,841 -923,948-1258,1281-1460,1484-2062,2097-2101
  Gene Ontology: Mol. function=antibacterial peptide activity; Cellular component=extracellular; Biological process=response to bacteria
atgggtcgtgacaacacattgcctcaagcattgttcagaccattggacaaattgcgcgaattgttcctgtcgggcaacggacttcgaaccgtacgcattgaaattggtgggtacgtacagaacgacgttggcatgaagatttttatataattgtaggcttattaaaggaccgaaattaagctagccaatgaccaaggcttaatcagtttagcaggcccaattctcgaccgattggacttgagccgaaaccgattatgcccttctcgaaaaaattcaaacgacactttcggcatcgaatggcctccggcaagacaactgagccttgaaaatgccaatgtgttagaactgaacagcacacattggacatttggggaagtcaaagtcgaacaacagcagaaggtgcctgataattaattgcttaatcatagcaattcatttgatcagcttaaaatttcactaaaaacggtggagtgccatgtgtcaattactgagagccattggaaggcgtttgaacagctccgaattggaggaaaccacgcacttcgactacacccttctgtactgccacggtatctgctgaatgccgacaaataacaaataattatgtcaattgggcggattatcaattaattggctaattaaatgcctcttactcaccgccgttgatttgcatttgcatttatgcctacaattagactgctcactcttcatcatttggacttttccgatgccgcgtccgtgccggaagagttgtttttggaatggacacgacaggcggaaacgcaatggcatcacattgggctgagaagagcaaaaatcaaagccaaagctggtgctgatcagccaaatctgcgccaaaatcagtggacattttgctcagccaaattggaatggttggacatctcagaaatgggcagcattggtaattaattaataattaattaattggggaaaaggcagcaacaaaaaacagctgaagtcggcacattacgattggacggatgcgttcagctcaaatggctttatgcggacgcaaatgccctgggggacattcaaatcggcgactcgggccctgcggcgcttctgtctttgtccgcacgcgacaaccgccttcgccgttggccagcgggtctgttgcgctcggctcgctctttgtcgtctgttcagttggccaacaattccatcgcgcgactgccgcccgaacttttcgagcagtacacgcagctgaactcgttggacctatcgcaaaatgcattctatcacttccattttggcgattcgtcccatcagcagcagaccacactcatattcctcaacctcagccaaaaccgactccgttccgtttcactcccaacactgtctagtctgaccctcttggacctatcgtacaacattttgacggagttcgcctctttgagttcgctgccctccctggagcatctccacctgagtgggaacgcgggcattcgtctgaccatcgcagcggaacatcccgcgctccttcggcttcacttagccaactgttctcttacgaaaatgcccgatttgagtcggctaatcgcactccgagaattggatttacgtaccaatgggtatggttgttttcattggtttgcttttaattgttttggcacaggctcgagtcagtgccgggccatttgctgccttcgcgcggagtcaatgcgttggacgtcgaggggaacgctctgcgggaattgggctgggattggcgagccgaacaattggccgcgttgcgcgacttgcgcgccgtgggaaatccatgggaatgcgcgtgcgaattcgcaccaccggtggtgcagcaactgttcaccccacaaacacagcaaacgaccgtaagagcagcaacagagggaaaagccggactgtggccattcccatggcttatgaccccccggggcatttggaagaatggcactcaccttcccaaaaggaattgactaaatgcgaaccaatgaacgaatgccattcgaacattttcagaatcaaaggacacttttctgtggggggaaatgttcacgcggagacaaacacagaaaagttgagaatgagcacagagaagcagcagaacagcagcaaaacg

SEQ ID NO: 81892 - DNA, 1628 bp, Heterodera glycines
  Genomic contig location: Contig_ID=SeqID_2843; Location=332..1959; Strand=-
  SCN-specific regions: Sequence locations=1-99,146-238,260-349,373 -621,643-658,681-1126,1214-1431,1453-1543,1569-1628
  Gene Ontology: Mol. function=protein binding
atgctcccactggacggcatcaaactgaaggacctcgaggccggcttcatgtcccggcagcacaaatttgcacttttctacccggacggaaagtgagacgggaagggaacggggtggccgggcccattcattcattcattccttgccgtttcccttcccttgtattttttttacaaaatgcgcaatcattgaatgaaaagtgtgcatttagcatgtgagtgagtcttcatcccttccgattttcccccaatttttggtctgtgtcggagtggacgaagccatcagccaaaaacagtgccaagtttcattaaacttttatttggcacaaatgcgcaaaaccaatacattcttccctctttccaattttccctttgtgaattcggtcctgtccatttttgggcattattttacatgcattaacaagggatgcttcaaaaactgaacagtttgacccgggaattgctgtttttatacagccctatctgccccctcccttttacaatttccaccttttatccctaattatgtgtgttcatttgtctctccatttttacgtttttcgcttccaggaggtgagtgggcggaaagggccaaatcgcacataactcgcgatgatagtgagctgcctttttgccgttctgtcctcgtcccaattgtcgtccctttgggttgcccctttctgtccttttccttttgttgcgttttgtctccaatttccccatttttcttttgtgcctttgcttttcgttgctttgtttttttgggttttgttatttttgcatttccttattgaaatttgttccttccttctcaggaacatttacaaagactacaaagaattggagctgagtgctaaaaacttggacgaagtggacgcatggaaggccagctttctccgtgccggagtttatcctgagaaggagcatcagccgacatcggacgaagtgagcggacggagaacggcggggggggggagggccttcattagcaaattcggaaaattagtccatcatttacgttttggtcttttgattgtcgcatttaatcaaatccgaatgtttgctttatttatccttcccttaaagcaagaggtcagtttccttccgttggttggccattgagtgggttcatttttcgtcttttcgtttgtccttttttgttttttgtccgtttctcctttttaaatttatttttatttattttttgtgttttttaatttcaattttacattttcagaatggtcatgtggaggagccgagcagtttggacccgcagttggagcgtcaggtggaaaccattcgaaatttggtggactcgtacatgcgcattatcaacaaaaccatccgcgacttggtcccgaaggcgataatgcatcttatcgtaaacaaggtaagcaaagaaaaagttttacaagtaattttattacttaaattatattttcattgattaaaaatcacatattttttcagttgggcgactttctgaaggatgaactgttggcgagtctgtaccaacatggcggggatacggtagcccccttcggttttatttttgttcatattaaaaacgcattttgctgcttaggaacaattgatggaggagtcgccgctcgaggctcaaaagcgtga

SEQ ID NO: 81893 - DNA, 313 bp, Heterodera glycines
  Genomic contig location: Contig_ID=SeqID_17410; Location=1289..1601; Strand=+
  SCN-specific regions: Sequence locations=1-313
  Gene Ontology: Mol. function=structural molecule activity; Cellular component=membrane; Biological process=intracellular protein transport
cttcaaaaagtgggcatcaacccgagcagtatcagtttcggaaatgttacaatggagtctgacaagtacattgttgttcgtgaaactgttggggacacggctcaggtggtgatagtggatgtggcgaaccccaccgatgtgacccggcgcccagtcagtgcagaaacggcattgatgaaccccgtttcgaaaattctcgcactgaaatgtatgtatagcattactggacttgtatatgatagaatcacgtttttaagccgggaagaccttacaaatattcgatctcgaactgaaggccaaagtcaagactcat

SEQ ID NO: 81894 - DNA, 1336 bp, Heterodera glycines
  Genomic contig location: Contig_ID=SeqID_17411; Location=620..1955; Strand=+
  SCN-specific regions: Sequence locations=1-1110,1145-1336
  Gene Ontology: Mol. function=structural molecule activity; Cellular component=clathrin coat; Biological process=intracellular protein transport
atgatcaccaaatatggatacgttcatttgttcgacctcgaaactggcatttccatctatactgtgcgtgtgtcgactgaaactgtttttgcgtcgactgaatacaaagtgaacaacggagtgctcggcatcaaccgttctgggcaggtatcaattggttttacatttggtgaaggctaaattcccagattatcgctctatgtttcatttgatttgtaggtcatcagtgttggtcttgatgagaccacaatcattccatacgtcacacaacagcttcaaaatccggatttggcactcaaattggcctctcgttgcaaccttcctggtgccgaggaattgtttgtgcgcaaatttaacttgctcatgggaaatggaaattacgccgatgctgccaaagttgctgcgactgcaccacagaaaattctgagaacaccgcaaacactgcaaaagtttcaaagtgctgtccaaccgcaggggaaaggcgctgcaccgattctgatttacttcaccacccttcttgagcaaggctcattgaacaaatacgagtcgttggaattgtgtcggccagtgcttgcgcaggtttgcgtttttatcgctgcgtttcaaagattatgttttgaaccgttgtaaaaatttgcagggaaagaagcaggtcgtggagaagtggatttcggaaggcagtttggactgcagtgaagaattgggagatttggtcaagcaatacgacatcaacttggcgttaagcatttacttgcgtggcaatgttcctcacaaagtcgtccaatgctttgctgagttgggacagttcgaaaaaattatcctctacgcaaagaaagtgaatttcgagccggattatcttttccaaatgcgccaagttcttcgcacacatcccgaaaattcctcaaaattcgctctgatgttgctgaatgaaggtccaagtggcgaaccattggcggacattaatcaggtgatagggttttccatttaaattccggtcgatttgcatacaaaaattgttgtttagattgttgattgttttgccgaggctggaaacatccaacaatgcaccgcttttttgcttgaagcgctcaaaagtgacgacgagtcccaagggcattttcagactcgtctgctggaaatgaatctgatgtcaaatcctcaagtgtccgatgctattctgggcaaccgaatgtttaatcactacgacagagcctcgattggtcaattgtgtgaaaaagctggtcttccgcaaagggcgttggaacatttctccgatttgtatgacatcaagcggtcacgttgtgcacacacaacatttcaattcagaggttattaa

SEQ ID NO: 81895 - DNA, 978 bp, Heterodera glycines
  Genomic contig location: Contig_ID=SeqID_17412; Location=5..982; Strand=+
  SCN-specific regions: Sequence locations=1-978
  Gene Ontology: Biological process=protein biosynthesis
atgccgaggctaacttcaagaaagacgcaaaatacaaggctctcaatgatgccgaggctaaagcccataaagacgcagaagacaacgttataatggatgctgaggctaacgccaataaagacgccgaatagaatgttaaaaaggatgccgaggctaatgccaagaaagacgcagaatagaaggctaagaaaggatgcccaggctaaagccaccaaagacccagaagagaacgctataaaggatgcccaggctacagccccgaaagacgcaaaagcaaagaacaaggaggaagaaattaggaaggaaaaggctaagcctcgaagaaaaacctgaggcacctgccgaaggcgtatccgtaatgcctgaatctattaatgcggaagagacactggataagctgaagcaggaatagagaccagtggaagtgcctccatctacttctttaatcacaggataaagaaagctgcacaggagaaggctcaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagagaaggctaaaacggatgccgagactaaagccaagaaagacgcagaagagaaggctaaaaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagaaaaaggaggaagaaggaagaagcaaagaaagacccgaagagaaggctgaggcacctgccgaaggctaa

SEQ ID NO: 81896 - DNA, 835 bp, Heterodera glycines
  Genomic contig location: Contig_ID=SeqID_17413; Location=1440..2274; Strand=-
  SCN-specific regions: Sequence locations=1-258,310-347,369-559,599-835
atgttgcgctctgtgtttctgctgcttttggtccttctgatcggctggctgatcgcatcggctgcacgcaaccaaatcaccgattttatcagttttatcacaccgcttattgtaaatttgttcatcgctgaacctgtggctcattcggttatgtgtaccaacatcaaaagtgtactgatcggcattatcacttgcgtgccaattttggcatccgccagtggggcgcccatccttttgctgaacaggtgtaaaaaggacaaaaattcaattaaaaaaatattattaataattttatttatatttaatttagcagcgattatcggactgcgtacaaaaaggcgattatgcgaagaaaaggcaattcttctacggttggaccgctttttcgtccacgccaaattgtggtggtttcgaatgagcgaaaatgatctttttgggcacacaatttttggacaaaatttaacccaagcttaattttactgaatttattgattttcagaaaaatgattcgtcttcaaaattttgtgatttgttcgctaagatttttgttgtactattttttaaacatttatcatttctttcaatgtcaagaatgtttaatttggttgactctgacaaaagtcatgggaagtttttgttcaaaattttcatttgatgatttttcatataaccctcttattcgagcgtggtggtcgcattctgctgactttaacattacctttacatcatgaggaccggtaaattggacaccaagcggaaaactggacaccgtcggaattttggacaccaagcggaaaactggacaccggaaaactggacaccatcctaaaataaa

SEQ ID NO: 81897 - DNA, 848 bp, Heterodera glycines
  Genomic contig location: Contig_ID=SeqID_17414; Location=862..1709; Strand=+
  SCN-specific regions: Sequence locations=1-267,377-656,678-848
atgattagaagaggtacaactgtgattagaagaggtacaacagcgattagaagattgattagaagaggttcaacagtgattagaagtagtacaacagtgattagaagtagtacaacaatgattagaagaggtacaaatgtgattagaagaggtagaaaagtgataaaagaggtacaaatctgattaaaagaggtacaaaagtgattagaagagtgattagaagaggttcaacagtgattagaagtagtacaacagtgattagatttgaaattaaattattttttttacaaattcaaaaaataaataatgaaattctttaattaaaaaaaataaataaatttaaatattttataaaaaatatttgaaattaataaaacatgtaaaagtaatcaaaaatgcacagaaaaataatgtacaccgatcggatccgaacttcgccccccccccctcaaaatgatgcctcagaatccccaatcacacagggattctgagggcttaacgatgtcaaaagtaaaaactgattatgtattcatgatcagcggcccaaattacccataatgacatgtttttagaagatttttgttgaaaaaaatttttcactcaaaaatcctgtccaccccctttggtcccgaatgccaaaatcacttttatttttgtatctttattttaaaagatgataaaaatgtcaaataaaatttatattatagagaaaaaaattgcggatttttgtagtattttacttttccctaatgacttttcagaaccgagatataaatttttttctgaaaaatcgaaaatttccagaatttctggaataactttttttgtttttgaggtataaatttcaa

SEQ ID NO: 81898 - DNA, 885 bp, Heterodera glycines
  Genomic contig location: Contig_ID=SeqID_17418; Location=1168..2052; Strand=-
  SCN-specific regions: Sequence locations=1-132,156-562,584-749,771-885
atggtcggaaatggaaatgaattagtggaaacagaagatgacgaaaattctgttaatttcatgaacttgtttgcgaatttggaactgacggattctgaaaaattgcctagtcatatggaaattgagaaaatattttctgacaccacaccaccgccagctgatctgccaccaattgaaagctcagttcttgggtttgtgttcatctcacaccccatattgtgggcactggtacaaccggacattttgggcgaacaaaatgagctattggaccaaaaaaatctaagcttagaatcggatcaattagtcttccaaagtacaccaagttatgtgacgacaattacacttgaccctaacaataactggccacatttcacacaaatttcgttgaattggaacaaacaatctctgttaggaactcggctcaaaacaattgatctgaagcaaatgacttctcctccaaaactgggaccatcagtaagtcaaattgtcccttcgagctgctgcggaataattagggaagtgatccaaaataaaatcacctcagaaattatggccattgatgtctttttgtatggggaagaaactaatcagcgttttttcccccaccaactcgattcaagcgttaacctgacggagttagaagaaggcacacgggttcaaactacgggattttgggccaaaacttctgctatggaatggccaacttcgagtgatggagttcgcgattggtggattgagcagatttatgtaggaacgaacttaaaaatatttggcgctgatgaacatgaagacattcatcaatggctccaaaatgaacaatttcgactatcataccgttacctatgtgccgccatggacttgcaacaatcaccaaaacgcagatga

SEQ ID NO: 81899 - DNA, 612 bp, Heterodera glycines
  Genomic contig location: Contig_ID=SeqID_17418; Location=2427..3038; Strand=+
  SCN-specific regions: Sequence locations=1-82,104-138,162-280,321 -359,387-612
atgccaaaaaaactattaaaaaaagagggtattcggaaaatgagagattttgtaagttttccctaaattagaaaaattttgtatgaaatgtaaaaattagtcaaatattaaagtaatttgttaaaataacaatgatcgtttggcttaaaatagtctgaaatacgaaacttaaaaaatgaggtttttagaagggcaattatagttagacacttgctttaaattttggcagaaaaaatagaatgttttggcgtaatgttatatatttcttttcaagaaaaataataaataaataaactcaaaaaaaaaaataaataaataaaattagttttgccaaatccgctattgtttgagcttttcacttattatttatattattattttttattctcatttcagataattaaaattggcaataaaccacaaatgctgtttgcgggtgtaattgttctaccaatattcgttttgcaacattgtgtgtggaagtgtcgccctgtgtgcataatgatgcagggaacgaaggaagtcctctagttatgaaggttttttttttttttaattagtcgggaggcaaagaaataacaagaagaaaaaaaatctcgagagaaaaaaaca

SEQ ID NO: 81900 - DNA, 1347 bp, Heterodera glycines
  Genomic contig location: Contig_ID=SeqID_17419; Location=140..1486; Strand=-
  SCN-specific regions: Sequence locations=1-873,895-1347
atgggcaaagaacagtttcgcgaggcggacacgacgcgcaaagtgtgagtagttgcttggttttgggctcaagtccagtttatgcgtccaatcgacttttgtgcgtcccatcaatttttatgcgtccaatcaatattatcagctaagtgaaaaccgattttttttccgtttgttggcaaaaagaaagtaaaaaacccgtacaggaatagaattgttacaattttttggtaaaaccacgtcagagtacaatttgaggaaatgctgcatatatatttgtttcagtaaatatatgcatgttcagagataccatggaaaacagaaatatttaccatatattggagtagatacggctgaattatcccgtatatttagaaatactgtcaatgcaattcaattaattagatgtataaaattgaatggacgcataaactgaactagagcctggttgtgtgcctttttatgggacccaattgttatggtgtaaactctgaagcgcggcacatatgcctaaaattccggaaatacaaaaaaaaaccggcagggactccccaaaagtcggcaaatgccgggttttccaagcataaacattccgggcacaacccccccagtcactcctcctcatggctgtccttaaaaatggcgacataaaacttttttttagtgtgggcgtcaaattcacggccggcagctcggagctgatccgtcaggcggcgcacctgcaaattttcagcaaccgactgtaccaggatgtgcagggcaatcgctggctgcccgccccgtacggtccgctggacacgcgactggtaaatcctgttttaaagcatttgttttccgacttattggacagccccatgttttctctcctattattgcaaaattttcttcccaaaaatcgtaatgaaaccgaaaaattgtgttttccgagggttcaaccagggaccgttccaggattccaacttggaggagggggcggcgaaattttctaaattttctttcgatttgtaatctgtttcatcaaaaagtggtaattttgtggattttcggaaaaatttcgctgttgaggaaggtcttgtaaggggtgccaacaaggtttggcactgattaccagcaatatttcaatttgttttgctcatttcgattccctccagggcaccttccaacaagcggtgctgtgcaacacgtgcggtgagaagttggacacgtgcgtcggccatttcggcttcatcgacctcgagtacccggtgttccatgtcggcttcttccgtctcgtcatccaaacattgcagtgcatttgcaaggtttgcgagcagcaccatggaaaatgaaaagtggcatttcagcaataaa

SEQ ID NO: 81901 - DNA, 917 bp, Heterodera glycines
  Genomic contig location: Contig_ID=SeqID_17420; Location=783..1699; Strand=-
  SCN-specific regions: Sequence locations=1-158,180-250,272-280,302 -615,640-650,711-892
atgctcccgtcggaaagcttgaattggtattttggctgttttttggctttgcattcaacgcattctgccagtttgtcgttttccttgctcttctcaaacaacccaattttccaaatagggtgaaatggcgccattaattatgaattattaaaatcttaactaaattggaagaaagaatatcaaaaatattattcctcatgagaaagttgacaagcaaatattaatctgactatttaattttggcaaaatgttttgccaaaaattcaaaaaattccaattcttaccagtgcatttttactcccgtttttgggtaaaaatttccgggagcgggatcgggagttcaaaattttccgggacgggagtcccgaacgggaatcccgtaaaaatcccgatcccgtaaaaaatcccgttcaccgaaaaaagcgggagtcgggagcgggaatcccgtaaaatcccgcgggagtcccgatcccgccgggctctagttgatatcattcgaaagcttaacaaaaattttgaagttttttcttaataaattttttccaggcttgaaaattttgttgcttttgtaaggctaataaagcatgttatgtcaccaaagcgactaagaaagtggagaaaaagaagaaatgaagaaaattgaggaagagaaatttaattgatttaaattggataattttaaatattgtgattaattttattatttaattggtgatctttgaaattgtgattttgtccctccattgaacattttgtacatttttagcattagtcactctttttgttgttgatcgctctgtccaaaattgctccacctacgctttttctttctatttaaacacgcacatttctcactcctcacatcttatccagacatcttattcatcttatcttatttatattttaaattaaataaa

SEQ ID NO: 81902 - DNA, 372 bp, Heterodera glycines
  Genomic contig location: Contig_ID=SeqID_17421; Location=271..642; Strand=+
  SCN-specific regions: Sequence locations=1-372
atgacgacagaatgggctactgtaacagtagcaaaggtcggcctaaacgttcttggcttccgctaccagagcaacagcatgaaaatcacaaaaaatttggctcatcggttggtgaaaatttcaaacaaaaaatgtggtgacaaaaactcaaacaaaaaaaaacgacaaaatttttcaaaaatctggcaaaaagccggcaactttttaaaaaaaaacaaaaaatcattaaaacagtaaaattttcgaaatttttcaaattttatgctaaattttaaggagatcaagtgcaaaatagtaaacttggcaaaacccggcatggcctcaaatgacggtttttccaggcaaaatcgcatcccctgagaaaaatattta

SEQ ID NO: 81903 - DNA, 667 bp, Heterodera glycines
  Genomic contig location: Contig_ID=SeqID_17421; Location=874..1540; Strand=+
  SCN-specific regions: Sequence locations=1-124,156-156,178-189,211 -318,340-667
atggtcaaacattggtcatgcccatacgaaatttggtgtgacaaatttttacgggagcacaactgtcggcgggaagagctgtgcaaagaggtgggatgcccagaggggatgacgacaaaatcgaaaatttgtatttttaaaaatttcttgaattttaaaccctaagtcccgggctgagtatttttagtcacaaaatgaaaatcttgcttataagaaacaattttcatcagtaaaaattagaagcctccataaaaccaaatttcatggtttctcaccaaaaataaataaaatattgccaaaatgaaaaatctaaaatttttgttactttaaaagcatttactctcctatagctgggtctaacccagaaaatagacaaattttcaataaatttaaattttcttgtccgggaattattggttcgcctcactccgaggctgggacctgtctgagaaaattgacaaattttcaataaatttaaattttcaggtgtttctgtccgccctgccccattttggcgtgttttttgttgtttccgcttacatttttcttggctctttggcgttccgtcaacttgacactcaaatggccaagcttccattccacgatgtgctgctgttcgcattcaccacaatcacaacaattggtgggtgaaaaataatgaaattaa

SEQ ID NO: 81904 - DNA, 399 bp, Heterodera glycines
  Genomic contig location: Contig_ID=SeqID_17421; Location=2075..2473; Strand=-
  SCN-specific regions: Sequence locations=1-318,340-399
gaaagattggcattttttgtatccaaaaatggaaaattagtccacccaacagggaatggaacagtatcagcaacacaaccactttcaacggcaaacgacatggaccgtccggatggagctggtcatcggcaccagcattctcctgaacagtattggtaaattctgtcatgtgaataactcgttaatattgggaaaatatgacaaaatgccaaaaattggacaatgttcaaatgggtagggacaaatgatcaactcgggcagtggagaagagggatttggggacaaatgattaacagataggactttttgagagccgagaaatggattttcttatgaaagtgtttgtttgacacgcattttttaaagttttcattcgcaaaaattctgcctaaaaataaa

SEQ ID NO: 81905 - DNA, 842 bp, Heterodera glycines
  Genomic contig location: Contig_ID=SeqID_17424; Location=296..1137; Strand=+
  SCN-specific regions: Sequence locations=1-4,234-244,387-425,447-842
  Gene Ontology: Mol. function=RNA helicase activity; Cellular component=cytoplasm; Biological process=post-embryonic development
ttagaggatggggaggaggagaaattgaagttagaggatggggaggaggagaaattgaagttaaaggatggggaggaggagaaattgaagttagaggatggggaggaggagaaattgaagttagaggatggggaggaggagaaattgaagttagaggatggggaggaggagaaattgaagttagaggatggggaggaggagaaattgaagttagaggatggggaggaggagaaattgaagttaaaggatggggaggaggagaaattgaagttagaggatggggaggaggagaaattgaagttaaaggatggggaggaggagaaattgaagttagaggatggggaggaggagaaattgaagttagaggatggggaggatgaggaggaaaaatgaaaatgagaatggtcacattcaattaaattccaaaatttattcattaactcattcatttgtcttatcatagtttcaattttggagaacaacacttcgtttgcttctccactccctgcaaacaaaaacattcaatcacttactccatactccaattaacatttaatcattagagtgctcatttttaagcacaaaaaatcaccgattaagcactgttaaaagcagcaccaaatttcccaaaataagcatgaaaaaagcacaaaaaagccaaaatcagcacaaaaaaagggaaaaaagcacaaaaactaagagattaaaggcacaaaaaattgaaaaaggtattaaaaaaacatttaggtatttgctcccttattataaaaaaccctaaaaataggtgctaaaaacgatgatgataacataattttaaaaatcaaaaaattcttgtcaagaaa

SEQ ID NO: 81906 - DNA, 676 bp, Heterodera glycines
  Genomic contig location: Contig_ID=SeqID_17424; Location=1..676; Strand=-
  SCN-specific regions: Sequence locations=499-676
  Gene Ontology: Mol. function=transcription factor activity; Cellular component=nucleus; Biological process=signal transduction
ctcatcctccccatcctctaacttcaatttctcctcctccccatcctctaacttcaatttctcctcctccccatcctttaacttcaatttctcctcctccccatcctctaacttcaatttctcctcctccccatcctttaacttcaatttctcctcctccccatcctctaacttcaatttctcctcctccccatcctctaacttcaatttctcctcctccccatcctctaacttcaatttctcctcctccccatcctctaacttcaatttctcctcctccccatcctctaacttcaatttctcctcctccccatcctttaacttcaatttctcctcctccccatcctctaacttcaatttctcctcctccccatcctctaactgtcaattgctcctcctccccatcctctaacttcgttttctcctcctccccagcctctaagttcagtttctgctcctccgcatccgttgacttcagtttctgctcctccccatcctttagggtcaatgtctcctcctccccatcctgtaacttcaagttctccgcctccccatccgctaacttcggtttctcctcctccccatccgctaactgcaagttctcgtcctccgcatccgttaactgcgatttctcctcctccccatgcgctagcttcgatttctcctcctccccatc

SEQ ID NO: 81907 - DNA, 573 bp, Heterodera glycines
  Genomic contig location: Contig_ID=SeqID_2845; Location=1536..2108; Strand=+
  SCN-specific regions: Sequence locations=1-79,102-230,253-299,321-573
atggcaaaaaatgtacgaaaacacacaaatttgagatttgcacaaaataatcgacaaaaattgcgggtaagactatggatggtggtgggcccccttttttcgaatcccgaattcgaacaaaaagttcaaaattaaattttttgtaagtcatgaaaatacattttcaaaggttttcggggacgctgatcacgagtccgtcatccatttcggccaaatccgcggattcaaacaaaaatttaaattttaaaaattcacatttgtaaattgttgagcttttaactatgttttcagcgcttaatatacctaaatggctgtattggaagagtttcaaaattttacattgaaaaaattgcatgaaaaactggctttgaatgacaatgattttgtcgaatggcttgagcatttgggactcgtgcattcgcgtcgctcatgtccttgatgtggtggaaatacttcgattgtagcagttggtggaaattggcgttgcactacaaagaattgtcgggcaaaaacagggttcttggttcgtagtgcgacttttgcggaccactatttctcgatagaactgtctaa

SEQ ID NO: 81908 - DNA, 559 bp, Heterodera glycines
  Genomic contig location: Contig_ID=SeqID_2846; Location=5226..5784; Strand=+
  SCN-specific regions: Sequence locations=1-62,84-559
atgccaactgtacgcgaaatacttgagagtctgcaaaagcgagtaaaaagaccccgcattgctacaaatgaagacagcgtactgaatgttgagaggacagacgcagaacaacaaattgaaggcacttcacccaggaacaatttggacgtcgcttcgagtgatgacgaagaaaattgtgagcccgttcaattcaaacgtggagaaacaatccggggagctctttgtctttggtatcaaggtgttaatagttttttttttttgatttttggacgagcagaacgtctccagaaaagcacaaaacgacgacaacggtacatcatcaaagaacaaaatgtggtgcgtatccttgacgaggctgactttgaatcgcaagaaggattgacaaacgccttgaatctgatcggacttgtaatgcaaggctttgttgagggacttcacatccgtggaaatgaagacagtgaggaagaaactgatgatacggatggaaattgaatttatgattttaacaatttttacttttatgatttttaacattttacttttttttctttggagttta

SEQ ID NO: 81909 - DNA, 1027 bp, Heterodera glycines
  Genomic contig location: Contig_ID=SeqID_2846; Location=1255..2281; Strand=-
  SCN-specific regions: Sequence locations=1-337,359-1027
  Gene Ontology: Mol. function=transposase activity; Biological process= DNA transposition
gccgctgacaaggaaaatatccataccctcttacacattcaattccaacttggccacaaagtggcccaagcagctcgacatatcaatgaggctgttggagctaatgtttgcaaagaacgaacggctcgacattggttccagcaatttcgcgagggccgcaccagctcaaaaacgcaagggagggtcggggcggccgctgatggttgacaagaacgttttggcacagcggttgcgacgacagccggacagttcaagtgcagaattgtcggcgcgacattgccacaaaacaacagcatggcgatggcttcgaaagtccggtcgtcggccgaggaggaccaaatgggtggcacaccatctgacggatcaacagaagcagcgacggctggacctgtatctttcgaacatcgccagacaccgaaggggtcatgtgctcaaccggattgtcacttgtgatgaaagctaactacatatgttatgacggcacaacgcagaaaattgtttggcggaagaagaatgaagacccgattttggtcctccgtcccaacatccatcaaaaaaagcgaatgttgtgtattttttggttcgtgcatggcccactgtattgggaactgctgcctcccgggaccattttggagagtacctctatattaaccaactgcgggcggttgtatcgcataccgcatccagaggcagcagggccaatttgatggacccatggtcttccgccaagacaatgcccctccacactgctcacgtttgaccacccagtacatcactaacacattgaattggaaagtgctaccccagccgccttatagcccagaccttgctccctcggattaccaccttttcctttctctcaaaaatttcttacgggacaagcgcttcactgaagatgccgaggtcgaggaggcggtggggcagtacctcacctcaaagatcggcacagactttttccgtagggggattcgcaaacttccttcccgttggagaaatgttaagggttcggggaaactattttgttgag

SEQ ID NO: 81910 - DNA, 778 bp, Heterodera glycines
  Genomic contig location: Contig_ID=SeqID_2846; Location=4041..4818; Strand=-
  SCN-specific regions: Sequence locations=1-305,329-501,523-778
atgtcggtacaccatcactccgtcatcgcttttcttcgttcaaatcaccaaattttcgacaaaagaggcaccaatttatatttgtggattccatcaccacactctacgaatggccaaccaatttgggatgttttggcccgtgaaatttggccaattttttcggcaaacattcgctgtttgggcttttcccgtggtgatcatttggacaatttgcgtcgtcgcacttcgccaacaattctcactgatctcaaccaattgacttcaatcgattcatatggtctgtcgcccgctgcgtttggtgatgattttgatgggccaaatgcaacaatttctgctggccaagcattgtccaaatggttgcactctccgagaaaagatggacaacccaagcgattgcgttgcgaagattacaacgaacaagggaacaccaattggatcgacagtttcaaggaggtgtggcccaacatttttgtgatttttgttttatcaaattgtttagcattttcttcgtgccaatgccatttcttccgtcagttaccaaattcatttttcttttcgcgtgccgtcaatgccaatggtgccgtttgaattggtgaacgaatggacaaaggaaaagctgacattgaccaaagaaaacgaaaatgacttggagaattggataatgaagcgatgcaaaattggagaggccgcggatgttcagcttcagaaagatgaaaattggggcaacaattttaacaatgtggccatttggcttttcagtactgattgcattgggtga

SEQ ID NO: 81911 - DNA, 546 bp, Heterodera glycines
  Genomic contig location: Contig_ID=SeqID_2847; Location=762..1307; Strand=+
  SCN-specific regions: Sequence locations=1-99,121-285,345-546
gtataaaaacccgggattgacaattgattggactcataaaggtcgattggactcataaactgcactagagcaaaatccgttccctaatcatgacacataaacaaaaagatacaaaaacattcatcaatcccttttcatgtctataaaaatgtttgttttttcactttgtctcgcatttgaaaaaaaaataaaaatttctaacgcaattaattattctgctctttgttgtgtgatatcattcggaactcggccaaaattgtgctaattgccacaaaaatgaaccgacggtaagcaatttgaaaagtcacacaaattcatcatttatttagctaaactgttttccataatttcagttggatttgcaacgacgtttggatggacattttcccatcctttgaccatgctcaactcggcctcaaattggcacttctttcgccacgtttcaatgcgttggtggacaaacatttcgatggcaaaagcgaattgacaatttggagaccaatcgaaattcgtcgcaaggacaaaggaccagaaccgaaactatct

SEQ ID NO: 81912 - DNA, 633 bp, Heterodera glycines
  Genomic contig location: Contig_ID=SeqID_17425; Location=1609..2241; Strand=+
  SCN-specific regions: Sequence locations=1-95,166-179,205-216,238 -278,315-339,361-394,419-466,488-579,616-633
atgattgttggaaagacacgaaagaaaaattctaattggcatggtaaaaacgaataaaataaatattaaagctaaacttgtttaagctaattagcaaaaaaaaaatattagaaacttataaaaaaataaagtttaatgaattttttttctattaataaatataatcatgcaatagcttctttatatttaaataaaataaaaattggatcgatcgagaatcaaattataaaataatagtcaaaagtttaaaatggtataatgttgagggatatacaaactaaatatatttagatttaaaaaataacaattttaaagataaaacggaagtctttcaagaattttttaagcggataattaattgttttagtataataatagaatacatttttgatcgaataaatgtaaaaatatttgtagcaattttgcaaaatgttcttatttttgaccctaaaatcttattttttggcctttattcttattttgaaaattttgaaatagaaaccctggatttagataaaaacacccataaaaattgactattctgacataatttataatccttaaatttggtcatttttagacaatatctatgaaattataccaaaaaagaattgaatcgaggcgatacatcga

SEQ ID NO: 81913 - DNA, 334 bp, Heterodera glycines
  Genomic contig location: Contig_ID=SeqID_17426; Location=293..626; Strand=+
  SCN-specific regions: Sequence locations=1-78,100-150,172-213,239 -301,332-334
atggcttggacacccgacggccgtgtgttggccgtttcctcgatggaagggttcaactcgttcatcacagtcgattcgtccaaatttggcaccacaattgaactacagaatgcggtaacacctttcggagacgaagtagcaatgtcccctctaaacaaagcaaagaaaaacattcgtaagcgatgccctgaaaaatagtgataaaaaagcttaatttctttcctttatttattattatattgtccagataaaatgttttatcttgcaaagaaaccggacacattctgagtttttaacacagtatttatttatgattttaaaattatatttacta

SEQ ID NO: 81914 - DNA, 1370 bp, Heterodera glycines
  Genomic contig location: Contig_ID=SeqID_17427; Location=794..2163; Strand=+
  SCN-specific regions: Sequence locations=1-151,195-325,347-430,452 -924,947-1370
  Gene Ontology: Mol. function=ethanolamine kinase activity; Cellular component=cytoplasm; Biological process=phosphatidylethanolamine biosynthesis
atggcacgaatgcacaaaattccgctggaccctgactcggcaaatgtgccaatgtttgttgctaaatgcgagcaatggttggccaatttgccaacacactttgaacaggtcgaaatgcagcaaaacttcgatcaaaattttaatggtaaagaatttaaaaaataaaaaattctttttttaaattaaatttttaaggctcttctttgtctgagcagttaactgagctaattaaagcattggaaacttctgaatcaccgttggtggtgtttgcgcacaacgatttgctgctctttaacagtaagacaaaaacaaattctcatttatgttaatttaataatataattttggcacttaattttgctagaactatgattgatcaatttttgggctaatcaagacataaaaaatgtgtgattggctttttgggaacagttgatcacaagctcaattaggtgattacggtctgatcaaagggacaattcaaattttgaaatattatttttctattattttttggtgatcaattgggcaatccttggattatcaatttgattagattactcctaataaataacaaatggacagtttattatggcgatcaaggacaattttgatcagtagacttcttgagctgtcaaagattcgaatttttcatgcttcgagaacgggactgaaatttgatcacaaatgagttatataaatctcgacccattaattaatctactaattgccaaaaaagctaacaataaggatcgatttcccgagttttagagataaaaacaaattaattaattgcctaatttagtcctttttgacgaggaaggcactggcgatgtccatttcattgactacgaatatgcgggccaaaactaccaactgttcgacattgcaaatcacttttgcgagtacgcaggttgtgcacacagaatcggttgcacttcatttatgactacgtattggttttcaggtgttgatgagtgtcccgattatggaatgaattcggccagtgaagacgaacgtcggcactttctgcgccgttatttcgtctattttggccaaccaattgaggaagagtgtgaaatggacaaaatgttgtgcaaaattcggcactttgaagcggtacattcataatcacaataaaatagtgttaacttttcatttacaggcagcccatttttctggactctgtgggccatccatcaggcagcaaaatccgcgattcaatttgattacatgcgttacgcgatcacccgccatcgttactgcactcggcttatgacctcatcaggcattgctaaaaataattagccacaaaagcacaacattattgatttttggttttcgttatctgtactttatcaactctctta

SEQ ID NO: 81915 - DNA, 132 bp, Heterodera glycines
  Genomic contig location: Contig_ID=SeqID_17428; Location=653..784; Strand=+
  SCN-specific regions: Sequence locations=1-41,63-132
tcgcaggaaggcgtccttcagcagcagggaacagctcaaaatgggaataaagaggaggaagccaagagacaagcggaacggcaggaaatggcaaagaactccattttgacacaggcaaaggctgagaattaa

SEQ ID NO: 81916 - DNA, 1952 bp, Heterodera glycines
  misc_feature (36)..(36): n is a, c, g, or t
  Genomic contig location: Contig_ID=SeqID_17433; Location=62..2013; Strand=+
  SCN-specific regions: Sequence locations=1-105,428-837,859-915,948 -1358,1393-1420,1442-1450,1473-1673,1709-1754,1782-1952
atgcgctgcgtgcggcgtccggtgacccgacgcganctggatgacagtcgcaagcagttcaaggagctcaccgaacacattttggtcagttttatcacttcacggtttttaaattattttttggctttttaaaaaatttaaattgttaaaataattttgatttaatatttatttatttattttattttttatttaatatttttaaatatgcaaaattttatttacatatttttttaaataaaatatttattttagatatttcatttaaaacatataacctaacttatttattttatattttgtttctatttttaatttataggccttataaatttttattttaaaaaatatttaaaatacatttttttaaattatgaataataatttaagagttttttcgcctaaataatttattttttatattattgttcattattggcacgaattgcttaaataattaatgttaaaatttaagtcaaagcgaggcgaactgagtgccatcgctcagctggcgcagcgcattgaaggcgagatcagcgcttatttggcggagctcagtcggcgcaatgagtcaccggcgccgggattgcaacggcatcactgtgtggaggcggcgcagcgggcacaggacgattatgaggtaaatttaaaagaaaaaacactaaattctttttcaaaaaataaaaatcttgttttcataaaggatctttgctgaaacgaaacttgcaattttgttagattagtatgaaaaattctctatgttttcaaagacctaaaaaattttgtctaaaattaaggcatagcaaatttaagccgaaataagcaattttaggagtcttaatcaaaatttaaaaaattatcttaagtttgagtcttacgattccggaaaatgaaaattgttgaaattttcaaatatttccagtttaaatgtttacaaattaaggcacttttgggcgccaaacaggagctgtctcaactgttgcgccgagtggcgaactgttcaatgcaatatgagcaaaaggtggaggaagtgaacggatggatggccgaactggagcgagcaatttcgcatgccaatgtcggcacatcgggcgcaacaggtggaaacttggaaaaaaattttgcattttattttaaaacgaaattttaaattcagttttcaatcatattttgatcagttatgtgaatattttcaactttttgttcggctaactttttgggctttgtcattttttggctaatcgcaattctttcaaattctcattaggtagggtcgcgatttttaggttttaactaaattttttgctcaattgatttgaaaatgaaaaatttttctcaaaaatgtattttttggcaagaattttttaaaattatttttttagttattattttggttttttgctcttaaaaatcccagtcctactcatttgcaactgcaaatagtgaataaaaattatttttgctcaatttttggctgaaaattatgtcactatttgtcactaattcgtactttttgccactattatgtcactattttggcatttttactcactattttagttaactattttgggatttttcgtcactaaaagtcgcgaccctactcattagtctaaatttagcggttatgtttaattttgtaataaggttaattttctttttattttctgaccaatttttgataaatttttatttaaaatttatttttggccaatataattgaaaactttggcccaattcaaatatttccaatttcattttttgctcactttttctatacataaaatgattgctaaatttattattttggcatttaagccgatcgtcttgacctgttgagccgtctgaaccaaaaagcggttgaagggcagccgagaattgaagcggtcgaagccactgggcaacagttggacgaagcgacggcacagaccgatgcccatcagcgattacag

SEQ ID NO: 81917 - DNA, 540 bp, Heterodera glycines
  Genomic contig location: Contig_ID=SeqID_17435; Location=285..824; Strand=-
  SCN-specific regions: Sequence locations=1-166,239-362,415-497,519-519
atgattcattttaaatttccccgtaaattaagtttcaaaactgaaaaaattgacaaagtttttgcttcaccgttcaaacgaactgttcatacagccagtttattacttgatggtaacccaaaccatcacaacacttacataaacgttgagccgggatttggcgaggtatttaaaataaaaattgtttttttaaatactattataaaataatatttaaatattattttaaattaatttacagttttataaactctgttctgccaaacttggcttcatggacacagcgaaattaaaagaatattttccactaattgaccttaattatttgcctgtttacaacaaaaggtgggttaatgaagtgcaaaataatacaattaataatattaataattgacaatattacaaatattatttcgatcgtgggtccaaaatttatatctgttttgaaaggagcattagttttggcgttttgaaacagtacattcaatggtgatgacagcatttttattcaaaaacaccaaaattaaaatttttaataaa

SEQ ID NO: 81918 - DNA, 623 bp, Heterodera glycines
  Genomic contig location: Contig_ID=SeqID_17435; Location=2092..2714; Strand=-
  SCN-specific regions: Sequence locations=1-43,130-270,292-589,613-623
gccaatttgaattttttctgaaatttcctagtgaaaaatatggaaaattataaaaaatcaaaatttttaatttatttaaataaaaaaaaatagttttttaaacatatctttttaataatattattatttgctataaaaaagcattaaattcaaaaattttcctcgatttttaatgtcaatttaaatatatccaattttaagaatttttggtccgatttcacttattcaaatttagcataaaaaaatcagctcatacaaagcctatcaaccgaaaatgaaaatgagtgcaatttcacaaattcaccaagcacaaaatgtcataattgcacgttattttctggccaaatttctctccaccgaagcggagcattggcacaatattagcaaagtccattaattgcttttgcatggtgccgctaggcgccgtcgaatttttctttttgaaaatgtagtcgaaatttatgttgctaagtggtttcgtaaaaaatcactaattagggtgtttaccaaataattaccataacttttgctcaaaattaacaaaatttaatccttttgataccgtttgacagctgataatgcctgctaaaaattttcaacaactatacaaatttttgtatttg

SEQ ID NO: 81919 - DNA, 315 bp, Heterodera glycines
  Genomic contig location: Contig_ID=SeqID_17435; Location=1586..1900; Strand=-
  SCN-specific regions: Sequence locations=1-85,160-292
atgggaatttatgatgctgtgctgaagaatatccgatatcagctgaaggaaaaggaggaattctgcgacaaatgcaccgaaactgtaaaattaattaaatttaaattagtaaacatttaaaattcaaattttttgaattaatttatatattttttttaaggattacggtatatcgtacaaatatgaggattttttgcaatcattggacttaattgaacatgagttgcgcaacattcaaattacaatgacagatgaagacacaaataatgtgcagcaatattggacaataggcaaattaaaataataaaaaataaa

SEQ ID NO: 81920 - DNA, 1144 bp, Heterodera glycines
  Genomic contig location: Contig_ID=SeqID_17436; Location=45..1188; Strand=-
  SCN-specific regions: Sequence locations=1-78,100-123,145-1144
  Gene Ontology: Mol. function=damaged DNA binding; Cellular component =nucleus; Biological process=DNA damage response, signal transduction resulting in induction of apoptosis
atggatgtccatgacgaggaagttgaaattattgggactaggtcaaatgagaggcaaatggaccgggctcatcgacaagaacaacagcaggaaaaattttactcccaacaacaaatgtctgaggaaagtgaagaagcattgttttgcatttctaagcatgacgttaaagaaataagccaagtggtcaaagcaatggcattccgagacgtgagaagcaatggcaaaaccatggcagaaaacattccgttttagcattgcacattaaatgtaagcaatgagggcattcgcttggcagtggacgaccaacacaatcagcaaggcagtgcctacttcagatccgagcacttccaagacttcaactttcgtacccaaacatgcagcattaaaataccgatgaggcctcttatggtaaatttatcaaaaaatgtacacttttggattcttggccaaattttgaacattaataggaagcactgaatatgttttccggtacgatgacaatggtgcaaatttcgtggaatggcgaaggctttccattgctcgtcattttggaagacgaaggcaggtgcttacaattagcaatcatcctcttccattttgtcttttaaggagttgttgtccacaccgaaattcgaactttgatagcgcccgaggtgtaaaaaatattttccatttagtatgagtattctgccgcttcagattctcgaattcgatttcgacaatgaaaatgtgacggccaaggcaattctgaactctctaccaattcgggagattatgcgcgacttggacgactccgccgaaacggtggtgctcactttcactcccggttatctgcaattttatgtggccggcggaatgggacgaatgaaggcactctcttcgagttttgaaatgcattatcacaaaaataggcatgaagcatttaatcatcaaatttcatcagacccattttctttattgataatatttttaggtggaattacccacaaattgtgaccaattggagcttttgaatgtgaccactgatcgcgttcaacaccggtatcgaatgagcctatttaaacggctcaaagacagcattcgcttgtgcaacaaactttcatttcgcatcgacaagaatgggattctcagttcacagatgatg

SEQ ID NO: 81921 - DNA, 46 bp, Heterodera glycines
  Genomic contig location: Contig_ID=SeqID_17436; Location=1570..1615; Strand=+
  SCN-specific regions: Sequence locations=1-46
atgtggtcatacgtatcattaccaatgcatcgacaaatggattgcg

SEQ ID NO: 81922 - DNA, 426 bp, Heterodera glycines
  Genomic contig location: Contig_ID=SeqID_17437; Location=718..1143; Strand=-
  SCN-specific regions: Sequence locations=1-109,131-426
ttggcgtgaccaactcgtccagtatttcccacataagtatcaggaccttcgctatctcaacgagtattgtaagttctcattacaattaaaaaaatactacaaaggctataaatatttcttccattggcagatgacccatggggcattggtgttaatgacaccaattggcgcgagcgtttcaaggacttccaggtttgctttttcaaacgaatcatcatatatcatgatcattttttgattagtaaaaaaaattgttcagagtcgtcctcgagagggtgcaacgcttcactgatcgcatgattttacaatttaggaaattcaacgtgattttatttggaagaagttattcaatagagatgttattaaatggacattctcttttgcacaaattggtttagatgataaaaatttgttgctctcaaaata

SEQ ID NO: 81923 - DNA, 724 bp, Heterodera glycines
  Genomic contig location: Contig_ID=SeqID_17438; Location=366..1089; Strand=+
  SCN-specific regions: Sequence locations=1-10,45-724
atgccgtcgcgaaatttgtcagcaaagaaaaaacaacagaattcgttagttcgggatgagtcgacctcttcacccagcagaacgcccaaatcggtgtcgaaagcgagtaacagcaacagtagccaacagaaacttcagaagaagcataattcatcagaactgtccacgattagcagtgaaagtgtcgagtacgacttcttttgttttttgagaaaatacagctaatgtttagaaaggatctcagctcttcaatgtctaccaatccgcacggacatccgacggacaaaaaatggaccattggggagaaagtgttatgccgttatctgaactcggagcacatttattatgaggctaaagtgatgtttctgaaagacttgtctggcggagatgtcggctatggcattcattatccggtcattttaatttaatccattttatcgcattgaagattttagggttggagcaaccgtcacgacgaagttgtaccacaacatgaagcactaattcgcttcaagaattactccgatgaagaggcaaccaaggcaaaggttatttttcgagtattttacgatgagtgttaagaaaaacaaattttaggaagacgtgaaaagggctcagcagatgctaaatgccaaaaaaagaaagcaatcggaactgaagaaccgctcgcaagcgcatgatgaaagtagtcgctccagcacaccaggaagcgccgacaacgcat

SEQ ID NO: 81924 - DNA, 863 bp, Heterodera glycines
  Genomic contig location: Contig_ID=SeqID_17439; Location=77..939; Strand=+
  SCN-specific regions: Sequence locations=1-102,124-208,252-717,740-863
atgccttccacacggaacacccatttcgcctcatttgtcgggtccgaaggatgtggaaaacgtttccacattggttttttctgtaaacaaaaaagcagttagtctaattaaaaattacaaaattgaaaaaaacatatttgatgcctcattttctccaaccaaattttggtgcgcttcatttcgattaagtttctcgtccaaaatttgtgtcaatacattaaaaacaaaagttattaatataaaaaagataatactcaaaatcagagcccatgttttaaaaaaaaaccggttatcggattcgtgaaatccaatgaccatcctcaggttcttaagtcatgtctcttttttggctctattgcagttcacacgaccacaaaataaattggcaactttaatacaacataatttttgctaggagcacccaaattaaatattcttggtatcattcgatagcattaagagtcctctattaatatgtgaaattgcaaaaaatttcgttttgttgcaaaaaagttatgatcaaaaatgtttagaaaaccaattttttgaagtcttcggccattactttcttgaaacacaacgaagttcttttaaattattacagaccaatatagaacttttagggctatcgaatgataccaagaaagtttaatttgggtgtttttagaaaaagttatgatgaattaaagtaaactgaactataggtcgcccttgggctctgaacaaaatccatgtaattttcggggactttaaacagcaaaagtggccaaaaataccaaaaagtgtgaagatgaaataattttggttctccgacatcccaaaagccccggcgaattccatcaacattcggcgacagccaaaaa

SEQ ID NO: 81925 - DNA, 2994 bp, Heterodera glycines
  Genomic contig location: Contig_ID=SeqID_2848; Location=296..3289; Strand=-
  SCN-specific regions: Sequence locations=1-425,450-841,863-1463,1505 -1639,1661-2382,2410-2994
  Gene Ontology: Mol. function=chromatin binding; Cellular component =dosage compensation complex (sensu Drosophila); Biological process =dosage compensation, by hyperactivation of X chromosome
atgagtgacatcaaacagtctttatacgcagtgttgggaaaacgcaaattgggaactcctaattacaacatcaagcctgaaaatcgaggtggtaagccacgcttcatctgccaactgacagtcgccggactaaattatggttgagtttaaaagataaaatcgtctttattcttttttttaagttggattgggaaattccacttctaaaaaagatgcgcagtctaacgcaggtccgaggaagtcaaattatttaatcataaattcttttagcaagggactttagccaatttcttgtgcgtgagggtttaattaatgcgtcggaagtaccacaactgcagcttctggtgcttttattcagttttctttccaaaaacaagcattatatttctgtttaggaatctgcatcgaatattgataatgctcctcaaaatggaaatgattctgtttccgctgatgcaattggtcaaccttatcatcagcaacaaaatgccgcccaaatggattttacggatgacaattttgaaacaaatattgttcctttaccgccgcaatgggcaccttatgaaaagacagcgcatgaccaatatgttgaacagaaggcggaagaaatcattcaggtacaaaaaactaaaaattgaaaatattatggaatttagtctgaatccgttgacatgacgtccgatattcatggtataagtttttgttttttttttcttttttaaaatacacttaaaggtggatggacaatggagaactgcaaacaagcactaaacgaattttgccagaaaaatcgcattccaaccaacgaatatcgcactgttgctacaggttctgatcacaacaggtttgggtttttgttgttatcatgcactttatataaagtttagaacatttgtgtccgaacatggaatatttataccgtcgcttaacaaaagtaacaattcaccaccgatttaataacagattattttagctgtcaatggtcgcggcgtcggttcgaacaaaaaagttgcagaaacgagctgtgcactttcaattgtccgtcagctttatcatatgggtaactggttaatcccccacaaatgtaatgcaataaactccggtttagggactttgcctggggccaccggttatcagctgtcgaagaagaaggcatctcccgaaaatgtaaggcttccagcgacttactacgagaattatgtggttcattccctgtttcagttgcccgagatcaaagtgagcgtcgacccttctctggtggagcgtatcgacgcacatttgacgcaaaatggcatagaatcagtcgacaatctcattgattttgcgtccgattcgaaaccaaaaacgctttttatggagaagaaagttgaagagtttccattttcggacaacgaagctctccccagccaaaacattgtgtgggctccgccccaggaaaattggaatgcgtggaagtaagtctcataataaagttaaaattataaaaaaatataaacattatttacagcgcttcaaatattgacaatcaaacattggcatttcgttccttggaatggataagcaacgatttgttaacgcgggaaaagatcaaaaagattcctgcccgtttgactgcttcacgtcaagccctccccgtttttcaggttttattcaatggaaactggaaattgtttgttttttattataccattagcatcgggatgaaatcatgcacaatgtgcagcaaaattccgtagtattggtcaaaggcgcaactggatgtggaaagtccacccaaatctgtcaatatttgttggaaagccatctcacccagggcaaaggtgcccatttcaattgcgttgtcacccaacccaggcgcatttcggccattactttggccgagagagtggccgaggagcgctgtgagtcggtcggcgagtccgtgggttattctgtgcgctttgaatggatgggtccgcgaccttatggggcaataatgtgagttacttaaacggcataaacgacccctttttctctactgtcaaggttcatgactgtcggagtgttaatgcgaaaaatggaacatggccttcgcggaatttcgcatctgatcattgacgagattcacgaaagggacatcaacaccgacttcatgttgatcgtcgttcgcgacatggtcaaggcaaatccgaagctcaaagtgctgctcatgtccgccacgatcgatgtgggattttcaatttatccaattatagtagattgtttatttagacaactttgttcacgaattatttcggcaattgtcccatcatcgaaatcactcaacgtgtacaccccgtccaatatttctttatggaggatgtaattcaaatgctcaagtacatgcctcccgtgccagaacctgaacggaaaaagaagaaaaaacggaaatcaaattcggactcaaaagcggctggtgccaccgcgaaaaatggcgaaaatactgaagaaatgaatgaaacggaagactcaatggaactttcggagaacttaatgagatgtggggatgggtacgggcctgaagtgaacaaagcactgcgaaggatggacgaaagggaaattccactggacattattgaagtgacttcacacgacaaatctgtagttaacaaattgggtcatttagctactgctcaatgacattgacgcgaatggtcgtcccggggcggttctgatctttttgccaggttcgttaaaaaacaactgctgctgccgtgttttatagaaaagcattttcatcgactaattgttaggttggaatttgatctctctgctgctgaatcgtctcaccatgcatcaccccgtcttctccaaccaacaacgctttctcgtgctcccacttcattctcaactgacagcccgggagcagcaccgcgtttttgagcatgtcccggacggagttcgaaaggtttttcagtgttttaaggttaaatttgcaaattttttacaaacggaggaccgggctgaattattaaa

SEQ ID NO: 81926 - DNA, 433 bp, Heterodera glycines
  Genomic contig location: Contig_ID=SeqID_2849; Location=275..707; Strand=-
  SCN-specific regions: Sequence locations=1-433
atggtttggtcaacatttaaacctatattgtcttttaaagcccccatcaaaaatggacagccgtttgattgtttggtgtgtcataaacagaatgccaaactcatgaagctcaaccgccatctgaatcctgagctgagtgcattgtttcgctcgcccaacgatttgatgcacgaattcggagtcaaactgaatcaggtcatcgcattccaacaggcgcatcagcagaaactcgaaggacatttgatgaatgaggtagatagaagaacccaattaaacatttacgattacattttgtttattgaatttaggcacaaagggccaacgaatggacgaagtcaatgcaaaagaaaatgcaaaaattgtcagtggatcgtgacaaaatgaaggccgatttggagaagagcaaggaggagatgaacaaaacggagggaat

SEQ ID NO: 81927 - DNA, 250 bp, Heterodera glycines
  Genomic contig location: Contig_ID=SeqID_2849; Location=2585..2834; Strand=+
  SCN-specific regions: Sequence locations=1-86,108-250
atgcagcaacaacaacaagtaagaggacgaggttttgttttgtggaatctgttgagtgcttcggcttgctctatttttctagtctgatcagcagccgatggctcagccgacgctcttcccaattggtgcgatgccttcaatgtcttcttcgtcgatttcctccacgaaacagccgagagatgtgagtggtattttctcaattgactcactcccattcgattgtcaaaatatgggcgtcggagggtggtga

SEQ ID NO: 81928 - DNA, 974 bp, Heterodera glycines
  Genomic contig location: Contig_ID=SeqID_17442; Location=81..1054; Strand=+
  SCN-specific regions: Sequence locations=1-25,47-60,178-249,271 -697,724-974
  Gene Ontology: Cellular component=synaptic vesicle; Biological process=synaptic vesicle priming
atgcactacacggagacattcagccggaacaacagcaacagcagcattgccgagctgaaccaacaacagcaacaacaacagcagcagcaacggttgcaattacagcagcaacaacaacagcagcaacgtgcgagaagtgcagcgcaacagcaacaacaactgcagctgcagcagcaggcaacagagtttgaagttggcattggactgaaccagcggcgcaagagcggcgtgtacatgctaggaagtgagttgtgctgctgtttcttatattgatataatattttggaccactgatcgtacccccccccaagacccctccatacctgaattttgaatggaaaaatcgtttttttgttgaaatttccgaatttcttattggcaccttctcgaaagttctcattcacccaaatttccataaaaattgataaattattttctaaaaaacttaattagctttaaaaaaacgccgcaaaaaatggcgtacattcaccttcaatatgctaatttgtcaataagcaaatcaatcacaaatcactaagatgatcatattgattattttttattgctttttaaatcgctattgatctgtagtgatcattgtttttcctctttgttcagacatgaacggcaaggagcatcaggacatcaaacccacactgaacggcggtgttttagttggtggtgctggttcagctgctggtggtagtggtggtggcggtggtgctgctattgcgggtactgcttgccctcttcccgttgctgctgctgcaccaaatgcggcggcactctccgcctcaaacaatgctaccgcgaccgttgccgcaaccagcacaccgatgtcgaccagtgtgatgatgaacttcatgaacaacatgttgacaacggccaagtccacattgcagggccaaggcgtatctgtgttctacgaccaaaacggacttccggtagaagaaaaaaatatatgttttttataa

SEQ ID NO: 81929 - DNA, 110 bp, Heterodera glycines
  Genomic contig location: Contig_ID=SeqID_17443; Location=979..1088; Strand=+
  SCN-specific regions: Sequence locations=1-110
gtcagtctgttcgatttgtttttcaatgccactgaaccgtgctcgttgtcagcacttcgaattggcacgacagattacgaaattgtgcgcgattcggcttggctggataa

SEQ ID NO: 81930 - DNA, 737 bp, Heterodera glycines
  Genomic contig location: Contig_ID=SeqID_17445; Location=685..1421; Strand=+
  SCN-specific regions: Sequence locations=1-182,204-737
atggctgaagacgacaaagttgaagcgctcttcagacgggcagaaaagtgtgtgttgtgttttacgaaaacaatggggacgaattcctccgacgagggcttttttaaatttttttgggccctaattagcaaaagtgccactaacccttccttaaatttaatggttttttaaaagcaccgaaatttttctaaacctaaattaatatccaaataaaacaaagtttaggaccctccatctaattagcctggatattgttgtgccatgcttaaattcttcgatttctacattaactaacccccccccattttttaaatatatttttaccatttctaaccaaacattgaaacccaaatgtattttagttctaccaaagagcaacggctggaggccattcgacagcgcaatttcatcgacgccaaatttgggtaccagccgtacactgagtcgacggcacgggatgcgtggctgatcaacgtccaacaggcactattactgattggaaaatgaaattttcaacaaatttaaatgccatggcatttttggaaaatccggtttaaacgcgacaaaaatttgccgattttacatcacatgacagaggcgacgaagaatttcacaatttttgaccatttttgtttgaatgcgggttccgtaatagtcaaaatgaatgtccctttttcaaattattagcaaaaaaaaaccctaacaaaaatttcatgacaaaaaaattccatttaaaa

SEQ ID NO: 81931 - DNA, 471 bp, Heterodera glycines
  Genomic contig location: Contig_ID=SeqID_17445; Location=1620..2090; Strand=-
  SCN-specific regions: Sequence locations=1-471
atgcaacaattaaactaccgtttgttgaacgcgtgcagaaccggaaatgttgaacaaggtacgtaagtgttaacagtaataatattcagcttccaagtgggtaataagggcacgaatgggcgtcgaccaaatgggcgccagctcggtttttggggtataactcctttcatagttgaccgaattgaatgcatttaatattattcaatagtcctaatgttctctatttgcctgcaaaatttcaaaaaaattcgttaactttcaagatagggccaaaaaacataaaaaaacagactttttcgtaatttttttattttaacatttatgaaagttaacaaaaatttttcgaaattttgcaagcaaatagagaacacttagggctatccaatgaaatcaaattcattcagttcggtcaacaatgaaagaagttctactgcaaaaaccgagctggcgccctttagtcgcccaatttaa

SEQ ID NO: 81932 - DNA, 502 bp, Heterodera glycines
  misc_feature (497)..(497): n is a, c, g, or t
  Genomic contig location: Contig_ID=SeqID_17448; Location=90..591; Strand=+
  SCN-specific regions: Sequence locations=1-325,350-467,497-502
atgtcggggttttatgaaagccgtcaattgcacctgaaattagagatcggaccggtcgattatttttttaattactcgccgtttgatatgagcaacaagttgatggtcctcttgacccaaattcttcatccaatgctcaacgttttttattcacctgctgcgccaagcgttggcgccttagctgggcgcctggcgtgcccttcagcggccgcagctcctccggcaaacagcaaatagcggcgcgccaaacgccaatcaccggtcggcgctcacacgtcacgctcggcgtgccgatgctggtcgtcaacatgcagagatatcagagaaaaaaaaattaaaaattattttagcaaaaattttttaggtgaatcttgcgacgaagacgacgagttataggttgataatgaagaaacggaggatgagcctaattgcttttgttgtaatctatcgaacaatttctgaaaaagatttattttgaattttattaatatttttancaaaa

SEQ ID NO: 81933 - DNA, 178 bp, Heterodera glycines
  Genomic contig location: Contig_ID=SeqID_17450; Location=732..909; Strand=+
  SCN-specific regions: Sequence locations=1-1,118-178
tgatgatgaggaagacggtgacgaatcggaagaggatgaggaggaaggaggtgacgaattggaagaggaggagcaggaaggaggtgacgaatcggaagaggatgaggaggaaggaggtgacaaatcggaagggtccgacatggacatcgatgaattgtccgagggaatggaaatgtaa

SEQ ID NO: 81934 - DNA, 1331 bp, Heterodera glycines
  Genomic contig location: Contig_ID=SeqID_17450; Location=1105..2435; Strand=-
  SCN-specific regions: Sequence locations=1-676,707-1270,1293-1331
atgccactccaatcagtggccttttatatgggcgaattgccaaaattgccgccagcctttgaaagtgccaatgataatggtaattataatgccaatgccaatgtgccgtggaacggaagcgaagctttgaccaaatggttgttctcctctcgtccggagaatgatttgccgcccaaagtgttgcgatgccgtgtctataactctgatattgagagttggattgcgagaattgaacaatacaaaacggtgatggtcaattttggttttaaatttgtgctgtttgtagtttaacatttctggggatgggtacggtagatccaaagactcaaaaacattttctagtaatggggatatggtagagttaggcggtacgatagatcggcaaaaaggttgttaccacattggcaccttttgaatatttaggcgagtgtacggtaggctcaaaaaatgtaccgtttgctaaccatcgattgattggcccctttgtttaggcatttgtgaatggcacttctcctcgtgccaatttcatcgtccttttcaaacgccggcctctcatttcttaccgcaatcgctcaatggcggacttcgctttgacaaatcatttaacggcggaacgactaagatttagaacattaaaaccagggtagccaactgaaaatttcaaaatcaacatttcaaaatttgaaaatttaaacaatttttggggccggcgatgccaagacgaaagtgcgggcgaattgaggggtgagggaagtcgagccccgccctctccccccccccattcattttgtaagagaaaatgacatagaaaaatcaacaaatcgccataaatttgaaaacttgggagttttgtgtagcaattttacataaaattggccattttgagatttacaaaaacaaaaaattaaatccagttttgacacttcaaaaagcaaaaaatttgataaatcagcagagttgttaaaaccccaaaagagtttcagtcaatttttgcttgtccgttctccaattgcgcgcgacgagaagaaatggatcaaatggatttcggcggcgattgaagggcaatatgttcttccacgaaatctaattaccatttgggaaaacgatgataacgccgaaaagggtcagtgaaattgtgggagtcgtaattgttcaaactgttcgagagtgagcgaaatttggcagagtttcgagaaccaacacctgttggaattgaccacctccaaaagcgagactctcgaacagccttttaactaattttgagaaaatatttttccttttcagctttcctttcgcaattcgctgctcaattggtcagcaaaaatgaatga

SEQ ID NO: 81935 - DNA, 522 bp, Heterodera glycines
  Genomic contig location: Contig_ID=SeqID_17451; Location=356..877; Strand=+
  SCN-specific regions: Sequence locations=1-522
cggcgatagtaccagatgggttggcaccgaaagcggtgaatgaacgaaggagcttttggggcctgaaaagcctatggcataagagggagtgccgagttagaaagtgatacgaaaagcattaaaaaatgagaaaagactttgagcaggaccatttgaggaaaaaaaagacgaagagtaagaccaagttacagtattctcatttaaaaattagagaagggagaaagcacagtatcccatccgatcagaatggggatgagagttacggtaggcatttaaaatatttctgcaatttacgacctgcttaacagcatctgctgccggccgcagaagcttgtaccgaagctgttgctgctcaaccggttccgcctcgtggatcagttcgagcgcgtggtgccgtcgttggtgctgtgccgcttccgcgtcggcgctgttccgcctgctgttttcgcacttctgcggaccctttggccgccgcgccccaccgtgcggacatttgcctaattgggccgggccccgtgggga

SEQ ID NO: 81936 - DNA, 943 bp, Heterodera glycines
  Genomic contig location: Contig_ID=SeqID_17452; Location=1..943; Strand=-
  SCN-specific regions: Sequence locations=1-179,240-268,290-426,448-943
aattgtattttgtataattaggtgaaatttcttacagtttattgcaactcttttatatataattttgtttctttttttcatgacaaatgattatttaaaatatggccactgtttttattgttctattttgctcgtcgtactttatcggcatttcatctcttgaaatgtttaatttacaattaattttattttttatttatttttatttaaatttacaattttattttatttttgttttttcgtgtttctccgctattattttcccccttttctgctcattgtcagatacattgctctgatgctcatttatttgggcgttggcctcgccgtcaccacaatgtgcattgatctcgtcggcatccaatacatccaaaagtgacaattctctcctcctcccaattttaatcactatgttttgcctgtctctctgatcagaatccattactttgggcgcaaattcaaaggcactgacattttgcaaattttgcgccgaaagcgaatgttggaacggcgatttgcgatgggcgagggcaaagagctgatcgaatatgtgatcaaacaggagagggagtgagttgggggggggggagggtcattaattgaacgaatgggcgggggaggagggcataaaatgcgatttttaggtaaattaacgatcaatttggcaattagcaaatttcacgaaaattgaatgagtcagcaggaccccgatcactgagggagtgatcttttctgagtgatcggagaggaaggatttctatttgaatctgtccaaatatattttctaaattgacgctctgccacagagcgttgttcccctcgcatcagccccgcgggttggcgcaacccgcgttccatttggccaaccaggcgcacgcgcgggagcaaacggagaatgagaaaatatcgctcagatcggagcagcaggaaatggtgccaacag

SEQ ID NO: 81937 - DNA, 1114 bp, Heterodera glycines
  Genomic contig location: Contig_ID=SeqID_17453; Location=576..1689; Strand=-
  SCN-specific regions: Sequence locations=1-194,216-373,396-660,706 -1092
atggaaccttttcaattctttggcagatcaaatggagaaagtgttgaagaaaggagaatattcggatgttcattttttggttgggaaggatgacaaaaaggaggcgagtcaaaaaaagcaaaaaccatatcttaatgcccaaggataaacaattacatttttagaacatatttttatggaaatcttgtaaattctcgaaaaattttctgcaaaatctataagcgaatgcatataaattttgaatatagtttaatgatcaatataagatcaaaatttcaatgttgataagaccaataaatatgcctcggtagctcaatggtcggatgcccacggattgggatttagggtgggttcgattcccacccgagtcctaacatattatcattatttatttgtaggaaaaattactttaattctctaaatttttccgtcagccttttaaattgaattttttgaccttttttaagattgtaacagctcatagagcaattctctccagtgcttccgatgtatttgaagcaatgttccattacgatgaaggtcaaattgaggtccccgacattgaaattggtgcgttcaaagtgatgctaacatttgcttacacgaagcgttttaacggattgaatgccaataatttgttggaagttttaaaagctggtgaaaatttattaattgaattttaaataaattggaattttaattatagcagacaaatataacatcactggcctggtaaaagaatgtgccaatgtttcaattcaaaagttgccaaatgtttttgtggcttttgaacaggctttgttgctgaagatggaggtgaagaaagaattttaattattaatctcattaacactaattaatgggacttgaaagtttggggtgagaaaacaaaaaaatgtgattaataataagagcccggacaggaaagaatcaagtacagagacccacagattcttatgaaaaatttgattcgaaaaatatacccctaaagaaagaaaaaatttttgaaaacatgccattaaaaccgaaaaaattggaaaaataccataattgtgaaaaacaaaaatttatgaccgaaattcgagtaaaaatatctaattttgcaaataataaa

SEQ ID NO: 81938 - DNA, 932 bp, Heterodera glycines
  Genomic contig location: Contig_ID=SeqID_17454; Location=31..962; Strand=-
  SCN-specific regions: Sequence locations=1-298,331-430,452-550,583 -644,668-754,793-932
atgcctggggacgtctcccaggcggggatcgattggccaagtctcttaggtggctcccgactgactcgactgatcccgttggctggctctccattgccttttaagcgcccttcggaatgggaggagtttatcggagtaataaatgggcgtgggaaaatgccatttccggtcaatgccttacacctccgaccctccaaaagaccgtcccttaatttcaagatttcacgaagtactcagacttttttttcattttattttgagaagactactttttttgagttgagcctaaacaaaagactatatttttttaaatttaattaattaaaataagaattggaaaatgttaggtctctggtgtaaacggctcattcctccaaccaatccgtggaacctctaacattgagattaccgaggcacaaccgcctatttttgtctaataaaacatttatttttcgtttgaccacgcccctttgaaattctgagtcgattggatttgaattaattgattattgattttagagatatgggcccaagaaagtttgcgatgaagttaaaaaaaatatataaattaaacaattatttgtttcgcttccaatcgatgaaattagatttttagtatatttcggggtgttgaatccaagttccagaccacagcaaatgaccaagcgtgaccgtatgattatacctccccttcatatcagcggatcgtccctgatccaaaaacttaaattccacgggattcatatattccttcatttatttaattaatttttttttaaattcataatttttgaacattcgcctttgagttatcaatttctccagtttttattattcattaattagctccgcagggcttagacagaagtatgtgagtaatatgttttgtttcaaaaaaaattgaaaagaattagcttttatatttaaataaa

SEQ ID NO: 81939 - DNA, 667 bp, Heterodera glycines
  Genomic contig location: Contig_ID=SeqID_17455; Location=913..1579; Strand=+
  SCN-specific regions: Sequence locations=1-170,192-312,345-407,429-667
atgcctccggcatcgttggccgatttggcgtccacggccagctcgctgctgtacgcgttgcagtcgtcccagtccagcgcggtgatggcggccaacacaattttggtaagaatggccgaataaattgcaatgatatggtggttccttaaccatggcttggcatatcgccattttgattaatgtttaatgattattgttgatgcttttagcaaaatttcgtcagcggtgtgcagccttcgctggtgtcggcgctgaacaacagctcccccgccctaaacgttcatcaccacaaagttgaacccgctgaacaccaatcacagcaacaacaacaacagcagcaccagtccgtttttgttacaactgccgctaccgtaccacccccggctacagtcaacaccgtgtcgccaacggtttccaccgcggtgccgcctttcccgatggccagcaagtcgctgtccccgtcctcctcttcgcgttccgtcacaccgacggtctcgggcccaacgagcgcgggaccgttgcatcaccaccatctgatgagcagcaacagatccgaaagctgtttggaacagtttgggcaacagcacagcaaacacttccaagcaatgcacggcggacaatcgcagggaaaaggggaaacgattggccaattggagagcaatatttg

SEQ ID NO: 81940 - DNA, 1212 bp, Heterodera glycines
  Genomic contig location: Contig_ID=SeqID_2851; Location=1..1212; Strand=-
  SCN-specific regions: Sequence locations=1-23,45-1038,1115-1212
  Gene Ontology: Mol. function=transmembrane receptor protein tyrosine phosphatase activity; Cellular component=integral to plasma membrane; Biological process=cell adhesion
ctcgtataccatccaacaactacacccccactccaaatatcgcatcggagtcgccgcccgcactcagttgggcgccggcgaacgcgtaacgcgggaggtccaggtaatcggggaacgcgtcaccagggaagttcaggtggggagcgaagggcatgggtggacgggtgatcagtgtccgatttgctcagactgatgagtcggcgccgaccgcgcctccggcaaatttccgcgtggacaatgtgggggaacaaaatgccgaactgagttggcacgcgccgccatgtgagaaaatggagaacggattggcttgaccagacttccctttaggcgttcacaccaacggagacattactgaatatgaagtctgtgctttttctctttccacttaccgtattccatttgctattacagtacgaaatagccgctgccgatcgtctttccgcccaaattccgcgtctgacggacgtgacacggaccactcgagtgcacttgaccggcctgctgccctccaccgcttattccgctcgtgtgcgcgcgttcaccgctcgcggggcggggccatggtcgcccgaagtgcgcttccaaacgcgacccgtcgcgctgtccgtcgtacaatacgacccgaaaccacgcgtttactcaacggggccacaggaggcgcaattggtgtggcagacggaccagcaaggggccaactacttcgacaagttcgcctgcaaatgggcacctgttggcactcagcaatatgtggtgagtgtcagaatatcaaagaagcgattactgtaacaaaatcaatgacaggaggaacgcgtgttccccgcgtacaatccatgcgacgtccaactcgtgcagcgctaccagttgcctcccagcaccacccaagtgcaaacgcactgtggacagatcactggactgtcacgggatccggccgtgttcgattttagcgtgagtgtactgctccaactcttcggtgtataaaattcctctgcttttcaggttagagccaagccgcgagaacagtcctggcagccgtggagtccgccccaacggccggtgcctccgccaccgccgcccgtccgtccgcgcccggcgccgccgccccctctgccctcgctaatcgtcgagtgcgagcggctgtcctcgttgcacaagacgggcggttcgcccatcaaagagcacttcacctggtcccttctgccacagtgacttgct

SEQ ID NO: 81941 - DNA, 700 bp, Heterodera glycines
  Genomic contig location: Contig_ID=SeqID_2852; Location=208..907; Strand=+
  SCN-specific regions: Sequence locations=1-211,233-496,520-665,687-700
atgatgaatcgtaaaaaaattgaaaatcttcaaaaatgtcgtaagcgcaagtttttggataacaatgacagtgaaaacgaaacgctatctgctgatcaccgtgagcaaaatgagaacaacaacgaccgcgacgatgattttgaagaccgcccctatggagatggagcagtttctcctctactttgcgaagacgtacatcggaatgacgcagcaacagctgcttgatggtgaaaatgcgtttggagttcgtcctggtggtctttctccattttcgtgtccgtttttttcattttgttttatttttattaatttgcttttaagcgtttgctgggacatcatttgcgtccgttggatctgaccatacgtactcacggcagcccttgcaatttggcatcgactcgcccgccccctcaacactatcatggccgtcaacagtggagcaaaattcgccgttggtgcagtactcattgagtccatcatcaacgacgacattgcagccaggcacagaaaaattcccaaaattgttgatttaaaaaattttaagcccgtccttgggaagaacccgtcgttcgtcgcgcactgttcccaattccatattggaacgtgcactcgcatgcggcttctgccctcgctcggaccaacaatggcctcgaagcaacccatcttcatttctctgtatttattacttataaaaccccaa

SEQ ID NO: 81942 - DNA, 1158 bp, Heterodera glycines
  Genomic contig location: Contig_ID=SeqID_2853; Location=1..1158; Strand=-
  SCN-specific regions: Sequence locations=1-739,768-818,840-1158
cgcaaatgcactctctcctctttctctccttctcttccgtctcctccccacctccactcccttccagctgccgttcgatttcgtcgttccatcatctgcgatccgcgcactgacttttggtgtcgtccggacactttcagcaccaacaaatccgaacaaaatggtcgaggtaaacactgtgtgtggcgtgccgtgatgtctgtcccctccctcccctccctccccgccccctatttactcaattaactcattctttctctacgctgattactctaatcatttttgttccctgccctttgatcgtttgcctttttctcttccgctctctcacttttcaccgtcttttgcttgctttcccttttccgctttttccctgctttccatctttctcatgccatctcccctttttagcactcatctccgcgccgactttctcccaaagttccgatggttccctacaggtcaaatggcgttcagaaggcagtggccgcggggtgttcggttaccgccttttgtaccgcgcccccggcgccggatggaacccttttgggtgaattttgtccacatttaagatcataatagggcgatgatttataactccgattttgcagtcaaattgtgccgtacgttggcgaaggggaggagaacagcgttttgctgagcggactttctgttggggtgccgtacgaagtgaaaattcaggcattggacaggaactcttacgtgctgtacacatcgccagaggtaaaaacaaaaacaaacaacttgccattggaaccagtagtgatctgataatttggcgcttcattcgtccttttctttcatttgccttgttgatcggcattttctccccccccccccaaaggtccgttcttcgcccacctgtctcgtccctctgctccctccgtccaatttggccattgacactcccgacccaggccatgtccgtgtcacttggatgccgcctccgcaaagcgcgtggcgatgtgctaatgccgaagtggaacttcaggcgagcacagaagtgagaaggtcaacaacagtgctccattcggcaggtggacgaacaaagtgggcgttctatcggtcagcgcgtgcgagtctcacgcggatcagccatgttttggagtcggaaacggaccacccgtgggcgatcag

SEQ ID NO: 81943 - DNA, 2033 bp, Heterodera glycines
  Genomic contig location: Contig_ID=SeqID_2854; Location=42..2074; Strand=-
  SCN-specific regions: Sequence locations=1-170,192-450,472-564,743 -970,992-1442,1489-2033
tgccggaagagtctggagaaatgcgcttggaatacgcgggaaataacgaaattcgaattgattggcctcatttggaggaccctttgctgcaacattacgaggtgaaaatgttggtgctgatgcgccattttaaacatttacaggtcgttttgtccgaaatggtgacggatgagcagcagaaaaagacagacgaagccgcgaaaggggcgggcgaaggggagagaatggagcgcagccgagtgggtcccaagcagcacaccgcttattttgccgaactgcgccccgacactcagtaccgagtcggcgtggtcgcatacgcgtgagtcacgggcaaatggccaaaaaataaatttaaaatggcaaaacagacaaaacaatgtgaaatgaatgactgatcaaatcacagggaccatgaaccgaaacgcatctaccacatgttaattcgaacgaacacagaaccaatgcaaaagctgtcgcaaaagccagtgattgtcgaaatgagagagggaaggcacgaggtgatcaggggaagagagtgggagaggaaatgagagacggtgaggaagagagagagagacagagaaagcgggggagagagagagagggggagaaagagagacatgacgatagaaagagcaagagtgatagtgagtgataaagaagaaaggaagaaagggtaaggggagagagagaaagaagagaaagagagggaggggggggggtagggagaaaggagagagagcgacagtggccaaaggtgatcaaccgtttggaagtgatcaaaaacgaacaattgaaggtacgaatggtcaaaaccaagtcgaatttcattaataacaggtgcactggaagtccgagccgactgttcccgccactcatttcgtcgttgagtttcgccttggcaatgattcaaaatggcgccgtgcggcggcagagattaaaccgcccaaagagaatgggcaccaaagtttggctgcgcgtctcactgagctggaggacaacgctttatccgtccgcgttgtgttcgtcgacgagcgaagccgagcagtggcggtgaccggggagcagctaatcgcgcacagagcggacgaaaagtcatgcgaaagaatggcaccggcggtgccaaaagcggacgaagttggcacggaaagcgtacggttcagctgggagcagtccaagtgcgagggcgatatacagggatacgaacacgcggtcggtggttatcgactgatgcatcggcatgccgaaatcgaaaataacgctgccaaccatttaccttagatttggccttccgaccaatcgccccccgagacgactgccttctctgcggatacttccgccaccgtcggtgacctcgaagcggccaccgcgtacactttccgtgtccgcacacgtcttcagcacgggcacagtccgtggagtgttgcgattggagtgacaaccgccgagggcaaagatgaggacgaactgctgaagttggaggaccaaaagacggacgcggtacagccaaaggcatctgctgagaatttataccgcctgcgcattgttttggcaccacctcactcctttttggtgtggagtccgccgccggaacaccgcgagaacattgcgcgctttaagtgggtccaaactggcaaaagggcatcattcttcttccattaagagtgtcttacaaaccgaccgcttctgcttccgccccgtggacttcgttggttcagtcccccgccgaattgcaatgtccgccggggctgagcacctacgcggagacggactactgcttgaacctgcagggattggactttggacggcaatacgaagcggaagtgacgtacgaactgaaagagccgaagggtcgttggagccaaaggggcagcccactgttcttcattttggtcaagacttcgtcggaagaacagcgcattggcattacttcgccggacgaccaactgccgggcatttcagtaagcgaagtgcgcgtcgaaccgacggagggcgccaaaacgattgtgcgatggaaagtgaacggacaatcg

SEQ ID NO: 81944 - DNA, 423 bp, Heterodera glycines
  Genomic contig location: Contig_ID=SeqID_17457; Location=301..723; Strand=-
  SCN-specific regions: Sequence locations=1-186,208-262,284-351,380-423
atggctattgaacattcatttgtcggtggcctactgtttgcaccgtttcattgctttgttcgcccattttcaacaacacgagccttcggcacaatcaccggcattggcacaatcgccaccatcggacgattcagtaccaaatgccgtgccaatgccaacaaaatttgcgcaaaattccacggcaccaaacagaagcagcgaagaagaccaatgccagcagagaaattgatgaaagcaataagagatagagagagagaaaaggaccatttttaaaattaaaatgccaatgctggcacccaatttttgttttaagtatgccaaaatgcctaattagccttttttgcatttcttttaaattcattctttccatctttcgttgtatctgatctctaaattttttgaatattgttttatttcaataaa

SEQ ID NO: 81945 - DNA, 309 bp, Heterodera glycines
  Genomic contig location: Contig_ID=SeqID_17458; Location=796..1104; Strand=-
  SCN-specific regions: Sequence locations=1-169,191-309
atggcacaggtccgtgtcgcgtaccaagccgtcgtcaaacggtgccaattcggttgtcgcttagactgtaatcggcacttttacattggcacggacattggcggacagcagcaacgggcggtagaaatggaagcggatgaagagccgcttaattatgaccgtgccgaagaggaagatgaagaagccataaatgctgatgccaacaatgtgccaaaaccaacggaaaacgaaaacggtgccaattttgcatccatgaggcagaaaagagctgatcaaaatgaggattggcaccaagactcgagaatttaa

SEQ ID NO: 81946 - DNA, 1528 bp, Heterodera glycines
  Genomic contig location: Contig_ID=SeqID_17459; Location=409..1936; Strand=+
  SCN-specific regions: Sequence locations=1-264,286-349,404-436,458 -563,790-875,1003-1014,1055-1062,1092-1240,1263-1268,1292-1378,1401 -1528
gtccatcaacgttccgtgcacaatttgttgggtctgtccgcccgcccctggtggactgttgagcaaagcgaatgtgccaaacagctcaaaaccatggaacgtcaatggaccgcgatcagaggtgggaccaaactccggagattaattcaggatcagcagaggataagattggataattcggcacggatcggatctcaggattaaaatgcctgttttaggattcctgctgatccgagtcaattttacaaaataccgtatttactgaaatagaacccctctcccccctgtaataaagcccctccaccgaggggggttgaaaaacaaagttccccccctgaaataaagtcacttttttttgaaattttaaatttctaaaatttgaattttttaaaattttattttagaagaagcattgaaagtgtggagcaaaaggaaaagcctctttgttgaagaagccctaccaataggcagcagtggaatgatgggaggaggtgaattggcactcgttttgagaagcaatgccatcggcggattcagagaagaggtaaagagagaaaaatgtcaaaatttaaaattgctaaattaaattaatttaattaataaaggttaaaattatatttttaaatagaattttgaaaattatattttttttgtatggaaaattattttttaagtattaaatttattaaaaggtttacgactgaaaaaatgctattttatttaaattaaaaattgttaaattttttattaattttaaatatagttttcaaattaatgaaaaaaaaaattcattaaagatttgcgaccgattgatgcagtcaacatgtgaactgcttaagcaatttgaaacagcaagctgtgccaaggacaaggtgaaaaatttaaaaataataaatcagaatttaagaaaaggattcgaattaaaaagtttaaaataattttaaaaacgaaatttaaaagggaataaaattacaaagtttttttttaaaaatgaaattaattccaaagggtccgaattaaaatatgaaataatttattaaattgaaatttaaaaggggtccgaattaaaatttcaaaataatttaaaaaatgaacactctcagataaaattgtccgttttgttggccggcacgcgaacttggcccttttgtgggcccaccaattatgtgctggaggcacagcttggcctggtggcacattcggatgcacgaattcgggtgggcaacgagacaaggtccacccacaaaagttttttgaggaatttaaccaaaaatttttttttaattttttaggggttggcgcccgggccgattcctcgtgttcgacacgagttttgagcgggaaatcagcttcgaaggggtgggctgaaaaaaaaacgtttttttaaatttaaattttatggaattcccaggccccctccaacgcaatacgactcgcgctgaccatggaactgtggcacccgcaaatgccaatggaattgcgcggcaaaatccgtgccgccgatggcagtgatgaagagagaaaatga

SEQ ID NO: 81947 - DNA, 187 bp, Heterodera glycines
  Genomic contig location: Contig_ID=SeqID_17459; Location=2746..2932; Strand=-
  SCN-specific regions: Sequence locations=1-7,29-76,104-158,180-187
atgtacaaaagtgacatcacccgttcatttcaacgaaacagggtaattagcttatcgaaaaaaaatctcaaaaatctaaaaaaaaaaaaaaaatttaatttttcagttggatatccctcgcgctcctggcctcggtcttctgttaggtgatgatgttttttgaatgaaaaccaagttttataataaa

SEQ ID NO: 81948 - DNA, 1361 bp, Heterodera glycines
  Genomic contig location: Contig_ID=SeqID_17461; Location=53..1413; Strand=-
  SCN-specific regions: Sequence locations=1-78,101-410,433-454,491 -596,618-628,650-739,833-915,963-1105,1132-1134,1156-1361
atgaaacaaatggccgacgaaaaggcatttttggacaccgttcgcaattctttggtgcttctcattgtcggcatcattacaattttattggccatgaatgccaaaaatgtttggcactttttcgcgcctgctattgttgtaaaaagcactaagaaaaagcggaaaaattcaccgacggcttcaattgggacaaaatcaaaaatgaactccgttattaaggtagcgcgaatttgttgacactaattattccattacagtatattacttatatatcccccgcccctcctcaactgttaaatcaaaaattgaaaaaaaaatgaaaaaaggccatttacttagtgtcatttaatttaagtgctcaaatgaagaaatggaacagaaagaaacggtgctgcaccagttgcctttgccagtcaaaaaacaaattattgaaaaagccgaagattttgaggtaaattaaattgttttatttattttttgatttttgtgtcaaaaagtatgtataaaaaaaatataaatagagattagactttaggtatttatactttttgcaaataatatttgctaataccacgaaaatcacttttggcattgtcattaatatattaaaattttaactgtgccttttttcaaataaattgatatttttaaggcgcaaattgatgaaatcgaacacaacggagttgaatctgctcaaccaaaaataatcaaggttaaaacagaaaaatttttgcttttctaatttattttatctttttatttaattatttagaaatcaaatttataattttgccttattttttgtattacaattaattattaaacttattaagggtgaagataatgccgatgattctattcaaattctatctgtcaaacaaccgaaacgcaaaatgcgtatgacaaaaacgagggtaataaacaatttaaacttattaattaattatttaactaattaaaaaggtttttttaagtttcaagacgatgaagaaactgttgatcaaaaagaagtgccgcctcacaatttttcattggtgttgagcacacaaaaggaatctgaacagcaaaaacgtgccgaatcggttcctccaaaagagaaaaaggcaaaaaaaaaaaaaaattttttttattgccttttttaatttggcacttttttagccagaagttgacttggacaccgttgtcaaactgatggagagcggactttcacaggcggacattgcgcgtcagctgaatgttcacaacatttactacattgtaacaaagtgccgaaagcagggcctaattacggggagtcgaccaattacgaggaaaaaggcgggcaaaacataaaaggacagcaaaacaataatttaaataaa

SEQ ID NO: 81949 - DNA, 413 bp, Heterodera glycines
  Genomic contig location: Contig_ID=SeqID_17461; Location=1658..2070; Strand=+
  SCN-specific regions: Sequence locations=1-310,353-413
atgtggccagagatgttatcactaataaacattttgtctacattttcggctttgggtaaaaatgccattttgtttagaaaccggtaagatttttttgggagcgggagtatgggatttgtgggagcggagtacgggatttgcgggagctggatcaagaatcccgaaatctctgaaatttcaacgagggttggggtaacccaaaaattaatcttaaatatattattgctcaatttcaaagtcccttttatatctcaatctgttctctatacatttattttcaacatttggatcagctttgcaaattgatgagataaaaaatttgttgaaatttttgaaaaaataaaataaaattcttattcagaccctttcaaattcaacaaaataaggagaaaattcagatctgtgaactttaa

SEQ ID NO: 81950 - DNA, 384 bp, Heterodera glycines
  misc_feature (204)..(204): n is a, c, g, or t
  misc_feature (209)..(209): n is a, c, g, or t
  Genomic contig location: Contig_ID=SeqID_17463; Location=126..509; Strand=-
  SCN-specific regions: Sequence locations=1-55,77-92,127-252,274 -337,377-384
atggtgagtaagcactaattaaaacaaaatcattatccaaatttcctgacagcaattttaagcaaattcttttttcagccaaaaaaatgcagaaaataaaaataataattattattataaattttacttttcagaaacttggacaaaactttatttttttatcaaataaactttgtttttgccaaattaactctgaatgcttanattanataaattgatatgatgtactcttgatagctctattattttaaaatttcaaaacttttagttcgggtacaaacatgttattgccaaaaatcaaaaaaatgatttttttaaattgcagttttggcgccgcttaacttttttaaaaaaggttgaaacattttaattttgtctaataaa

SEQ ID NO: 81951 - DNA, 1722 bp, Heterodera glycines
  Genomic contig location: Contig_ID=SeqID_17463; Location=1113..2834; Strand=+
  SCN-specific regions: Sequence locations=1-289,311-459,481-784,806 -806,1034-1045,1125-1529,1551-1722
atggtactaattattattctcatatttttcgccacttttaatggaatttttggggttggagaaggtggtgaagaaaacgatttgttcagtgatttgtggaagaattatttcaacgcaaaaaacgtgcagaaggcaaatgttggccgaaacggaggacaaaaagtgaccaatcgcgtaaagatggaagaaagggacggtggtgtagaaatgggtgcggtcggcattcgcatgccacccaaattggcacaaatggtgatcaagagtgaaccaaccgcagcagcagcagtttttgatcagctattgaaaaatgtaaagcatgagccaaaagaggaggagtttgagcaattggacattggaaaaatgggtgtggttggcattcgcatgccacctaaattggcacactctgtgatcaaagatgaaccgccatttgatcagcagagagagcatcaacaaaagcaagcaaataaagagccaaatcatttggactatgggatagaaagaatggaagaaacagaaaattcattggaatcgaatgggaaaattagccaaaaaagtgccaaaaagttggcaaaaaagaaaagacaatggcaaaaggaagtggacagaacgccacaacaatttaaaaaggaggagaattccaaaagcgacataaaagtattgatagaacaatttgatcaaatgaagaagaaatttagaaaaaaaatccattttgttgacagaaaaattaatgtgaatttggaaagtaaaattgcaaaaagattgggcacttgcagaaccaaattatacaaaatgaaaagagaaaatggtaaataaacaaaaaaaaaaatttttaattttaaatatttttaaatgaaaaattcatattattgtttttttaataaaaaattatttttttttaatattttcacataactatttacttgaaaaaattcacccgttttaaaaacttaaaatttaataataaaaaataaaaaaattttttggtatttaaaaaagtttaaatttttcaaagagaaaatatataaaattttaagtcattagaaggattttatacttttaaaataattaagcaaaaataaataaacactttcaaaataaaatttactaaacttttttaatttttaggattattgaccagaaatttttcaaatgaacaaaagaaggaaataatccatcgatttgaaataataaaagaagaatttatgcgcaaattcaaaataaaaaccaatgccaaaattagcgataaaattgcgcgaaaagttggcgtcaatttggagacaattaatcgttggaagaggtcatttggctcaactggtaaaaaataataatcaaaataaaactaaatcttttgtttttaaaagatttttgcatagctttttggggataaatgtttaatttttacagcaaagccaatctatacgagcgcagaacaattggaattcatccgaaaatatgatgcactgaaaattcaaaacccactgatcagcgatcagaacaccgcccaaatgatcggaacaaacgcaataagcataaaaagatggaagaagaagtttggtatcgcgtatccttgcaaaagaagacggatcacgtgaattgattgggcagtgatcagcaatggcagttgcttgaacatcacagaagcggaagagtgatcggtggcttctgctcagaattggtctgctgacctggtctgagtgatctgcttaatttgtatgctcttaa

SEQ ID NO: 81952 - DNA, 249 bp, Heterodera glycines
  Genomic contig location: Contig_ID=SeqID_17464; Location=2444..2692; Strand=+
  SCN-specific regions: Sequence locations=1-166,193-249
cgctgacccacaaaatgtccagcctacgaaatgtccaagtctcgaatttgagttttttattattcagatgggcctaaggttaggcaaggggtaatataaagggtatattcgtattcagcgaccccgaaaaccctaaaaatccgaaattagactcattttgtttttataaattttgaaaaattttggacatttcgtgggtttttactcttttggacatttcgtggcttggacactttgtggggatgccat

SEQ ID NO: 81953 - DNA, 890 bp, Heterodera glycines
  Genomic contig location: Contig_ID=SeqID_17465; Location=724..1613; Strand=+
  SCN-specific regions: Sequence locations=1-51,96-135,387-818,840-890
atgaggcaacacacttcattctcccggcttccggccgccgacagcatttcccaacaaaaccaacaccaacaacagcaggacatcaacaacaacaatgccgtagtcgatgataatgatgttgaagccgaagatgaagcggcggcagcggaaatgccgggggcgccggcggcgacggcacagcagcgctgggaggactcaaccggcggcggcgacgatggcatggaggaacagcgacgggacggaaatggcggggacgaagaggaggtcgccggcgatgaacaacaacagttacaacaacgacgacaacagatgttcaagcggaagttgttgttggcgcaggacaacgacggcacggcggcggcgagcggtgccaacgacagcggcgaaacgtcgccgcgggcgttggcacgctcgcatgtggagctgttcacgcgaatgcgcagcatttgcggtcggatgaaccgcctgaagcgcaagcggacaccgcggcctggctcacccgagtcgttggtcgctttcctgtgcgacagtgccaaattccagtgaggggcacggcacaaaaaaaaacatgggggacagacggacggcacaatttgatcattgatctccaaaaaacggaaaaaaatatttgtttttttttttgcccggatgcaatttttgtgttctcctctttgtccaacaaatctcaaatatgtaatgaaaattgtgtgttcattttgcgttgtgtaaacattctctcctggcgaaaaaaatagccgaaggcacaaaactttaattttgccgatctctgttttgtactgactccccatgaaaaaaaatcaaatcctttcaatttggcacaacgattttggtacggtaattaattaattaatcagcctgttcctgcacca

SEQ ID NO: 81954 - DNA, 958 bp, Heterodera glycines
  Genomic contig location: Contig_ID=SeqID_17467; Location=203..1160; Strand=+
  SCN-specific regions: Sequence locations=1-55,77-331,353-532,554 -581,605-763,785-915,937-958
  Gene Ontology: Mol. function=ATP binding; Cellular component=integral to plasma membrane; Biological process=growth
atgagcaatggactaattatgtcccatttaagtgccgagtgcacggaccttgcccagggctacacctgcaagtgccgaagcggcttccgcgacgtgtccccgtccaaggaaaagccgggtcgtgtctgccgggcaagtaagtgccgcccactatcgttttgggcctttataccgtattcaatctcccccaaaataccgtaatgccattttcctcattttcagtggtcaatgagtgccaatttgcgcatctcaacgactgccatcagaatgcgcaatgtttggacttggaggtaaatttgtgaaaacacaatcacttgatataatcctttttagaaatttaaaaattaaatttacgcccggtaaatttggaaaaaaaactaaaaacccatttttgccaggacggctatcagtgtaagtgtgaaaacggcttcaaagacgttcgaccggaaaggccgggccgactgtgccaacagatggtcaatgaatgcgcacgtgcggacacaaattcatgcgacaaaaatgctaaatgcgtggacgaagaggcaagttcagaagagaggcacacaaaactggcatttgtcattaaaaaattgtgtgtgtctaaagttagggtattacagtaccatgaacttttgggatttactgttttttggatattacagtattcagaacaattccttgactttaccgtatttattttatttccggtgataaatttccatgctgtacttttcttttaaattcagccagccatggaaacggcctaacacagtaaaaccctggttataaccaatgcataccgtatctctcaaccgcatgacgattagttacagtcttcccgacttgaatatacagtatcaattatccatgaaaattcatagcgcataattaattgttcatggcacggttttcatttctcccccatctccctgcttcgtcccctctgtgtgttactgta

SEQ ID NO: 81955 - DNA, 564 bp, Heterodera glycines
  Genomic contig location: Contig_ID=SeqID_17468; Location=255..818; Strand=+
  SCN-specific regions: Sequence locations=1-564
  Gene Ontology: Biological process=growth
tcccccgatggattgcaaggccgaatttgtgtgcgcaactcattttgccgtgacccgaagctgaacaattgttcccggaaagctgtatgttatgaggaaggccaaggctaccgatgcgaatgtgcccgaggctatgtggacaagtcgccggacggcacgccaaaaggccgagtttgcgaattgccgccggcgccggcacagccccagcgacacccgtgccaagacgggagccacgactgtcacaccaaggtggataggacattttgtgtataactcagaaacaaaatgcaattgtgtacatatttggtgctattcgttgtagaataacgagatgaatccattgaagctattgtaattgtttgtcgaattttacagcacatcagttaggaaaagcagcggaagtcatttaaaaatatcctggaaaatcagagttctgctacccaaattgaaattgacttttctctaggcatcctgccgagctgtcggcgccactgggttcgtctgcgaatgtttgcccggctatgaggacaaatcgccggatccgaagaacaaaggcggaagagt

SEQ ID NO: 81956 - DNA, 1268 bp, Heterodera glycines
  Genomic contig location: Contig_ID=SeqID_17469; Location=54..1321; Strand=-
  SCN-specific regions: Sequence locations=1-939,961-1268
tttttcttcaattggaccatggacgcgcaacagcttcaacaattgctaaatgcactccagcaaaggtcaccaatgccgcaccgcaaaacgccgcaccagcaaatttgagcaatgccaatttggcaagctctatcgatgctcgcctttcaacctttcattacaatccggaggtcggtaccacatttgaatgctggttcaaacggtacggaaaattgatcgaggacgacggaagcacactgcctgaggcctcaaaagtgcgactccttctcggcaaactcggagaggaggagtacagcaaatatcgggacacgatcagcccaacccagccggaccaagtgaattggaatgacaccatttcacagctcaaacagctttttgccgagacacgttcgctattcgtccgtcgcttcgaatgttttaaaattcgacagcaacaagggcaagacatctcatcactaattgcgcagatcaacgcatcatgtgaaaatgccgacctgagtctgacaaaggagcagctcaagtgcattattttggtcatcgcactcaacgatgaacaccatgatttgcgacaaaaggcattgaaaatgttggaggactctcagaaaaatggcaccaacatttcgctcaagaaaattgaggaggaattaagggcaattcaacttgtcaaggagagcgccctttcgctggtcaacccaccaattgccacaaacgccattcgcacaaggccacggcaatgggccgacccagcgcaaagacaaagcggcggctccaatcaaaagcaaactccaaatgccaattcaagcggaaagccaacgcgtggtcaaccgacgcatccatgcggatcatgtggcaaatccgaccattggcgctccgactgcacattcagggacgccacttgcctcaagtgcaacaaaaaaggacacatttcaacaatttgccggcaaaagaaagcaaaggcggcaccgaacaaccacagggcatttcacactgtcaaagtcgacgcaaattgcctgcatgtcggcacgactcaaggacgatggtggaaattatgcattttgattaatggaaggcaaacttccatgaatggcgacaccggcgctcaggccacaattatttcattgcaaacatggcgagagttgggagaaccggaactgactccatccgacatcgatgccaaaaattgcaatgaccagccattcgctttgcttggcaaattccaatgcaccgtccaaattgccgacaaaccaccgcaaactctgatcgcctat

SEQ ID NO: 81957 - DNA, 632 bp, Heterodera glycines
  Genomic contig location: Contig_ID=SeqID_17469; Location=405..1036; Strand=+
  SCN-specific regions: Sequence locations=1-632
ttttttgttgcacttgaggcaagtggcgtccctgaatgtgcagtcggagcgccaatggtcggatttgccacatgatccgcatggatgcgtcggttgaccacgcgttggctttccgcttgaattggcatttggagtttgcttttgattggagccgccgctttgtctttgcgctgggtcggcccattgccgtggccttgtgcgaatggcgtttgtggcaattggtgggttgaccagcgaaagggcgctctccttgacaagttgaattgcccttaattcctcctcaattttcttgagcgaaatgttggtgccatttttctgagagtcctccaacattttcaatgccttttgtcgcaaatcatggtgttcatcgttgagtgcgatgaccaaaataatgcacttgagctgctcctttgtcagactcaggtcggcattttcacatgatgcgttgatctgcgcaattagtgatgagatgtcttgcccttgttgctgtcgaattttaaaacattcgaagcgacggacgaatagcgaacgtgtctcggcaaaaagctgtttgagctgtgaaatggtgtcattccaattcacttggtccggctgggttgggctgatcgtgtcccgatatttgctgtactcct

SEQ ID NO: 81958 - DNA, 692 bp, Heterodera glycines
  Genomic contig location: Contig_ID=SeqID_17470; Location=625..1316; Strand=-
  SCN-specific regions: Sequence locations=1-136,178-201,223-265,295-692
atgagaactgagatattttcacaaatttttttcatttgtattttgtctttatattctattgacacagcacctcccaaaaatgaatcaactgaaaaagaagcaagttcatcaggttcagcaggtgataattttaaggaatatttaataaaaataaaaaagctttaataaattaattaaccgaaatctcaccaattataagctaagttttgtgcttttcaattataatttaaagggtaattcacccattcaaaacaaaatctgattgaattttattaaaataatcattttatattaccaaacattttaatacacctataaattactcaaattaaggcacatacacaataagagattatgcgatggacattaaaaaacatttggcaaaagttgaaattgaaaaactaattcaagaagcgaaagaatgggcacaagacttgggacttgttgttattcatagggttgcaaccccgaccccgccccgaccccgacccccgacatttttggccattttcggggaaaaccccgaccccgaaccccgacgcttcataccccgacaaccccgacccttaaccccgatcggggtcggggttaaatatacacccctaagaatggcattttcgtgggagaaaatgcaaaaaagttagacgaaatttgaatttttttaaccatttgccaaatttttattaaataaa

SEQ ID NO: 81959 - DNA, 2272 bp, Heterodera glycines
  Genomic contig location: Contig_ID=SeqID_17472; Location=111..2382; Strand=-
  SCN-specific regions: Sequence locations=1-84,106-210,232-348,370 -793,815-815,854-883,906-1245,1267-1325,1418-1458,1480-1544,1628 -1936,1958-1961,1984-2113,2135-2272
  Gene Ontology: Mol. function=glucose transporter activity; Cellular component=integral to plasma membrane; Biological process=glucose transport
atggccgagacgaacttggacaaagtggtgtccactcgggaccaggagcagcgtgagaagttgatcagcaaagcaaaggagggccttgtggagaccacgaccgagccggatgggtccaagcgagcgccgccaccggtcaaggcacgtgttggcaagcaaaatttggatgagttcattcgtggtagtgggttgaagttttgggatgatttcaaaatgataaaaatccaactcgtcctgtcccgactcgtactgtttttcgacaaaaatgaccataacttttgtaaaaatcgcctgttttaaacatttttggcattattcaatcgattaagccttaatcttctctttctaaaagcacaattcaagtttattatgttagaaaaaaaataaaaggattaacaattttttttttaattttgtcgcttttgataaaagtcgaaaaacaatacgagtcggatttcgtcctttaaaaatatacgcaaaacggacccgttttgaatttgtcgggcatttcagtaccaattaacacatgaatttgaccaaatttaaccgtcttcaattttttggtcgtatcattttgtttcttggtcatttgaatttcgaactcttcattttcttgctatacgcagggccgactcaccggcattttggcatttgctgtttttgtggtagctttcggcagttcattccaaatgggctatcacattggctgcatcaatattccaggttcggattttactgccttttatgatgcatttgttgcaaaacaagactcatttgaaattcttagtttttgcattttttgaaaattttgaaacaaaaaattttaatttttttaaattttagatttaaaaaactagaatttttcttcacctcaaatctctaacatttcctttttaaattttccaggggacataatcaaagaatggatctctgaatcgtacacgaacatgacaggggtttcgacaacagtggaagagatggactcgacatggtaaaaattgactatcggagttttctaaaacaatatactaattaattctttgaaaaattgtcattattattcgagaaatgaattcaattaattatgaattaattgtccagggcacttgcggtcggcattattgccgttggcggaatgtttggtggcattatggttggcactgttgcggacaaattagggcgccgtaaatcacttctgtacaacaatattttggcgatcattgctgcggcactgatgacactggcaaaatatgtgaatgtttattatttgatcaccattggacgattcattattggactgaacacgggtatgtatgtgtatgacgaaaatattttgttaaattaataatataagcgtaattatttgaatttttattgaaaaaataaatgaaatttaatcaaaaacaataaataaaatctgggattaaacgaaatagctcattgtttttttctactagcataaaaattttcagaaaatttcattcagttttcataaagttgtgactaaaaatgatgcaaaaactgccataactttttgaaaattgaataaaatttaaattttttaaaattaaccacgaattttttttttttgtaatttaaattttcattaaaattttaaattataaaacccatttttaaaaatttgtagggttcaacagcggactgtctccaatgtatttgatggaaatttcaccaaacaatttgcgtggctccatcggctcgcttcaccaattgtttattaccatcgcaattctcgcttcacaaattattgggcttccacaaatttttggctctgcaaatctttggccactgatttttgcgtttactctggtaaatgtagaaaaattatgtctaatccagggttgagattatataatatgtcttttgagggattatgtgccaaatttatgccatattttaatgcattagtggcttttgggcatatttttaaaaatttcccggcccgcccgccaccacctcgcctaaaagttttttgaaaaaacgcgccgcgcaaaaaaggtgctttgaatagcaaaaaaaaggtcgtcaccggagaaaaatttggaccttcgtacgaaaaattgggcttggcgcaccccttgttcatgtatgattattttatttttccattcctattaaatttcaggtgcccgtgttgttccaattgtgcgcacttccattttgccctgagtcgccaaaatacagtttgattgtccaaggaaggaaagatcaggcggagaaagatctgaaatggcttcggggaggcaatgat

SEQ ID NO: 81960 - DNA, 355 bp, Heterodera glycines
  Genomic contig location: Contig_ID=SeqID_311; Location=576..930; Strand=+
  SCN-specific regions: Sequence locations=1-109,140-355
gttgaaattgccattcgttctttggatacagcattctttgactcgggctcgtttaattccaaaattgcagttattgtgccgtcaaaagaactcatttggagtgtgaggcattaattaattatttatatattatttaaatgctttttattgcataaattaaatagggatttcattttagggctccgactttcgtgccagcattaacagtttggtgcagctgaggccgttggacaaacgcgactcaccgacgcctttgttcagtgcgcatgtgccgctgaagttggaaagagttcgggtggaattggttttgggtcccagcgtcaaccaagacggacacttaaggacgggtgggtaa

SEQ ID NO: 81961 - DNA, 246 bp, Heterodera glycines
  Genomic contig location: Contig_ID=SeqID_313; Location=1349..1594; Strand=+
  SCN-specific regions: Sequence locations=1-114,138-246
atgtggttcaaatacgcggaggactacggactgaatcatttgttggactggcgcctttggtcaatgcacgccaattgcgcggatgtgcgtccagaacggttggactacgactcgagcgtggagctgaaggagtggagcgaagtgtccttcgaccaattgttgagttttgaccgtctgcagacggtgggcgtcgatcggacggcgtatttgcaggcggcgcttcgactgccccaaagcgtcgcaaag

SEQ ID NO: 81962 - DNA, 1280 bp, Heterodera glycines
  Genomic contig location: Contig_ID=SeqID_314; Location=71..1350; Strand=-
  SCN-specific regions: Sequence locations=1-216,249-265,288-553,577 -831,865-912,953-1013,1035-1280
tataagacatttattttggtaaattgcgcatctgaacaaattgagaacggtgaatatttttgtcgatttgtttccggccgaattcggctgcaaattgtttttgacattgaccaaaaaggaaatggcaaaacggagactcagctgtacaatggcatttaccaggagaaatgtacgctttatgagtcctcattttcgcaaaacgcactttcattccggtaaatttaattaaaaaacaaataattaattatggaatttaaattgctaaggcccaatttttgtattttttggctgattggaattcaaagttatgagagcagagaaaatatgcgtaaaaatttgaaaaattttgacttaaaaattaaaagcgattttgtaaagtacaatcacaaggacaaagacggcaaaaggcgaattgattttcatagaataaatgcggaagaaatagccgaaaaattcaaagaattgaaaatggaattaaaatcaacggtcgaggacagagagcaacttgaacgtttgaattctaaggacaatcattgaaaatccattcacttaatcatttatttgtttattatttttccaatttgtacaaatcaattaaaaaaagaaaggcacgctaattggtaagcacagaaaagacacgaacgtcgcccgtgaggggtacccccacccaagccgaaaccctgggaccgtcaatgtgacgacacgtatgtatggtcttgattttggtttcgagtctcaaaaccaaggcgcggcttcgagaagggggatttttttaaattcagtttggttcaattgtttattcaaatagataattaaaaatggaattttaagatatataaaaagtgtaaatattttcaaagtaaaatttagtcaaatgcataaataatgaacaaaaagaatgaaatggatcattttgtgtgtgtgtcgaatctcttggccttttccatccactatatgtcctcaagaattgatcagacgagagacacgtgttgatcactgatcgaaaaaatgcgttttccaggaaaaggcagtgcatagcgagagaactgcggggtgaacacttgccgatcgacttggccattctgagtgagctgacggaagaggcggagggactcagtgttgttggacggggttttgtagaggagcgattcgaaatgggcggacggattggggccggcaaattgaagcagtacatcgcgaagaagggcagaagcaatggactgaataaggcggatcgaatttgtagagagagagagagagatacaagaggaagagagtga

SEQ ID NO: 81963 - DNA, 249 bp, Heterodera glycines
  Genomic contig location: Contig_ID=SeqID_314; Location=131..379; Strand=+
  SCN-specific regions: Sequence locations=1-186,208-249
tccattgcttctgcccttcttcgcgatgtactgcttcaatttgccggccccaatccgtccgcccatttcgaatcgctcctctacaaaaccccgtccaacaacactgagtccctccgcctcttccgtcagctcactcagaatggccaagtcgatcggcaagtgttcaccccgcagttctctcgctatgcactgccttttcctggaaaacgcattttttcgatcagtgatcaacacgtgtctctcgtctga

SEQ ID NO: 81964 - DNA, 2632 bp, Heterodera glycines
  Genomic contig location: Contig_ID=SeqID_315; Location=3934..6565; Strand=-
  SCN-specific regions: Sequence locations=1-481,503-544,611-676,905 -1055,1077-1165,1187-1287,1309-1373,1395-1429,1458-1544,1566 -1567,1589-1708,1759-1771,1793-1887,1910-2119,2153-2366,2388 -2449,2471-2537,2559-2573,2595-2632
  Gene Ontology: Biological process=N-linked glycosylation
atgcgattggccgaacgctttggtgccgatgttttcgtgtggatgaattggttggagatggaccggcacaatcagtgcacaaaagtgcaaaaattaatggacgatttgcacctgtatttccgacttctttacgatgcttattgtatcgcagcggaaatggaagacgcaatgcgaatttttagcttcgcattgccaggtttgtggcattttaatcagctaaaatcatttaaaaatccaacaaatggcatttctgccttaaaatccaaatgaatttagcgattaaaacatttgtggatgaaagcagaaataaaatgttaaatctgaccgaaataaacaaagaatggggcaaactgagcagacttatcaagaaagtagcagacaatgcgcaaaatgttgttgcacaaacggaagaagaacgaaaaaagtacgaagagccaattccgatcattcagaaattacattttgccgaatttatggaattgttgaacagaaaagaggaagaagatggaagcgagaaggaggagcttgagagaatgttggaaggtaaattaaaaataaaattaaattaaaaattaaataaatattaaatgtttagatgaattaaacaaaaacaatcaacaaaaaatgagcgactttctgacggaaaatgatttaaaaagattttatgaagcaattgaaaataaaaaaacaattttaaatggaaatgaaaaaggacaaaatgaaaataatgaaaacaaaaaggcgaaaaaagaagagaaaaaacggagaaaaaaggagaaaaagaaaacaaaaaaggaggaagaaaataataaattaaatgagaaaatggagaaaaagcaaataaatggggaaaatgaaggagaaaatggccaatttggacaaaaggaaaagaaagaaaagcaaaattcagatgagaaaaattgtaaagaaagtggcaaaagcttaggaggaaaagccgtggaaaagcgaagggacattacggaatataacgcgagaagaaaactgatcaaacacaatttggccgaagaattggccaaaattcattctattaacggtaaaatataatataataattagggctcgaaattatatggactaaaaaccccaaatatggacataaaatatggactaaaaatgcctgaaatatggactaaaaactgtcaaaatgtgtgttttaaaccctcaaaaattccaaaaatattcaatatttgcttaaacaaacttagaaaatacactaaattaccaaaaattgatttaaagctaaaaaatgcaaattttttttaatcaaattcttcctttacaatttttaaccaaatacatctcaaaatttatgtaataatctcattctgttgtcagcgaaaattttaggtaacgaacaaaatacctaaaaaatttgccaaaatttcgaaaaaatatttttttggtgtgtattttctaaaaaattttaaaaagtcaatctttaggggtgtatttttctcttttttgcatttttcttgtgaaaatttccaaaaatggccgaaatatggactaaaaaagaaaaaatggcgaaatatggatttattcccgaaaacccccaaaatatggatttatatggactaaaaaccttcaccaaatcaaaaaattttaacgcagaaattctatttttgagcgcctttcttcgtagcatatgcgcagaaaaaaaaatgttaatccatacaatttcgagccctaataataataatattaaataattatgtattaatttaatttatttttaaacagaaaattgctaataaattttgtaaattttaattcagatttttataatgacgcattcctttatgccaaatatgaagaatttgtggcaaagccttccatcgaaatgcaacggataatcgatgttggggcatttttaaatgaaattggacatcgtttaaaagcgatgggcgaattggaaagatttaatcacacgggcaatccgcaaaagagcatgggacaattaagaaatgaatgggacacatttttggagcaatttggtaaattggaagtgccaaaattggagaaaatggagaaaaaagtatccaaatttatgcaattgtttttaaacaatttgcaaaacacaaaacaatttgagcccgacgaaataacaaagcaaataaaagtgcaaattcatttgaaaaatttgtcaatggcacttttgaaaaacaatgaatttaatgaaaaatggaaaaattatgagaataaaacgaaaaaagagaaattattttatttattgggcgaacgtttcggcgcagaacgcttcgaaaaagtgaaatttgaatggaaaagaatggcagaacaaaccgaattaggcaagtgatgaaaaaatattttatattcgattatgaaaagaatatatttgtttttgaatcggaattcgttggcttggcatttcgtcgatgccttaggggctaagaccattaattctaattattcttaattttgtctgtttagatatctcattatatcgtaaacacttgagcaaagaccaacaaaatgagcacattttccccgcttttccttacatttcccagcagacatttttaggcgatcataaaatgaaagaaaatgtaaaaagactttctgactgttttttcttaccattacaaataaa

SEQ ID NO: 81965 - DNA, 917 bp, Heterodera glycines
  Genomic contig location: Contig_ID=SeqID_315; Location=6750..7666; Strand=-
  SCN-specific regions: Sequence locations=1-633,658-890,913-917
atgcgagttgtgcatgtgctgttcacccatttccacgattttctgaaacacgtcgctttgaatggcataaatttcacaaaaattatcgattacgacggtaattaaataataatttcgcttttttaagatattttttttcattttactgttatttttttacttttgtaggcattgggcaaaaggaactgctcgaattttacataaaacatttgattgagtccaacaatttcgacgaggcatcgctggaagatgaggacaaaattgctgtcctcattaagctgctctcactgtgttcaagtcgcaaggaaaataaagtgataaaaaacatcgaaataggcaaagaattattgaaaagcggagaacaaaattcggaaattgacaaattcacaatgataattagggacaattatgtggccaaagcggaaacatgtgtcctgctaaaggcaatcactaaaatcactttgattttggcaattccttcgcactgatcgctttaaattcccaaattattttagttgattgaaatttttgcgggaaagtcggccccaattcggatgctctgtcctctgatgcatttcattgactttttggagaaacagctgacaaatgagcatcaattttggcaattcccccgcaaatgttttcaaatggaaattagtgaaattaaccgaaaacaaatgaaagtgttgggggcggaacatttcaattatttggcggcatttattgaaaatgctaaagaaaaagacgaatttatgcaaattttgcgagaaaagcacggcgcattgtatcggatgagacttttggtgggcggaaaaaacgcaattcagcgaatgtgggaaatgccgaagatacggaacaaattgctgaacagaaattgtaaacaaacagagaaataaatgaaagaaaatataaataaa

SEQ ID NO: 81966 - DNA, 1825 bp, Heterodera glycines
  Genomic contig location: Contig_ID=SeqID_315; Location=8850..10674; Strand=-
  SCN-specific regions: Sequence locations=1-80,102-532,598-1066,1088 -1244,1311-1354,1384-1649,1671-1739,1761-1825
atgatgcaaaacgatgaaatggaacggtttatcaagttgtacaaaaagattgatataaatgaaattgattgccataaaattgcagaaaatgttttccaaaatgtgccattgacagatgagaaaaatgcgacaaatatttttttaaacgatttgcgacaattgcatttcaatgccatccttttcttattggaccggaaaaacgaagtgggaaaagcgccagaaattggacaagttggccaatacaaattatggtaatacagaataaccaaattcaaataaacaatcaagaaacattggattaattgagtttaattgatttaattacagggaattttcaaagtttttcaatgacacaaaaattgaaaatgaaactaatttttcctatcaatttcgaattctgcgcataaaagaggacaaacaaagtgtcgttttgctcaaaaaattgaaatggaaaataaaagaattaattggacccatttatttgagcatattagaagttttgaggccaattgaattgcaaattggtgagaagaaataaactaaaaatatttataattttttatttttcatttaattttaattttcatttaattttaactttttcagatacaatttttgacgaagaatatgccacagaatacgccatgattctttctacggatcgccaaattgcaaaacaggccgaatttcggttgtccattcgcatttactttagtaaaatttggaacaaaattttggacgcaaaaatttccaaaaatgaaatggaaaaatgccgaatcgttcacttttgggatggaggcgaattagtgcaaatgacccaaacatttattcattatgaggagaaagaaaccttcgagaaaatattcgaattttccgctaaaattggggaaaaaaacgaaaaggaaaaaggcatcgaaaacaaaagcggaaaactgaagaaaaaagcatcgaaaaagggcaaaagccgaatttgtgatgacattttggacaaagttcgaagcaatttgctggacacacacagcgaattaatggccaatttaagtggggaaacgaacgcatttagcaaattattgaaaaactcgttggaaacggagaagggagccttggccaaactgtgcgacttttattcggcaaaaaatttaattggaaatgacaacaaaaagtgctcaccgaattcggtggaagtgatggcaaaaatggagcaaaaatacccaaaattgacacaaatgcttcgaaacagttagtttaaaaagaaaaaaaaagtaataattaattaaaattgatataaaactaattaaaaaattataaaagtgaattaattcagaactgacagatgagcaaattaagaaactccaaaataggaattatttaaaatatttaaacgaaaaaagtgaacaaattgagtggacccgtgccaaatttatgatggacattttggcacattatcagatgtaacaacataccgtttagtcttttttagtacaaattttaaatattttagtttcaaaaaccaattgaacgacccaaacaatttgtcatttcaaacggaattgatcgaccaaaatatgggcacaatggaattgtcgatggactcgattagtgtaattaattcggtcaaagaaattgagcaattgcagggaaacctaattacacaattaaaaaattcaagcaatttatttcctgagctaaaacattcacttgccaaaggccacgtcgaaattttgaaaaaactttgcgcagaaaaagaattccaaaatcagttgagaggcaagtcgaaatttagaaaagaaagttcactttcaagcaatgcatagatcgtaataaa

SEQ ID NO: 81967 - DNA, 686 bp, Heterodera glycines
  Genomic contig location: Contig_ID=SeqID_316; Location=821..1506; Strand=-
  SCN-specific regions: Sequence locations=1-7,29-250,272-423,484-686
atgtttgcaaataaactgtttttgttgttaatcgccgctttttcactttgtgtttttggcattgactttggcgggacgaagcaaaacggggcggccaagggcaaattattgtgcggaggaaagccatacaaaggggccaaagtgaaactgtgggacaaagacacgcgtaagtgatcagcaaagtgatcagccgatttgtgatcagcagcggaaacacgcattgccaaactaagaaagaaataaaaaatgctttttgttcctttttaaagttgaccccgacgatttgatgggcgaaacggagacagatgaggagggcaaatttgaggtgaacggttcggaaacggaagtgagcgacatcgacctgagactgagcatttaccacaattgcgaggacgaagcgaaagtccaattcttttttttgtgattttaatttaattaatttaaaacgatttagcaattaattaattaattttaaataaaattgctttaggagtgccttcgccgcattgacatcgaaatcggcgatgagttcatttctcgcctaacggactcagacaaagcggaaaaaatgttcgacgcgggaattctgaatttgtccgggcatttcccaggcgaaacgcgcgaatgccttcagtcgaagaaataaacataaaacaacaaaatgtgaggaattacaaatgaataaa

SEQ ID NO: 81968 - DNA, 447 bp, Heterodera glycines
  Genomic contig location: Contig_ID=SeqID_316; Location=1685..2131; Strand=-
  SCN-specific regions: Sequence locations=1-249,271-447
atgcagggcgaaaaactgtcgaatttttcgaattcatctgtcacgtataaggcaattcaggcccaagctataaagacccaagatagctcactaaaatcgccagagtctgaaggtgtgctctttctccatcaaacactgccgggtttcggtactctccggcccgctacagactcttttttgaaacatggtcgaaaattttcccaaaaagtttctgaagaacttttttctatttcagtttttttaaattattcaaaaacggacactcatcagtcccttgaattctcttatatttttccattgttcaaaagttaaacctgttccgtcattcgtttagaacaacaacaaccattcttcccctatcattcttattttccattttcctcctcccgcgcatccatcgccacattaattgattgaattattatttaattgtgtccttcaaataaa

SEQ ID NO: 81969 - DNA, 396 bp, Heterodera glycines
  Genomic contig location: Contig_ID=SeqID_318; Location=525..920; Strand=-
  SCN-specific regions: Sequence locations=1-182,204-335,357-396
atgcccgcggttaagccaaaatttcaatacgacgaattgctggaacccgtgcttgacgaaatcgaacatttaattcgcatttcaatgttttattttgacgagaatttcaaacggactgaaagttacaaattgaaaggcttttcccaattggaaacgaagccaattttgctgaacgaaaaacagttgaaatattttcaaaataattttcagaaaaattcggaagtgaaaattcggaaactttttgaggtgaaaatgagcttaatgttcaaaaatacgaaggaaaatgcggagaaggagaaggtcgaaatggaagaagaaacggacgagcaaaagtggaagaaataccgaaacaaatttttgggatttttgaattcgccattcctcccaattgtgtga

SEQ ID NO: 81970 - DNA, 154 bp, Heterodera glycines
  Genomic contig location: Contig_ID=SeqID_318; Location=1173..1326; Strand=-
  SCN-specific regions: Sequence locations=1-154
tgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaacaaatttgaagaa

SEQ ID NO: 81971 - DNA, 372 bp, Heterodera glycines
  Genomic contig location: Contig_ID=SeqID_318; Location=2487..2858; Strand=-
  SCN-specific regions: Sequence locations=1-55,77-132,155-245,267-372
gagagagtggagcagttgtgttggtttgaagaagaagcattccttgcctttgtgaagggtcggccaaactttgacaaattttacgagaaaacggacgaaagcatcaagaaaaaaatggtgcagtacagaagtgaattgaaaaatttgacatttgaccaattacgggaacatttggcacaaaaatttgcggcacggctaagcgcggtccatttattgtggcaaaattggaactgtgccaatgttgtggaggaagtgcagggggaggaccgggcaaagtgccaaacattccgccgacatttggacattgtgtacgaatatctgttcagagtgtacgtcgaaggtaacgggagggaaggaagtgccgaaaaataa

SEQ ID NO: 81972 - DNA, 957 bp, Heterodera glycines
  Genomic contig location: Contig_ID=SeqID_2856; Location=431..1387; Strand=-
  SCN-specific regions: Sequence locations=1-61,84-156,178-766,788 -925,947-957
cttattgttagcaaaaataagaccaagagccataaaattccaattacacattcataaattgttcagtgttttgacccaaaattatttccagcggcatttgctgaagaaaaacgaaacattgcggctcacctacgacatgctgagacggccccatcacattggcaagactttcacattttttgccaattaactacgaatttggcctttttaatggccggggaaggaaggcgttttatttccgagattcaaatgtcacaaattgaattgtcttttgtcccattttaggcaatcacaaggcgtggatggcgtggaacacgcagaacttgaaggagttcgagcagcagccggggctgaccattgctcaggacgaaatcatccggcgcttctgtcgcgcgctgttcttcgaatttttgcccgaaattgcggggcccaccgaagtgcgaatttttacataattaggggattttgccatttggataatttaaaaaattggtgagttttcaaaccaaaatgaaatttcgaagtaaaaaatgagaaaccggggaaaaatgaagccgaactgaaattcattggttttgcgttcagttggtcatcaaacggcgtggcaattgcgcatttgtcaccggctttctctgctggaatgaccgaaccgtcgcaagccaacgcaaagtgagcactttttgggaggggcgagggaaggaattttaaaattacgggtcaggggcattcggcaacttgaccagaacccggttcagggctaatatccggtttttctgggtcttggtctgggagaatttttccaggctcacgaaaatttcaatttccccccccccttttcttcagttgtattggctgtggggcttcaccgaggaaatcctgtccaatctgctaaagcacccgctgaagttggagctgcaatttgtgcgcagtttggaccatttgatcgtggccaatatt

SEQ ID NO: 81973 - DNA, 1363 bp, Heterodera glycines
  Genomic contig location: Contig_ID=SeqID_2856; Location=6898..8260; Strand=-
  SCN-specific regions: Sequence locations=1-72,95-164,191-210,234 -412,439-550,573-1086,1108-1151,1175-1221,1251-1260,1282-1363
  Gene Ontology: Mol. function=pre-mRNA splicing factor activity; Cellular component=nucleus; Biological process=mRNA splicing
atggaagcccagaaaactgggaacggggaaatcaatcccttggttttttaaaaatcaaaaagccgctttttcaaatttataatttaaattaattgaaacataatgccaatataatttttttcttctggactccaacggcgcccccacaaagtgtccaagccacgaaatgtccaaaatttttcaaaatttataaaaacaaaatgagtctaatttaggatttttagggttttcggggtcgctgaatacgaatataccctttatattaccccatgcctaaccttaggcccatctgaataataaaaaactcaaattcgagacttggacatttcgtgggctggacattttgtgggtcagcgactccaacagttttccggaatcattcctcaattttagattactttcctcggcatttcctaattttaattttaatttttgcatctttgtgtgcaactgatcagccatgaaatttcattcagccgataacataaacaattaactaattacctaattttaatggaattgccggacccgtttctgccaggcgcagtttcactgctggaccaactggacaaaaagctggtggttgtgctgcgagatgggaagacactcgtcggttatctgcgcacccttgaccaggtcaccaaattatgaatccgtaaattaattttcaattcgtcttcccttcagttcgccaatttggtgctgcacgaaacgctggaacgaattcacgtggacgaattttatggggacattccgcgcggcattttccttatccgtggcgaaaatgttgtgctggccggcgaggtggacgacacaaagccgaacccattcaaaaaggtgggaccgatttaagcagggaaattggtgaaaatttttcacaatcagagagcctccatttcaggaatattttcagatttctaatttagacctgtcgctaaattttaaaggaacaacgaacagaattatttcttccacacttaattttgttccttttttcaggtgagcatggaagaaattctccgacttcaagccgaaaaagtcgaacagcgtcagaaacagcagaggaccaggcaagaactgatgcacgggagtggccagcagcaggcgaagtcccacgcggacgcattgatggacgaattttgctaattcccttaattctaactaatttttaattggctgattttaacaatcagccaactttgtttgttacattatgtttcaatgttttcattttctaatttttgattttcttacaatttgtaacttataatttataattttatcagagctataaatgtttccagatttacgtaatttcagttttatccatttggtttcctcgaattccaattattttaataaa

SEQ ID NO: 81974 - DNA, 1045 bp, Heterodera glycines
  Genomic contig location: Contig_ID=SeqID_2856; Location=1930..2974; Strand=-
  SCN-specific regions: Sequence locations=1-124,146-622,646-687,709 -787,825-1045
atggcctcccgtggacgtggtgtcattgtgaacgtcgcctccgcggccgcccgttgccattggtattactacggcgtctattcggcggccaaggcaaaatttttgggggtttatttcgaatgccgaaatttgtgcgtcattaaaagtcccgaattttggcgatttcgggattttctattcctggcattcattttttcattttctttcaatttttctctcaatcgcatttacccccccccccaatttttagcatttcattgtccatctgtccgccattttgcgtgccgaattcgccccctctctgtgctgtggtgccggcccaaagagtgccaacattgtcatccagtccctctgccctttgttggtgtccaccaaaatggcctcgcggacaaagggacggccctcctttttggtgccgtccccggcggcctacgcgcggcatgcaattcgaacggttggcattgtgtcggacacgacgggccacccgatacaccaaattcaggtggatggattggagtcgcggggactcggggctaggactatacacagactgggcttcatctccatcagtcccctcctcataatttcgaagggcttttaaaccttgaaattctaaggagctccattaaaaacaaaatatttttggggaacaaatctgaggtttttgccattctggtgcaaattattccttttatttcatcaaaaaactccgtttatccttttgacatatttttttagattttggggtatgtgcacaaaatccaaaagtaccaggaaacgcatgtgcttttggaaaaagaattttatttcaaaatgactgaagctccaacaaattgttgatttttttctttttttttcaaaaaaacgtctgttttcccaggctgaactgctcttccagtgcattccgtcgccccttttcaattggctgatgcgcaacgaatcgcacaaaaggcgcgcgttggcactcgccgaacagaaaagcgaagcacaaaacggcaggagggaaaagggcgaggaagaagaagaagaagagaaagacggatga

SEQ ID NO: 81975 - DNA, 1521 bp, Heterodera glycines
  Genomic contig location: Contig_ID=SeqID_2856; Location=8347..9867; Strand=+
  SCN-specific regions: Sequence locations=1-450,473-567,589-1445,1467 -1521
atgaataatgaaaatgtcaataatgcgatggttaatgacacccgcgtaaatgtaaatgacaactgtcagaatccaaatgatacccgtgtccatgtcaatgacactcggtcggtttttgcctcaattaacccgttgaagcgtcgcgttagcttccgcgacattccgaacattcggcaagttggatgaaaacatttaatcagtcgactatctaatttagtgagtttgagcagccttcttcttcctctactgcaccttctcctttgccttgtaaattcataacttaatcaatttgataagatttaatcccttttcttttagccgggtttttggacacaactcataccatttttaaatcgttgatggtggcgcaaacaccgaccaaactgctgaaggtattttcttttgaagaagaatacattttaatttcttaagacaaattcacgtttttaaggttgatgaggtggccaagtatgggtcgctggacgaacaactggacgtaactcatgtcatacaacacactccgtttcgtaatcgtgagtttttaaattattggaccttgtgtccctgaatttcaataaatgccattcaagtgaaggtgttgaatattttacaattagtcactttttcaggccaccaaagcccgttgctgcttgatgacctgacgaaacaacatgcctcatcacttttgtttggctctcaggtaaaatttagaaaatgaaaaaaattttctttttaaaaaccttttaggataattacggacttgacgaattgtcggaagatgctcgttcgatgaatataagcattcagcaacagcaggtcctatcataatgttactagtaaacatcctaaaaggattattggctctttctttaaggtcgctatttcactcgtcaaatccgctgctcaaacgtcggcgtcatccgccgacgcgatgacaatgattacggaaacgccgaaaagttcgcactattcgacggtaaatttaggcattgattttcacatttaaattttagcaaattttgaatttgcaggccacccgaaccgttcctattgactttgaggatgagcgcgtgtccgaatctccgcaacttccgcctcctccgactgtgccaattccaatgggccatctgaacgattcggagtttgaacagtggcacgagacggaaatggacgaggcaatggaagggtattgcgacgctgtcaagcagtacacggacaaatacgggtgaggaattggtggtgggatatagaaaattgtaaaaatttaattgcatcgttttttcagccgtttggcagcggagaaaaagcgtttgttgagccaaatcgacgcggtgaaagagcgcattttcaaattccgttccgatttttccgaggcgtaccaacagaacgaggagaagcggcgtgcgttgtgtgccgatttgacgaatatttaacgggggagaaacaacaaaaaataattcttttaatgtgtgatttgcatggaatgacttttttgcctcatgtgctttttgtcttaatgca

SEQ ID NO: 81976 - DNA, 1513 bp, Heterodera glycines
  Genomic contig location: Contig_ID=SeqID_2856; Location=4651..6163; Strand=-
  SCN-specific regions: Sequence locations=1-67,100-602,624-638,662 -755,778-806,829-1287,1310-1317,1342-1513
  Gene Ontology: Mol. function=ATP binding; Cellular component =mitochondrion; Biological process=pyrimidine ribonucleotide biosynthesis
atgttcaaagtgatttttgtgttgggtccgcccggcagtggcaaagggacgcaatgccaacgcattgaaaaggtgggcaaagaaaacatggcattttgatagtcaatccccttatgattttggttaatttctttccatttttttaaaatgatcactctctcccgttattttaagaatttcggcttcgtccatttgagtgccggcgatttgttgcgcgaggaacgccaacgggaaggctccacctttggcgagctgatcgaccggcacatccgcgagggcagcattgtgccggtggaaatcacgtgcaaactgttggaaaatgtgcgttttgaggacattttattgacagaataaataacctaatttgctaactgttaaaaagggcaggcattattatgtgccggcacggtcacataattagggaagatgtttcaccaaacaaatttgtggacattttctcgtcaggcaatggtcgcccggtcggacactgccgccggttttctcgtcgacggattcccgcgcaacaaggacaacttcgacggttggcaacgcgaaatgggcaccaatgccaaagtgctcttcgttctgagcatccaagcgccgattgaggcataaaacactcaaaaattttgatttacgagatttcaacagatttgtgtgcaacgatgtctaaaccgtggccaaggccgaaccgatgacaacgaggtgaaaagtgggaggggaggggtgatgctattttcaaaattaggcggagaaaaatttgtgaaattaattaaagagttggccaaaattttcaggaactacacattttttaaaaattttgaattgccaaattattttaaatgaattgatgtcatttggtaagaatttgtttcctctgttaggagtcaatacggaaacgaatcgtcacttacaaccaacaaacggtaccgatcattgaccattacgcgtcgctgaatttggtgaagacggtggacagcaccaagggaccggacttggtcagtcagtgtttcttttttggagttgaattacgaagttttctccagtaattaaggggggcgagggggaactgcaactgatcacaaacttatggactttcataattattgtcggtgttttggagggggggggggaaatcgaattttgagacagactccactgattttgagtcgacaaaagcttcttgctcgccacaccccttcaataattccgttttcctcattaaatttggcctttttagtcttcctttttcgttaattgctcaacttgactaattcctggccgaacaaaagttgaaaattcaaatttttacgcacgccctttcctttttcccatcccaaacccctgctaatttgtgagtgccatgggaccgaacccatttggaaatgtcggactgaatcggaataacctcctgatcagtgcaactgtgatttgctaggaattcgtcaaattggcatccgttttgcaggttttcgccgaaatacgtgctgtgtttgagcagtcgggcattggc

SEQ ID NO: 81977 - DNA, 650 bp, Heterodera glycines
  Genomic contig location: Contig_ID=SeqID_2857; Location=119..768; Strand=+
  SCN-specific regions: Sequence locations=1-574,596-650
gaaaattatggacttgacgaattgtcggcagatgctcgttcgatgaaaataagcgccggtgcgatgacaattcttacggaaacgccgaaaagttcgcaccattcgacggtaaatttatgcattgattttcatatttaaattttagcaaattttgaatttgcaggccacccgaaccgttcctattgactttgaggatgagcgcgtgtccgaatctccgcaacttccgcctcctccgactgtgcaaattccaatgggccatctgaacgattcggagtttgaacagtggcacgagacggaaatggacgaggcaatggaagggtattgcgacgctgtcaagcagtacacggacaaagacgggtgaggaattggtgggatatagaaaattgtaaaaatttaattgaatcgttttttcagccgtttggcagcggagaaaaagcgtttgttgagccgaatcgacgcggtgaaagagcgcattttcaaattccgttccgatttttccgaggcgtaccaccagaacgaggagaagcgccgtgcgttgtgtgccgatttgacgaatatttaacgggggagaaacaacaaaaaataattcttttaatgtgtgatttgcatggaatgacttttttgcctcatgtgctttttgtcttaataca

SEQ ID NO: 81978 - DNA, 884 bp, Heterodera glycines
  Genomic contig location: Contig_ID=SeqID_17473; Location=366..1249; Strand=+
  SCN-specific regions: Sequence locations=1-200,223-812,834-884
atgcacgttgatttcgatccttttaaagttgaatggtcagcattaactcaaatttctccagaagtagtcgtccaatacggtggttataatgtgttcagaggggttccatacccgcgcggtagtggtatcgggtctgtttttaggagtctattgcgttacctaataccaatcgggaaagaaatcgggacagccatcgggcgccaaggacttgaatctggaaatcgagttctatccaatgtattagagggtagggacctcaaagagtcacttgttagtgagggaaaaacggggctcaaaaatttgctagagaaagcagccaacaacataaatgcccaaaaaggtcaagggttcgacttcaaacgatacacaaagagaaatgatgcaagagaaggtggtgcaattggtaaagcgaaaaaaggtataaataaactacaatcaaggttgggaccacacgatttcctaccagcaaacaccccagcaggtcggaagaaaaaacacactaaacagaaatcggtcaaacgccttcgtaccgatatacttggaacctattaataaaacaaccccccagaagcacaatcatgagttgttcacaaaaaattagcgaaagtagtccccttgccacaaatagtgctttgaacattttttcagtacctccaacaaatgtgtcggttgtgcgctcatatttccgtgaagtcctccccctagtgacaataacgcaagaatctccgtatctttttcgcctgtacagtgacaatctttggaccgatctttcccggatttatctcttccttgacctttcaatagaaaaaccggatgtggacggcaactgggtgtcaatcgcagctaccgatgctcaagtcggcaccattcagggaattggttaa

SEQ ID NO: 81979 - DNA, 1052 bp, Heterodera glycines
  Genomic contig location: Contig_ID=SeqID_17473; Location=1580..2631; Strand=+
  SCN-specific regions: Sequence locations=1-386,408-981,1004-1052
atgcagacattgaaagcaaacgatactaccaaataccgcgttagagtccatgacgtaaaactgtatgctaaaatgattgatgttcagtcatctttgaatttaagcatctacaaaacgcttgaaaaacaaccagccacatatgcagtgcgaaaaactgaaatcaaatcatgctttataagtgaaggtaggtttgaaattgactacaatgtattcagtgcaacaattcctcgacgtatgacaatcgcacttgtcgcaaacggggcatttaacggaaattatgctatctctccatttaattttaaaccgtttgacatacgagacattgcagtgtacgctggcggcatgatttacccaattgttccatacaagcttgactttgccaaagatatttttgtccgtccttttgttgacatgtatgagggaggcacttggcatggctaattcagagcgttctttcgacatcacaaaagagcaattcaaatctggttggaccttttttgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaattaactgtataaataagatgcataatgcgaaaaaatgccaccataaaaatgaccttcttaaacactacagtcaacgccagtttaaagccagagatacaagtactaacatttgaaaacaaaagcgttcatcctaacctcctcgtgcaacttctattgcttgcccattatctcattgcttttcccgttttcattttatgctggtattctttgataaattttcttaagagaagaggacatatttctcagcgtgatgccaatgagatgatggatgatttgcgaaattaccaattaccaaaaaattcatcagttatttttccaacgccccccccccgattcccgcccttcaaaattttgaaaa

SEQ ID NO: 81980 - DNA, 914 bp, Heterodera glycines
  Genomic contig location: Contig_ID=SeqID_17475; Location=1814..2727; Strand=-
  SCN-specific regions: Sequence locations=1-27,50-335,357-567,589 -878,902-914
gaagtatgttggcagataaagtcgtcattttcataattggcaacaaaatcgatttggcacggcacagaacggtgccaaaggaagaggccaaagagtgagtggaccaaaaaaaaaaaattttgtttatcgatggcagaaattttcttaccatttttttagcgaaaaatgaagtccggtggtgccattaggcaaagccaggaaattcttcaaaatttatggatttgtatatatttttaccaaaaattatgtcttttacaaaaactatcacccaataataggcaaaaattttattctgactttttgaggtattctcaatccatcggagccaatttctgtgagtgctcagccaaaaccaacgaaggggtcagcgaactgttctcgaagttggcaattggtagcaatttgactttatttttagtggggtatcttttcccctgcacttcccccagggggtcccagagccactggtttcgagttgaataaatttttggcaatagccctcaaaaataattttagaaaatcgcttaaaaaatatccatttcgtggagggggttcgaatcgtagccttttctctttttatcttacaaaaaccactcagccatacacgcaaatcttttcggtacagaaacacattttccggatgatgtgttttgcattcatttaaaaagattatcatttagaaatgttaaataaatcttccgaagagacggaagacaccgatggaatcggcacgactcctttccaacggcattacgggtcgaggcggagccttagaattgcggacgaagatgaaacacatgcggaacggaaacgacgcggaaaatgttgccgatgatgcataaaaggaaataagatagacgagcattccaactaattgtattatacttatggacaaagttctataaatatttacg

SEQ ID NO: 81981 - DNA, 1760 bp, Heterodera glycines
  Genomic contig location: Contig_ID=SeqID_17475; Location=1..1760; Strand=+
  SCN-specific regions: Sequence locations=1-179,201-253,275-363,385 -638,660-884,906-1634,1659-1760
  Gene Ontology: Mol. function=pseudouridylate synthase activity; Cellular component=cytoplasm; Biological process=pyrimidine base metabolism
gaaatatgagacgagaaatcaacaaaatctcgagattctgttcattttttagtttttctttcgtgcattgctaaagacaaaattggtggaaagtcgcgagggttgcgaatggacgcgttgtggcaggacggaccgcggagtgtccgcttttcgacaggtggcggccgttactgtcaggtggggacggagcggcaaaggctttgtggatctattgcagtttattcgaccataaataacacgacacaaatgacagaacattcaaatttaaaataatgttgaattcgaaggctaactcttagatagctattttattctgtcaaaattaggtcgacggatgtgtcttcgtttgacagtttttggagtgagggaaatgcggagagaaaagacagaatcacttccaccgtcgaattgtcctacgtaaaaatgtgaggatctacaaatttcggacttctttcaaacttaaggctcaacggcgttcttccccattccgtccgtgttctcgcctttgccccggtccgcaggggtttcaggtaccgttttcgccctttttctattccttcgttcggtcttttcagtgctcggttcaattgcgttcagcgtgagtacacttacatttttccgcgtactgccattgccgacctttccgtctgtcctctccaaatgatttctcaatttgttgcctaattaagtggctaaacgatgcttgcgcgcgactctgtggcacccacgactttcggaacttttgtcacatcgatcggaatgagaagagattggccacttcatacgtcagaacaattaaggaggctcgagtggaccaattagggtgaaaagtgaatttattttaatgatttacattaattcgccattttaaagaaagggtaaaatgaatttcagcagttcgtctcacgtcgcttcccttgtcccctcaacgtctgctgaactgtccgattcgttccaattgttgagattgaccgtcaaggccaatggttttctttggcaccaaatccgttgcatcgtttccctcctttgggagatcgcttgcggcaatgaggagcccgaggcagattttcattttaagtcaaatcttagaaacaacaataatttaatttagctgatcgacgatttgtttgacattgagaaatttcctgctaggtattttccttttttttattaattaaaaacacaattaagaggaatgttccgatttgtttaggcctcagtacaaaatggccaacgaattgccattgtgtctgttcgactgtactttcgacgaaccgattgattggaagttcgatttcattgcgttgggttcagtcgtaaatacccttcagaaaaaatgggctgaacatcagataaagttagtttcggccggtttcatgcgcccatgacattttacgcgttccataaatggcacatgaaatgctgtaggacgtgtaaaatgtggcatgggatgcgtaaaactgaccagtgccttaatttctgacaaaagcgtgttcataaagttcctttattagagcggcaaacattaaagaaatgttggatggacttaattttcacatggcaaattcgcccaatggattggatgagtttgtgcgcaccgaacccaccccgaaggtgccccgccatattttgctcacattttataatttttcagaaattcattcccatacgaaaacgttcactttgcgagggattggaagaacgaagacgaaaagcacaaaagaaaaagctaaaaatgggaggaacggatggaaaagggg

SEQ ID NO: 81982 - DNA, 455 bp, Heterodera glycines
  Genomic contig location: Contig_ID=SeqID_17476; Location=154..608; Strand=-
  SCN-specific regions: Sequence locations=1-1,23-305,327-405,428-455
  Gene Ontology: Mol. function=regulator of G-protein signaling activity; Biological process=regulation of G-protein coupled receptor protein signaling pathway
cagcttgattttgtcctcgttcgaattgtccaatcggctcaattgcgtactcacaaatatttccgtgtggctgtacctcaagcgatcactggccaggcattggtgcagcatatccaagaagtcttatcagtggaggacaccaatgaagcgtaattaatttatctttttcggtcatcagctcaaagtcttggcttttttaaccccccatggttatttgttcacccccccccctccgtttttgtggtttgatactcatataactgttcaactcgctaattacactgcgaatatcttttttaggctacattttgcaacaattctgcttcattttggctacctttttcccgtaattgacgtccattctcaagctgtcagagaagacaataccctctacagaatacaactcccttatttttggccttcacatgcccatcaggcggacaatgtggaatatg

SEQ ID NO: 81983 - DNA, 204 bp, Heterodera glycines
  Genomic contig location: Contig_ID=SeqID_17477; Location=668..871; Strand=+
  SCN-specific regions: Sequence locations=1-204
  Gene Ontology: Mol. function=NADH dehydrogenase (ubiquinone) activity; Cellular component=membrane fraction; Biological process =growth
atggcgctaagctttgcttctcgtgaggatgccattaacttttgcgagaaaaatcgctggtcctatattgtcgaagaaccaccggttggctttttttattgactatcatcttgatctggcttgttttagagccgtgaaatcaagccgaaggcttatggttccaatttttcatggaacaaacgcacgagagtcagcactaaatga

SEQ ID NO: 81984 - DNA, 132 bp, Heterodera glycines
  Genomic contig location: Contig_ID=SeqID_17477; Location=1267..1398; Strand=+
  SCN-specific regions: Sequence locations=1-76,98-132
atgtctgctattaatgttcttgaagcgatgaatttattgaagccggaacaagtaactgtgcagaatttgctgattgaaaatggacaactcattgaaactgtggcggaatatcagcggatgggcaaaatcgtt

SEQ ID NO: 81985 - DNA, 2889 bp, Heterodera glycines
  Genomic contig location: Contig_ID=SeqID_17478; Location=34..2922; Strand=+
  SCN-specific regions: Sequence locations=1-214,256-274,318-386,418 -450,485-665,687-1077,1112-1466,1499-1635,1675-1747,1769-2163,2187 -2506,2533-2605,2627-2889
aattcgccctcggctttggtcaaagtgagagctacgctactgaattctattatgacgaaaagctcgaaattgctttggccagtgaatataagcaaaaattcttttgccaaaatgacaacgaatcgttgccaactgctgaagtgatcgaccaaattctgctgttgactttttcactcgcactgcgcttacaatttaatgcaatgtcagcattttgttttaaatttaaaaattaaatatttaaataaacattatttagatttgctatttatccaatgtttgacatttttcactccaatgaaattaagcattggcaagtccgaacccttttgactgcgtataaacaattatcaaatgctaaaggcatcactgaacatgggtaattaagcaaattaattaaatattaattacattaattttgggatatttagcgtttttccttttaaactttcccaactttcggatgacaaaaaatatgcttattggttgttaacatttattgaggaggaacaaccgacgaataaacaatacattggtatgaaaataagagaaattaatttccttgtaaatttcagaaaatttcaatttcatcataaaaatttccgaattttcattgtctcctttcgatgtttacaaagtgctcgaggcaattctatcgaatgttaatgaaaaggaaaatactgtgcataaaaatggatcagcagaagtgccaaaactgtacgaatttgtgagagaatatttcaatgccaaattaaacagtgaaaaagcatcaaattctcccaaaagtccttctttatccattgattgtgtgctcgtccatttgggctatcaattgcaaatgaatgcttaccaaaaattcagagaattaacggagaaacaccaaagaaatacaaatgggtgtgcaaaatggagcaaggacattttggaaattgttgatctctatgagtttggggaaggattgggatacaggtaaaatgaagaacaacgaaaagaacggaagaaattgagggggaaaagaaaagccattttataggacatttgttcgctgatgtgacgaagttacaaaagtatcaatgacagtaatatttaaattaatattatttaaattttatttgcagaaaatgatcatagtcataaaatagcaaaagctaatttaattaatcaatcatggtattgaaaggagctctacatcgcctctattatcttatttaatcttgcaaaaatttacaaaaagttgtaaccaaagaatttttttaaatttaacagaagaatagagaaacctgttctatctaatcacataaagaaattaaaattagttgtttctgaaaaagttactaaggaattaaatgtgttatatgtttatggtcatacaaaaatgtcaaatcgtttaaatgcgtgaaaattgttcaacaactcttaatatgattagatagaggaaagatttctccattattctgtaaatttcaaaattttattgaattttaaaaaggaaaaattatttagtctaatttttcgaatttttttcgttacaacttttgtaaaaaattttgctagctttttaaaaaatacatacgataggaggacatagagctaactatcttccaataccaagattattaattagattaagtttggctaggtatgtttattttctgaaataaaaaagtaataattaaacttagatattattatcattgatacttttgtaacttcggctcaccacgcattattcattcaacgataataaacccaattggaaaaattcatttttcagctttcacatataatgttcaccattttaggatgtgctcgactgaaaaaagataaatcttagagaaaaaaaattttaagattttcaatattagacatcctccagaaaatggcaatttattcatgtttggtttagaattgcaccagttgagttagaattgttcaacgagccaatacaaaattatgcgaatgcaattgaaattgacacacatcagtgcagaggttaaatacattcgaatttgtaatttgagacttaaaataagctcttctcgagaccaaagccccagcaccggaagagataactaattacccccttaatgactgacatttgtccaaatgagtggcagagaaaataaaaaaatagactgacttaattattttgagtgaggtgagtaaaatatttccttggttttatttagcattgactcaatttgccaacgacgcattggacaaaatggtcaaagaaaacatcgacaaaaatgagcattttgatcgattacaaattgtccttcaaattctatctgaaatgaaagacacggaaaattatgaaaaacttaaaaaattattggaaaattttgaacaaaaaattgcaaacgaaaagaataaatcgttgctaaaagagccaacgaaatttctaaggcagttaattggggaatacagctgcaagggttattgtacacagatcaacggaagagggaaacgtgacttcggttccggtcttatgatgttagtcaaaatcccataaaatgaaattttatgatataattttgctcaaaatcaccaaaattttaattctttatatcattgggtaaatagagagagaacactagggctatcgaattttacgaagattttaaaagttgattgcttttgagcgaatttatgaataaatttttgtgaaaatatttgcattcgaaggtttttgactaatgtcccatccaattactacagatcggtgaacaaaataatgccaatatttggacaaattttgatcgaagccctcaaaaaatcatatggtcaaacagtggaatataatgtgaaggaacaaaaactgtcatttccatcggaattgggcgaacatttgctgggacgactcgacgaaatgatcaaaatgttcgaaaa

SEQ ID NO: 81986 - DNA, 225 bp, Heterodera glycines
  Genomic contig location: Contig_ID=SeqID_17482; Location=75..299; Strand=-
  SCN-specific regions: Sequence locations=1-225
atgggcgagttggagccgtacttgctgatccgtcacatttgctggggcgaatctccgccaggggaggtcagccaatggaaaagcaccgctttacgggtctgtgccaattttcagaattgtgccctcctctcgcgcatggaccttcagccgacgcccgccgcgaaaatgcttccgccgatcattttgggcatggacagtcaattgaaaacgatagtgatgtgctga

SEQ ID NO: 81987 - DNA, 1180 bp, Heterodera glycines
  Genomic contig location: Contig_ID=SeqID_17484; Location=91..1270; Strand=-
  SCN-specific regions: Sequence locations=1-176,237-329,365-457,484 -667,691-726,775-818,843-1003,1032-1180
tcagtcgatgtggccaaaagaaacgaatcatccgcctttggccatccggaccaaggaatacggaggtaaagctggatgatcattgagtaacaaacagacgggcagatgggcggaaggaatgatcagagcaaaagtgagagggactaaagtgatcggacgaggtgagaaaagtgatcagagggaagagagagtgatcggaagaaagagagagagagagtgatggaaatggcgagagaattaggaaaaaaatgtatgccaatccagtgatgaatggagttgaatgcgttgattccgacagaaaactaattgtttaaatgaaaattcgaaagaattttaaattttatctaataataattgaattaaagcataaatcaattgttcctttattcaaagatctctttttaagcttgatgagaagtgctatttttactgacgtgacaatcgggaaaacgaattgaatttttaattattttatatatatttgaatgcttcgttttattgtttacgtttaaataaggcataattaaaattaattcgttttcaaatgtttaaatgggtcctcccttttgctaattggatttgttagagcgataattttgcttatttaaatagacaaataatttgttaaattgcattcaaattttccatccattcatcatttaccaatgtttccccaggtttttctttttcccataattcttttttgcgtttcattgtcagtgagtttttcatataaattaattttacttttaatttaatttaattttttaatttttatttttttcagaatgtttcgtcgtcccatcggcgatttggacatttatctgaaaaaattgaagtgaattttttaacttgaactatcaaaatgggtttttccaattagcatcacgccaaaatacccaccatttttttttctttgcaggattcgcaatatgatttccacgctttgaaagagcgaaaaagattgggtcggatggatgaggaaaaggtaaatgaacattccattaaataatagattaattattatttttcatagctttttgctgcttctgaagagggacgagaaatggaaacgaaagtttcggaaatgaaaagcatcagaattgggcaagaatacgaaatgcaattggcaaaatggctggacgcgtgcgacatgcgaccgctgagaaagccaattacg

SEQ ID NO: 81988 - DNA, 1692 bp, Heterodera glycines
  Genomic contig location: Contig_ID=SeqID_17485; Location=324..2015; Strand=-
  SCN-specific regions: Sequence locations=1-1181,1206-1429,1452 -1589,1614-1624,1652-1692
atggaaggtgggacagaagatgacaaaagtgaaaaagaaaaagtgagtaactgttctcatcgagaagaaaaagtaaaagaatacggaccaattgtctgtgctgccctcgtctgtgtgctcggtaagaaaaccgaaaattgggtactgtaaattgggtactgaaaattgggtattttaaattgggtacagaaaattaggtacagaaaattcggtaccgaaaattgggtactgtaaattgagtactgaaaatgggtacagaaaattgggtactgaaacttgatactgaaaattgcgtaccaaaaattgggtactggaattgggtaccagcagcagttccacattttgtgtgtaacacagtcccagcaaagggcaaagggcgaggcgtacaagggatacggtagataccacacgccctgcccccgcctccccaaatccatcgccccataaaagggaaaattggataaggtaccgaaattgggtaccagcagcagttccacattttggtgtcacacagtcccagcaacgggagagacgtacaagggttacggtaagtaccacgccgcgccccccacagaaaaaaataaaaataaatccttcgccccaaaaaagggaaaattggataaagagtgaaaatctgttatattcagaaaaggaaaagcacgtcttttatcagcaaacttgcaaaaatgaaaattcgaatacccagagagattgccaaggatatgggcaaaatggcgcaataaagacttttggtaaaggagattggaagtgcaaatgtgcaaaaagcaaggtcaaccaagggaaggacattggtaagacacattgttatacaaaccagggacgatgggcagggattcacgatttccgaaaatttttgggcctcggaatgccatccatctctgacacacattgatatacataatgcccaagtttgggaccggggcacggcacttcagcagcagggcacaggtacctaaccaagaggtgccatgacaatcgtacaaaaggcaactcgcacataggcttaggctaggcgcctaattagtactacttagaggcttatttaaaaaatattaatcgttaaaagctgcaaaattcaaaatttttcccagcggcgcatctcacaattagcagcgccggacaaaaaattccataaatttttttccaactaaatttaacgttttttgcgaaaaatatcttttgtttagaaaaaaagagatttttgaattccttgtaaattttggttatttatggaaagcttacaaatagcctccctaattatgtaacatttccaaatgggcattttctatgggtgaaaagcatcacatttatgaatgctatacattaaatttattacaattgaaaagtcattcttttcattttcagatttgtctgctctcggccttccatgtaagcttttagtgcaaaatttattaaattaaagaaaattatgcgaaaaaagtagggagcggatttatatggaaaaaaaatgcaaatgtggacaaaacgctgaaaatttgccaatatatggataaaaattcctcagaaatttggttcaaattttcacaaaactcttaagccattaattaaaacgaaaaaatatatatttgattctcgaaatatcaaaaatattatataaatttaaatatttggtgtctgaaaaatggattttcttttcattgggaaaataaa

SEQ ID NO: 81989 - DNA, 1338 bp, Heterodera glycines
  Genomic contig location: Contig_ID=SeqID_2858; Location=31..1368; Strand=-
  SCN-specific regions: Sequence locations=1-298,320-532,558-576,598 -629,654-831,936-967,990-1014,1039-1042,1069-1338
atgatccatttgcttacgcttacattattgctttttccaacattggcattgtcaaagctgaataccgtcaattttaaaagcgatgacattgtgctgctagatgaaatccgaggttagggttaactgggaaaatgaaaaacttgcgtaaatttaggtgtagcaggcaaccaaaaagaaaacaacgacaaaaacaggtagacatgaattttttttaaatgggcaaaatgttaggccttttatcccctttttcaatctcagatatgttttcagttaaacgacattaaattaataatggggaaaaattacatgataaaaagttcatatttttgtttaagactctcaaattcatcaatatagtcacatctttagttagccgacatttacgagtcctatttctggtttgaattatctaaaaaacatctagatttttttatctttgttttttttgcgttaagcagttgaggtgattgaaattttgggtctaaagttgggaacagcaatatttcagacaatttttggaattagatataaaaattcactttttgtttttcttaatattaattgttaaatgaaggtggaatttttaaatgaaattttgtcgctgagtagatcacccttggttgtataacaaaaaaaaaaaaaaaaaattataacaacggaatgagcctctgtgccaaagatatggtatgccaaaagttccactatttaggagataaataaataaaccaattattaataaattcacactgtgatcactggtctatcggtagtgcctttattaatgtttatagattagaggttcaagtcattcgcatgccaactgatttctacttttttaaaatttatgtttcttataaaattaagtcagaaatataaaaatattttttacaagtataaaaatataaccattttaaaatgataatttacttaaattagtgtttgaccacaaggagagcttgacaataataattatcatctcaaaaattaaatgggctaattataagaaacttgatcatattattaaaaaatattttttatgggtaaaaattttggcagtaaatattttaacaattggtactctataaatttaaaactagtccagggtaaatttcccaacaagaaaaaaaagtatgccaaagttaatttcaatgttagaagcattgaaatttattgtaaatccactttttcacaaaaaaaacactcatcctctaaaagaacaccaagattaaataaatcatctgttctgtactaaccaaaatcgatcacttttcagcgagttggccaattgggcggtggaaaaaggatgcgaaacaattcaaagtttggacaaatatttag

SEQ ID NO: 81990 - DNA, 382 bp, Heterodera glycines
  Genomic contig location: Contig_ID=SeqID_2858; Location=2444..2825; Strand=+
  SCN-specific regions: Sequence locations=1-382
atggacgcgcaacaacttcagcagattttggatgcggctcttaaaaaatcagccgaagtttttgccgccgcactcaacactcaaaatcaaaacccaaacgcagggtcatccacaacggcatcacttgcggcatcaatcaatgcccgcctcgaaaaattcaattataatccggaggttggacagacatacgatgcttggttgaatcgatacggaaaaatcgttcaacaagacggcgcttcgctcccagagcagtccaaagtccaacttttggtcggaaaattagacgaggaggaatacaaacggtacgttgacagcattgcccctaaagccaccgaacaattcaactggctcgaaaccgtggcaaatctgaaaaagatttttg

SEQ ID NO: 81991 - DNA, 2094 bp, Heterodera glycines
  Genomic contig location: Contig_ID=SeqID_2859; Location=2361..4454; Strand=+
  SCN-specific regions: Sequence locations=1-345,367-500,522-899,922 -2094
atggaggcaataaagccgattgaatttagccattgggccgcgccaattctggcagttaaaaagaggaatgccaaaacacgcgcgtgtatcgatttttccacgggattaaacgatgcacttgagcttcaccgccatccgctgccacgtccagaggacatttacaatgcaatcgcaggctcaaaacatttttctcgtctcgatttgcgcgacgcttatctgcaattggaattgtctgaggagtctaaaaagctgtgtacaatcaacacacaccgcggacttttccaatgccagcgtttaccattcggcataaaatcagcgcccgcaatttttcaaagtttgatggacaaaataattacacccatcaatggtgcatttgtctatctcgatgatgtgattatcgccaacacaactctcgaccaacacgtcaaaacaattaccaaagtttttgacaaaatcaaacaatttggtttccgaattcaacaggaaaagtgcagttttctacaaaaagaaaccatttcccttggccacataatttctgaaaatggctttcgcccggacccatcaagagccgaggctattcgaaaaatgccagcgccacacgacaagtcaacactacggtctttccttggagcactcacatactacggcaaattcatcaaacaaatgcgcgaaataagaagcccattagatgaattgcttaaaaaggatgtaccgtggaattgggaaactgatcaacaaaaatccttcgaaaaagctaaagaaattatgctttcggatttattgctgacgcatttcgaccccaaattgccgtcattgtggccgctgatgcttcaaaaggaggaattggtgcaacaatcagccatcaatttcccgacaaaagtgaacgtgtcattgaacacgcatcatgcactttcacggctgcgcaacaaaattacagccaaatcgaaaaagaggctttaggattggtttttgcggtacaaaaatttcaccgcatgctctacggcagaaaattcattctgttgaccgatcacaagcccctactggccatcttcggatcaacaaaaggcattccaatatattcagccagccgacttcagcgctgggcgttaattttgtcaaattacgaatttgatattaaatacgtcaacacaaaagcattcggaaatgccgacgtactttcgaggctcatcgctaattacccaaggccatcagaagacattctcatcgcaaatatctgcaacgatactgattgctgtgttaattttgtgtttgaggcgaaaatagagcaactcccgatcaccgcaaaaataatagcggatgaaacagcaaaagacgaaattttacaacaaatcagtgccttcaccaaacaaggatggccgcaaaaatttgacaacattaaattgtctccttttcttccaaaaaaggcacaaatatccgaaatcgaaggatgtctcgcctacggtgaacgaattataatcccttcgacgctccggaacaacatcctcaaatcattgcatttcgcgcatcccggcattgtgcgaatgaaagccattgccaggaaccatgtttactggcccggaattgactccgaaattgaacgactggtgaagcaatgcgaggaatgtcactcagcagccaaaaatcctacaaaagcgaatctttagccatggaaagcagcaaacggagtttttgagcgaattcacattgatttcgccggcccgtgtgctgacggccaaacataccttgttttggtcgacgcttactcaaaatggccagaagtatggcaaatggaaaggacatccagccaactcaccatttcaatgctgaaatcattcgtgcatcggcttggaattcccaaagaaattgtctccgacaatggaagccaatttcgatccgccgaatttgcacaattctgcaaagaattcgacataaaacacaccttcacgccgccgttccacccaatgtcgaatggggccgctgaacggtttgtcgacatttttaaaaggtcaatgaaaaagtgccgtcaagaaggcaaagattggcttcaaaaagtgcttttggcgtatcgcacgacaccaaacacggcactcaacg

SEQ ID NO: 81992 - DNA, 356 bp, Heterodera glycines
  Genomic contig location: Contig_ID=SeqID_17487; Location=478..833; Strand=+
  SCN-specific regions: Sequence locations=1-41,71-126,212-218,241 -245,276-356
ggaatcgaaggtgttgtaagcttttttccttttttcacttgtaaatttatttaaattttcaatttttttagctttttttcgaaaatttttttgtctttttttcggcaggcactgcctctgacaatgttttttatttatttagaaaaataaattgattttttttctttttgatttattttaattatatttcatccttaaattttttaataaacattttcaaactttcaccttattaatttaaggcgaattttgccttttttaataaattctcttgtgaaaaggcaaaaaaataggctcttttaaatatgcctatttaaattactttaattgctgtcctttcgcttacgaccatacca

SEQ ID NO: 81993 - DNA, 111 bp, Heterodera glycines; identical to SEQ ID NO: 54152
  Genomic contig location: Contig_ID=SeqID_17487; Location=1237..1347; Strand=-
  SCN-specific regions: Sequence locations=1-3,92-111

SEQ ID NO: 81994 - DNA, 990 bp, Heterodera glycines
  Genomic contig location: Contig_ID=SeqID_17489; Location=106..1095; Strand=+
  SCN-specific regions: Sequence locations=1-58,101-391,413-960,985-990
  Gene Ontology: Biological process=adult locomotory behavior
atgggtcattccggggaaaagcgcaactcggcacagacggaggccaacaacaaccaggggagaagtacaatcgtaacggtaattagaatgaataaaaggcaaaccgaaggaaacggacaaaatcatttggggaaacaaaggaattccgagaatggcatttttgttaggcccacaagtacaagcagttgcgcgctctgttcggtctgctcacttacctcgactgggccatggtgctggtcaccgccttttcctgtgcttccatgctgttcgagtcttcgtggccaatcggtggcgacaatttggtgttgaacaacccttacttaaaggtgccctcttgggatgggcaattactgtaccggttaaagtacaccacaattcgcaaagccatcatagcatcatatttattattattgctaattttcaggcatgcgattttgtatttgtgcttgccatgaccattgagttggcactcaaagtcgtggcccatggccttttcttcaccccaaatgcggtggtgcgcgatgttggcggcgtaatgacactatttatctatgcgagttcattttggtttctgatttggatgccgaaccatgtcgagcaaaactcattggcacaactgctgatgatattcagggcaatggtcagtggtgaagcttaaaagtaatcgattgacagattgattattgttgctaattgattgtcggatgcaaacaaagggaaaagcgacgcttttccttttccgacaaattgcgattaatttgatttggagagaaggctgaatcaccgaatgggggtcatggcagttcgtacaattggcagttcgtacaatggagtttcgtacaattggatttcgtacaatgggactttcgtacaatgttccaattgcggatttcgtacaaaaaatatatataaagtcgattttttctttaaaaactcatttaacgacttgtttttattgccacttttgtgaatgtttgaaaaattaacaca

SEQ ID NO: 81995 - DNA, 1447 bp, Heterodera glycines
  Genomic contig location: Contig_ID=SeqID_17490; Location=505..1951; Strand=-
  SCN-specific regions: Sequence locations=1-243,293-296,318-379,401 -1067,1089-1376,1399-1447
atgggaaatgccattttcgatccgtcgccgtgcccttgccgggaaagtgtaagtgccgactatggtcgattgaaaaagtccaacttaattcataagaagccttaaaacaataataggataaacagattaattaacttaatggtctctattatatccaatagatggaatccaagtttattccctaattaaaacagctaattacctatcccacccccctaatatggaagcttatcatatgttttcatttttttgaattttaaatatttttttgtcaaattttattttaattttagttgccggggggcttttacttttttctaatactatatacaattttaatggcgttttaacaaataaaagtccataaaagctccaagccttcccccagcagggaaaatccctaaatttacgggcttcagtttcaaattggaacattccctgttcgacttttagaccacgccagattccctgtcgatgcccgtgttggagtcgctgcagcagcgactgcacgcgttgggccccggcgtggacaacgtgttcaccgtcatggacaagctggaaggggcattgggcggcgactcgggtgccgagaccaaaaagcatcggttggcattggaacaactgcgacgcgactattccgcgttggtcagcgagtgcaacagcgcgttggatcaggcacgaagcaaggtgtggcatacaatcagcagcagttgataatgataagagaggaaaatccgaacgggaggaaaattgggcactgaaaattgaaaatttatggaattggccatagaaaattgaatatttgagtaaatgggcaccaaaaattgaacatttgtgtttggcacaaatgaaaaaataggagccaaaaattaattatttgaaaaagttggcaccgaaaataggacatttaatgaaatgttggacacaaaaaaattgagtttattttacaaattcgccgatttttattaacgtaatgaatatggaaaatcggaatcatcatcaaaatcattattgaacgatcactctggacttttatgctttcgaaattgaatctgatcattaataatttttgtcatagtttaacatgtgatatctgagtaacaattatatatttgtcagatgtggaatgccttaaacctgaccaaattttcaggaaacactcaaagcacggtttgacgcggacactgattcactccgatcactgttggaggacacagctcataaactgcacaatgatctcattggaaaagatgcacttaaattgggtcagtttccattcaaattgaaaatatctcgaatctcaatgccttattctcgagtattattggttatcttattgtttttcaagcaatttaaggcttatcttctagtcagatcattaccattccaaaatcccacatgcccagatcattaccataaagtgccgtttagcaatttccgactttga

SEQ ID NO: 81996 - DNA, 700 bp, Heterodera glycines
  Genomic contig location: Contig_ID=SeqID_17491; Location=226..925; Strand=-
  SCN-specific regions: Sequence locations=1-596,618-700
gttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaa

SEQ ID NO: 81997 - DNA, 262 bp, Heterodera glycines; identical to SEQ ID NO: 60799
  Genomic contig location: Contig_ID=SeqID_17491; Location=430..691; Strand=+
  SCN-specific regions: Sequence locations=1-262

SEQ ID NO: 81998 - DNA, 1527 bp, Heterodera glycines
  Genomic contig location: Contig_ID=SeqID_17493; Location=517..2043; Strand=-
  SCN-specific regions: Sequence locations=1-61,84-133,155-198,229 -625,647-677,720-882,905-1403,1434-1527
aatgatggcacaatggcaggagcaacaaaaggatgacgtgtcgacgaactcgccgcatcattcagcgcagggcgatcaccagcaaaagaaaggcaacgaatttagacgggggacgacaaagcgtgccgttggcacaatgccaacagcagaagcagatgggacaacgacatcggcggaaggggcaggtgccgaaaaatgtttaaaataaaatttaaataaattttttaagcgccgtccggcactttggcaggaaggcgtcgcctgttctcgtcggatgaagacctgctcgacataccgccaaactttcagtattcctcagctcgacttccgcccgacttttacacacgttacgccatttggtggggcgggaggaggtaaaaaacgcattagaaataatgtaaaaaaccaaaagggccaaattgtcgagaaccgtaattgaattttgcgcggctgatcacgcgagatcattccatcgaaattggtccaatcggccaatttttgcacccctttttacgccggagaaaccggcggcacttttcaacaattttcggcctaattccatttagtcgcgcccaatccgtcgctgcacatccgacgcgtgtccaattgctgcccgatgcgacacaaaaaggtgtttctgcttcaaaagttgatcagcatctgctgaaacggccacacacaaccccaaaaaacacgaacaacaacagaagcaccaccagtcactgccacgcgcgcgacttggccagacgcaatgcttacgacaactcagttgcccgatgcacgtggtaagaagcatcaaataagcgagctgtgagaaaaacagagttgctgaccatgcatttagcgacggaatttagggaacgaaacgccaaaaaattaaatcttgagctttttcttccctttctcgaccgacctgtctatctcttgcattttccagaaactgtgctggtggaagggcctgcggagctgtatcactccgtctcgctaccgtatctgatcaacggccaagctacggtaccgcacaaacagtggacggcgacggaacaggcaactgctgctgtgtcaaggcggacagagatacagttgttaagcgatgacaggcaacaactgttgacgagtgccaccggtggcagtggcgttggaataacaccgacgcatacggtgacggcgccgacacggtcattggatacggtatcggcccgacaaaacgaacttggctactgaagttttttttattgcagcattcgccggctgagttcaaaattcaaaaatttccgaatgatgccgatgaaagggtcggcgacagaatgccaacaaattggccgccgcatggcattgacgactctgaacagcttcaacagttgcgaaccgatgccaacaatgtgtactttgccaaaatcttggaatttgatgacgaggaggaggaggacagcacgggacgagcagtgggaagaacgacgccgcagggcgcgcgaggtgagtgccaagggggaggggctgaggacaaaattttaggcttttatctaa

SEQ ID NO: 81999 - DNA, 1317 bp, Heterodera glycines
  misc_feature (1304)..(1304): n is a, c, g, or t
  Genomic contig location: Contig_ID=SeqID_17494; Location=2300..3616; Strand=+
  SCN-specific regions: Sequence locations=1-172,194-423,448-471,493 -903,925-977,999-1056,1093-1146,1168-1274,1312-1317
atgacactttggccgtttgtggttgtgctcacacgtgcaatcgttgccatcaccaggcttcatatatggcacaaggaaggtgcaagaatgtgctgtaatgtgatgaattggcacacagattacagtaatgatgtaaaagcattttaaccaaccatttccaaccgtataattctgccgtacatacacaaaaaacgatttgtagtttatggcatacagtaaaccaataaaactattctcgttgattcattttaactttaaatcatttttgataaacaatagtggttataaacatatgaccatgactgtaaataaatgctgtcatcattcgataataaggctccaggaaaatgcgtcattaaaataaagtactgttgcattaaatcatgtattacaaggtcaagattgtataaaaatttcgttctgaattttttcaattaacttttttaaaggccaataataagcactcagggatcactttttaaaagtttttctttcaacaaaaacgacaattattcggtgtttaatttgccgatttttaacaaagatatattttttttcaatatagatgccaaagtggggaaatggcattttagcgcatttttgacccatgttacaattgttcaaaaatggcacttcaagaattcggctgggaaaatatcgcatgtcaacagaatttgtaaaaaaattgttaattttttgaaaaaaacgtaaaaaaaattccgactttttatataaaaatttcggaatcggaattctgaactcaaaaaatgtcagaaatcgtaagtcggaattccgtgccatccatggttaaactttactttttttttgacaaaacatttttgatttttaaatttttactcatttgaattttactttttatttacttcgtgaataaaaaacattgccttttctaagttattttgttaaaattgttcaacaatcgaaatttcgcatcaaattatgcagcgcttgcaaattttctcaactttcttttcattttaaaatattaggcatttgctttggaaatagctcacatcaacaattggtttctttgatttcttacaaattttcaatttcaaacttcaatttctttgctaatgtgctatgaagaaagtattaattttttgaatgcttttgtcccatataaattttgggtttatttgggaataaatccaaaaatttcgacatttccgcttcgtagtccattttttggatatttggccatccatcatcatctttgtctaccatatcaaaaacttattgtaatttttcagataatttttatttaaaaactttttaatganattttttcagtaa

SEQ ID NO: 82000 - DNA, 1787 bp, Heterodera glycines
  Genomic contig location: Contig_ID=SeqID_17495; Location=249..2035; Strand=-
  SCN-specific regions: Sequence locations=1-76,98-107,376-394,465 -474,635-637,678-708,731-781,821-849,1021-1082,1105-1132,1157 -1204,1226-1226,1248-1498,1543-1674,1696-1701,1743-1787
atgagaacgagtcaacaatttgacacaataattcgagtgccattttatcgcagacgtgtcacagtgtttgatgatcaggaaaaagaaattaatgctgaagtaaggagaaaaaatattaaaatatttaaatttaaacaatttattttatttttaaattttttgtcttcaaaagttataaaaaaaatattgcttattaaatttattttttatttttttcaccattccttacttttatttaattaattaattatttaaaaaaaaaattaaacataaatatatttatattaatattttatttttatctatacgcatttttaaatttttttcataatttcaatagttaaatataatcaaaaaatattacttattatatttggacagtttttctcgatcatgtttttataattaattattattttcattatttttaattatttatttaattaattattattttttatttaaaaactaaacttaaatatttataataatatttaaatgtatcttttgcattaaaaaaatgtttttttttcacaatttctatagttaaatatattcaaatatattacgtattatttaatgacagattttcattgataaattttttattatttttttaattatttatttttttgccatttttattcagttgataaaatcattttggcaaccttttccccattcttcgcatcacgatgcggccccatatgaacttgtttttcctgttattgtacctccacttggctttcgcacatattttgtgtttggagatggccaaaaacggtaaattttattttaataatgccatttttaaatttaaatgtcaagattttcttaattatgctaaagaaaaattatttattttaattgtatataaaataattaactatttcctattgtttaaactatatttttgttattaatttaaaagatataaaataatttaattaaaaaataattttaaaaaaaatttataaattttttacatttaaattatttattataaaaaaaaaattatttgtcccagtgagaaaaacaatctgaggacaagcaaacgaaacaacaatgaacaacaacaaaaccagcagcagcagcaaaatgatggtggtgacgaattgacaacaatttcaaatgaagtaattaattaattattcaatttgtcattttctttgacctttttaatcacattgtttttgcgtccttttgccaattaaattcagaagggcatttaataattaataaattttgtaattagtgtaatttaaaatccggaacccggaaaaatctgtccagattcaggctccgactccgggcattattattaaatatgatatagttaatacagtaatcatacataaaatagaataaaaaaagggatgaattaccactcaggatttatttagtgaataaaattctttcacaagatttttaaatttagctaacttccgatttccatagctgttttgggaaagcaataatgccacgcattgattgtacgaataaaaaaaatgtttttgttttttaatttatataatttattaagtttttccgactgacttttggcaccgatgggctgcttcaaagtgtggcagatttacgccggaaccaaactgttcaacttcggcaacaattcttgtactatcatggcatgtccaataatgcaacaccaagacaggcattttgactttttattttggtttcaattattttaaataatttcatttaacatttttaaatttatagagtttcttgtttacatgtccttttatggcatttgcataaataaa

SEQ ID NO: 82001 - DNA, 132 bp, Heterodera glycines
  misc_feature (105)..(105): n is a, c, g, or t
  Genomic contig location: Contig_ID=SeqID_17496; Location=1395..1526; Strand=+
  SCN-specific regions: Sequence locations=1-132
agatatccaatttacacttacaaattattctgaaattttctacaattctaagcttaaaaatgacaaaaaaaatttgaaattaaatttcaatatttttggaccganttttttaaaggaattatagggagacaa

SEQ ID NO: 82002 - DNA, 1526 bp, Heterodera glycines
  misc_feature (28)..(28): n is a, c, g, or t
  Genomic contig location: Contig_ID=SeqID_17496; Location=1..1526; Strand=-
  SCN-specific regions: Sequence locations=1-265,295-296,318-432,552 -572,616-714,754-779,804-808,835-880,908-1099,1137-1220,1242 -1279,1316-1361,1414-1526
ttgtctccctataattcctttaaaaaantcggtccaaaaatattgaaatttaatttcaaattttttttgtcatttttaagcttagaattgtagaaaatttcagaataatttgtaagtgtaaattggatatcttcagttacccgggtttcaccacaatgaaaacgaattattttttcatctacgctattgtaaccaaaagcattagtaaaacaaattaattatttgattgaaaattatgtgctttgctcagttttcattaattccgaataaaaaatgatttaaatttaataaaatgcgaaaaaattaattctaaaattgacaaaaattaatttaagcatgtgatgttaacaatgggcggtgattttcattacacaaattcaaatatgtggttcacacaattggacaaactgattgctgccgcaaataaacaggtaaaaaattaaatatgaaaattcaaaaaaaaaattaaatatattcatttaaaaatatctattaatttattttactccttaaaatatacacatgtatatttaaaaattttatttattaaactaaatccgaaacttttccagaatttttaattaagaaataaaatatttaaactttattttttaagactctgtcaaataatatcaccgttttttactcaacccctgcttgttatgttaaagcgttgaatgaagcacagccaaaattaccagtaaaataatgctctataaaataaaaaataataattatttgaaataaaataatggattgattatccatgaaaaacgaaattttaatcaaatgtttctttcatttcttgataaaattattttggttttaaattaaagtgttttggaaggtttcataatttttgatcatttaaacttactacttaaaaaatatttaaaattataattttcagattaaatctgatgacttcttcccatatgcaagcgccaatcattcttgtgatttttagatctttcgattttctaaaaaaatatctttcaataaatttttcagattggacaggctatttaacttcaaaaccgggcatcaagggactcattcgagcttcaagtgcatttttacaggtcataacaaatttctgattttttttaaataaaattatttaaaaagattaatttgtccatatttttttcatattttgcgcttcataatttttttataataagaaaaatacgataaaatcgaaaatgaacacaaaatttgaattttaaaatccatgaattataacaattttattgttttctatttctggctcacattctatttaatattaagtaaatttaattattttttatttgaaacccaaaaatatttttagaagaatgggtatttaagcataatggaattaaatttaaaaaaattttcatttctctatttatttattataatttttttgacagctttcacgcaaatttgcatcatttgcccttctgtcaaatgcttctaagcagttggaaagtttggaacagctcaagcattgtgcacacatcacgatgccgtgacgtcag

SEQ ID NO: 82003 - DNA, 2265 bp, Heterodera glycines
  Genomic contig location: Contig_ID=SeqID_17497; Location=523..2787; Strand=-
  SCN-specific regions: Sequence locations=1-408,430-863,885-921,943 -1107,1129-1171,1195-1470,1494-1542,1564-2035,2057-2162,2184-2265
atggatttatcccctcattatttatcgcttgaagggaaattatcacctttagttttggacaagtatttcgttataaatgatgccgaagataatcaaaattggaatactaccaaatttagaaatgctctatcgagagcaattgagcaaattaaaaacagacaagaagtgagacaaaaggtcagtacgagtcaaaaaagtaaattacaacaaatacgagtcagaggcaacaatgaattttgcagtaaaatttagagaggaatggaaaaaagttcaaaatgaacaaaaacacaaaaattttggaaacaaaaatgatcaaagacggagatttagctcctctccagaatattcagtggatcataacaattaaatattttcaagaccacaagaaagatgggaaagagggaagaacatacccaaaaacaaattttcgaatagctcaaataactctaatggttcaaattattcaaataaaagttctcctaaatttccttgtcacttttgtgaacagattcactcaccagtattttacaaaacatatcagacggctgaaaaaataattgaaagtattaatgcagcatcatacttaattacccaaccaaataaaatatcagtgttaaaatgtcgatatgtcacaatttataatccattaaataaaaacttagaaaaagggttttagcatttttcgacgatggcagtcgaaaaacttatattgaagaagaattagcaagaagccttaaattaacagtgattggaagacaaaaattagaactttctggtttaggtggagcaaatttgggaaaattcgaaagcccagtagttgaatttggcttaaaagcaagagattttaatatgttaatgattggaagagcaattaaaaaagttttaaaagaaattcccttttggattatcaggaaataaataatcatgaattaaagaaaaataaaatttcagttccatatttactcgatgaaccaaaaattaccatcgggagcgatttttacaattattttgacattagacctattaaacatttaaattctggtttttggatcagcaattctaaaatcggtaaaattttgagtggtgatggaaaagtgacctggacaaatttaaatgacaaaaatgtgaatacaaaggacgaatataacgtatcagccataaactcaagtgcaatacaatgtgaaactgaaataactgatcaagtggaattggacaaaaacaaggaattgattaaattggttagacaacacgacagtttaaatagcgtgggattcggagatttatcagaaaaggaagaaaatatgagagaaaaaatgataaaaaatatttcattcaatggcaaaaggtaccaatcaaagttactttggatagaagaagaggccgaaaaattgcccacgaattttgcaatggcttacagtcaattaaaatcaaatttaaaacggttacgcacaaacccaaaattactccaattatatcataaaacaattttggaacagattaatgaccaaggatcagtggaaataactaatccgttggtggacccaaaccaaaaaggacaaaaaattcattatttaccccatcatggcgtagtgaaagaaactagtgaacacactaaattaaggattgtttacaatgcaagtgctaaaagcggtaaaaacccagccttaaatgaatgcatagaaaaaggcaccaatgaatacaatgatttaaccggcatacaattacgcacgcggttaaaaaaatattttgattggttctgatattgctaaagcatttcatcaaattgaattagcacctgaagaccgaaattgtgtacgttttttgtgggtggaggatccattcgacccaaacagtccattaattcattatcggtttaaaagagtgacttttggtgtcatttgtagccctgcccaattggcattaaccattaaattgcatttagaaaaatataaccaccccattattaagcaattggctcaaaatatttacgttgataatttactagtgggaattaatcacaaaaaggattttcaaatggtttatgaattaattaaaaaggtgtttgctaaagcaggaatgaatgtgcgtgagtttgtgtcgaatgaattaagtgagcttcaaaaactcccaaaggaagaccgaatcgaaaaagaaactgtcaaattgttgggaatttggtggaatgtcaaaaatgacgaatattttataaaaatgccaaaattcgaaccaaataataaacaagaagaaaagtactatctcaaatag

SEQ ID NO: 82004 - DNA, 57 bp, Heterodera glycines; identical to SEQ ID NO: 56798
  Genomic contig location: Contig_ID=SeqID_17498; Location=1935..1991; Strand=-
  SCN-specific regions: Sequence locations=49-57

SEQ ID NO: 82005 - DNA, 946 bp, Heterodera glycines
  Genomic contig location: Contig_ID=SeqID_17498; Location=1126..2071; Strand=+
  SCN-specific regions: Sequence locations=1-26,48-221,245-527,552 -777,879-946
atggcatttcaagaaaagcttgagaaaaatgtcatggcacaaattgatgtgaaagtgcagacgaaggaagttactgtcaaatagttaagggaaatgagcaatggttaattactgtacctaccgtaacattattattataattactgtcaaatattaataggatttgttccaatttaagttattactgaaaaggcaattttgattgaatcggtgaattgaagggacaacaaaaacaccaaaagcagcaaggggagaaggagacaaaaggcgagttgtaattacaaaattttattaagaaaaaacttcataatttcgaccttttcgcaattttcatgtataacttttttggtaattgtctaatcgcgaagtgatacatagaattagattcgaaacatgttaagctttcgaatgataccaacaatcttggatttggatgacaaagaaaaaagttatagcgaaaaacataaaaaattttgaaaatctgcccacagataacacacaagtacccaaaattgttacaccgccagatttttattttattttttatttttcagtttcgtcatttgagtcctaatgactaagaaatttcagttccgtctctaagattggcttatttttcggaattttcatcacaaaaagtcaaattttgccttaaaaagtgtaaaaagtcatgaaaaagtcacaaaaacgcaaaaaagtcataaaaatcccaaaaaagggtaaaaaagtcaaaaaaagtcacaaaaaatgtatgttagaagtagagtgccacgggaccgggaccgggccgggaattcccggtcatccgaggtcccggttcccggtcccgggttttgaaaagctcaggtcccggtcccggtagggcaaccgggaaccgggaaaaacagcactggtaagaatggggggtctgagtgaaaattagtgaagaaattggagtcaagggaaa

SEQ ID NO: 82006 - DNA, 3912 bp, Heterodera glycines
  Genomic contig location: Contig_ID=SeqID_2860; Location=419..4330; Strand=-
  SCN-specific regions: Sequence locations=1-130,161-350,372-430,452 -460,482-553,576-599,720-1063,1087-1546,1568-1619,1642-1667,1750 -1894,1931-1990,2012-2119,2144-2219,2241-2553,2597-2785,2808 -2935,2957-2985,3013-3041,...
  SCN-specific regions: Sequence locations=...3130-3560,3607-3639,3661 -3723,3746-3769,3831-3862,3884-3912
  Gene Ontology: Mol. function=structural constituent of muscle; Cellular component=cytoskeleton; Biological process=regulation of striated muscle contraction
atgccgaggatccagctgaagaggtgccgccaggcactgttgaaattggccttcgctcacttggtaaaaaatgtttcatattgtacggtaaatgcctaagaatagtgattggaaatactttcctcatcagatcattatttttaattatttttgcacattttcaaggattttctaattcgtgggaaaccatccggaagcactaaaataattttttaccgttaaaattaggaattcacaattcaaagctgaattttgttttgactcacagcttggaatgtaattttgtcggatttttttgacactgaaaaagattgaaaactcgaaaaaatgcggaaaagtgttttaaatgcttttttaactaattaaaatatatgatcaaaaatgtttttttcaatttcattctatgaaagaaatttaattgattttgtaaatgagcagtttaagagcttttccactgaaacttttggttttcaatcaatttagtgcctaacaaagaagccccggacaatcagtccatcactggtcaatcaatcagtggagaaaatccattagcaaaattaaaatttaaaaaaattgcaaggcttttacaatatttccacatattaaattttaaaatcttttatttaatttttttaaaataataaattcttcactaaacaacataaattattattttaagtttttatcaaatttattatattttcataaaattttaaatactcaaagtagggatgtacaaaacttataaatgtactcaattttaattccgagaaaaaatagagcggaccgcgtccggtagcggaaggcgacgcgttggcagcaccgcggcggaccggtcggcaaaggcggcagcagcggcttgcgctgcgggcgaagaggcaagggacgaggtggacaacaacgaggaggagcgacagaacatggcggtggtgacaaaaaggatggcaaatttggtaaaaaaaaatttcaaaattattgtgtatgcttttcgggatttttgtgcttaatacacctaggcgctttttttgtgcctatttcgccatttttggcgcctattttttggattttttatttattaatatttttccttgagaaaagcagcacaaaaacaaaaatctttcactttttaattgtttttttcaatttttgggcaccccttttttatttctattttttaaaggacctggaaacatccggcacaccggcacggattgtcgaaatccctgaaaatgtgacggtggttgagggcgaattggccatcatcaaatgcgtcgtggagggcaacccggcaccgacaattgtgtggaaaaagggcggccgaaaaatgccattgaccgacgaccgagtgcggtgccaaacggacggtgacacgggacatgtaagtggcaatttttaaatgaaatttttaaacacagaaatttaaaaaaactgctgttttttggaaaaaaatttttttgcgaaaaagtcatttatcataaaactgagaaatcactaaaaaaatttttgttttaatttcactaaaattacattttttcataccgtagccctcaaatggaggacaagaaaactttttactgtagttctaatcttggaagggatttttacggcactcaattaattaattaatgtagctcatttatttctaaactaaattcaaaacttagcagtaaatttaataaaaaaaattttatcaaatcctaaaataatgttaaaaatattttatcaaattaaaataatgttaaaaatattgtcaggtttctctgatcatttccaaatgtcggccacaagatgggggcgagtacacattgatggtgaagaacgcgcatggcaagcacaaagttggcgccaagctgcttgtcacgccagcggccgaagtgaaaaaaaattgccagccaaatttaaataataatatttacaaaaaataaatttacagtcaaatttggacttccgggccaagcagaaaaaacgtggcacgggcattagcaattcggaacaggaaaaacagcgccaacggagtgatgccgagcccaaaagcaaggctgaacgacggtgagccaaaaacagctaccaccaaaaaattttgcaccgaattttggaatggtgccaaaaaatcgatgccaaattctgcacttcgcttattttctttttaatttgactgaaatttcaaaaaaaaaatttcagtgccttttctttttttttgatggtgacaaaaatttaaagacatggcaaaagaaattattgaaattcaatttttttgattaaataaaaatcgtgaacggaaaatgggtcagtggaaaatgcgtcagtgaatcaggatttctttaaattgagatacggtagtaatattaccgaaatcacaacttgttttttagggatttgggaaagtttcaattaggtattttgacttttaaaaacttaattgataaaattcagaacaaaattattagacaattttgtccttttgtaataatacaatacttaatgctacagtaactttattttaaaaatactgtattattgacaccttttccactgacgcatttgccaggagccaaaattattattatttttaaaaattaattttcatttaaattatggcacaaaaatttccagcaaacgccaagtgtatgtggtggaggagccccgtgacacatttgttgtgccgttgaactcgcagcatgccaacgaaaaggaaaatgccacttttgaatgcgaagtgaacgacaaggagatcgatgtgaaatggttccatgacggtgccgagatcgggatggacgggcggcactttaaggtgggaaggagggggcaaatctcttgctaatcaaagaatacattcatattttgtgttatgaaagatcaatttaaaaaattgagtaggaggttaaattacctattttgggattcctttaagcccaaaaatccctaagtatggatatttccaaaattcaaaccaaaactagctcaaattcttcaattcaaatgcctatcagaaatttaaaaaatatattagaaaagtcagaaacaaaaccattttttaacaatattttttttaattttatatttttttacattatctaaaatttgtttttatgccaaatttcattttgtttttctattgtgtattttattgatgcttcttgttttacaggaacgggctggatgccgtcgtcgcctgctgatcatcaatgtactcattgaagaccacggggagtacaaatgcacagccaaagacgacgaaacaatggcccaactcattgtgcaccccaaattcgtcaaaaaagcggagcgcaagccggtgaccttctagttcgacgatgagttgtattaaatttttttgtttttcactgttcctgttttatttgtgcccatctcttttttaaactctgtgaattgaagataaaattttattttcctttagttgtcctattttatggtatatcccaaccagggctggccgtgattgaatttccaatcacggaaatccgtgagccgtgatcacggggctttaaaaaaaatccgagatcacggcaccccaaaaactccgtgagccgtgatccttgattaaaaaatttttttctagtgatttttttaatttaaatttatttagaaaaacggaatttaatcgctggaaaaattcctaaaagatattttaaagaaaccaaaacacaatccgctttttttgctgcgtaccttttccaaaaaatgactaagtttacgattttgagcaaattttttgatgaaaattaggcttttgtagaaatctccaaggaaaaattttattttttaactaagtttattaagaaaatttttcaaatttttcttaaatttaaccaaaaatctatttatatagagaaaaaaatcagaaaaatttcctctaatttgtaagctaacttttgatgctgaacaaataaa

SEQ ID NO: 82007 - DNA, 543 bp, Heterodera glycines
  Genomic contig location: Contig_ID=SeqID_2860; Location=7887..8429; Strand=-
  SCN-specific regions: Sequence locations=1-4,26-106,128-145,206 -405,427-436,479-515,537-543
atgcattttttgccccctctctcttatctgatcactctgatcgcagattctacgccatcattgacgttcattgaacaaatcgggcgaatggaactggttcagtccattgttcaattcatggaaaaaattggcttaggaacgggcgaaaataataaaaaaagtaaaaataaatacattttaaatatgaaatctaatttttttttaagaaaaacagcgaattgagcgccgaagtgctacaaataaaaatttgaaagaaccatggaatcacccggaagctcttaattagcattattaagctctcaaaaatgacaaagcattgcaggcatgtaaaaaactgtaaattaaaatatgcaaaaattctgacttattagattttcagccgcgaacttttttgatgaattgattaaatgcttagctcagcacttgcttataaatatcttctaacattagagcagggatggcaaattttatgctttttagtttcatttggaaacaaaaacgaagtagaaagcacatacaaaataattatttcacaataataaa

SEQ ID NO: 82008 - DNA, 526 bp, Heterodera glycines
  Genomic contig location: Contig_ID=SeqID_2860; Location=8779..9304; Strand=+
  SCN-specific regions: Sequence locations=1-177,220-267,290-526
atggcactattaaatgagcatacagtagttagtatttttcaatgcttagctttccttacattcattgttggtgggttgggttgattgcaatttttgttgataattgaattctgtccgctgttgcttggcgctgctgtagctttcggccactattggcgctgccatttggccatgaataattgccataaaaatgattaaatgataataataaaaaatggacatttcgccagcctaaaaagcattcgtttttaaataaatatcgatacagtcatggtcatatgccccataacagctcatggggatgaggtacctatccatagaaaaatagatttcgcaagtattgaaagattatctgggatttttgggtcgctgcatggtgtcacattgtttctgggctatccattggtaccacacattcctcgtttgctttattcctttttgtaaaaatttgtgttttcttccatatagtcaaatttcggggtggtcatatgtttaggaacactacccatattttttttcatcagca

SEQ ID NO: 82009 - DNA, 1333 bp, Heterodera glycines
  Genomic contig location: Contig_ID=SeqID_17500; Location=347..1679; Strand=-
  SCN-specific regions: Sequence locations=1-354,376-1281,1303-1333
atggccagaaaaagtcagttttttaggtttttggccaaacttttttgtatctcaactagattttttgaaattttgcaggctattagcgactatcaagcgctttaaaatcacatcaaaattttttaattcgaatgataaataaaaatgttatagcgtttggcgccaaagtgggtactctttaagtttgggtccacattcaaaatttttttttaataagcacgtaaaaaatgtgatgaatttatttctgtttcaaaattgtttttgcgttctttttgctctctcatttttcccaactctctctttttaagttacataacaacagagttttgccttgccttttttgacacaccaatcaattggaaaaagggaaaattgagccacaaaaatgaatcgacggtaaggaattttttttaaattacaaaattttcatttacccatacatttttttacgaatctcagttggctttgtaacgacgtgtggatggacaattctcccatcttttaactatgccaaactcggcctcaaaatggcattgctttccgaccgtttcgatgttttggtggacgcacattttgatggcaaaagcgaattcacaatttggagagcaatcgaaattgaaaaggaggaagggccaaaaccgaaaatgtttatacgaatcgatggcagttttgtggattttccgttgtctgttcgtcagatgcccaacaaaatttgctttaagaacctttggattgagtcagtcttaacttttgtgtacgctaaagcatttttatctttcttcagctacattgaccattccgtgatcaaatttctccgctccaagaagcgattctttgacagaaggggcaccaaattggaagtgtttgtgcattcaatttatacggatgtccaaccaatttgggatgtttttacccgcgaaatttggcctatttttgcgaaaagcattcgccatttgtgctttcctaatgccaatcatttggacaatttgcgtcgtcgcacatcgccgacacttctcactgatcttgatcaattgaatttcattgattctggtggtcttttacccgatggaatttctgacgatgggccaaaagcaactgccggccaagcgttgtccaaatggttgcacacgccgagcaaaaatggaaaagcgaatgaattgtattgctgtgcttatttttgtgaaataacatggatcaacactttcaaggaggtgatcgagctacttaattgttcattaaacgattgactaattattgattgattgcatttgattcgtgaccggaaaatcggtcagtggaaaatgcgtcagtgatacaaatattttaaaataaa

SEQ ID NO: 82010 - DNA, 1470 bp, Heterodera glycines
  Genomic contig location: Contig_ID=SeqID_17504; Location=757..2226; Strand=-
  SCN-specific regions: Sequence locations=1-23,46-123,145-554,576 -787,810-1375,1401-1405,1427-1448
atggtgcacaaattcccgctaaatttggcctttttctctgtgcccaaatttgtccgcctctttctcctcgtcgttttggcatttcaccgcagcaagccgagtgagtacagactcaaataaatgagaaataaaatttaaatttgtatctgctcaacttagcctcccatacggattttgcccgctccgttctgatccatttcgaaaaccaacaagaattccgcgcactaacataagtatagccaagactttttaagaaaaagcataagaaatcgcatcccatttaaaactgagtaatttaaagacaaaaaatattttattaaaaacccaaaaaataattcacttaaagcggtttttcgtttgatcggctccttatgaaattgttcagatcagaggtgcatttactcggcgaattattccaacgatttgtcggagtccaccaaaggcagcctcgtgtcatttttgcagaaatggggagttgaagaaaagcggcgtataaaaccctgtcaagaaggtgtggcgtgccaaacttaccgttgcaaagacggtaagaaaatgccaattaaaatttaaaaattcaacagatttgttagaaatctatctttagagtccgggtttttgaacttccatttttagaagcttatttggtactatttgagcttggttgaagcttattggattttcaatttttccataattcagagttctcgattttttcttcaatattaaattcaagtttctgaatttttgtccatataatctggtttctcttatatataaaataatagcatgcattatttttggccatttttcaggaaaagatggccacgatttctttttggtcactgcgtgcgcaacgccggacgatctgacggggctccaatgtagccacagagattttgaccccttttgcctggatgggaaaccggactgtaaaacgtgtcgtaaaagggagtgcctcgacccagacagaatgaagttggaggggccgaagaaaggtgagtgattgctcactgatcagtgacaaatgagcaaactgatcagcaaacggaagagcagggaatgaatgatcagaaaagcaaaacactaaaccaaagcaaaaaatcaaatcggaaagacaaacggtgagagattggatttggcctcactaaaaccgcaaaatgtggttaaatgctcaattcgacgacgggcctattctaaaaattaactaatatctttattttaatgatttaaaagaataaaaaactgacatttttcgttcagtttttagaacttattttggcactttgctgttgattaggggtgatacattagtgccaatatttataatatttttggagatttttgtaacacattaaaaccgtaacacagccataacattttttgtgctttattcaaattttttgaattttgttatgctatgtttaaaatagagattatcaagcgctttaaaagggtagggggaaaaataaa

SEQ ID NO: 82011 - DNA, 524 bp, Heterodera glycines
  misc_feature (444)..(444): n is a, c, g, or t
  misc_feature (495)..(495): n is a, c, g, or t
  Genomic contig location: Contig_ID=SeqID_17504; Location=2555..3078; Strand=+
  SCN-specific regions: Sequence locations=1-5,27-138,250-404,427-524
atgatagtaagtaaaaataaatagcaaatgggacggatggacgggcaaaaataaagcgacgaagccaaaaaatggaaatggcaatggatggaatgaaagagtgaatcattcattcattcacatttatctgctgatcagataaataaatatgaataattaattaatattccaaatttattatacaattgttaatgttaaatagtcaatgaaaaaattattataattaaaattaattattaaaaatatttagggattccattttaggtaaatgttcgggttgtgcaccgtccgtcagttcttagccaggaatatcgaacggcattcgactcggctgattttagactcctcggatttcggtttcgttacattgttaagaaacgcgtcagcatgctacgaaagggacggttaaaaattgcttttatgcattaaattttcctttgctcngacattttagtctatatacaacagggctgggcgtaactggattttaattanggaatctgtaattacggcgatttcctaaa

SEQ ID NO: 82012 - DNA, 1010 bp, Heterodera glycines
  Genomic contig location: Contig_ID=SeqID_17505; Location=636..1645; Strand=+
  SCN-specific regions: Sequence locations=1-74,106-198,220-242,271 -398,504-521,546-1010
atgaactcagaggcatactgggtatggagcaagaagtaaaattaattatttcgagtcatgctcgtgttttgttgaattttaaaaaattaaattttaaaaaaatttcgagggacaagaacttaattgacaccctaattaagacacagatttttttaatgtgtttgataaattaataaaatcagataagtctaagttaaattataaataaatatgagaaaagcgtccgttttgtataatggaacaattttataaaattattatttaaaatttcacatggtactaaacaaatgggagatttttaaaatgtcgttcaatgaaaggcagactaatgacacaaaaatttgaataaatacacaattgatgatattaagaggtgtaaaattaaagaaaattgatgcttaataatattattcatttatgaatttaaaaaagttagtaacataaaaataaaacttaggaattataaaaattttatttgtattatcttttgatattttaattaacaatatcacccatcaattcaaaagaaacaaatgaataaatagcctgcggaccaaagacaaattgacgagcactcgtgttcagggccataccctggcaaaaaggacgatgaaaaggcaccgaagtggtacctggtcgcccaaattgttgcaaatggcgtggttgcagcacgtgcacagctggcagagcaatggtctgccctaatttgggtggacaacgacattgcccaaaagacttggcccttggaagtcggcgattcggtcaaagtggtcagcgttgaatggacacagacggcaacgggatgggcaagcgccggagattggctgatcatggtcaacaagcgcttgaatcaccaagccgtggccaaggaggtaagtgagtctttccagggacctttcagctcggcggcgtgggagcagttcgaattccttcgggaaggagcattggaagccgttgagcttcgtcccatggtctcaacgcgtgcactgagagaacgagcgaacttctga

SEQ ID NO: 82013 - DNA, 1536 bp, Heterodera glycines
  Genomic contig location: Contig_ID=SeqID_17507; Location=67..1602; Strand=+
  SCN-specific regions: Sequence locations=1-629,652-1046,1068 -1476,1500-1536
  Gene Ontology: Mol. function=signal transducer activity; Cellular component=heterotrimeric G-protein complex; Biological process =signal transduction
ggaacggcaccggctatcaattatggaattaatggccaaaatgacaaacgaatggcgcaggtgttgtgcatggactgggcgcaggacaaacggcacttggtcagctcctcccaggacggcaaagtgatcgtctgggacgggttcaccaccaacaaagagcacgccctgacaatgcccaccacttgggtgaattcggcacttttccgcccgccattagtctatttctttcccaggtgatggcttgtgcctatgcgccgagtggtcaaatgatcgcctgcggcggtttggacaacaaatgttccgttgtgccgttggacccccaggaggacattctgcagaaaaagcgttctgtcgccactcacacttcgtacatgtcctgttgcactttcatccgttcggacaatttggtaattgctgggtaattaactaatggttgctaattaattgcccatttgtattagcttctgacgggcagcggcgattcaacttgtgcaatggtcggcttttgttgcggtccgaataaaataaaattattttggcattcagtgggacgtggagagcggtcaaatgatccaaaatttccatggccatcttggcgacgtttttgccattgacatccccaagtcggacaccggcaacattttcatttcaggcgtaagaatttggctatttttttgccaagactttcaaaaactcacagggtgccgatcgacatgccctcgtctgggacattcgaaccggacagtgcgtgcagagcttcgagggccatgaggcggacattaacacaattcgcttccaccccaacggcgacgccttcgccacgggctctgacgacgcgtcggtaagcaaaaaagccaaaatttaattgcatttttaatccctttcaaagtgccgtctctacgacctccgagcggaccgccaagtttgcgtttacgagaaagagtccattctgttcccggtaggcttttattggccgatcatttctcgacttctctccctaaggtcaacggagtcgacttttccgttagcggtacggttttagggttttcctttccttttaattccttcctttcgcaggtcgcattttgttcgccggttatggcgattatcgcgtcggcgtttgggacacgttgaaatgtgttcggcaattgattttgtacgggcacgagaatcgcatttcctgtcttcggtgcaggtcgaaaacattgccaattacttatacgaattcgcactaattaattcgctgtgttttcagtccggacggaacggccatttgcacggcgagttggcacgtgaccggaaaacagctattcctttcggacaaatcacttaacatttccgatttgcaatttattggaaatgccaaggacgaaaatgcagttgaaattgaccaatcactttttgaggttacaaaatcagtgattaacaatcatagaaagctgttaaaatttattaaagggcgacatcgattttgacgacgatgatgaggattacaaccccgaggctgatgtcggatcagaagatgaaagcaaataa

SEQ ID NO: 82014 - DNA, 642 bp, Heterodera glycines
  Genomic contig location: Contig_ID=SeqID_17507; Location=1739..2380; Strand=-
  SCN-specific regions: Sequence locations=1-465,487-642
gtgatggagtggcggttggccaggcgcgctttcaccgttctgccgatggacaagtggcaacggagtggaccatattcgttgataacggcactgaatctgctcgaccgacaccatgtaaatgtttttgaatccaaactttcatttatttaccacgtttttcggacccaaaaaaattgctgaattctttgcacgaattggccatcgagcacaattgtcccattttactttctgtcgtgctccctattcgacaatttgtcgaattcgacgataaaattgtctccgctggaagaaaacttccgggtgaattttgattttccatgtgttcccattacatttttacatgctttgaagttttaatttagcttcagacattccaacggaaggaacgaccttcgaagcccaagtgaattcgattatccaaattggagcccaatgggttcgaagtgattcggtggacaaaagtacccatttaaaacccaaaaatgattaaaagtgggtttacatatttctcagcttccctatttgtgcgagggcgacttgagccgtgcttattatgtgttggatgatgcggtctttcttctcaatgctatgctttatcagaccaaaggggaacctatgattttcaagtgcaaagtatcttaa

SEQ ID NO: 82015 - DNA, 2450 bp, Heterodera glycines
  Genomic contig location: Contig_ID=SeqID_17510; Location=102..2551; Strand=-
  SCN-specific regions: Sequence locations=1-355,377-530,554-679,702 -744,766-790,821-1502,1525-1970,1993-2450
atgacagggatggtgaggggacaacagttgcgtcagtggtcttcaccaccgtttgccaacgcacccagagacaacacagctgtgccagtggaggcgccgacattcaaccagcgccgcttctacttccactcattcgacaacgacggcaacgacccagtggaccaatttttggattttttgactcatcatgggccaaaaaaggcccacacggtgtgcgtcgcgcacaacggtggcaagtacgacttccatctaatccttgaggcattacatcgccgaaatatgccaccaaagcgcctgtgcacaacggggctcaagatttactccatgcgtctgtcgggacgtaaccaacgacgagtcaccttcaaagacttcatcaattatttcttctgtgaattggatgcgttggtgagaagagctttgacctgccccaccatcaggcgacggttaagcccttcttcccctacctctacattcagcgacaacatctgctgcaacgtcttgagggtcttccagcacgggagttttactcaccagacacgatgaaagcggacaaacgggccaaatttttgcgttgtgcgaaatcctgcgggttctttgcagatacgcaccatcgccacccaccttttcccgtcaaggactgcccattttattgaggcctaccgggacgcatgcgcaaaaaattttggataccttctcatggacatgcacccagagagtccggaagagatccgccttagaacaaatatatatgaacaaaaacaaatagtttacctaccaaaatgaaagggtcacaaataataacaataaataaatgctttttggagacattgtgtaatgccaaaaaggcgaatgcccttattcgagatgcgtccgatgagcaacttttatgtctagtcgaaatctgcctatacattctaaagggccgagtccctttgcgtccccggcatttgaataagctgaaagctcatgcacaggtgcttcgtcgtctcgcccgtacacgttgctcgcgctctgccaaaaaggatttgctacagcacggagatggcctcccagctattgttgggctcattgcatcaattgctcttccgctgattgcggatgtcattgaaaattataaataaggtgtaacaaagtaaaaaataaataaaaaatgcagcatacaaagcgctatttgcttgtccccgaagatatttatcagagtttggcagcaccgccaccgtcagacggtacaccaattgggctggtccgtaacagaattaaacaaatcaaaaacgatgacgccataaatgatgcagaaagggcagtcaaatatgagcaggaacttaagcgtctcaacaagctcgcaaaggacgaggatgaacgtcccgtcggtgttaaattagaaaatttgaatgatgtggttgacgccatgccaaaaccaatcaacattaaaagaccaattgttgttgctacgcgtcgccatctcaaggttgggcgtgcgcgaaaagaaaatgttgaacaattagaagaagatgatgatgaaataccatggccatcgagttcaattaaacgacaacccacccaaacggaaatcttaaaattaatttataaaaacgcccaatctctaggggtgtcggaggaagggcaagttttgagggccggtgggcggccatttataaccagcagtgttgatgacattgttagtcacctgttgaacaaggacaagcgtggccaaaacaaagagccaactgaattcaaagaatttgttgaaagggcacggcagaatccgctcttgagtaggcatttatttcccgaaggtcaatccggcaaaggaaattataaaaacaccccaattaagtttaagccatcattatggatttaaagaaacttcagctcgagtttttgtacaaggacctaagtttgcctgtatcattcacgagcgttgaaccgctgctgagaggcgcggaaaagccaaccaaattaatcggactgatgtccaaaattatttagccacccaacgtacatacacactacatcgtcaggccaagcggcgctaccgtcgattgccaacattggcacttggcttacacactgaatggcaggccgatttggctatttttgaccgacttggtaaacaaaaccgtggctacaaatacttgttagtctgtattgatacccttagtcgacaggtgtttgttgagcccgtaaagaccaagacgagcgctaacatgatcattgcctttgatcgtatattcaaaagatcaaaatatatcccgtggaaggtgttaacagatcagggaaaggaattcactgcccgcgcagtacagcagttcttccgcacaaaagacgttgaacacttttgtatgctcacttcaccccaatttcatgccggaatggccgacgtgcgaatcgtagcatcaaagagcgcctttaccgctactttacggcgcggaacacgtacaagtggatag

SEQ ID NO: 82016 - DNA, 525 bp, Heterodera glycines
  Genomic contig location: Contig_ID=SeqID_17511; Location=11..535; Strand=-
  SCN-specific regions: Sequence locations=1-185,209-234,363-465,488-525
atgggacaaaaaagaagagaagaaaaagtgataaaaattgaactaaatgaacgaaatgagaactcacaatcagcagcagttgatcaaatgggtgaagaaatgggaaatgaccgaaatgatcaaatgggaaattacacggatcagaacctttttaaaagtgatcagaatataaatgatcagcaaaagagagaaattgtcaaaaaatttaatgcaattaaagaaaaattacgtgaaaaaggtaaatacaaaagaaaagatcaaagcaaaattgagaggaaaattgcaaaattattaggaacaaatcgaaaattaatacaaaaatggaaaaatgaattgaatttaaataaaaagaaaatgaaaaaacaattatatgatgagaaaaagagagaattcattgaacgatttgatgaatttaaagaattatatggccaaggcaaacagaaagaatttgcgaaaggattaagtatttctgaagcaacatttctaagatggaaaaaagaattgggcaccaaattaccacaaaaa

SEQ ID NO: 82017 - DNA, 290 bp, Heterodera glycines
  Genomic contig location: Contig_ID=SeqID_17512; Location=942..1231; Strand=+
  SCN-specific regions: Sequence locations=1-134,212-290
atgaaatggaaaaaggagcaattaaaaaagaaatacaaaaagagcccaaaaactgcgcaagaatgcaaagtctgtggaagagttgcgcgtttcaagtattacaaaatacagagctgtgatggtaagcgaaaatgtaaattaataattatttatttaaatttaaaattacaattaaaaatttacagaaatttattagtaaataacttttttagcctgtaagcagttttttcggcgtacaattgttgatcagcgaacattcatttgcacgaaatcaaattcatgtgtcataa

SEQ ID NO: 82018 - DNA, 786 bp, Heterodera glycines
  Genomic contig location: Contig_ID=SeqID_17512; Location=1293..2078; Strand=-
  SCN-specific regions: Sequence locations=1-298,398-544,566-700,729-786
atgctatttggaattgatgattgcctcggtaatcatctgcgacacggcgtccgtcccagcaaaaggctgcggttgaccccattggatgccgttgttggcggtgggggccgaagtgatggaggtgtggtgggcgtcaccaaatcgatgtccataccgattctcaccctccacgagtcgttccaccaatttttcgacccgttcgaggattgggataagggtaggattccctgaccctcgagcaatttttcgagtcgttctatacgaacgaggatcacatcttcttaaaaaaaagatttaaaaatttaattagattaaaagagtttaatttaatattaaaaccgtaaaattatatcattattaaaagccgaattactggtaaattaaattaaaataaattttccagtggttctgacttaccttcatttctctgatcgaatgtgccattttcaattaccgtttcctaaaatcaaataataagtaatccaaaatgttactgtatttgcttaaatcttactgtatccatgggacagaatttttcttcattctccttcagctgctgctgaagaaatgcacggcgttcgtaaagcgattggatgattggcttaattccgcactttgttcagcttccacattgttgggtcatgccttcaaacaacacttgtcaagacggcacgcacgaccactcgtcatttcttagccgaaattttaatttattttaatttttatttcattgaatttttacggggtaggaggaggttcgaaagtcatttgggtcaaacgaataaa

SEQ ID NO: 82019 - DNA, 284 bp, Heterodera glycines
  Genomic contig location: Contig_ID=SeqID_17513; Location=357..640; Strand=+
  SCN-specific regions: Sequence locations=1-137,159-284
atgatatcaatggccaacgttactttgtcatcatttttgtcgtaaaagcgattgctcgggtccattaattccttaattgcccataattaggcgccaattaaggaatgccattttccgcaagtgcaatgaaagaaggcaatccccagcccttaagatgaattgctaaaaattgcattgaatttttcagtccgtttttcgccccactcattcgcgagacaatttggaacgatgtcgaacaaacacagctccaatacggatcgtaaatttgaaataattgtttttta

SEQ ID NO: 82020 - DNA, 373 bp, Heterodera glycines
  Genomic contig location: Contig_ID=SeqID_2861; Location=425..797; Strand=+
  SCN-specific regions: Sequence locations=1-373
atgtcagagtttacttcgtccgacggatcagggaaaaggtttgtagttttttttagttttagcaataagaaaaattcttttgctgtaaaatatagtaaatgaaaatcaaatttcgtttttagcgttagcagtaaggtcagtgagtcggaaagctacgacgcgaccacgcttggtaaattgatgaacctcgacgccaaagtggtcgaatggctcgagaaagagccatatacggacgacgatccgctcttggttcttgacttccttggtccgtttaacaatcttcatggcgactacaaccaaaacaaggcctttttggtgcagaagttggtatgtcttaacagcaaattaacatgaaagctggatcaaattcaaa

SEQ ID NO: 82021 - DNA, 2019 bp, Heterodera glycines
  Genomic contig location: Contig_ID=SeqID_2861; Location=1456..3474; Strand=+
  SCN-specific regions: Sequence locations=1-38,61-260,282-1391,1413 -1434,1458-1479,1501-1517,1540-1572,1601-2019
atggatgctcgggttctacatgttgattacgtggtggtgggtggcggtgttgcgggtgtttgcgttgttcaagagctgtgcgatttattggaaagggacgaagttgctggcacatcaaaccatcgcatcgtttttatctcaggcgccgaaggattcgttaagcgtgtggccaatcaaagacaggttgagatgtctgttcaagcctgatgcagtcaatctttaaggttggacaggtcacaatggccttcgacgtggagggcattgacccaaatttactttttggcgggtcaagcagaattcaattagttcagacccaacccatccaaaagtaatccgattacgcgacctgcaaacagttaaggaactacaaaaacaactggggaacgccagacgtctgctcattgtcgggaatggcggaattgccaccgaattggcgtaatttaatagacgagaaacttaaattctttcgaatttgtgacaaatttacaattttcttagatttgaattgcgcaacattgaaattgtgtgggcgatacgacattcatcaatttcagcaacttattttggtaatttttcttttcctttttgaaattgtttattaaaaaaggtttagatattgctgcagcaaaattcttcgagtctaaattggcttccgggagactgaagggcgaccagaaatccgaggtccacgctgacaggtccttcattacatttttggagatgtttggtcgattttagttgcctgacttttctataattggttgaagaaaatatgcaaaaccctctaaattattattttaatttgaattgatcaaattgtctttgccagattcactagtttggtggtccaacgcacggacaatgccgaattgaccgccaatgcgtcagacgatgagacactgcgcgagcattttggcgccgcgctgggcccgcattggctggccaaattggagcagaatgagtcgcatgaaaatgttaattattttcggttcttatcacttttgtgaccccccccctgaaatttttatttttagctatcatgagttttgcgtggtgaaattttacgtgcaaaaaatttaaaaaatgtaaagttaaaacatcaggcgggcggcatgaaatctacaatgcagcccaaccatctgatatgagatagtggagccgtgctcaattttttcttcaattacattaagcagagtctctgcagtcataaagcattcacgcgtttcccgacatatccccccaaacacccactgctctggtaaaatgcgtcccacatggtttttgcgttcgaaaacatggcctcgtcgatttcgaccgtcaaattgtttccgcctattttatgttgctgttgttattgtgattgatgatcaactatttataaaacagtgatgcattaactaacaacatttataaacagtctcagattatctttaatccttttaaaatgtctttttcatgccgcccgcctgatgtttgaactttacattttttaaaatttttcacgtaactcacgcaaaactcatgatagctaaaaatgaacgtcatattcgtgttcagcgcataaaaatgccctataaaaaattgttaaaaaaaattttatggggggtcacaaaagggattagaacctcattttcaatcgtattatcgccactttcattgctttttcaatttcagtccgttcgaaaagtacacgtcatttccgatgtggaactgattgggctgagtgaccaaaggccatcatcattcgccatcgattcggccgtttctttctgtgaacttccttcacattttcttggtgcccaaacggattggccattgtgggcacaattgagcaacggagagcgatggttgggatgtgatctgatcgtcgatgccagcggagtggtcccaaactctgaccaatggaagagcgattgtccagaggttgtgccgctgtgcttatcgccagaaaatgtgccacaatttgttctaagctttctcttgccgaagattatggcattctggtcaacgaacagatga

SEQ ID NO: 82022 - DNA, 424 bp, Heterodera glycines
  Genomic contig location: Contig_ID=SeqID_2861; Location=1343..1766; Strand=-
  SCN-specific regions: Sequence locations=1-30,52-251,274-424
ctgaactaattgaattctgcttgacccgccaaaaagtaaatttgggtcaatgccctccacgtcgaaggccattgtgacctgtccaaccttaaagattgactgcatcaggcttgaacagacatctcaacctgtctttgattggccacacgcttaacgaatccttcggcgcctgagataaaaacgatgcgatggtttgatgtgccagcaacttcgtccctttccaataaatcgcacagctcttgaacaacgcaaacacccgcaacaccgccacccaccaccacgtaatcaacatgtagaacccgagcatccataataaagtgtacaagtaattcttcgatatttttggaacctggaaatagggttagacaaatcgggtccgggtaaagatatttacacgattctgtattgactgggtccaaaagca

SEQ ID NO: 82023 - DNA, 356 bp, Heterodera glycines
  Genomic contig location: Contig_ID=SeqID_2861; Location=7206..7561; Strand=+
  SCN-specific regions: Sequence locations=1-94,117-356
atgtccgtgtttagcagttcggattctgcgacttggtaaaattgattagaatataataaatcgttaccaagttatggtttttcagcggggtacctaaaactatggatgtaccaaatacctttgtctcaacaaataaaaaaaattttgtttctagcagcaacagtgaggcgtttttcgaaagtgcggaagagctcggggaagccttggatctccatcccgatgttattaaatatctaaaggaagcgccgcgttcggatgaggacccgattttggtgcttgattacaccgatttgttcaatggccttcaaggcactctcaaggacaacaaaacctgggtggcgaatctcctggtatga

SEQ ID NO: 82024 - DNA, 826 bp, Heterodera glycines
  Genomic contig location: Contig_ID=SeqID_17518; Location=221..1046; Strand=-
  SCN-specific regions: Sequence locations=1-187,218-432,507-518,541 -593,615-826
atggagcaactttccgaaatttatgcaattcgcgcacttttgcgtcattattggaagaagggcaccaatgccgaggagacagtgcgcaaaatttgtgccgtcgaaggaccaaatgttgttgacattgaaacggcacacaattggttcagttggtttgagtctggccacctaacacttgaaccaaagaaaacaatgtaaaattaaaatttatttttcacgaatttgtacagaattttgggtagaatgtcaaattttttggcagcctatatctggattccatgttggacctggacctagatttcctggacaaaaaccctggaaacgccaggtccaggaaaaatccaggcttttcgaggcatggacctgattttttaaaaatttttttgaaaaagcaaacaaatgttaaaaaaaatcaattaattgctttggaacatataaaaatatttaattgaaaataacattttgtttttaaattttttaataattttttgaaaaacttaaaaatacatcggtcagatgaaataaaaattctaaaactttgcccaggaaatcaagcttttttcatatttgacatggatctggatatcctggataaaaatccctgaaaatccaggtccagaaaaaatctaggatgccgaaaaaagttatccattgcagttggcttcccagcgaaacttgggacgaggtgttcaaatttgtgccattctctgacttacaccaacacgtccaaatgacttgccaacgtttctgggcactgtctgaacccattctcaacagactgtgcccacgtgtcgcaaaacccataaaaatttgttgggaaagcgaa

SEQ ID NO: 82025 - DNA, 471 bp, Heterodera glycines
  Genomic contig location: Contig_ID=SeqID_17518; Location=2373..2843; Strand=+
  SCN-specific regions: Sequence locations=1-471
atgacttttgtcaagactacagtggaagcattgaaacaactccagacctcttttacctccgaccaaatgccaatttttaataccctaattaccactttgtcctctcaaattgacctgcttaatggatcgatttcccaactccgctccactgctctctccactgaaggcatgccaatttcagcggaggaattggaaagacagagaagtgtcgtcattattggcatgccagagcacaacgacagttcaccagcaaagcgggcagagatggaccggtcaaaaatcaattgcttattcgattcgctggggatcgaatgcggtaccattgcctatcgcatgggtcgttcctttaacccagcccaaaaaagtcctcgcccattgaaaattctcttgccttcccgtggcttccaaaaacaggctctcgctggggcaagattggattgtgtatgctgggaacgttattttgagagatga

SEQ ID NO: 82026 - DNA, 378 bp, Heterodera glycines
  Genomic contig location: Contig_ID=SeqID_17519; Location=377..754; Strand=+
  SCN-specific regions: Sequence locations=1-117,139-254,276-284,309 -344,366-378
gcttcaggaattcctttgttttcgttctttcttttcatttgcactgtccgacggattggaaaatgatcaccgatatgcaattgggtattcattcatcctttggcatttgcttgttcctttcattttttgctgcttaggtatcatggccaatgttctcggcgtctccattttcattttggtcattttctaccattacatcgtcgccaaccaaaagaaacagtcgccgcagtgagcgaaagaagcgaagaaaacgccgaagaaagtcaaatgatttgatgggttatgattaattaattaatttatgtattaattgagagggacggcgcataaatttgtaattgattcattgtaaagagaaaacaaagttaattacacaaa

SEQ ID NO: 82027 - DNA, 1834 bp, Heterodera glycines
  Genomic contig location: Contig_ID=SeqID_17521; Location=23..1856; Strand=-
  SCN-specific regions: Sequence locations=1-206,228-236,258-518,540 -568,591-808,830-888,910-1206,1249-1373,1396-1517,1539-1695,1717-1834
atgagagtaaatgttggcatagtgtcttatccgaaaatgtgaaatctctcggattttatacacatacctatttcaaaattccatattggcccttcatccaaaccctaaaattgtccctgaaattcaattgctatgaaaaatttgccgcccgaacttttgagtgaaatgaccctttacatattgtacccaaacaaaaattttccgaacattttttcttcttcctggttactcagggaatttctgattccccatgtcactaaacgcaaggaaatatttaaaaaagtgcgttacatattagaaatagaaaagggttttggtcaaattctgacccatttatatccgatttattcagcgccggaatgaactcgaacgattgtataatggtgcaagacaagagccaatttggctctgtatcgtgtcatcaactgggccagaaaaacaaaaacagactatcgacaacttccttttttatcttgaagaatacctcgtaagtattgattggtacactttaccaaatatttaaccaatttttcaacaaaattcagaattaccccatttcaaatcgaccaaccgtggaagaagagaaggtcagttaggggtgtagaaataatgtaaatgtccataaattgatttaaggaattgtccgaccgattcctattactggtcaagttcttctaccattgtgaagaaacaattgcctggaagtatctcaaaaccaccacttctcgcaccgttcagcaatttcttgatgagctcagctcattcttcgctttggtatgcgcattatttgacccgattattctttgcattctccaactaatttataggtctttgatttgtcacccgaacattcgcaacaccagcagcaaagtgaccacgaggtttacgcaaattttgaacccacttattcttctccacttttgctaaattgcgtttactttaggcggtgccaactgatcagaccagttcggccgattcggaccttcgtcctctgcccgttgtcaccgagtcggtgccggtgagtcaatagcagttactgaaaaaatgtaaaaccctaacaattttaggaagaatcgatttacgatccgccttgggacgaccgccctctgcgtttcatcaaaaccatggctgctttgcaatcgcaccgatcaacaaatgtaattgatatctctcttatctttagttgctttttaaatgttctcaattaatagcaaatttatttttcttttattgcatttttgataaattgtgtttattttaggtgctgcccactgttccctcaacatcggccgattcggaccctcgtcctctgcccgttgtcaccgagtcggtgccggtgagtcaacagcagtttcctcaattgcaaaattttagaaaaattttcaattttgaaaacagcctttgtaaagtgtaaaaatgtttatctgttgaacaatggataattttgaatttgttttggacccgggcccagccattttatggccgtcttgtttttattgaatcgcagtgtaatttttaatctttcttttcgactttattaaaatcgctcattttattttagacatccgatcttactgcccttttcgcggagtttttgcgcaccaactgtgttggacatgtgcccaaagagtttcttgtcaaccatctggaggaggccatcaaaattttgaaccttggcggcggacaaagcgacgacaattccaaaatgtccaagtttcgcaaggtattacgttccatgtgccttctaataattgaatcggatcgggcccagtgtgtttttaccgggtcgccgtgtgtcacttttttggatcaatcaccgggaagggacttctag

SEQ ID NO: 82028 - DNA, 1061 bp, Heterodera glycines
  Genomic contig location: Contig_ID=SeqID_17523; Location=1124..2184; Strand=-
  SCN-specific regions: Sequence locations=1-117,169-180,202-535,565 -613,637-1061
gaaacaattaacttagattgtcctccacaacttgtgccggtgcctggcgaaggcgctataccctacagatattgctctccgtcggcaccaattaacgatggcattcaggtccgggacatattatatttataatagtatttttttaatgtttaaattgtatttttaatagaataatcacatataataatacatatttgaaaaagggatgcggtataaacagacattgccaatactcaacaacactcgaacgctacatttgttgcggacttgagagcgatgtccgactaccaagtagccggggggggtttatcggtggggggcaattcggtttccgcttttaggaaaccataacttttttctttgatgacttataagactaaaaaaagttatgacatgcggcgccaaaaagccaagtaaaatcaattttttgagcttttttggccataacttttttgtaaagcgacccaattttttttactaataaacagaaaattaagaaaaaaaatgggaaatgaatgattctctttaaaattctacttaaaattttttaaatttaacagaaatctctagtgaaaggacatcttttttttctgaaacaagttgtcaccagaaattttaattttgtttttaaaaatatgctgtattcttggaaagcttaatattttcaaattacctgtaaattgtttggtacaaatgttgattatgcttggcaatgcaaatgtccatgcctgcggcgcaaataatgcgcgaaaaattaaaaaaagctgtctcattaagtattttaaattgaatgcatagtgaattttcagatgtatgtccgcctcaaccagcaaatcttgttcccgttgaattggccggtaactaccgtacctgtaatccatacgccaggtccggtaccccacaggtcagtgattcctttcttcttatttattttcttcacattattttaacgcgtttttaaatcaagaatttttgaatttttaaggcctgcccagagaattctgcatgtctgtacacaggccaagacaatggctttatatgttgccgagtgcagctgcaaa

SEQ ID NO: 82029 - DNA, 763 bp, Heterodera glycines
  Genomic contig location: Contig_ID=SeqID_17527; Location=14..776; Strand=-
  SCN-specific regions: Sequence locations=1-59,81-162,204-487,525 -549,573-661,684-763
atgcaaaattattttctgttacctcttttgcctctttaccacgataatgggctcagaataatgcacgaaaaactgagaaacccaattttggacactttgacgcaactgcaaaatgccattggaaaagaaaaaaaagcgaggtaaaaatggaaatatataatttaaaaataaaaaacaaaaaaaaattaaaaataaataaaaatttaaatgaagggaacaaaaaatgaatgcgatacagccgagcagcagaatgaacaacgtagaaataagcaataaatgcacgaattttgtggtgatggccaacaaaacggggagaaaaagtcaagaaaacaattcaaaaaaagaaaatgaaccaaatgaattagaattaaatttcctggaaaatattggtgttggagcgcagaaaaaagtaaaaatccaataaaaatgatgaatagggatcgggtttttcgaccgtaaccttggcattttgtctgaatttcttcataaaaatgaaagaaatgcaaaaaatgttccctttttaaccaattttaagcccacaaaatttgaaagaaatttttaggtacaatttttaatttattggccaaaaatatgtggaaaaaaagttaaacttcattcatttaagacacaaaaaagtgtttacatgagagaatggcacgacaaatatttggaggacatgaaaaaagtgttgggacagaagcgaactcagccgcgaaatctgttgacagagcaaaagtacaaaagtctaatggaaaaagtgaag

SEQ ID NO: 82030 - DNA, 1761 bp, Heterodera glycines
  Genomic contig location: Contig_ID=SeqID_2863; Location=145..1905; Strand=-
  SCN-specific regions: Sequence locations=1-347,376-545,569-613,635 -913,950-997,1036-1265,1287-1344,1366-1761
atgcccacggaggatgactttttcggcatcaaatcgctcgattccatgccattgccacaattatatcagcacagagcaaaagtgccaaaatcgaccttcaaacggcgagagcaaagcggcggacgaagcgatgaggctgatgtgttcgaagcgcatttcttcccggaattatcggaaaaggaggagcaggaaaaaatggatgggaaaaacggtgccgacactgatgctcaaacattcattgaggaacagttcttcccgcgaaggtgccacgagaaaaattggcattcacaattaaaaaagcgtcgccaacttttgaaatttctagattcgacattttgaaaaaagtctttttttttaaattttttttttaatattccatgttggacctggattttctgggcaaaagtacaggcatagaaaaaatccaggctgccgaaaaatgactatagaatctaaaactgcgagtcaggacagtacgagtacagccagtgatagacacacctttttcgaaattttttttggcaatcctgaagaatgggggtttctatttttattttttttttaatttgtgctcaaaagggtccggaattggggaaatccaagttcagattcgtaatcatcaccctcgaaacccccattccttcgtgcatttggttgaattttgaaaattttgagatttagacttacctattaggtattgaattcggggtccagggttcggaatcatatcatattaaacgtatgtcagattcgtgttcaacgaccccttaaacctcctagaaacacatgacttttcaaaaattaaaaattaaaaaacgcccgagttgggctgcttccgttttgacgtaaaaatggagggggtcaaccatttttttgttgcaaaaagagggttcaatggtgcaaatcggcttactttttgaggctaaattaaaaaatttccttgaaaacttcgttttcgagggattttccattgaaattccaattttcttttttgcatcccgttttttcagagttcaacaacaacaacaaatgatgccgccattggacagtccaccaatgacaacaacagaaattgacacagcagaagcagatgatgctgctgaactgttcgagctgaaccagtctgacgggaccagcggcatcaaacagttgtgggctttgatagacccaatttggaaatttgaccgtgccgaattggtcgactgcatggcaaaacgggtcatctacgagactggtgatagctacttgttccatgattttcgtatatataaaagacagaaaaattttctgctcccctctgcaacttttcgctctttaaggcaattgagggccaagtgtccaccttttcaaaatctcaaaatttgaaaaagagttgatgaaacacattttagggattatcggggtcgttaaacgtgaatctcacattcaattccgaccaattctgcacccctaatccggattataataagccgaaaaattcagagagtataaatgtgaatatgaaattgaatcgagcccgaaaatccctaaaaatgtattatgaaattctgtaaagtttaatttatatttttttcgaaaaagtgggagggggtaccacctagaatggccatgatttttaaaaaacgttcgggatttgtatttgcgttttatttatttgattttttttgcctttcagatgaccttatcgcactggacaaaccattccaaatggcattttcgtcgggcccggatgaccagccccaacttgacaggattttacag

SEQ ID NO: 82031 - DNA, 2499 bp, Heterodera glycines
  Genomic contig location: Contig_ID=SeqID_2864; Location=3124..5622; Strand=-
  SCN-specific regions: Sequence locations=1-112,134-722,744-1078,1100 -1362,1387-1572,1595-2499
atgcaggggcacgaggccgatatcaccatcgtcacgacgacagtcaccaagcagcaacagttcagcaattggcaacgggccaatttttcaaaggatcgtaagagtgaattttggggtgatgcccaaagggtgaatgttgccctttcccgtggaaaacatggactaattgtaataggcgactttcttgaattgggaggcagcccaatttggtccagatttctgaataaggccattgagtttacggtggtaacatccccgtccgttgttaagtccatcaaaagcccgagttcgagctacgtccgtggacttttagtcgatgattctggtgagtcagtccagaactatcgttttcatgctgattggttggcacccggtcgttcgtcttcaaccgcggctgttctgtctcgaaatgggaggccattgaacgatttaaatcgaccaaataatctcaatttccaaaattctcctatcagccaatccagggacatctccaatccgccacttccttctcgtcatgttcagcgcgaattttcacgaactcgtgccgaaattcgatgttggcgttgtaaccagccaggtcatgtctccactcgttgcaccaatccaccagcacggcagaactgagagtttgtggacaaactcaaaagaaggagggacgtgtgaggcacagagacggaatatgattataagcgatcatcgatcactttgttgtctttttccccgcccctttcgcttccttttcccgttctccccgttctcgcggcagtcagtcaagggggggctaaagagtcgagagcgatagagcgagatgggctttttgcgatgggattttcaacttatttatcggctaataaatgatatctgttttactccttcttggcatttctccatacgcatccaatcagtcgcgcgacccggggatcccaattcggggaggccattaatccagggcccggatcattggctcgttcatccctttcccccgaatacgatgtcccctttcgtagcacatttcaatgttgtatgtgccaaaattggacgcagaaatggttggcaagaaacaataagcattaaaaaagttgttttttcataaattttcgtaaatatttaaaaatcacacacagtccaaggggtgcgtagagggccgggggaggcagggtgaaaaacgaaaatttgttttctcggcggacacctctcacctctttccccgttgaaaagttagaattttttggacaaaatcactactacatcgtcggacccactttccaatgcttttttttcttgaattcattgttgcgtgctgagaatgagttaaaaattggaaaacattggcaacaactcatgacaactcatacaaaagacaatttaattttaaaaaattaaaaagaaaatctttcctattaaaaaatattgtaaaatgttaaaatgaaagatgaaactagtctattctttgataggtcccttgttgtacgagttgtcatgtcaaaattggatagtcctaagatcctctattagcatgcaaaatttcaaaaaattccgtctggtttcaaaaaatttatagccaaaaatgtttagaaaaccaactttttaaaattttctggccataaccttttttaaacataatgaaattttttgaagctttgcagcctactagaggataactaaggcttacgaatgataccaagaatgtttaataatggatgattttagaaaaattttcaggtacatcgatcattccgtcatcgcttttcttcgttcaaatcaccaaaatttcgacaaaagaggaccgacttatatttgtggattccatcatcacacatcatggatgtacagccaatttgggacatttttgtgcgtgatatttggcccattttttcgacaaacattcgccatttacgctttaacatggtgatcagttggacaattttcttcgtcgcacttcgccgaccattatcactgatctcaatcagttgaattcaatcgattcatatggtctgttgcccgaggcaattgcgattggtgacgattttgcacacaccgagaaaagatggccaacccaagcgattgtgttgcacacttttgaacgacaagtgtacttcgattgggtcaacaatttcaagaaggtatggtcccatatttttttgcatattactgattttgactacttctatttttattttccaaattgtttagcaatttctccgtgccaatgccatttcttccgtcagttaccaaattcattttactgttcatgcgccatcaattgtgacatttgaattggtgaacgaatggacaaaggaaaagctgacattggccaaagcaaaggaattggacaaccgatggataatgaaacgatgcaaaattggggaggccgtgacggttcagcagcagaagaacgatgaaaattgggataacaattgtaacaatgtgttctttttgcttttagtggcactaattgtgtcgggatcttcggaaaatccttaacaaaaatgcaataaa

SEQ ID NO: 82032 - DNA, 231 bp, Heterodera glycines
  Genomic contig location: Contig_ID=SeqID_2864; Location=1326..1556; Strand=+
  SCN-specific regions: Sequence locations=1-8,30-151,180-183,217-231
ttgctttagtgacgtcatcgggcgaccattcgccgccggcggttgtctcagcgaatgttgcaaaggtgggaaggaaaccttaattatttcacaaatgccatttaatttcaggaagtgcctaattcgcagcaacaaaatgattgggatgccaaagtttgccacaaagacatcgaaatcattggggaaaagcaattgacgatcaattgcaagggcaacagatttggtatttaa

SEQ ID NO: 82033 - DNA, 57 bp, Heterodera glycines; identical to SEQ ID NO: 78091
  Genomic contig location: Contig_ID=SeqID_17530; Location=619..675; Strand=+
  SCN-specific regions: Sequence locations=36-57

SEQ ID NO: 82034 - DNA, 102 bp, Heterodera glycines
  Genomic contig location: Contig_ID=SeqID_17531; Location=1783..1884; Strand=+
  SCN-specific regions: Sequence locations=1-102
atggtctttcggctcggcctcctcctcgtccttctcatttgccttgtccacatggccagctcaaaaattgccgaggacgactattgtggagtggaagataat

SEQ ID NO: 82035 - DNA, 438 bp, Heterodera glycines
  Genomic contig location: Contig_ID=SeqID_17533; Location=849..1286; Strand=-
  SCN-specific regions: Sequence locations=1-102,124-158,180-438
atgtccattttggtccccggaaaaatccttagccgttttcacattgcccaatcgctgcacgaagttgaaaaatggatagcgccggaagcgattccgatcggatatggcgggaagagagtggtggaaggagccgaccttccgacggggtgcaacagaccgacggagtacggcaaaggggactatctggtgagtggtgctggacggaagttacaattcaataaagccgccctaaaaatggcattcgtcggtgctaattttgccatttatcacagacggatggaatggtgtgggagagatttggagtgggcaaagtgaattatgagcaaagcgtcgtcggagtgggcgacagttggacacgcgaactgagggccaaagctggtcaaatgctcgtttacgaatactttgccaatcgcaacttcgaaattacagtcgaaaatg

SEQ ID NO: 82036 - DNA, 1259 bp, Heterodera glycines
  Genomic contig location: Contig_ID=SeqID_17534; Location=400..1658; Strand=+
  SCN-specific regions: Sequence locations=1-144,169-1029,1051 -1097,1119-1259
atgtacatccgagagttagaatctccagatgagcactccctggttttattcaatccgcttcgttcttgctttcgtcctactagagatgttcgagaataatgaaatttgattttttaggctaaaagattgttatagttgaggaagaaataattttaaatttttaactacatacttagtttcggataatgggtttggacatcaatgaaatcagaaaaatctaggaattgttttcggcaattgcctgtcagcgacgctctatcgcccgtctggacactgaaagggcccgattccgtcgtttgaacggagctcagttccgtgtggttgtgcgattgtcaggttatttttaaaacgatatccaattttagcagtttaatggtgaacaaaccgcgcgcattgtcagctcaccctttgttttcattgtttgaaaattaaacaaaaagattaaaccagggggtcgtcggggcttctgatcacgaatatgaatatcggatttgcaattatttatttaccatagtttatatcatatatttagaaattttgacaaatctaattaattattgaccctaaatctatgcttttcaaaatcactgattttcaaatcaatgttattagtgcgtgatcagaagccccgaaatccccagcagcggggttggtctttatcgataacagaaaattatttttatcgagcccatatccattatgccttaaaaagtagttaaatttatatcttacggaaaattcctcgatttaggaggcttcttgccaaactttgctgctgttatgccacagcaacagaacggtgggttgtcatttcccttcgttttaccaatctgctcatttttggcacattttagtggtcaatgttgctgctgttctcgccaatgccaatcccaatggacagaattataacgtatgtttttatttcttaccttattaaagaaacagcggggaataaaggcggaccgggaacccattagttcttaatcgcgttctcggctaatttagacagggtcccgattccggcgtaataacaattttttaaaagtttctggtttgggaaatttggattctccaatacaaagaaagttcagcaaatcctatttattttttcttttacaacccatgtaaaccagctgaaatttagcgcttgcagcgtttgcatgcggaattatcggagaccatcgcccgtttaactgtagaaatttctcagttgggatacatgtatgagcaattgaccgagcgtcttgaacatctcacgg

SEQ ID NO: 82037 - DNA, 805 bp, Heterodera glycines
  Genomic contig location: Contig_ID=SeqID_17535; Location=264..1068; Strand=-
  SCN-specific regions: Sequence locations=1-535,557-592,614-615,637-805
atggcactgatggacatgaccatggacccggtggtgatggcggccgtgaccatttccatcggcttcagcgtggacatgccggtgagtgtttttatggaggatgttgatcagccagccattttaatgaacaacgatcggtttttcaagtgatcaataaaagtgtccattttccaaaacaatcaataaccgatcccttgccagttaattgataatgaccgatttccaacaaatcagtaacctatttgcctccccagctgatcacaataaccgatcaatttttggccagccgatcaataattgccggctctactttttaggcccatgtttcgtatcatttccatgccgccaaatgggccggcactttgggtggcaagtggcaaaaatgtgcacggcattgccgaccaaagtgttgaacacaaaattcggcatgccttcacctctgtcggcttcccggcctttcaagcatccatttgtaagcagattgttggatggccggaaaatttgccctcgggatatatgcggcatggaaattattctttttgggccaataaaataaattagccccaagaaaaatttgccaaattttaggggcaaaattattattaaaaattttccaaaatcttggaaaatgaaaaggttgatattttttttattaatttcccaacagatctcaacaaaaaaacgcgaattttttccgctgacgtctgtcaaaattttacatttttcgtagtttttttccaaaattttgcgggtaggcctgagggagggggggggggctatacattccatttagttgctaaataaa

SEQ ID NO: 82038 - DNA, 2973 bp, Heterodera glycines
  Genomic contig location: Contig_ID=SeqID_17536; Location=229..3201; Strand=+
  SCN-specific regions: Sequence locations=1-139,219-227,249-384,407 -558,580-596,619-816,851-892,914-996,1061-1242,1319-1404,1427 -1434,1472-1540,1562-1825,1847-2163,2187-2245,2278-2286,2318 -2669,2783-2850,2872-2973
tatccgcttaaattgttgtcaggttatttgatgggctgaatgaggaaccatatggattattgcctctcgttaatttgatgggaaaaggcgggccaacatcagtaaaatcagtgcaaagaataggtgttttttaacaaactaataaataaattttttaataaatttaaattatattgaaaataaattgattaaagcaaaatttaaatatttaaaaaaaaggttcttatcaatggcgacttgaggacgatgagccggttattcttgtgcccgggatgccattggagtcattttactgggcgggtgggagactgaagcaggacggtaagccaaataaacgaatttcacatgtgccagatgttttcggcacagtgtactgattttgacaaaaaataaaataaaatttattgcgatttgctaaaaaatttcggggagtcgaatcaagaaaacgaagttcgactcgagaacattaaacaaaaccgaccgagacactacagccattttttttattggccaaagattatcggcaaaatccatacattaaattattttaaggcatggtaaagtacatacattaaatttgcaattaattggttgtataaaaatcaaagacaattaaaaatagagttgctatttgtgtcaattttgaattttcaggtggcgttgtgatttacaatgtgaaccatttaaaggtgcgcgatggtcagttggactcggcaatacttgcggcaaaattgtttggcaccaaagcaaaaaaggaagtgggtaatttttgcttttagagtaattggagagctatgaatttatatttgtggagggatttttgaattttttaaaattaaagtttttcaaactaccgaatttcttgaaatagagccccgggggctttgtttttaaccctcctcaaaaaggggggctttattacagggaggctctattttcataaaaaatccgggtaataattattttttcacaaaaaacaaatgcacagactactggattttataattgttactttttatataatatattttatttctttgtattaaatttaaaattatttgtagattaattttgacgagttcgatatcatcacaggtattattatgcagaaacaaatataattttcgaaaaatatactatactgcttcgcatatattatatgtgtccattcagatgcgataaatttgcaaaagatttttgcgtttgcccaagaagtaagtgatgggtgacaacggccgaaggaataaatttttcattgaaaaatattaaaattataatttaatattcaatatatcaaatgttatttaatataattatacatcgagagtgttcatattcatttatcgtgaaatatttattaaattctatttcgacataatttatgaagagtataaacaatgaaaattggggcccaatttccaaaaatttctccgttttatttgaataaataattttgttaaatttcaattttaggctggcgaaggactcttccgcattgattgcgaacgtgtcagtatttaaaaaaaaacattttaagggaatatatttattttttcccctaaaggtaggtaaaacaatgctgatgtcaagaatggaagcgtcggacctgatggaagtgagttgattggttggtctacagcgtgtccatgcattgctgctcgagattctcggcttagagaaatctcggtacttatccgttatgccgcaccccgcgcaaaaaaagtcattgttctgacatgtcaaaacaatttttctagtgtagttttaggcgctgaacaaaaattttattatacatttgactaccagatttttgattagcgcttacaaattagaacaaccacagaaaattgttttcatttgtcgggattatggcacttttttggggggggggggagggcataacgaaaagtaccgaaatttctttgtttttgagctctcaacacgttggttaagtctcaagagcagccagcccattatttaatcaatcaatagtaatgggcgagatctctggttagcgattttcgtgaaattctgatttttttgagttttctcctcacttcccaggggtcattattatattccggtccaagttccatgaaatatttctgactatagcatactgtatttgtagattggccacatgacctttgatcagggattaaaggcaaaaatggcgaaaccccgttccaagcactgtacaggaccgttctttcaacttgtcaggcaaaatttttttacagaattgtttaaaataattaaattatttattattttttagttttcaatttggccaattcaaaattttagtgagttttttaataattctaaaattccgtctcctttttaaggcccgttatgaagttgattgtgcagattttgcagccgcaaaagcgtaaaaaaattatcattttcatattctgaatataaatttttttggtaaaacagggaaccattccaagaaagtgaagaattgccacaaaaacaacaatttgaaggtagaaaatatattaaatttaatcggattaaaatttgactaaattagaaaaaaattattttggttccagaaaattcctcaattggttacatcgagtttggacaggttccgtcaaatttgccactccaattggtcaccacatacccacaaggagccggattcccgtttgtcattgttataaattataatttaaataattcaaaaaagatttttttttgacataatttgaaaaataattaaattaaaaaaaaattatttttttaacaaaatttaaataataattaaattgtaaacaattttagattctttacttggggacagatgtgagtttttaacaaatgccataactcatttttcactaattgtgcctattttgaaggttttttacaagtgctgaccaagaagtggtcggctttttcaaaggcaatggagacttcagcaaaccagccttttacgggctaaacgacatctccaaattg

SEQ ID NO: 82039 - DNA, 2164 bp, Heterodera glycines
  Genomic contig location: Contig_ID=SeqID_17537; Location=223..2386; Strand=-
  SCN-specific regions: Sequence locations=1-690,712-983,1005-1189,1212- 1435,1457-1691,1715-2164
atgaagcattttcgcaccaaccatctgccgaagaaacacttggctatcgtcccggaacgcggctacgacaacgcccaaaaccagtcgttgctggcacttcgcttctttcattggtatgcggaggagcatggtgttgtggtgcagacggcgcattcggctggcggagagaagaaaattggccaatattccgtggatggctgggtggaggaagaaagaagggccattgaagtgaatggatgcgtgtggcacggctgcaatgaatgcttccccaatgacaacatgttgatgccaaatggaaaaacggctggagaggtgcgagagcgggatgagaagcggctggaattcatcgaaagtcaagtgtcacgagtggacgtatactgggaatgccaaattaaaagaatgctgaaccgtgacccggacatgcgcgaaagttttggtgattatgtggatgatggcccgttggacattcgcgaggcgttcatgggtggaagaacaggaccactgaagctgtaccacaaggcgggagagggcgagaaaatctcgtactatgactttacgtccctctacccgtacgtaaagtgagttttgtttcgatcattattcacaatttataattttttatttccagtttctccaccacttacccgattgaacacccaaaagtgctcatcttgaatgaaaatgtggagtggacaagcgcacgcgacaacccctacaaattgtcgttgctcaaggtttgggtgattccgccgcgaaagtgtgatgtgccagtactacccgtcaaagtcaacaaacggctctgttttccgttgtgcatgcagtgttgtctagactacccaaagggaggcgttgattttgactaccaatgtgaacacgacgaccaacaacgcggatgggtgacaacatgcacatcaattgaattggacgcagcacttgaagagggctaccgcgtgaccaaagtgttccgggtgctgaagtacaggcatggcgacgacaagctattccgcccatacatcgccgagttcatgtcgcagaaaattgaagcttccggatttgacgccagcatcaagggaaatgaagagttggagcagcagttcatcacagaatgtgcggagaaattcggaatttcaatcgacaaggacaacatgaaagtgaacaagggcaagcggtcgttggcaaagctgtgtctcaacaatctgtgggggcgcttctcattgcgaaactttggccttgcccagacgttgatcaccgacgacccttcggtgttgactgaatacgtggaaaacagttcaatcgacatcatttccattgatgagctggacgaaaaacatcaattgatcagctacgtccagaagaaggagtgggtggaggagcacgagtgctccaacattggtgagattttttcaataatttttgtataattttgggatttttcagtcatctcactctggacaacatcaaaggcccgccttctgctgttgaaagcgatgcagaaggtggtgagaacgcctggatgtcggttgctctacactgacaccgactcgctgattttcgtccacccgatcggcatgaacccgttggagacaggaccacacttgggacaattcaccgatgaataccccaagcatgaaattgtggagtattgtagtggcggagcgaagcaggttaatttaccgtttatttagtgcataataatttatactttatcatttcagtatggactcaaactccggcgtaatgggcaggacgaatttgtgctgaagcttaggggcatcacactgaactacgacgtgatgcagaaccagtccctatgctacgacacattcaaagaagaagtgttgcggtatgcccaaaccggagagtatgagccaataaatgtgatgtacccaaactttttgagacccgacattaggggtggcggacacgtcacttcaggccccctccaaaaatgttatcgcccatatgtaggcaaagggatagtgggccctaattatgatgttctcaattttggacacactttgtaaatttatcgttcatcattcattgtatcactctcacacacacacaccccatacacacgtacccacacatgtaccacctttgtttttcatgttttataccaaaaattgtgtaattttgtcattttatttgcgtttttaataaa

SEQ ID NO: 82040 - DNA, 956 bp, Heterodera glycines
  Genomic contig location: Contig_ID=SeqID_17539; Location=686..1641; Strand=-
  SCN-specific regions: Sequence locations=1-311,335-956
atgtttattcgaaatattatttttattgaccatctaatgtcgagattattaaaaattattacaatagatggaaattttacaagttaccgaggtgggtgatagtttaattatatatatatgggttaatgtactttgataataaattaattagtgtataaaagtgttgtaatgtattcgttaaatatctgtatgtctaattattgcaagttttttgtgtaatgttaattaagaaacaataatcactaaatgtaggaaaatgacaattctttgaccaatatgtttttttacagaggaatttatgacgagggttagaaatcttattaattaattatgacaaattacaaagaatgtttgtagtgatgtatgatatgggggctaattgttgtgacaatttatgaaccaattatttttgattgaagtgttttatatagggatttttttatagtatgtgtgatgtttttaaaacttatgtgattaattatttcaaattaccgagaatgacttgtaatatttttattagttgtaaaagaatgttaattaataatgagtcgtaaattattttgtgtaatatagctaaaaatcaattaatcattcaaaggcggaacaatgtttggtgagatgcttttacaattatttagtatggttaaattactaagattttctggtagtgtatgtatggtatctgtattaattgtaattttagacctaattgttccttaattttttactaattgaagattttatgcagaaagaagggttataatgaaattatatctatgaagcataatattggaatctgagaatatagtcatcaacttcaacagatttacatatgtttcagtagagtgaaatttataaattatgattaattaaggaagggagtgtataagtcataaaaaataactagcaaaaatattgtagagtgaataagacaaaaggaagtgacgaataataaa

SEQ ID NO: 82041 - DNA, 824 bp, Heterodera glycines
  Genomic contig location: Contig_ID=SeqID_17541; Location=282..1105; Strand=-
  SCN-specific regions: Sequence locations=1-235,263-824
atggttattgtctatcgaccttacgtcagtcgttggcgccgagcatggacagttatcaaggcaaagcctcgtttctggctcaaatattatccagaattttctgcgggctggtatatgctggttccatcggtcattatttgtctcggaacaaggttctattttggcgggtatccaaacaacttcggcatgggctggaacggtaaggttttctctatggatatgcctgagtcatcaatattatttgtttgttttttgtaaatttcaacagtccttttttattttttgaatttactcattgaattctaaatttttgaacaccattaacaccttttttgagggtgaaaaaccaactttgcgcatttcaccattccaatttcagaaaaacccttctatcgtcagtttttcgaggtgcgtcgtcccgatgatccattggttctcaaatggcgtcttcctgaggttctgcatcttttgtttcatttttaaattgtccctccaggaatatcccgctcgtttccaaaccaaccgtcagtccgactactaccctactaccgctcacaacaaacactacgcctgggacgtgaaataactgcgtgtcgagcgaacagcgaacgacaagaaaaaaacatgcacatttattttatgttacgtttaggaatgacactgtaaaatgttctgccaatgtttttccattttaactatcgtggaggggggggggggtaaggatgtgtgttggagctgcttgtcaaacgttgaatcatttggcacttttgtagttgattcacggtaacagccccaaaagaggtcgaaaaacttaaaaaaataaa

SEQ ID NO: 82042 - DNA, 785 bp, Heterodera glycines
  Genomic contig location: Contig_ID=SeqID_17542; Location=105..889; Strand=-
  SCN-specific regions: Sequence locations=1-486,614-622,645-785
  Gene Ontology: Mol. function=helicase activity
atggcttctgaaaagtttctcaagctcagttggcacccgcttcagtccctcttttttgctgcaactatttccgtgtctcattttacgccctccccgccattgttcagagagctcgtcgacgacagcagggcgcctcaaccaacaacagacggaccgcgccagtgcgtggtcgaagcagcgcccgagcgcgtgtgagtgcagcggtgcgccgcgcgtcacgtcggcaggggaacaacaacgacggcaacgcgaccaggacgaggaagaagcgcggctcggcaatgcgtcgtccgctcaagctcaaaccgctccttggacgaccgaagggatagcgtaaatcgagggcagcgccgcgcactgctggacaaaagcgtggccgtggacgtccgaagaccgtgaaaaaaggccgtgcccgacgggggaagagcgctgcccagcagcagaggacgacggccgatgcagccaccaacactgacgcaaccggagcggcgactgtgacaacggacgcggcgaccactgcgactactccagcgacaacgacgaccgcggacggagcgacggtgaccaacgccaacgaacccggtgcgactacgacgacgacggctgcgacgaccaatactgaggtgaccgctgcgactgctccgacgacaaccgcggatggagcggcggcgactaacactgatgcaaccggagcggcgactactccgacgacgaatgcggcgaccaatactgaggcgcccgctgcgactactccagcgacaaccgcggatgtggcgttggattag

SEQ ID NO: 82043 - DNA, 857 bp, Heterodera glycines
  Genomic contig location: Contig_ID=SeqID_17542; Location=1240..2096; Strand=-
  SCN-specific regions: Sequence locations=1-384,410-541,565-668,690-857
atatttccgccttccgtcggctgatgcccaacacctttgccttccttcgttatattttgtcgccactccgttttttgaattagtaagtatttcaaatttcaacttaatttgattagttccttcgggatttttaagttatgtaggtaaactctcaaaaaaacattttccccaccaattaacaaaaacagcgaaaaaaaattttttttttttgttttcaaaactcatggaaaaatgtttctcccaatgtattttcggtttcgcgctgatcacgaatagggcacatccatttcgactaaactcgaacccccgggcgtgaattcgaacaaaaagtttgaaaacttcaaatttttcgagtttcgcatttttgttttcaaaacaacggcttaaaaacaaagaaacaaacaaaagtcatcaatgaaaaaaaaattgttagaccatttttgagaccaaaaacacgcgattctaaatatttgagttttcgactgtttgttcgagttcgggcccggggttcgagattggcctaaatggaatgccagttttgtgaaaaactttctaatgacattttttgggttttcccgaacttacttttttcaccccatgtaaaaaaacgaaaattttttgtataacttcccgactttttcacaattaatgtctttgcatttaccatatatcaattctccattacattttagctccgtatccctgcttctgtcttctgtataccaatccgtctacaatttggccgaaatgactgtggacatcgtcacgccgggcaccacccaaacagcgactaggacaaggacgaggaggactgcttcacgccgtcgcgcgtcaacagcagcgcgttcggtgagccg

SEQ ID NO: 82044 - DNA, 205 bp, Heterodera glycines
  Genomic contig location: Contig_ID=SeqID_17543; Location=5..209; Strand=-
  SCN-specific regions: Sequence locations=1-49,78-205
atgtcggacaatcagaaagaagcaaataaagaaatggaaaaagcgatgtaaataatttatttcaatttaatttctatgctaatcattttgcttttccattttcagcttcatctctgccgactgttggttggaggtgttcgatttgctggcaccctctcagcttggcctaggaattgcgatgatcagtcgccgatttgattatttt

SEQ ID NO: 82045 - DNA, 179 bp, Heterodera glycines
  Genomic contig location: Contig_ID=SeqID_17543; Location=691..869; Strand=+
  SCN-specific regions: Sequence locations=1-17,66-179
atgaacagacggtaagcaattaatttaaaaaaaaattacaatttttagtttttctaattttttttccatgtttcagttggatttgtactgatgtttggatggacattttcccatcttttgaccgtcccaaacttggtctccaaatggcattgctttcttatcgttttgatgttttttga

SEQ ID NO: 82046 - DNA, 464 bp, Heterodera glycines
  Genomic contig location: Contig_ID=SeqID_2865; Location=44..507; Strand=-
  SCN-specific regions: Sequence locations=1-36,77-325,361-412,434-464
atgaatgacaactcaacgaacaacaacacggtagtcattaattgaaatatttaaaaattgtttttttttaatttttgcagttttatttggccttcaaagacctccatcccagctggtctctgattggttgcgcactgacttatggaatcattgccacatttggcatcattttcaattcttctgtcattggtgtaacctttttaacaaagtgcgtaattagtgtagataaattcttggaataagcttattgattcataatttaaccctatttaaggtcattccgtggcaccgttaattaccttttggcactttgttccttttttgaaatgctccaccagtttggccattttttgtttgtttatacagcattttcgggacaaaatttcattgagtatcgtttggcggcaaagattttaatgattccaatgtttgggttaggtaatttactcaaactaataattaaa

SEQ ID NO: 82047 - DNA, 689 bp, Heterodera glycines
  Genomic contig location: Contig_ID=SeqID_2866; Location=215..903; Strand=-
  SCN-specific regions: Sequence locations=1-173,202-225,248-252,274 -455,520-689
atggttgttctcatccctttaaaggtccgtgatgccaatgaattacttcgacaggaggcggcaagcgattttccgacaacaagccggaacattgtaagagaaacgcggagcaatttgcctattgatgtgcgagtcggaagcgcaccttcagcatctaatatggcttggaattacaaataccaaaaaagaaagaaccaagaagaggtgatttcttaataaattacgaattaaaaattaattttaattacaaaattcctaaaataaacgcagcagatgtttgtttggatgccctccctgccacggcaattgccatacctgctcggttgcagaattttgtcattttggatggaaacgttgatggtggaagaataattgtttttgctcgaattttggaatacaaacattgcgaaacttcagaaatgagatagcgatcgacggaacatttgaagtgatccaaaaaataatttgaaaattttaactttttaaatataatttaaatgatatttatatatttttattcttactaaaatttagagttgtccaagagggtttgcacaactttacacagtttcaacgataattgatcattgctcagttccatgtgtctacgtgttgttgcctggcaaaagtttataggtctaccgccgattgaaaggtcaatacgaaaattattattttttctaattaaa

SEQ ID NO: 82048 - DNA, 1415 bp, Heterodera glycines
  Genomic contig location: Contig_ID=SeqID_2866; Location=1444..2858; Strand=+
  SCN-specific regions: Sequence locations=1-289,311-534,570-805,827 -896,918-1026,1072-1072,1103-1305,1329-1415
atgaacattaaaggcaatcagagattgagtacatttctgcgaaagatgataaaggaggatgaaatgtggggagttagtgtggcagattttcaggcggcacctgctgatggtattagagggtcacatgtcagccgccgatcaaaatatatcagacaacaatttgcaagctttgttagcagattttgataacagtgatccgattttatatatgagttcatgttcctaccactcatttctgatcaaaaatcaaactaaagaattatttttctgatcaaatactgtatccattattttgtagaattaaaatttaaccattattatttaattgattctctgccatttttaaaatttgcttttactgtcgaaatcactatttgtcgaattcaatttactgtcgaaatcacaattaggcacaaagagtaagtgaaatagttcactgtagaaatcacttactgtcgaaatcaaccactgtcgaaatcacctgacacgatattgtcacacttcgtttaaattttcgagttgtattttcgaatcacaaaaatattttattaaaatgaatgaaaaaaggtgcaaaagcctcgcgttcacctgacaattaatgtttgagaatttcaattatttgtcattttctgttacttttcttttggtcatcaaaatttattattccttttgttaattaaattcaatgccaataatgacaatgaaaaaaaataatgcctaccaatcatatgacaattaaacactaattgactaatggaagcccatcgtgcagtgttaaatgattttattatgtacactgaaaatcggggaaattttcgaaaaatttgtagggggttggtaaaatgtttctgcaaaaaagtcacacgtactatttcttaagaaatacagtaatttttgtagacacaaaactgctgaagtgcccatacctaatcgcgtgtaagttgaagtcccatcatccaaaaagcgaattggaagtaagtttttttgtgctcttttcaataaaaactattttaaaagtacctatgcatttttttataaaattttataaattttaactagaaaatataaattctcaaaaatgtaagaaacaaatgaaaatgtgtatgtaaaaattgcgaaatttttgattttttgtacatttaataaaaatttcctcaaaaaatgctcaaaaattgcaaaatatgtacaaaaaattgcaaaaaagtccaaaatatgtataaaaatatgtaaataaaagtcctgattttgttctcaaacataaaaaagaaatttttttccctacttttagactatagagaatccaggaaaaaatgtatttaaataaaaaatgaagccccactaatcacaaacttagtccttctgaaaatctttttttaataagatgtttgcgctcacgtttaggtgccaagccaaaa

SEQ ID NO: 82049 - DNA, 852 bp, Heterodera glycines
  Genomic contig location: Contig_ID=SeqID_2867; Location=789..1640; Strand=-
  SCN-specific regions: Sequence locations=1-1,24-123,152-257,295 -401,423-513,537-852
atgttttctctgctgctctccatcttcccaattgtctttttggtctgttgcaatgcaatgccaagtaaacacaaataaaacaaaaaaaacatttaactttaaaattttaaagcattcaatggaaatatacaaaaattatgaaatttaaattccacagatttcccgtgctgcccgggaagtcagcaagtggttgctgtgatgtccaattacattggcactttcactagtgaggacaaatctacagtatgctcaaccgcaaaaaatactgtggaaggaataaaaaatgaactgtcctatcgcatcggatgcccaaggggaggacaagcacaaattgtgaacgaaatcgaccgacagctgactagtaattacaatactatcagcagatcattgaaagacataaataattaatatgaaattttcctaattacctcattaagatattgcaaaaatggaaatcaattatgaggatgagtgtccctacaatttgggctttgcccgtgccatgttcgacttggccgctgctgctgctggccatgcgggcaacgacacagaatggcaaaacatgaaaagcaaatttgtacaggaaagccaagcaatcaaagcaattggccaagaaatgaacattgaagttacggatgtgcacattggacacccaagcaaaggcaaataaaactaattatttgataatcaagcaaataaatatttttccagggatttccgcgcaccaaaatgtgccaagtccaagccatgtgattgccaaccctggccaacacagttcggttggccatggaaaggaagacacaccgttgtcatcggattttgacttttgagagcaaagaaaagctgaataaa

SEQ ID NO: 82050 - DNA, 688 bp, Heterodera glycines
  Genomic contig location: Contig_ID=SeqID_2868; Location=22..709; Strand=-
  SCN-specific regions: Sequence locations=1-65,90-93,116-145,168 -276,298-407,430-688
atgttttctctgatgctctccatcttcccaattgtctttttggtctgttgcaaggcaatgccaagtaaattaaataaattaaaaaaaaaccttttaaaatcttaaagcatccaatggaaatgtttatttttccaaagtggcatttttcacaaaattatgaaatttaaattccacagatttcccgtgctgcccgggaagtcagcaagtggttgctgtgatgtccaattacattggcactttcactagtgaggacaaatctacagtatgctcaaccgcaaaaaatactgtggaaggaataaaaagtgaactttcatctcgcgtgggatgcccaagcggaggagaagcacaaattgtgaacgaaatcgaccgacagctgactagtaattacaatactatcagcagatcattggaaatataaatatttaatatgaaattttgttttctaattatctcattaagacattgcgaaaatgaagatcaattatgaggacgagtgcccgtacaatttgggctttgcccgtgccatgttcgacttggccgctgctgctgctgggcatgcgggcaacggcacagaatggcaaacatgaaaggtcatttgagcaggaaagccaagcaatcaaagcattgggccaagaatgaacattgaagtacggatgtgcacattggacaccccagcaaggcaaataaa

SEQ ID NO: 82051 - DNA, 1016 bp, Heterodera glycines
  Genomic contig location: Contig_ID=SeqID_2868; Location=2022..3037; Strand=+
  SCN-specific regions: Sequence locations=1-4,26-29,51-356,378-425,447- 466,490-659,681-871,896-1016
atgttgtcaaaagtttgttttccaaaatgtttgttgctgttgttattcggctgtataattggcaataaattttcattatgcgaccaaattttatcgcctcaaacaactgaagaaaaagattattcggaatgcggaattccggactttgatccgttcaatgaacgaagcgcagaggattcttcggaaatcagccatgtaattatgttattaattaccttttttcatattagggttgcgcatcagggatgggccaaattgaaaaataaaatcgaaaagcgaaatttgcgaaactgaaaaatgcgaaatgaaaaaaaagcgaaatgcgaaaagccaaaatatgcgaaatgcgaaaagcgaaattttttaaaaaaattttaccaatagcttgaggttgtgatgcaaaaaaaaaatctgcattttccggttcgatctttttctcagatagaaaatgacaaattctactcattttgtggttaaaatttcaaaaattaaggtaaaatgaaggtccggcggtgccgatacgcgccgccggaaaattttttggaaattgtaataaaatatggtaggaaaagttgcaaaattttcaaaaaatttaccgttttttcaaaaaaataaatcgcaaggcaaaaaaaatgcaccaaaaagttcaagataaaagcttcaagccaagttaaaaactcgttttcgtgcatattaggctatagcaagttagcaaaaaaggtaattattagagttgcacggaaccaggaattttgacaaaaaccgggaccgggacttacggggaccagaaaagtcgggaccgggacctcgattttcgtccgggactgggaccaaccggggattttcccaagtgaaattttttgaaaaaaaatttgaaaatttgagtgcactttgttacaaaaaattgcctatattcaaaaatgtacccataaaattttttaattctcgtttgtggggagaaattcgaagaatttttccattatgcaattttgagtgtaatatgttaacagaaaata

SEQ ID NO: 82052 - DNA, 146 bp, Heterodera glycines
  Genomic contig location: Contig_ID=SeqID_17546; Location=180..325; Strand=+
  SCN-specific regions: Sequence locations=1-79,113-146
atggctatctctttttttgagaaattttctatgcaacaaacgctctcgaacatgaaacgaagtgcggtgcgccatggccattttattttttaaataatttttatatttaatagatattccagaaaaatggctatctctttttttga

SEQ ID NO: 82053 - DNA, 146 bp, Heterodera glycines
  Genomic contig location: Contig_ID=SeqID_17546; Location=557..702; Strand=+
  SCN-specific regions: Sequence locations=1-79,113-146
atggctatctctatttttgagaaattttctatgcaacaaacgctttcgaacatgaaacgaagtgcggtgcgccatggccattttatttttcaaataatttttatatttaatagatattccagaaaaatggctatctctatttttga

SEQ ID NO: 82054 - DNA, 960 bp, Heterodera glycines
  Genomic contig location: Contig_ID=SeqID_17546; Location=2197..3156; Strand=+
  SCN-specific regions: Sequence locations=1-452,476-535,557-723,745-960
atgaaaagacgcgttgctcctcttactactgctactgctcctgctgagcaacatcaaataattggtcccgagtcgcccaagccacatgaagagacgcccaaaaatgttgagccgaaggatgagttggcaacgaagaaacacaaagtggacgaccgagagttgtggaaattggcaaaaggcaaatttttgctgaccacttatttgtgccatggtaataattaataacaatttcatcaaattttaatttgaatccataaattttgagatgattggaatcgtctgtacaacaaccagcagaaagtgaagcgcctggagggggaccgttttgccttcggctttgagatgtgtgaggaatgcgtgtgggccaactgccgcgcaaccgaccttttggcgccaatgaagaaaaagtgaactttgaccaaaaaacaataatggattttgatgatgcaatccataatttgaattaatattaattctgcataataaacaattttttttttgagacagtcctcaatttccttttttgtgtgttggttaagatgaaatgattaattggcttgccgaatttgaatctggcaaagacactgagggggggggggcacatggatagggataaagcgagtggaaggaccattcattgtcttattacacaaaccctctaaaaatataaaatgtcccgtcgcaaatcttcaattgctccatcacggtttggagctgcaatgcagatttaaaagaaagaaaaaatttttttgaaccaaattgttctgttgaaggatgcggcgagtgccattcggttcggtgcagggcgtgcgaaagtctgcgggagaggaacagagaaagaatgcgtatgggactaccccatgggcgcatcagcatggaatttgggccgatgaccagagaacagcagctcagtacaacggcagcgcgcaacccaatggaagccgcacttcaagctggtag

SEQ ID NO: 82055 - DNA, 146 bp, Heterodera glycines
  Genomic contig location: Contig_ID=SeqID_17546; Location=809..954; Strand=+
  SCN-specific regions: Sequence locations=1-79,113-146
atggctatctctatttttgagaaattttctatgcaacaaacgctctcgaacatgaaacgaagtgcggtgcgccatggccattttatttttcaaataatttttatatttaatagatattccagaaaaatggctatctctatttttga

SEQ ID NO: 82056 - DNA, 558 bp, Heterodera glycines
  Genomic contig location: Contig_ID=SeqID_17546; Location=1470..2027; Strand=-
  SCN-specific regions: Sequence locations=1-388,410-558
atggttcttgtaagcacattttgcgctcagcttctcaactgccctgtcaagtcattgcgcgaccggctcaaccacccagaggatcgggcgcttgtgctgaaacacatcattggacgcaaagtccgcaccacctacaacgaccgtaatggattgaccaaaactttcttcgtcactggaatttcggcacaaggcgccgcatttcttcccgcatatgggcaattgcgcaacccgttcaacatcaatgtggcggcgcatttttatgcacggcaccgcataaagcttcacttcccgtatgcaccgtgcataattgaacgcttttcggggggaggggaggatcggcactacccaatggaacttcttgagctgattgatgacaacatggacatggacatcaacaacaacaacgagcattggctgggccgtcttttcactgaaattgacgacaaacaatcgtcgtcaaacttatccgacacaacaatgcgcctagtatttgagggagacatggatgaagacagcggacgcaatgaatgctcacagagtactgtaccgttatattag

SEQ ID NO: 82057 - DNA, 70 bp, Heterodera glycines
  Genomic contig location: Contig_ID=SeqID_17547; Location=556..625; Strand=+
  SCN-specific regions: Sequence locations=1-70
actcatggaacgtgaagggcttttgaagatcatccgcaacacccagcgctatcagaaaccgtttatgcag

SEQ ID NO: 82058 - DNA, 354 bp, Heterodera glycines
  Genomic contig location: Contig_ID=SeqID_17549; Location=908..1261; Strand=+
  SCN-specific regions: Sequence locations=1-315,337-354
atgatgatttctttgattaacgaccaatggaatacaaatgaaaaaaacttggttattttcccatttttctttttttatactaaatttggactcaagcatgtaatgtttggtctgtcggctgcgtaatgttcgaattgtactccagcggaaaagcaaattagttttgagagctggaattaagctggcagctttgcacctcccctctccccgcatttttttacagaaaatttcacgaaaaaataagaaaatttcagtgaacagtttttttcgttttagacttatataaaagaaattttttgagtttgtaggcctctagagaaaagtaaaaagagttaattttaaaatataaatcaa

SEQ ID NO: 82059 - DNA, 1678 bp, Heterodera glycines
  Genomic contig location: Contig_ID=SeqID_17550; Location=336..2013; Strand=+
  SCN-specific regions: Sequence locations=1-77,107-603,625-639,662 -772,794-969,991-1156,1179-1678
atgatcgcatttaatttcacccaaattgtgatgagaaggaccaattgggagaacgcgtcctttcccaagaattcgtccattttgctgaaggaaagtgacgtgcatttgaaggtaattagtggttggagtgatcaaacggggaaacaaactgatcaaacccaaaaactgatcaaaaaaattgaaaaatgaacacaaaagactgatcagccttgaaagtggaaaagattgatcagtaaaacatgagaaatagaatgagactgatcagagccaatgattggtcagtgccaaaaaaggaaaaaatgccaaactcttctgaaatgatatcccaaatttgccatcggtctgatcaacctccactctgttgtcaggaggacgtgctgcccgggctcgtgctgaacagcagccacgtggtgcctccgacggtgccctattcgtcgcgggaaaagtcggcgctgctttacgctgtcggcgcggccagcatcgtcagcacttttccgttcagtgccctgtacacgcgcttcggcgctcgtttcgtgttcttcggcgccggtgtcgccagtgccgtggccaccgcacttttgccgttggctaccgcccgcggcatggccgcctttctcctcgtccgcttcgtccaagtcacccccctccccaaatttcctatttatttcttcatttcataaagggcttttcctatggctctatctttgctgccattggtttcgtttgccatcgttgggcgactctccgcgagcacggcttattcttgttgattttataattcgttcttaataaataaatattcaaaccttttcaggtcctttatgacttgttttacgtcactttccgttgggatgactaattatttggctgcttttgtaaattgtttcaaattaccaataattaatttatggctcctttcgcttttagcttagctcaacgccttctttgggatggccttgggtttattacattttggctttgttcactttgctcccgttcgttttgtggctttttctgtactctgatcaaccggaaaagcaccgatttgttggtttgtccgaaaggaaggcaattctgagggacaaaacggaggctgagattgtccgcagttgcaatatgccatatttgttcgtttttttttttgcgtttattttttgccaattgtccctttccctttagcaaaattctgaccactaaaattgtcttcgtcatttggttcaatgccttcgctgacatcgtttccgctgtctttctgatcacttacctccccacttatgtgtccaaagtgctccattacggcgttcgcgagactggcatttggagttcgtttccggcggttgttcagctcccattacgggtccttttcggcattttagccgataaaatcgggtaatgtttgcttttatcagtgtgttaattgcccttaattattcctttttcattttgctaattaacttttctttcagttgtgctagtgaattgaacaaaatgcgcttgttcaattccattgccctcgttctttccgcctttttctttgtcctcgtcggttttgtccccgaaaatttgcctttcgttgccattctcattatgacgcttaatttggctgcggttgcgtgcaatactggtggcttctacaaatgtgccactttggtcactcggttggtttaaatcaatggca

SEQ ID NO: 82060 - DNA, 746 bp, Heterodera glycines
  Genomic contig location: Contig_ID=SeqID_17551; Location=229..974; Strand=+
  SCN-specific regions: Sequence locations=1-299,322-650,745-746
atgcgcttgttcaattccattgccctcgttctgtccgcctttttctttgtcctcgtcggttttgtccccgaaaatttgcctttcgttgccattctcattatgacgcttaatttggctgcggttgcgtgcaatactggtggcttctacaaatgtgccactttggtcactcggttggtttaaatcaatggcaataaatgacaaattcggtaacggatttttgagtgattggttaaacggtaaaattgcctatttttattgttgtcacagtgccatacacacgcgaaagaatggggccgaaagagggggaaaggaggggagagggggcattccttgttttggattttgcccttaattatcagtcatgagtaatttcaagaagtttttgatttgtttagtcaatacgcccattttgtggttgccggcattcaattcgaaaagtctgtcactttgttcgtcgccccctttctctacgcccttttcatctccgatgagtcttcgctcgtccaatggcgcgccattttcatcggaatggccgtcgttttactaattgtttgactatttaaatgattaatgcatgtgacctttattaacaaattgaaggcaaatgcttttttcgtcgtattggcaaccgatcagccggcagaatttacaaaagcgaaaaagaaaaaggacgacgaagagaaaggaggagaatgggaggaagagaaagaggagcaaaagagaagagaaatgaaccgaaggaaata

SEQ ID NO: 82061 - DNA, 1198 bp, Heterodera glycines
  Genomic contig location: Contig_ID=SeqID_17556; Location=110..1307; Strand=+
  SCN-specific regions: Sequence locations=1-17,39-247,337-771,801 -859,881-1040,1062-1172,1194-1198
ggctacacgagtcagtgtatttggacaaaaaaccgggttctggtactgctgggttctgaaaagacgtgttcgggttaggggtgaacgaaacttcgagcttcgtgcttcgaaaactcgcgttttttttgggcttcgaacttcgtgcttcgaaaaaagttgggctcgattcgagcttcggcttcgagtactaagccgagcttcgcgcacccctggttcgggtccggcccaagttttcaaccgggtcctgaaaaaaattatttataattattttcattaattaaaaattttatgaaagagttggtaatttattattattaaaataaaagatttttaatagatttggtagcaaaaccaaataagatttgataagccagcaacactaagtaatttttagtccaatgctggtgaggtcaaagaaaaagaaaagaaaaagggtttgcttcgcacagtgtcgtcccttttcacaaatagtaagaaaaagtcatcaagctcaagcaaggaaaatcatctccaagaatttgtaaaaaggcatgcaaaattggtgccacctcaaaaccttgaaaaggtgagtttaataaataaataatatggtacagtgctgcgcacatggactgagtttggtgggcctgcccagcacgacattagaattccacctccttcggttgtttcggacggcacaataaaattttttatttcgtttccagtttatcttaaatttgggttttccgagatccataaaattaacttgttcacttaaaaattgatgaaaacattttattaatttcaaaaaatatttttaagacctttcctaatggattgtgttttccagctttgttatcaagttttgttcaataaatggtccttttttgagtgaaatttgcgactagacggtgccaatagtgcgtgccaccagaaaaaaattgggattatgaatgagactgtttagaaaaaatttttgttttcaaccctcattatttcccactgattagaagagctttctagataactgtcctatttattaatttttttcaaattagggattttttaaaccaacaaaagttatacattcttagcatcaatctatagctatattttctctattagcgtggaaaatttcaaaaattttctcctgattcgtatagacgttttccagtaattagtagttaagagtgattaaatttttttaattttttgatta

SEQ ID NO: 82062 - DNA, 1814 bp, Heterodera glycines
  Genomic contig location: Contig_ID=SeqID_17558; Location=685..2498; Strand=+
  SCN-specific regions: Sequence locations=1-417,439-551,588-998,1020 -1537,1562-1814
atggcaaaagttgcaaaccggaagcggaatgagcgccgaattcgtgccgtccaagacttggcacggcacctcaaccaccgaatgaaccgccaccgccatcggcagcgcgacggaaaacgggacccatcggaggaacggcacatccgaatgaccgccgaacgttatgctgatcagctctctcgcctgggagatgaccacattcaccgactgcagcaccaattcccgcaactccccaacccccgccggcgtcgatcagaggtggggggcaatctgaaagggggaaagtcccagccaaaattggcatcaatggtggtacgcccgccccagggagagttgctcccttcaaaggatgtcggcggcgcggcaccgggcgcatcgaactcccatagccgaaacgagaacgaagaggaaggccgtgagaaggccgagaaggaaagaggcagccgcccgagggtgctccctccgccgggggacagttttggagaattgctggagaaagaggcgaaagctcgggccgaagtggccgagctcgaagcccgggcaaagaaggcgaaaatggagagggaggaggaggaacagaaactgaaatcggcgaaggaagcgcgccttcgggacttggaaacccaagccgacgacttgcgccaaatgttgggcgatgcgagctggccgtggtcgaggggcaaagacgggaaaaatggggaggcggtggctccccgcgctgggaaagcggtagccatgccagcagtgccgatggaggatgatggagtgtcacttgccgattcggaaatggaggtggtgccggccgggggcagtgtcgcaagaagcgacgagatgaccaaaacgggcgggaggtctgctcccgccaaaggaggaagccattcatgggaaggttttctagtgttcggagtggacgatggaaagccccgggaactgtcacgggaggaggaggactatttcggagggggtgcgctcgatcacccggtggcatttccccgccgggagaagagagggaaaagaaacaaatggtcgaacgggagcacttcccgtcgcaattgagggacagagcgagaggcgtcaagaaaatgattggaatttgccttttcttcccaattttctctatttttcacctctttctttttcctcccatttttctcaacattttgctatcgtaattttattcaatttttgtcgtatttcaattttgcccccttttcttctctttttcacatctgcgtctgctctcccccttttgcccgccgctttgccatttatttttgaattcacctttgtcttcattttggccgacacttcccctccggccttctccgattcttttccgatttttccccattttttgtccctttgtttttgtcaattcaaactttggaccattcacatttttcgcatttttccattcacaatgtttacgatttgtgccagggagcttctctccccggcctttgactcttcccttttcttatcgcatatttgagaatcattcgtttgctcatttgtccaatttgcatttatctgtgcctaacccccggggggaaaaaacattcgccaatcactccctttccccccccccctttttttttcttttcatcacttttgttggccatcatatcattcattcgttcatttttatgtctcactcccctccagggagaaaaaattgttctttttggccttaatctctctcctcaccactcaatcacggcatccacttttactcctcatttttgccgtttgtcacttttatgcccaccccccctcccacgggtttaattaccccaagtttgagcgcttcatca

SEQ ID NO: 82063 - DNA, 715 bp, Heterodera glycines
  Genomic contig location: Contig_ID=SeqID_2870; Location=212..926; Strand=-
  SCN-specific regions: Sequence locations=1-292,314-333,364-715
  Gene Ontology: Cellular component=chromatin; Biological process =establishment and/or maintenance of chromatin architecture
atgtcgtctattaagctcaacgagtgagttttgttaaccgttattataatataatacatttgacattttcagaatattaccttcgcctatccaaaacgaaggaaaggatgaatgggcaaatgttgtcacgcgtgacccctggttcaaaggccacgaggttttggatttgcattaacaacagggattagatctgttattatttctaaggaatgttctgatttgggggtagtgccctatttttatttgtaagaggaagtttctaaaaaatgacaaatttctaacaaaattcgtgaaaattttcccccggcggcgcctattggcaatgccggcgtccaaaaacttatttttctttaaaaaattagtctagaatctgcaaattttgtcattttttgttttttagccttgatgttcttttaaaaaatattcgatcaagtccctgtttaataattacactgaaaatccgtttaaaataccacacccccacgctaatttaggtggccatcaatcacaatgccgcatcaaaaacagttgccatcaaagaaccaccgccctatgggcaccgcaaaggatttgtgccacgtacgcctgaagtatatttttgtcccctttactaaaataattttttgctaattttaatactttttcaggactttggcgatggcggtgcctttccggagattcacatcgcgcaatttccacttggtcctttaaaaat

SEQ ID NO: 82064 - DNA, 475 bp, Heterodera glycines
  Genomic contig location: Contig_ID=SeqID_2870; Location=1485..1959; Strand=+
  SCN-specific regions: Sequence locations=1-133,155-276,300-475
atggctaaaaaaaaattattgcttaagcttcaaggcagaagaggtgctgaacaactgaaaaaaaggcgagaggaaagaaaagctcagacggccaaggcgacagaagcccggctggccaagaatagtgagtttttccattcatttttaataaaatcctaattttccaaatttttagccgctccccagccgaacactgatgcagaaacgccacaaccatccgaagaagagccgtcgacatcagaggcaccggcgcgggacaacgacggacgaccaccatcaactccaacaccgatgacaccgcaggaaatggacgtgccgtcggtggagatggtggacaccgatgtgcaaatcccttcaacgcctgccgatgaagaccaacaagccgagcccgtgccgtcaacatccacggcacgctgtgacctcatggcgacaccatcaacttcaaagtgcgccggtgcctttggtcttgacgatg

SEQ ID NO: 82065 - DNA, 1470 bp, Heterodera glycines
  misc_feature (3)..(4): n is a, c, g, or t
  misc_feature (27)..(27): n is a, c, g, or t
  misc_feature (37)..(37): n is a, c, g, or t
  misc_feature (125)..(125): n is a, c, g, or t
  Genomic contig location: Contig_ID=SeqID_2871; Location=934..2403; Strand=-
  SCN-specific regions: Sequence locations=1-453,475-553,578-808,830 -923,946-1024,1048-1074,1096-1470
atnntatttcttgcgttcattcacccnaatttgaagnaagacaaaattcatgtggccaaatttttcgcaactgtccggggcaccaccccgggcggaatggaacaaatggggcgaattggcattgnacgagatggacggcactttcgctgtgcagcagtggattcagcaatgcattgggagagatgcgcatgggctggacttgatcttggactgccccgcgggcgtggacgagggcgtatggaagtacgaacagttgcgccagttttgcctggagctcagcgggttggccgtacttttacaggttttgttttttgacttattgcgaaacaatttcatcagagatgttttttggattttaaccatgtgaattatcaaccccttccccaaataggagcagtgtcaccccgaaagttgcacacaaatgaccgcgactgagcagtggatttgtgagtcttccttattgattttctgtctcaaaatagttagttgagcttggcttaggcctgggtttttccaggttatgtacgaaaaatcttaatttccaggaaaatacttaagaatttgctctttttattgttgcggtttagtcggttttacgcgtcctatgaatgaccatactcagtttcttaggccataacttttttctttcttgactaaggcttccattcttggtatcaaatgaatgcttaaactcttggtaatcttatgtataactaaattctgagctaaaggcaataaacaaaaaattatacttgaatatactcgaaaaagttgaatttcgttttctcattgtaatttcttttataatgccagtatttgttcttttctttgcatttatcgaactttaagctttcgtttcagaccaagaatcatgcattgatcaagtatgagtaatgcataaatccgactagaaccattgttactttttaaaacaaatttcaaaaatcaaggcccgggccatgccatgcgttgatttttcctggacctggatttttgtccatgtccaacatgggattcagatctaggcccgggggcttttttcaaaatgtcaaactctattattatccttccacttttcatttcttattttgtcaaaagttttgtgcgcggcgcacaaaaacccgaaggagtgcagtgccattgactacacgcggcacactttggacggggccgcctctctgctgaacagcaaccgctacttccccagcagagccaccatcaaagagtcgtcaatcgccaaaattggatcggtgtgccgacgactctaccgaatcttctcccacgcctatttccatcatcgccagatttttgactcatttgaggtggaaagatcgtgggtctttcatttttttgtatccattttcaattcacttttaggaagaaactgcgctgtgcaaccgtttcaccaaatttgtgcagaaataccaactgatcgccgttgaccatttgattgttccaatcggtccataa

SEQ ID NO: 82066 - DNA, 441 bp, Heterodera glycines
  Genomic contig location: Contig_ID=SeqID_2871; Location=397..837; Strand=+
  SCN-specific regions: Sequence locations=1-131,153-314,336-418
gctagaatcaactttattgggcatgaatcccgattttctatttcatttcgtatacactgcgactcacaattttgggctcccggtacaaaaaaaagtttattttttattcataaaacagaacgccaaattgcaaatcttaaaattctttgagattttcccttctaaaaatggcagagccgagattcgagttaaaaactaatacgggaaaaggcggggatcccgtcccgttcttttccgttttcccgtttccgtaaattttttttccaaaagatcgaatcgccgaaaagctgactgaattgggcgcggccggaacggaaggaaagtgagggatggaacttttcatcttggaaaagcagttcctcaagaaattcaaaaatttatttaattactcattttaaaaacaatcgaaataattggcaaaaaaattttaaattattatta

SEQ ID NO: 82067 - DNA, 144 bp, Heterodera glycines
  Genomic contig location: Contig_ID=SeqID_2872; Location=405..548; Strand=-
  SCN-specific regions: Sequence locations=1-144
atggacggcactttcgctgtgcagcagtggattcagcaatgcattgggagagatgcgcatgggctggacttgatcttggactgccccgcgggcgtggacgagggcagtagtataaagtaccaaaagcgagcgggttccgagcgg

SEQ ID NO: 82068 - DNA, 572 bp, Heterodera glycines
  Genomic contig location: Contig_ID=SeqID_2872; Location=3742..4313; Strand=+
  SCN-specific regions: Sequence locations=1-174,196-572
tcccatggcattttacgcgtcccatgacattttacgcgtcccatgacattttacgcgtcccatgacattttacgcgtcccaacaacatattacgcgtcccatcacattttacgcgtcccaacaacattttacgcgtcccatcacattttacgcgtcccatcaaaatttccatccaaattggtttatttacaaattaacattaaaaaataggaatatattttcaaacaggatagttgtgacgcatttcctctaaaatattttgaaatatttttgtgtttgagtggtaacgacgaaatgcgtactggtacaaatatgtttgcaacaattcagggttagtcccatgaaggtgttttaagctttgctttagagccctccaggtcgcttcaattccctgggtgtgtatttgagggttagttggatctacgaagtgtaattgatgatttacaaaacgatggttgtactgctgctgcatgttatttatcccaccatatgctgcccacccatcgctaacgatgctcgtgccgacttcgatgttttcggcaatgataggcagaagtgttgctgctgagcga

SEQ ID NO: 82069 - DNA, 2275 bp, Heterodera glycines
  Genomic contig location: Contig_ID=SeqID_2872; Location=3291..5565; Strand=-
  SCN-specific regions: Sequence locations=1-90,113-801,830-1629,1651 -1969,1993-2156,2183-2275
gcccagctgaacaacctgcatgcctgattgaatttagtcgtggcagattaactgctgagggtgcctgcccttcactttacatgggattacaaaatggcctaagcacaccaaatgatgtcaacctaaatggatcaattggttgtcttctttgccatggaattatgaatattgttgagctgttgcggaacgaaagtgttacggtgatcaaggaagagattggtcattactgtagttaccttcttgcattacgatcaacatgcaagtcaataatcagcgatttcttcttggaaaatttggtctgctgaacttaggattaacaatcagaaatttttagttaaaaaggattactgcatatcacccagtcacactttgttggatgtattttaatttgtgttcaccggaacaaaatagccttctgcaacggattaacaaccgagtcgagcatcatgattatcaacaaaatggacatgggctgaataattcactaggtgtcccacggcaaaggtttaccattctgcaaccgaatgatggtgatgttatgcctcccggggcattagctgcattgggtgatttaagttatgagacgcttgtgagagaatatcttggagaggatgggccagccggtatgcgcaaaaaacttatttattatcttgggttattttgagggtatgaaaagacattgaaatggcttgctcgctatggccttatagcaaatgcgttgacttgtgccgaatgtcaacagcaccgggcatcacttgtcaaatatgcccagaacccggagggcttaacagtaaaatagggaatttaaattataaaaaattgattttaagtggcgatgaagtcactgtcgaaaagcaatccaaaacagcgaaagttcaagccgattttcacccagatttggttcttttttcaaccatatgcatctgtcactacaccaaagcctgagactgtgttacttctgggccactcatccagcaagcactttggatgcagtgatgagagaaactggcgtgtctcacaaagaaacgattatagatttctataattttcttagagatttatgccaagcatgggcaaggaggattgaaacgaatgagaagctgggaggggtgggtagggttgtcgagatagatgaaacaaaaatgtatagggccaaatataatagaggacggatgttaaatcgtgcttacgaatgggtcttcggtatggttgaacgtggcacaaacagtgttaggttctttcctgttgctgatcgctcagcagcaacacttctgcctatcattgccgaaaacatcgaagtcggcacgagcatcgttagcgatgggtgggcagcatatggtgggataaataacatgcagcagcagtacaaccatcgttttgtaaatcatcaattacacttcgtagatccaactaaccctcaaatacacacccagggaattgaagcgacctggagggctctaaagcaaagcttaaaacaccttcatgggactaaccctgaattgttgcaaacatatttgtaccagtacgcatttcgtcgttaccactcaaacacaaaaatatttcaaaatattttagaggaaatgcgtcacaactatcctgtttgaaaatatattcctattttttaatgttaatttgtaaataaaccaatttggatggaaattttgatgggacgcgtaaaatgtgatgggacgcgtaaaatgttgttgggacgcgtaaaatgtgatgggacgcgtaatatgttgttgggacgcgtaaaatgtcatgggacgcgtaaaatgtcatgggacgcgtaaaatgtcatgggacgcgtaaaatgccatgggacgcgtaaaaccgactagaaccaaaaaaagttatggcttcttaaagctccttgacacggaagcgtgcgcatggaactgatatttttaaattagcgcacaaaaacatattggcgtaatgaataaagaaggacaattcatattcactgaaacagttataaacaaaaaatttccattgttttcctcattattcagttaacggaatttaagcaatgtccgataaatcagtctactccaccagcatccaaattgacatgacgttgtttaccgacgtcactccacctgatgtgcactacgctctccaccaccagtctgaactcgcgcctgctcccgtactattttcacttatttacttatttgtaatgttacgaattaaggtaaattcaccgactcgatcgcaagaggacatcgaccgatggcaggtcacttcgcaccgtgcggacggcccgaactag

SEQ ID NO: 82070 - DNA, 576 bp, Heterodera glycines
  Genomic contig location: Contig_ID=SeqID_17559; Location=210..785; Strand=-
  SCN-specific regions: Sequence locations=1-84,120-158,180-187,209 -227,249-283,343-503,525-576
atggttgcggttggcattgcggtgcacggcacaacggacggtgccaacgaatttgtggcaatttcggagaaacgacgatcggtgggcggcgccggaggagaaggaggaggcggacaaagtgacaaaaaaagtgggaaattttcttacaaagaaattccgcgggggataattatgagggttaaagaaattttgcagcaaattttgggttagaatttttttaacagttatttttctgagacattaaaatttggcaatattttggggccaaaaatctgaagatttcttaaaaaatatatcacaatatattcaaaaaatatgaataataattaaatttttaatattcataaaacatttaagatgaatttggataaaaaaaatttttgccagtcaattttttgtcagaattggaccttctccaaatcagaaaatattcccgataaatcgaacagatggccaagaagaggtctaaactcaaaaaatattatgaaccggattaagaagtctatttaataattttaataacaagaaaattttcgtggattttaatggcttaaagcaaataatttttaaaataaa

SEQ ID NO: 82071 - DNA, 353 bp, Heterodera glycines
  Genomic contig location: Contig_ID=SeqID_17559; Location=847..1199; Strand=+
  SCN-specific regions: Sequence locations=1-162,187-194,347-353
atgccggcaccgaacgcgtcgcccagcacattgatggatgtacgaattcgatccctgttcaatggcacgaaaattacaataatttggcaaaaaattggaggttggcacaaattttgatagtaaaataatagaatacgtgaaaatagaaaaaaatgatggcaattcaaattaataaaattattttcctaatggacaaaaaatctataaaaattaaaaatatagaaaattgtaactttcataagtagaaataaaaaaatatatatttagaaaaaattacatatattgctatattttttgattattattaatgattcattaaaagaattcttaaaaatttttaaaaattggtttaa

SEQ ID NO: 82072 - DNA, 2057 bp, Heterodera glycines
  Genomic contig location: Contig_ID=SeqID_17560; Location=147..2203; Strand=-
  SCN-specific regions: Sequence locations=1-239,261-306,328-473,495 -557,580-792,815-1162,1184-1370,1393-1677,1699-1835,1910-1958,1995 -2057
gaatatgttcccggaaaacattgtgcaggcaacaatgcagcagatggagaccacttatgtgtatgatgccaacaaaacggacgtgccgttgaagtacaagacggtgtacaaggacggcctgaacattctcggcacgttttttgacagtgtgccaaaagaggcttttaacgggctcaaattttcgggcatttcagattttttgagagggttttcggaattttcattgagaattttttgagttaaagaaaaaagccaactttcagtaccagtgagcccgtccggctagttgagtccctatttaattggggctgcttgagagccaaatttttacgagaaaccgaaaccccgaccaatccaaatgcaactgatcaatgggttttcattagaatttgcgagctttttgctattcaaaatttatacgtattcggcacatccgattttaaatttataaattactaatagtccactaatttgatgaaaacatagttaatttgcattgtgtaattttatttttagttttttttttgtgtttggtccaatatgcaaattatgttaatagaaaataaaaattaatcaaaatattagcaattacactaaattctactatatttatcctacagtaggaggggtaaattacgacagtatttttctacaataggaatcatcgtcttttgcatttcgtttggcattgtgatcagtcagctgggcgcccaggcccgaattatggtggacttttttgcggttttggacctggtcagaaactattaagatttttttcaatttcttaatgaccccacttaattaaggtgatcatgcgtcttgtgtccctcataatgtttggcatttttttgaaaattaataagaacaaatttctttgtttttgaggtggtattcgccgatcggcatttgctgtctgatcatgggccacattttgcaggttgaagacatgagcaacacggcacgctcattggctatggtaggttttgtttggcacaattgtgtcattggcaaaaactttttgccaaattttcttggaggagattaaattaaatgccttttcgatttcgacagcactgctctctaagaggctgaatattttgagaaaattacgtttatttttagaaaattatgaccgaaaaattgaaaaattgattttcggtacttttttttaaatttttaaattgactcaaaaaccgcgaaaatacttagaattgattaactctccattctctcattaatttcatggtcatggtttttgttacaaaacttttttttaccacccattaaaattttattattgaaaactgattttttttttgttgaaaaaaatgatgcttcgagtgtcaaaaattttgaaaatttccgttttttgggacttcaccttcgtttcggtttcaaatactaacattaagccgagctttgcccagccctgtttcacacgcacaatttgattcacctaataaacatttcgccaaaaaattatcgcttaaattctctgacacgcccttaaattttgtacagtattccgttaccgtactgctcggcttggccatccattccctagtctcgttgccattgctgttttttgtgctgactcggcagaatccgtacgtgttcatgcgcggattgcttcaggcgtggatcactgcgttgggcaccgcctcgaggcattttgttgaaatttcaatttcaatttaattttttcaaaaaaatttttcagttccgccactttgcctatctctttccgttgcttggaggaaaatttgggcgttgatcggcgtgtcactcgctttgtgctgcccgttggcgccacaattaacatggcaaaatttgtctttttttaattttctaaaaatttttgaaaattttttttttgaaaaatctctaaaatttttacaaattttttttaggatggcacggcactttacgaggctgtcgctacaatatttattggtaagaaataataaataaaatagaaattaataattaaaaaacattgaacatttagcgcaaatgaatgacgtgcatctttcgtttggccaagtgatcactgtcag

SEQ ID NO: 82073 - DNA, 336 bp, Heterodera glycines
  Genomic contig location: Contig_ID=SeqID_17561; Location=21..356; Strand=+
  SCN-specific regions: Sequence locations=1-95,149-162,184-227,250-336
atgtatgccgacgatgttaaattatattatgcctatggaaatgatgaccattcaaatcagttggataaagcaattgaggctttggaaaaatggtcaaaaataaaatcgaaaataataatataaaaattataaacaaaatagaagtaaattgtaattgcttagttaaaaaatattaaaatataacaactttagtttttccgagaattaatcaataaatttcattagcaaattttaaaaattcatatgtggcagtgttagtgaaatgcttaatatcgtagtcgtcttcgatagaaatgaagctttttatgcaaagtaaaacataaatatttcataaaa

SEQ ID NO: 82074 - DNA, 1103 bp, Heterodera glycines
  Genomic contig location: Contig_ID=SeqID_17563; Location=1721..2823; Strand=-
  SCN-specific regions: Sequence locations=1-125,148-384,406-497,520 -1103
atggtcagagcaacaacggccaggacaagggcatcagcagagcgagcacggaccatcaaaatcaatcgtcgaaatgccaagaaggcgcgtgccgcaattggacgagccggacatgtgggtgacgcgagagagggagggaggggcaattaatacactaattaattcaattcgacacccttttttaattgtgccaatttttcagtcaggcaatgcgatgggacgcgagaagtgcatgatgtgcctgagcaaagtgagcgacatgacgcgtgtgaccatgggctgtgtgcaccaatttcatcgcaggtggaggagtggctaattcctattaatttagaacccatggatccccgaattcaaacaagtctaaaagccgagtacttttcctggtctttttgcctttttctgatcgctattcgaaatccgttccgatcagttttgaaccgctgcgtatccccgaaattgacagggtggaattttatggattttttttggggcctaaaaatccaattttgattttaatgatttcggataaatgcatcatcgcttattatccccccatcaaggtgcctgtatcgctggctcaaatacaacatcaactgtcccgtgtgccgctacaatttcatgagcgcaattccccctgaagaaccggaagaaccgcaccagtggcaaggcgactgatcgatccatcattgaaaatctgtaccacccgcaataatgtgtgtattatgtatatgaatctgtaccaccataatgtgtattatgtatgtatattgtatatgtctgtatgttgttttgtgtattttggataaagatgatacaaggttaaatgaaagttttttgtcgagattttcgctgtaggtattatgttgaggcaattaatggagttcggattttcagattttcaccaaaaattcaggatccattcacttaaaaaagttagaagtgccaatttttctccacttttcgaattctttgtttgtttgttcttttgatttcttccgtttattttgacacccttttttgtctcccttttttccccttttatttgctgtcgcattctcgtaccattaaccaacccacacactcttcttttacaaaataaa

SEQ ID NO: 82075 - DNA, 195 bp, Heterodera glycines
  Genomic contig location: Contig_ID=SeqID_17564; Location=63..257; Strand=-
  SCN-specific regions: Sequence locations=1-195
atgatcaatgtatggaaaatgtggagaaagaatgttggacaaaatgatcaatcagtgaaagaaactgatcaaagtgcgggcataagtgatcattgtatgcttcaagttgatcaacatgatggacgcagtgatcagaccaataaatgtgttgatctagtattattgaaggcagttaaacgaagtaaatgtgccaat

SEQ ID NO: 82076 - DNA, 254 bp, Heterodera glycines
  Genomic contig location: Contig_ID=SeqID_17564; Location=537..790; Strand=+
  SCN-specific regions: Sequence locations=1-184,216-254
caaaagaaggtggttatttgacgaggtcatttaactatggttatttgacctggtcatttgaccacgaaatacgagaaaaacggtagcaaaagaagatagtaaattttctgctggagcaaccaccagtcaccgttttttaaccatgaactaacttcttttgctataccaccaactttctaccacgaaatttttatttacatatatatatatattttgcttcttttcatggaaaacaagaagtcaataagttgttt

SEQ ID NO: 82077 - DNA, 153 bp, Heterodera glycines
  Genomic contig location: Contig_ID=SeqID_17564; Location=1035..1187; Strand=+
  SCN-specific regions: Sequence locations=1-153
atgtctttgttctccaaacaaatgtctgagcaaattgcaacttcaattaaagacaattacgcaacattcttcccaaacagcaaagaagctaaatttgcccagaagtcaaatactgcctgggacgacttaacaaatgagcttatgcaacttggg

SEQ ID NO: 82078 - DNA, 341 bp, Heterodera glycines
  Genomic contig location: Contig_ID=SeqID_17565; Location=108..448; Strand=+
  SCN-specific regions: Sequence locations=1-341
atgccgaagaccgagttcggggcaacgccctctccttcttttttgccaaaggcatttcgtcgaaccgtaaaccctgttgtcgatctgcagcgcgatgtgctcgaactccaaaaagactttttcaaacattctgccatgcccttggttgacaaaatgtcagcttactatgactataaaatcgccaaaatgatggcttcgaatgatcagcagcagaaaagtgaagaaaaagaagaaaacaaagaatttgatgaaaatgagttggattattaattattgactaatcttatgatttggcatatttggctttataagccttttgatcaattaactaattatgttta

SEQ ID NO: 82079 - DNA, 612 bp, Heterodera glycines
  Genomic contig location: Contig_ID=SeqID_17566; Location=115..726; Strand=-
  SCN-specific regions: Sequence locations=1-108,140-300,326-612
atgttcctcaaacgaaactccgtccttcaaaatttgccatttgttccccgagccgtcgaaccatcgccgatggcaccggtgaagcatatttttatggaaaatgcgagactcttgagtatttctcatttcaactttcacataaatcgcccgtccatttgccaatcattggttcaaattacctatgcaactttttatttcagaaaatgccggcctggaagaaatatgcgcggatgtgagtattgcatataaaacagactaaaaaacgaaactccagactctgtcactccgattaattaattgcccctaattaattaattaatttcgatcccccccccccccctaattttcagtgttcttccccatgtcggactcattttgatgtccgtttgttacattgtcggtggtgcctttgtgttctaccaattggaaaggccaaacgaaattgcggtccgaagagaggcgagtgccaacaaattttttgggagcggcaaaatattactggattgatttattggccaatgcttattcagacattagacatcatcgagcgggaaaaacacgaaatgctggaccaaatttgggcattgatcaatgatccgacagtgccgcagg

SEQ ID NO: 82080 - DNA, 1656 bp, Heterodera glycines
  Genomic contig location: Contig_ID=SeqID_17570; Location=1..1656; Strand=-
  SCN-specific regions: Sequence locations=1-47,69-524,554-739,761 -937,959-998,1020-1310,1362-1395,1431-1454,1487-1487,1528-1530,1646 -1656
tttatcgttgcgcgcaagcggaaactccgtccgtcgccattaaatgttctgatgttttttgttgttgtccacctttgtgctgttttctctctctgtgcacttttgagtgtatgcatttgttcgggaatggcattttcaaaagcactcatttaaaattattccctaatcaattaaaaattatcaaatgtggtagcatttttttaatcggaaataatcatttgtacatataaatgctgaaagaaaaaatcgttgactttgaacggctaccagacatttgcggacaatttcgggaaaaaacaaaaatattctttaaaaaatctcaaaacatggaatggagactgcaaaactaaataaaaatttatttttggcttttaaaggtatcatattttatttttacacttcaaagaattaatttcactggccaaagtgagatgctgttccttaagtgattaaagaagagttgatccccaacactgttcggggaattcgaacgtcgtctgtttcactctgtcgggtgagagtgctttttttatttttagaaaaatatttttttctatttgacgaccaagtttttgacccccccccccaacatttaaaatttttttttagccttatagataattctcggggaatttgataccagttccccgacttttttcccagatagtaggggaagaaccatagataactcttgctctcgtgttcaattggatagcatttcgagaccccaaaaattttcggaaaggaaaaccgaaattccatggcacaaaaattacgggaatctgatgttggaaatcgggatttcgtgcagctattgatttttgaatatggacctccaaattgataaaaatgagtactccgggattatttctctaaaatacgacaattattgggtattttatttatatcaatttttagccctttctttcttctatcgaatgcattttgtttcagaaaaaatatttgtcttttttaacaaagacattgttgttaaatataggtgccaaagtggggaaaagcacattttttgacccccatgttacaattggtcaaaattggcacttcaagtttaaaatgtgtaaaaccgaacgtgccaggaattttcgacagtggctgatttcgacagtgacctgatttcgacagagattatgatcattgtctaatcgaccttgttagcattctaccgagtagcaccacaccgctcattgactgtgatgtggactttagagtgccatggtatatatccgttgagaatctgagtaggaactgattaggtcgagtaagatgagaagtacgatatgcagacctacgagcggaaaactggaaacctatcagcaacttacatgatatgtcatctagtctctctcagactttatgctataagaggctgactataagcaatccaatctcatgccaaattctattgtatagatctcgctctataggccgaaaatatcagcgctcgacacggactcattgtcaccactcgtcacctaaaatctactcagcgtcggcaaaggagccatgcagtctagcaactaacttacctgttgaaattcgaacacccaaacaaccttgttaatatctattcgaagcgaatgcagattgaagaaacctttcggagacttgaaaagtcctgcctacgaactaggccta

SEQ ID NO: 82081 - DNA, 221 bp, Heterodera glycines
  Genomic contig location: Contig_ID=SeqID_17572; Location=1022..1242; Strand=-
  SCN-specific regions: Sequence locations=1-221
gaaatgtctgatagagtaattttggctccattgaatgttgatgtagatgagatcaacgaaaaagtattagacttaattaattctgaggaaaaaatatacaaaagtattgacactgcaggaaatgatagctcttttgattgtgtgccagaataccttaatacattatatacaaccagtctaccaaggcatgaattgagattaaagaataatgccattgtaat

SEQ ID NO: 82082 - DNA, 922 bp, Heterodera glycines
  Genomic contig location: Contig_ID=SeqID_17575; Location=508..1429; Strand=+
  SCN-specific regions: Sequence locations=1-109,151-244,290-465,487 -492,515-543,658-724,777-846,871-880,902-922
atgttctttttgaattcaattcccagcgagaatgggctcattttgctactgtttgccatcagattcatttcaacactttgtgtagtagattcaccaaaggctggtaaagatttaaataaaataatattttaaaaaaaattaattttaaatgttttcgacaaatttatttaaatcaaaggattagctatctgaaacagaagtaaatttagtcaattctcatgtgtattattttgaaaatttgtagaaaattataaaaaaaattacaaattattttaaatacttattttttcctgctttatttcgattataaatatacgaaaaacatatttttaccaaggaaaatcttcgctttaattttcatatgcccctagaaatccttattttagattttttatacctaaaataaggcccctattttcgcgtttttttctcctatttttgcccatgttttagtttttttaatccttaattctaaattaaattaatcatttttatagatgagaatgtggaggataaaaacaactcacaaccaattgtgccaacaatgaatgaccaattgaatgaatatatgcaaaaaaatgaggatggtcaatcaaataaaaatgagggtaattaacaaataaattaattaatattttaacaaaaataaataaataattttatttaatttagatagcagcattcgtgccgaacatgcatcagtccaatccagctcatttggtggtaaataataatcaaatgaaattactaaattaaaaaaaaaatttatttaatttctgtttgaaaaagtcagtttttaatggattaattaagtttcattaaattttattggtttccgtcatccacatcttttttaaaaattatttttagcctaacacggttataaaaaatgtttcaatttcaaaatttacatcttgggtaa

SEQ ID NO: 82083 - DNA, 631 bp, Heterodera glycines
  Genomic contig location: Contig_ID=SeqID_17576; Location=191..821; Strand=+
  SCN-specific regions: Sequence locations=1-100,303-385,408-557,593-631
aatcgaatataagcaaaattgatgaagaatatgtagcagaaagtagtgaccaacaaaatgttggaaaaagtaaatttatgatcaaaggaaattgtaattgttttaaattaaattaatttaataaatttggctaaaaacttaaaattattattttatttccgtctcaaataaatatgaaaaaaagaattatgaaatagaaaattaaatattttttaattgaattaaagattttagaaatataattttaaaaaaagttgatttttcatataatttttaaatattttttctatacatttttaattgaaagctaaaaatgaagatctgacctcgtcaaatattggagatgctaacattgagaatgagattcatgaagaaggtaaaatggttaaatttaaatgaatttaaatttgatttctctgcctattatagctacaaaattggacggaattgaagaaattggtaataaaagtgccaaaaataacggcagattggagatgtatgaacagaatgccaaactcatagaacaattgaaccgcgaccaaagtgaacaaaatgccaattaaaaaaatttattttaaatttaaaattttaaggcacaaatgaagcagacaaaaatggcaaggaaaagaga

SEQ ID NO: 82084 - DNA, 478 bp, Heterodera glycines
  Genomic contig location: Contig_ID=SeqID_17576; Location=903..1380; Strand=+
  SCN-specific regions: Sequence locations=1-43,121-160,182-190,212 -214,282-370,417-435,473-478
atgccacgttcgaaaagcgtaaatgagaacaatgaaaaagaggtaaattaattattagtaaaattaaaataagagattttaaaaatgaaaaattaaaataaaaaattttgaaatttttaagctgaaaattcgccgtcactttccagaaacatttcatttaaattaatatcattaaaaaagattaaaatgtctctttaagaaaattcttttttccattttttaaatgataaaaaattttcttaaaaaatatttgattatatatatatttttttcaattttatgtttttagtcccatcaaaattcacctaaaaatataatggaaagacaattggacaacgcggaatcaagtgttgccaaatctgctgaccatatgccaccatcatcaccatcaccaataggttgggcaaaaggaagaaccgtcagaaacaaaatgccaaattaatgaaaaaaaatgttaaataattttaaaaaacgccaa

SEQ ID NO: 82085 - DNA, 1802 bp, Heterodera glycines
  Genomic contig location: Contig_ID=SeqID_2874; Location=1574..3375; Strand=+
  SCN-specific regions: Sequence locations=1-133,156-325,364-474,496 -649,671-1009,1031-1293,1316-1459,1481-1588,1616-1802
atgaacaagtggattgcccttgggtaagtgttaattgggggaacaaattcataattaaatgaggcaatttaaatcccaaataaattttgatcagtgatcacaaaaatgatttcaaatgttttcaattggtccaataaaccaaaataaactaattaattaaacgtttttaaacgggaaaccctgatataatttgactatctgctctcattttagtgtgttgatcgccataatcagcgcgctggacagcgctgttctgcgacaacggcgcattgttaaggcgggaaatgcaccgaaatcggagcaaaaggaaaagccgggtaaatggaataaaataaaataaattaataaattaacaatttttttcattttccaattttaatttaaggagaagccaacttgcgcaagaaacggcaaagtggaggacagggagatgaagcggaaaaaatgccgtacaaattcgacctgacttgccgattttattcttccaacccctttagaatggaaaatgacgaagtgccgccgagggacacatttgcaagcgaagctgaatatgaggaggcgcggaggctggccgtgttgcgcgttcgggcggatgaagaaaaggcacgcatcaagaagccaagcgaggagtcaagcttgtttcaaaatgatgtgaaatattttcattgtctcgacgatgaaacttattacacaaaggaactcgatccacaggttttaaatgcaaaggaataaattaagactccaaaaattatttttttaagaaaattatggcccttcatcacgcaatattggtcattaaaaaggaccgggcttccgcagcaggcgtttaccgaatgaccgatgtattcgttggagacgacccgattggcgtgcccgcatgggaaattccggcagccatggcgcatttctgccggtggctcaaagtcgcagaagaagagctgaataggggaggcgaactggcaagatttgttgcaacagcgcatctccgtctggtaggttgaattgtcaatcctttggagaaaaataggcttaggttcaaatccacccggcagaagacgcgaacggcagattagcaagattgctgatgaatcttttgctaaagagaagagggaagggcccaatcatcctgcgcgagtccatccatgacaagtacgatgagtgcatgaggaccggaaacatagaagctttcatcgtggagatcaacgttgaacttaacaacttggagaagccgggttgcagttgctaacgcggtcgaattgtgtttttatttaagagtccaaaagcttacttttagcatattttttgcgtttttcataactatgttccttaaacgaaattaaatcgaaatgcacccaataagattggcttttcaagttttgaaataagtaattttttattaactcaaatactcagccaaaaaaagtgctaaaaatttatgaaacaatttcgttctttttgatgaatttgatgcaaaagaggactaatattaattctggtcctattttttcacagcagttaaatttaagttttttcctattttggtggttttcggtgcttaaaaaaatcaacattatattagtagattccgattttttaataattaaaaaaaaattttccagtgatggtgggtgtgcttctgcaattcttgctcacaaaggaaggtccccaggtgtccgtgggatttccaaatgaaatttggtgggtggatagagcacccatgggttcttaagaaaagtgtttttattttctgcgaaatgagtctgagtgccgagttatgacgtgccaaacttttttttattgca

SEQ ID NO: 82086 - DNA, 403 bp, Heterodera glycines
  Genomic contig location: Contig_ID=SeqID_2874; Location=3586..3988; Strand=+
  SCN-specific regions: Sequence locations=1-356,396-403
atgtccgtaaatccccaaaatattattgtccttttaaaaaaatatttttccaaatataatgatgaaactccaataaattctgtcgaaatcaatatttcgaaaaattttgccgcaactattgaaaaatgcattaaatttgatgaagaaatgcttttatcggaggatttggtgattgatgaggaagcaaattttgatgaattagatgacgaaagtgatgaattcgattatgattccgcagaagaatttgatggaaatcaaagtcccaacggttcaggtccattcgtgtattgtagatttgttttctgacttaatacataggtggatggcgtttacaattttaatcatgaacattactgaaaatttttcaaaaaaaaaatttttttttttgtttttttggacggta

SEQ ID NO: 82087 - DNA, 737 bp, Heterodera glycines
  Genomic contig location: Contig_ID=SeqID_2874; Location=4050..4786; Strand=-
  SCN-specific regions: Sequence locations=1-6,28-55,77-279,326-383,407- 516,538-737
atgcagccaaaaattataaaaaacattttcacgatcaccgaaacgctgacgccaaataaattctgggaagtaggtgtcgtaagtttcagtcttgttcccaaattgctgtttgaaattcctcttcaattttttccacatggattcaacattttgggtatgggcaagacataaatgcgaatttcgaaaaatttgagttttcgatttttgttcgaattcggatcaggggttcggaattgggtgaaatggatgccatattcgtgctcagcgaccccgaaaaccttataataaatatttttatgacttttgaaattttttaaaaaaatttcaaaaaaggtgtgataccatcggtactattacccatattcgtttcccccacgtcgtcatcccccccgaaaaaaattttttcgggggggggggggggttgggaatgatgtgcacccctaaatatgggtttgatacagggggttttcaggggtgttggtatggatctgtcacccatttttatgaaataccaccgatatccttaattgaataatatacaaacaccgttatagttggagcatgatgaggatttcgagtctccaccacactcgtcggacgaggaggcgccagaggacgaggtggattcggactttgacaaagacgaggaggaggatgagcccacgccggcggaagaggacccggaacaaattgagcgacgacgaaaggtttttttttggaaggaaattaattcataa

SEQ ID NO: 82088 - DNA, 93 bp, Heterodera glycines
  Genomic contig location: Contig_ID=SeqID_17577; Location=88..180; Strand=-
  SCN-specific regions: Sequence locations=1-93
gtggacctggtcaccgaccgtggcgagctggccgaacttgcgcacattctcaccgagggcaccgtgggcggtcaaccgatgaaaacgaagccg

SEQ ID NO: 82089 - DNA, 916 bp, Heterodera glycines
  Genomic contig location: Contig_ID=SeqID_17579; Location=1474..2389; Strand=-
  SCN-specific regions: Sequence locations=1-228,250-296,335-847,869-916
atggacaaacttttctgtgcaaattttgctgtaaagacgtgggaaaaggaaagcggtgcaccgattgaatgccaattcgatgtaaaaagtgtcaatgcaaaaattgacgaaacggaacagataggcaccaaatgggtattttgcatgtacgcgagtgccaacgagaaactccaaggaaagccaaacatattcgagcagccaaataaggtcgaagagattctaaagccaaaatattttatttttaatcttgaaataaaaccgacatatggaaatgattttgtattttatatgccatgtatattaaattctataataattaacaaattttaatatagaatattgaaaagatttcaactaattttgtaaattgaatagagcggcaccggtattcttcactaaagcagatgccggtactgcgatcacctatgccgataccgtatgcaagtttacgaccggtatcgatatcaacaggacggttagttgcggtaccgccggtactgcaagattcgagccgggtagtttattttttactaaaaacaggtactggtcccgtcactgttgtaaattcaatttttgaaactcaaaatatgcgcacaatgtaaaggagcagcagaaaggcggagcgatgtttggagaggcgccaattggcgggcagcacaaccaattgggacacaatgccaagcgcgtaaatgatgaacaaagtgatggcggacgaggtcagcgtcaggtcacgccgcgttgggtcgtcacaaaattggacataatattggtaagcagctgagacatttgtggaaaaattcggaaaggaattgtcgatgggcgacggaatggctgaggaagaagccatcattattttctttctctaaaaagcattttttacggttactgtatgcaataatagaaaaaatgtaataaa

SEQ ID NO: 82090 - DNA, 1101 bp, Heterodera glycines
  Genomic contig location: Contig_ID=SeqID_17580; Location=579..1679; Strand=+
  SCN-specific regions: Sequence locations=1-192,215-306,330-418,440 -1015,1037-1052,1075-1101
atggaccaaaatgccaaaatatggaaatatggacataaatcgcgaaatatggaaaaatatggatatagaaatccttcttttctgtcttcatctctgcaggcttttctcccaccaatatatcgatttttttatggtgacaattttagttgtgagcagatagaaagaaaatggagaaatagtgtgggttagagaaatcaaaaatatttggaaaaaacggatgaatcaatttttgttctactgttacgtcgggattaatacaaaatgtttgcaattgatggaaattttgaatttagcgaagaaaatgctaaaacaataaaaataaacaattacgattggtgaaaaaatcctgcagaaacactcgaaattgttgagatgactcggaaattgaaactcaggcaaagaagttgaatttaaaattctttcaatttcattttattaaacgcactgaaaatctgctgtcgccaatttcgcatgttaaacttatgaatgacattcaattaagtctgtgcaaattcgttttcggctttttggcaatctttaggttttttttcatctaattcgctatatttggccattactttcgagttatatgtaatgcgggatatgcatccaatagtttcgtcatactgcagcagaaccaagacctgctgcagttcaagcagcacaaaatggtagaggaagcggtccaagagcaggaacgtcgccggagtatcgtcgtcatggggttggccgagtcggccgaaacaaagccgtcggatcgcgttgctgccgaccataccgctgtctcaagtgtactcgatgagcttggcatcaagtgccccatttcaaactatcgaatggggtccccccaatggaagaacatgaacattcgtccgtcgctgagcccagcggaattggacgtacgtcgacagctgcagaaagaatgtgcagagaagcgaaaagacggcggtgactgggtgatctacgctgggacggtcattgaacggtcggacattcccaatttccggaaaatcaattgacttctccccaaatcacttttgacaaatacatatttttcacaaaataagaatatattttccggtcttaagcatgttaagctca

SEQ ID NO: 82091 - DNA, 155 bp, Heterodera glycines
  Genomic contig location: Contig_ID=SeqID_17580; Location=150..304; Strand=+
  SCN-specific regions: Sequence locations=1-155
ttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgtgcaatcat

SEQ ID NO: 82092 - DNA, 87 bp, Heterodera glycines
  Genomic contig location: Contig_ID=SeqID_17583; Location=925..1011; Strand=-
  SCN-specific regions: Sequence locations=1-87
atgtatttgacgtgcagcaccgagcggcccggctggatgaggtcgttgccgctgaatagcacacggccccggccgcagtcgaacacg

SEQ ID NO: 82093 - DNA, 870 bp, Heterodera glycines
  Genomic contig location: Contig_ID=SeqID_17584; Location=1..870; Strand=+
  SCN-specific regions: Sequence locations=1-74,96-314,337-517,542-870
  Gene Ontology: Mol. function=DNA N-glycosylase activity; Cellular component=nucleus; Biological process=base-excision repair
aatggcataaattcccgttttttgtttttttgcaggtgttggtccaaaaatgtcaaatttggcacttcaaattgcatttggcaaagtggagggcattgcggtggacactcatgttcagtggggttgccttcccgtctttgtcggcacattttaaacaatgtttttttggcaggtccaccgaattgcaaatcgactcggttgggtgagcacaaagagtgccgaagaaacggaacaacggctcaaggaactgctcccaaagtgcgtaggtgttaaagccagaaatttgaaataatttttgccattttcgggtatcgtttttcttcatcaacaagaaaatggtaattcctacgggaaatgtttccatttttaggaatcattttcattttatacaaaaattttgctttattgacttgttgttagttctttgagcggcatttagatttttcaaaaagaaaattttattgtttgatttataaaaaataaaaggaaaaaaatttttgaatactttctcagcaatatttttgaaattttgggaaaaattagtaattcatcataaaatatgaaaaaatcgctataaatatttttttcttgaattttcttatagaaagatttctataaaaaaatttttgtaaaattctaagtagtaaattttcggaggagaaacaagctgcttcccatactttctcacatcatctcccctaaatcagcaggtctgaatggccgtccatcaacaaactgttggtcggctttggtcaaacaatttgtttgccggtgcgaccgaagtgcgacgagtgcgccaaccgttcgctctgtccatggtcatcaccagcaaatggagcagcaccaaaaccgaagagcaagaaaaagaga

SEQ ID NO: 82094 - DNA, 1059 bp, Heterodera glycines
  Genomic contig location: Contig_ID=SeqID_17585; Location=88..1146; Strand=-
  SCN-specific regions: Sequence locations=1-1059
atggacattttgcccagttttgaccgtcctcaactcggcctcaaattggcaattctttcgccacgtttcaatgcgttggtgggcaaacatttcgatggcaaaagcgaattgacaatttggagaacaatcataatagacaaggacaaaggacctgaaccgaaactttatgtaatggatgaaaaattttacaaatttgtgccatttccgttgcccgagcgtccgttgcccagcaaaatccgttttaagcgccttcggattgagtaattaaaaatcaaagctttatggcaatgaaagctttccttccattttcagttacatcgatcacttcgtcatcgcttttcttcgttcaaatcaccaaatttttaacaaaagaggcaccaatttagagttgtggatttattccgcacacagctcggatgaccagccgatttgggatgtttttgttcgtgaaatgtggccaatttttgcatcaaacattcgccacttggactttatcgatggtgatggtttggacaatttgcgtcgtcgcacttcgccgacaattcttaccgatcttaaccaattgaattcaatctattcatttggtctgttgcctgatccaattagtgattttgatgtgccaaatgcaacaatttctgctggccaagcattgtccaaatggttgcaaactccgagaaaagatggccaacccaagcgattgcgttgcaaagattttaacaaacatgtggacattgattgggtcaacaaattcaaggaggtgtgaccataatttcggcaaatcaatgctttttgattgcctctatttttgttttcccaattgtttagcaatttctccgtgccaatgccatttcttccgtctgttacgaaattcatttttctgttcatgggccgtcaatgcaaatggtgccatttgaattagcgaacgaacagaccaaggaaaagctgacactgatcaaagcaaaggaaaatgacttggaggacaattgttggataatgaaacgatgcaaaattggggaatccgcggcggttcagcttcagaaagatgaaaattgtaacaat

SEQ ID NO: 82095 - DNA, 765 bp, Heterodera glycines
  Genomic contig location: Contig_ID=SeqID_17586; Location=33..797; Strand=+
  SCN-specific regions: Sequence locations=1-308,348-765
ttttcaacacgagccaatcaaaatgggcagcacggaaatcggagtcgcgaagttcgtttcgacaacacaaatggacgggcgtacacacgtcgcaacggcagttattcgtcggaaccgtcgtcgggtcgacgaagctccttttcccgtcatcaagatggtgctcgtacatacgtaccctccactgcagtacagcgaccgatcagcccgaatgggtgtgacagtggcggcatgtttctaatggtcgaccccttcaacattccaaacacattgggcgcccagtaaataaacacattaattttcattcatactatattatacataattcttataaattaatttatattattcagaattcaagtatttgatctccaagagagttagttcctttttattttggcatcattcgcctttttatttatatgtccaaaatcagacgcgaatttaggcatccgacatattattggttactgcattccattgcgttgctgtgtgggtctgttcaagcacattcagccatgccgtgccatcaagtcgatggaaagtcaatctatggatgaacagttcgcgcacaagtacaaattccaccccaaccttccattgagcgttgtcccgcttcacgacacggaattccatcggatgatgggctcaccggtgatgccgttgcgcgacggttatcagcaacgtaacagattctttgtgcgtccctcttccccgcggttggctcaacagcagagacacgaattcgacgacaccgcgatgcattag

SEQ ID NO: 82096 - DNA, 384 bp, Heterodera glycines
  Genomic contig location: Contig_ID=SeqID_17588; Location=1276..1659; Strand=+
  SCN-specific regions: Sequence locations=1-318,340-384
  Gene Ontology: Mol. function=fructose-26-bisphosphate 2-phosphatase activity; Cellular component=cytosol; Biological process=fructose 26- bisphosphate metabolism
atggaggacatgggcctttacctggagaaaaaggagggcgaagtggccgtttttgacgcgacgaacaccacacgccagcgacgcaaatggctggtcgactactgccagagggagcgcatcaacccaaagtttcgcatattttttgtggaaagtgtgtgcgatgacccggacataatcgcagcgaacatttcggtctcacccattttggcccatttctcaactaaaatgcatgcatttcaggaggtaaaagtcaattcgcccgattatcgcggaaaaatgacggaggaagaggcgaaggccgactttttgcgccgcatcgaaaattacaaattgcaatatgaaccgttggacaacgaaaaggacgaccacctttcgtacatcaaa

SEQ ID NO: 82097 - DNA, 1070 bp, Heterodera glycines
  Genomic contig location: Contig_ID=SeqID_17589; Location=850..1919; Strand=+
  SCN-specific regions: Sequence locations=1-201,224-775,798-1070
  Gene Ontology: Mol. function=6-phosphofructo-2-kinase activity; Biological process=fructose 26-bisphosphate metabolism
ggaatttgtgagggtttgacctacgaggacttccaaacccgataccccaagcagttcgctgagcgggacaaggacaaataccattaccgctacccgtccggcgaaagttacgaagacctcgtggtacgactggagccggtgatcatggagttggagagacagtccgacattttggtcgtttctcaccaagccgtgcttcgctgtaagaaaggaaaagcaaattgcaagacaataatcccatattaaggcattttggcgtatttcaacaataacaaccgggcagacttaccgtatttgaacgtgccattgcataccgtaatcaaactgaccccaaaggcatacagtgagtgggcggttacggcacgatctctgctaattggaaatacattaggctgcaacgtcgaactgttcaaattcaaagtggacgctgtcgacacttatcgggagaagccaaacgagccgatggtaagcgaacggcggaaaatgaaaattgtaaacaaaaagtggattagttccaattaatgattcttcgcattgcctttgtcctcggaattcgcttcatttgtctttctttctcatgcctctctctctcttgcattccctcgcatttattcgttgcctcttttgtagtgggaacacatcgaaggtgaaggctgcattcgcatttgtcgctctccctggtcagttgcgcttgttttgcccacttttcttttcaatgtctttctgttgtgcatctttgcccaccttttgtgcttggtcccccccccctaacaaatccattaactgcgctatcactcctttttggcttctttcgtgcttttgctttccttacaattattttttggttttctattactttttaccttggcctgaaatgcactttcctctctagtggtttgcttttttcactttctccactcttttcgttttttcctaatttttctgtttcattaattaagaagaaactcttggccgagcccatccccgcaccaattcccgaggagagagagtcgtcaatctccgatgatgctgtcgaacctccaccatcccaaatagttcctctcaattag

SEQ ID NO: 82098 - DNA, 967 bp, Heterodera glycines
  Genomic contig location: Contig_ID=SeqID_17591; Location=32..998; Strand=+
  SCN-specific regions: Sequence locations=1-967
atgccgacagcggaatgggcgatggcacaacaaaggtccaccaaacggctcgcggtcgaggcgacggaaacgccggcagcgaaaattcgggcgaggatggcacaacaaacttccatcaaacggttcgcggacgagtatacggaaatgccggaggaaattctggagcgggcacagcaaacggccaccaaacgattcgcggacgagatggaaatggaaattccggcagcggaatgggcgatggcacaacaaacggacaccatgcaaatgccggcagcgaaaattcaggcgatgtcacagcaaacggcgccgacagcgcaaattcaagcgatggcacagcaaaatgtgtcgggctccgaggtggccgaattgcagtcagacaacgctgcgccagaaattacaacaaagagagggaggccgaaattggagtacgacggctatttgtacttgttcgagaggcggagtgcggacggcaaactcaaattctggcgctgtgagaagttcaaaaccaagtacacgaaatgctcggcccgactgcacaccgacgagcacaacgccatgcgaaaaacactgaatgagcacgtgtgcgaccaaagtgcggcacacgtggaggcgcaacggttgcggacggccatcaaacggtacgcggccgaggcgacagaaatgtcggcagaggaaattcgggcgattgcactgcaaaatgtgccgggctccgtggtggccgaactgccgaacaaagacgcgatggaaaaggtaaaacataacaaaagattttttgtttcgtattttcgagtgatttggcacttttttcagatggtgagacgtatgcgccaacgaaattgacataagctgaagggagctaacaaatgaggagaaaggaggaggaagcaaagcgatgtcaatgccgaagcgatcaaaaaaggacgaaaatgcttattgttaattaatgccgcccatatttttgtgcaca

SEQ ID NO: 82099 - DNA, 1147 bp, Heterodera glycines
  Genomic contig location: Contig_ID=SeqID_2876; Location=2021..3167; Strand=+
  SCN-specific regions: Sequence locations=1-441,465-478,704-951,973 -1065,1087-1147
  Gene Ontology: Mol. function=structural molecule activity; Cellular component=microtubule associated complex; Biological process =nucleolus organization and biogenesis
atggagtgaaaacacctcaaattgaggttgacggcgacgacgatatagagagaattataatagttaattaattagggcaaggcaatgaaagtttttgcaaaattcaacgccttttatagaggtgaattcacttaaagaaattcattccaaaaaaggcaatataaaagcaacaaatctccgcaaagtcctcactaatttcaaccttctgcctatttggttgagttcatcactttcaccactgttctccaatacctattctatttcaacgtcaacacccaccgcatcttcgcccgctgcttctgtgcgacgacgacccaattttgtgaggcgccccccccaccctttcaaattttctgtttttcatttttaattgttttttttcagattgtgccagacgacaacagcagcacatcaccgcacttcagcagaggaggaggcagctcatcatcatcaacaacaacaccaaacaatgagcgacaagaagaaggaggagccgaagaaggaggagccgaagaaggaggagccgaagaaggaggaggagaagaaagaagagccgaagaaagaggagaagaaggacgagaagggcggcaaggacaaggaggagaagcggcgcagcaagaagagcgggaaatcatcgaagaagaaggacaagaagaagaaggacgggaagaaaagccgaaaggatcgcaaaaaggaggagaagccgagcacgggagacgccgctgtcgcgacgacgcctgccgctgccgcgacgacgcctgccactgccgaagcggcgccgaccaaggagcaaccgccagcagccgtcgtggaagccgcaacgccaccagccgcagccgagccagcagctgacgcagccaaggaggagccgaagagcgcggagacgacgaccgaccaaccgcccggcgacgctcctgctgctgatggtgccgcggagcccaaagaagaacagccgagcgcggagacgaagactgaccaaccgcccgtcgacgctcctgctgctgatggtgccgcggagcccaaagaagaacaaccgagcgcggagacgactacggacccaccgaccggagacgctgctgctgctgatggcgccgcggagcccaaagaagaacagccggagacggacaaacccgctgcggacgagtga

SEQ ID NO: 82100 - DNA, 170 bp, Heterodera glycines
  Genomic contig location: Contig_ID=SeqID_17595; Location=715..884; Strand=-
  SCN-specific regions: Sequence locations=1-170
aggtacaacattggtcagaagaggtacaacggtgattaaaagaggtacaaaagtaaatggaagaggtacaactttgattagaagagatacaactgtgatcagaagaggtacaacagtgattagaagaggtacaactgtgattagaagaggtacaactgtgattagaagag

SEQ ID NO: 82101 - DNA, 227 bp, Heterodera glycines
  Genomic contig location: Contig_ID=SeqID_17595; Location=1..227; Strand=-
  SCN-specific regions: Sequence locations=1-227
taattaaattcattgaaaataacgtaaaaatgcacaaaaaaaataatgttacaccgtccggattcgaacctgcccccccccccctcaaaatgatgcctcagaatccccaatcacacagggattctgaggtcttgacgatgtcaaaagtaaaatctgatcacgtattcgtgatcagcggcccaaataacccctaaagacatatttttggaagatttttgtgagaaaaa

SEQ ID NO: 82102 - DNA, 664 bp, Heterodera glycines
  Genomic contig location: Contig_ID=SeqID_17596; Location=263..926; Strand=-
  SCN-specific regions: Sequence locations=1-664
atgtccgctgaacgcgaggcgcagagagcgcttgaagaggagagaatgcgcgagagggaagagcgagaacgtgtcgcacgggaggaagcggaacgcgaggcggaagaaaggcgcagaatggacagaatcgaagtgggaaggggggggggggctaattaggggggtaattaatgagaatggaatgggccgagtcagccgagagcaaagaagactcacttgagaacggcacttttggctgtggaggggagggggcatcacttgacatcccatagtttttgccatgcgattgatcgcccgatcacttcccctaacttttcaaggctcgtgatcaaattgaacggtcgactttggcgtgtctgcagaagggtaaaattatttcagcaatgacgcgccttttgctaattaattggccaaatttgaggcccaacgcgaagccgaacttttgcgacgtgccaaactgtttcggcacattttgttggacggagacggacaagcggacatgaaaacggcaagagaagtgctcaaatgcgagccggaagaagaagcggtgctgaacgacgtgatcagacaggtggacaaagtgacaaacggtggaaaaaggaacagacaattgagagaaaagttggaaatggatgatcaagtcggcaggaaattaagaatttaa

SEQ ID NO: 82103 - DNA, 1830 bp, Heterodera glycines
  Genomic contig location: Contig_ID=SeqID_17598; Location=131..1960; Strand=-
  SCN-specific regions: Sequence locations=1-360,386-1195,1220-1830
atggccgctgacattggtcaaattcttcaacaattagttaaaaatcagacggaggcttttcaagcccttctccgaaatgcccaaacaaatccaaattccgtcaatcattccactatttattcgactatcaatagccaacttggccaattcacatataatccagaattggatttaacttttcaagcatggctcgaccgttttggcccgttcattcaggtggatggcaaggaccttccagacgcaatgcaagtgcgactgctgcttgggaagctcggtcaggaggagtacgctcgtcatgccgaacgtgtacttccaaaactgccgaccgatttcactctggcacagacaattgataagctcaaaattttgtttggggaaaccaaaagcattttcactcgtcgatatgagtgttttcagttagctaaatcattttcccagtcaccattagattttgctagccaagtgaatgccatgtgtgaacgttcgaaaatggacttgacaaaagatgaaatcaaggccctcattttcctcactggcctctcggatgaagacagagaactgagggaacgctgtttgcggattttggaggaagccattaagaaaacaccgccggaagtgatcacttttgagaagcttactgaagagtgccgtgcgtttttgtcattgcgcaacacatctcaatctttggcaactgtttctggaacaaacgccatcactctcaagccgcagaaattgaaggaacagcagctcaaaaagcgcagcatatcgcagcgcccatcggcgaaggcacaaagcaacaaaaatcgcagcccttccccttttcagcgccaaccaaagccgccatcaccgtgcaggttttgtggtcaaatgcattgggtgcgtgattgttcacaggcgccgacttgctcaaagtgcaaccgccgtggtcactaccgctccgaatgccgctcagcatcttcagcccggcccaattcacaacggtacaacacaacaatgtcggtcttcaacattacggacgacgacttatcggaatggataatgatcaactgcaggattaacaatactgatgcgtcattgatggctgactctcggtcccgtctgtcggtcattcagattggtttatgggaaaaattgggtaaacccaaactcataagtggcatcaaaaaggccaaatcatattctggtcactttttcgaaattttgggattttttgtgtgttcagtcacgtaccagggctgcactcttcaactcaaatgccacgtcgccccggacggaccaatgaatttgttcggattgccatggatcaaagcgttcgaaatggcattgcagcgaccaatcgctacgacactcaatctcgcacaggcacacgccgtcacagtttgcgacgacccaaacactttggccaaaaatttaaaacaaaaattttcaaaagttttttcctcaagtttgggtctttgtacaaagatgcgggcgcacctccagctcaaaccggacgcacagccaattttctgccggcctcgtccagttccacatgcagccaaagcagctgtcgacgacgaactcgaccgtttgctcgcttgtggtgccataaaatctgtggacttcagcaaatgggcggcgccgattgtggtcgttaagaagaaatgtggcaatgtgcgggtttgtattgattttgcaaccgggcttaataacagtctggaactaaaccgccacccgctcccacgcattgatgatatttttgcctcgctggagggttgcacagtttttagtcaaattgatttccgcgacgcgtacttccaagtcgaattggacgaagagtcaaaggagctg

SEQ ID NO: 82104 - DNA, 65 bp, Heterodera glycines
  Genomic contig location: Contig_ID=SeqID_17600; Location=812..876; Strand=+
  SCN-specific regions: Sequence locations=1-65
aaaacgcagccaagaattcttccgctgctgttccttggtgcgcgttcggttgaactgagcatttt

SEQ ID NO: 82105 - DNA, 402 bp, Heterodera glycines
  Genomic contig location: Contig_ID=SeqID_17601; Location=1217..1618; Strand=+
  SCN-specific regions: Sequence locations=1-306,340-362,385-402
atggccctcacgcgaaaatggccctcacgcgaaaatggccacgcgaaaacggccacgcgaaaacggccacgcgaaaatggccctcacgcgaaaatggccacgcgaaaacggccctcacgcgaaaacggccacgcgaaaacggccacgcgaaaatggccacgcgaaaacggctacgcgaaaatggccacgcgaaaacggccacgcgaaaacggccacgcgaaaacggccacgcgaaaacggccacgcgaaaatggccacgcgaaaatggccacgcgaaaacggccacgcgaaaacgtcctggcccgctaaaatcataaatttttatacaaaaagcaacaaaactatgccaaatcaatattgagataaataatttttaaaatcaaagatttgccaaaaaaacaa

SEQ ID NO: 82106 - DNA, 226 bp, Heterodera glycines
  Genomic contig location: Contig_ID=SeqID_17601; Location=952..1177; Strand=-
  SCN-specific regions: Sequence locations=1-226
ggccgttttcgcgtggcagtttcgcgtggttgcacataagcgaattttttacttttttatagtttggaaaattttttcactcccgttttacttctggtgcttaattcaatatatatttaagtgaattttataaactaaattaagactgacaaattattatacagtcaaataattttttcacggtctaatgctctgctggtattagtgtaaactcaccatcccaaat

SEQ ID NO: 82107 - DNA, 577 bp, Heterodera glycines
  Genomic contig location: Contig_ID=SeqID_17603; Location=685..1261; Strand=+
  SCN-specific regions: Sequence locations=1-553,575-577
aaaatttcatccgaaacgttgtcccaataccatgtcaaaggtcacatggaccattttgatcagcccgccatttgctacccgcgctatcgtggcccatccacgcgcaatcggttgcccacagggctgaaactgatcagacgggtgggcgaaaagctgatcaaggagaactacccgagcacggaagagtgagcataaattagggcaattatatctgccatattagtttttaataacaaattgagagtaacaacgtaacaacattttaaatgatttttttgaatcttttcgttggatcattcgttatcccatcttttccaacttggcattctgcttttatatctattattggactaattaatagatctaattttcctaacttttatattgttttgagcaaatgatttgagtacgtttcgctcggagctccattttccacttttctgctaattaatagggatgcgatttttaggttttggctacttcgtcactaaaatagttaaaaatcactattttggcgtatcgtcactattttttcactatttcgacattttttggaaaattccttaacaaaaatgca

SEQ ID NO: 82108 - DNA, 230 bp, Heterodera glycines
  Genomic contig location: Contig_ID=SeqID_17603; Location=1408..1637; Strand=-
  SCN-specific regions: Sequence locations=1-52,74-115,138-181,207-208
atgccaaaaggaattgaatcgaggttaactaaaatagtgagtaaaaatgccaaaatagtgaagaaatagtgacaaaaagtccgaaatagtgacgaatagtgacaaattttcagccaaaaattgagcaaaaataatttttattcactgattgcagttgcaaatgagtaggactgggatttttaagaccaaaaaacccaaaatagttacctaaaaaaatttttaaaattaaa

SEQ ID NO: 82109 - DNA, 683 bp, Heterodera glycines
  Genomic contig location: Contig_ID=SeqID_17604; Location=401..1083; Strand=+
  SCN-specific regions: Sequence locations=1-683
  Gene Ontology: Mol. function=structural constituent of ribosome; Cellular component=cytosolic small ribosomal subunit (sensu Eukarya); Biological process=protein biosynthesis
ttatcccccataacacacaggcggatgacaccgtggtgattgacattggcactggcaaagtgacggactacgtgaagtttgatgctggcaacatttgcatgatcactggtggacacaacattggccgtgtgggcattgtcggacatcgcgagcgtcacccgggctcctttgacattgtgcacatcaaagacgccgctggccactcattcgctacacggttcgttcgttcattgttttttgggtttagttggttgtaaaacacttcatgaccaccacttttgggtcccaagcgtttacccgacattaattgttaactgtcatttcatttattttttttgtgaattttactcagtttccgcaaattttggtcgcgtataacggaaataggcatcaatttgtgtagcaaattatgtgaggcatagaaaattgggtggaaatttcttcattttcgaaaatatttaattgtttggattatattccaatccctttaaattcggaaaatcttgtcttaccagcaatcaggccccctatttccaaaataatttttttcttttctgtccaggatgaccaacgttttcatcattggcaagggtgcaactccgttgatcagtttgcccgcttccaagggcatccgtttgtccattgcggaggagcgtgaccgccgtcttgcgcagaagcagaaa

SEQ ID NO: 82110 - DNA, 131 bp, Heterodera glycines
  Genomic contig location: Contig_ID=SeqID_17605; Location=130..260; Strand=+
  SCN-specific regions: Sequence locations=1-131
atattcgagaacccgacagcaattttgtcgagaacgattcctggacgagaatggaaagctaaagcgagtgaatgaattgatcccattctcagttggaaaatggtaacttttggtggattgtaatatattta

SEQ ID NO: 82111 - DNA, 1767 bp, Heterodera glycines
  Genomic contig location: Contig_ID=SeqID_17605; Location=621..2387; Strand=+
  SCN-specific regions: Sequence locations=1-207,229-290,313-328,351 -490,533-599,621-759,781-897,919-1021,1050-1158,1181-1360,1382-1767
atgccgcagtctcagccgtccgtagttgtcactgattacctcatcaaatggcacggaaatgtttttataaattggggcaaatttgtgccaattgttaatggtggaaaattgaccaaatatgtacatacgtaagtacaaaagggggattaaaagtttgatgccaattcggcgttatatgaacttaaccggggcaattactcattagtgatccatttattccttttcattttagttagtttttcttttctaatttaaaaaatgatcattatattatttttcaaatgggataaattattaattaagttttattttgcttaaccactttccatgaaattattcaatgtgaaaaactgaataacattgtttttatgaaaatttaaattttccaacaatcttaaactatgaacgcataattatttgggaccatttgaacccacgcgatggaaagtgccaaaatatactactcctaagttataaaaaaccaaatcataaaaaattggaaattaaataattctacaattttctctttttagcttagaatgactagcttcattcctcccgaacttttattcgaaatttttcaatttacgacgtccgttaacaacaaaaatttggttcgcttacgatccatttattacagaatgatcggcacagttgactacaaaaaaatggcaatgttatgcagttttttccaaggaattgtcaactcgtattttgcaaagcggaaatggattgtcgattttattgaaattcgttgcaatgaaaaagagggcaaaaaggagtttgaacttgcggaaaccagaagcaataaaacgattgaattgccgaaacatctgccagacaaaattcgtggttttgtatgcatctcgataacgtaaagaatataaaattgtattgattttaacattttgtaacatattacaggtttcttgaccaaaaagccattgaatttctgcgccattttcaccgacttttcggcacgtgccaaataaagttgagtattggaacaagcagcattttggcaattggattcttttattgtttcttatggccaagaatcaaaaaccaaatatcattcattgaatttcgggatgaccaagcgttcagccgaatgcgagacattgcaccgtccatattcagtgaattgccttctctccgtatttttgagtcattggaagatccattccccgcgtttcctgccatcgacagtaccaatgcggtaaatggacagctattggcacattggctgatcaaggcgcttccgaatgaaatccctaaaattgttcgttgttcaattgaggaacccgacacggcgggtgatttgccagcaaaaattggcgcaattaaatcggtatataaaaaattgaaattatttatgtttgtaactaactgttaatccctttaggcattttcaaaatcttctttttctgccaatttcataatccaaatgacgatacctgatgaaacaatcattgcaccattcgatgtgttcaacaaaaaaactggaagacgtctgttgctggatgattcccacgatcaaaatctgctgctaatttcatgcccaattaaacgggacaaaaaagcatggacgaaatggagggaagaggctcttcaaggaagtgagatttacacgtggaatttaattgatctcaccgcgggggacgctgacattggcgaatggtgaaaaatcattttgtcaatgcataaatttttatttttaggaattcggcacaattccccgatttaatggcgaatatgcaaaagtga

SEQ ID NO: 82112 - DNA, 395 bp, Heterodera glycines
  Genomic contig location: Contig_ID=SeqID_17605; Location=2820..3214; Strand=+
  SCN-specific regions: Sequence locations=1-208,230-395
atgtttgatatgtttgatgccattctttttcaatgtaaaacgttcccccgtctttctattgatcatttcaaatggcacaatataactaacatctctccatggaggaaacctaatagcaatgatgaaattcacgggagaagaagcattggcaaaagcctaaacggaaaaaaggttaaattagcaattaactattaggtggaacgcggacagaaaaattaagtgttttcttaataaattcgggataattaaattttatagctttctgagccaatttttagtcgatgacaattaatttatacgcaaaaattgatatgttccgttccaccctattttctgttactatcaccgatttaatgcttataattttcggcctccattggtgttctcgaatttga

SEQ ID NO: 82113 - DNA, 1512 bp, Heterodera glycines
  Genomic contig location: Contig_ID=SeqID_2878; Location=2387..3898; Strand=-
  SCN-specific regions: Sequence locations=1-56,78-1052,1076-1512
atggacagaaagaatgtgaaggcgaattactacctggggaaggtgtacgtacaccagggacagtttgatgaggtgtgaaaattgggaacaaattgttacataattttataaatagtcaaattgtatggaaattcaatgcttacgttccattcatttttaggctatcaaagtgttgtcgcgggctcatgaaggcgttctcaatcttaagcaaacatatggcgacgaaataacccaattgttacggttagcgcgcagagaaaattgagttttttcattattttaaagtaattcatttgaactttgtttttaggttccgtcaagaagaagacaaacgcataactcaggagattgaacttcaaagttacttaaaccaattaattgacgacgacatcgccaaaaaagtgaaccaattggaggacaaaaaggaaaatgacgttgaagaaaaggcggaagaactgaagacacaaggggacaccttcaaaaaacagctgaacaatctctttgctcaggtaaaaaaagggagaattgaaaatcggtaccttttatttggggttgggtaaaaagaaaggttattcttgccggtattttgcaaaataaatgcattttttaaattttacaatacaccaattttagcaggtttcattcaaatttgaaaaagttcacttcacccgacgtcactgtcggcggcggcaccgcggacgactaattcctataactatttaaaatttttacaagaaacctgttaaaataggtttttctcccgaagcattttccatgaaaattacattttaagcacaaaaaaattgtctttcgtccattgatgcctccccaaattttggtaataatttcggtggtgtccctcctctcttttcgagtcaaagcgaatctgacatccatttcgactgattccatacccaggacccgaattcgaacaaaaattcaattcccgaatttcgaatttttcgtttaaaaatggtttaattgatcttttattgtagggttgctggttttctttgtttccgtattcgaaaagttcgaacaaatactaatttcaaaaaacttgtattttcaacttttgtttgaattcgggtcctgggtacgaattgatcaaagtggatgtcagttttcatattcagcgacaatcaaaaccctaggaaacattttttatgactccaaaaccgtttgtgacgctaattttaggttgacgatcgtagacggaagcgcgacctcccggactatttgtgtggcaaaatcagtttcgagctgctcaaagaccctgtaatcactccttccgggatcacttacgaccgacaggacattctcacccatttgcaccgagtcggacatttcgaccccgtcacccgggttccgtaagtttcgcaatcatttaattacttgtcctaagaaccaatttatttaagtctcactgccgaccaactaatcccaaatttttccatgaaggaggttgttgaccattttgttcaggaaaacgaatgggctatagatttttga

SEQ ID NO: 82114 - DNA, 3687 bp, Heterodera glycines
  Genomic contig location: Contig_ID=SeqID_2879; Location=1..3687; Strand=-
  SCN-specific regions: Sequence locations=1-72,96-139,166-196,229 -261,297-299,324-425,447-511,533-701,791-905,939-1062,1084-1129,1151 -1158,1181-3666
ttttcatgattaacatatttaattttttttcttactttgatattgcccaatgcatttgggtaagaatcgatattaaaaatttaaaatacttttcccacaactgccaaataaccattagaaaaagtttttgttgtaaaacaaaaaaaaatttttaaattaatttttgttgttttaaatgtgtattttggctgctgggataataataattttttaataaaattttatttaggggggttttcgttaattaccttatgctaaacctaaaaatgttaatttaattttaaaatttattttatcgtaaaaaaggacatttttggtgaaaatctgttaacaaattttgcactcaaattaattttttccaaattttagtgttggaggcgtaaaatttaaaaatttattgactttcaataagctttgatgcttaatttaaatttatcttcatttttaattcgatatattttcattagttttgtggaatgtcgaacaccaaataaatttattaaacacaaatggaaaataaattaacaaatatttgtcggagggacggagcaaattggggaagcacaaataggaaggaaaaaaacagaatgaatgaaggactaagggaagggtttctaatttgttaattatataaataaacatactaagaaaatattttgctcttaaaatattagaatttgtatttattcaatttaaaacgctaaatttatatttaattattctgttaaatttaaaatatggttatgattttttaaaattatttatgattttcatttgtttataaaaatttgtggactttaaaatcgtgtttcgtggtgtggcatatttctttctgccctcggcacttgcatcttggtttgatcttttttctgcttttatttaatttatcgtttctgattaaaaaatttttccatctgtttaataaaaaattgtatttatatcaatgattaatgttgtgtatatcactcaatattcaaatgtacgccatttactgtactcaatttcgtgtcaatactcatctctcagcatcgtccataaatacccatcactttgtcactcatttgtttcttcttccactcattcaacacatcattttattattcatttattcttcatccaccgacacaccaattttattatttattcttttgcctccgacaaataaactatttttattcttcgttgtgttcaccattgaacataacatttttggcgcagtcagcgaagtgatttatttttgtttcatcatctttttgcgcctagcatttggcgcaaatcaactttggctaaattgtcaacaattcgattggagcatctcaaattctttatttattttattctctcatcattcattttggtttttgcgaagttggttgtcagcagctcgcatcggtcggcacttcacctatttcactcattttccatcaatttcgacctttgcccaccccgtaacacatcggcttgaaacgtcaaggcaaaatcatagcccgctgaacgccaagcaagccgagaagcctttttgcaacacttacgccgtaaaaagcctctgagtgcactgttttaaggaaagacacatttgtgaaagtgtaagtcattgcgaccgctacactcagcgcatttgtgcatcttcccatcaccaaaggtcgtttattgatttcccactcatttttctgtgcctgaccaccactgcagcacttgctggccgacaccaagcaaagtcatttcaatctcttaccaccattcaaattcactactcatcaaatcattgctccaattgaattcaatttctgacaaaaatggccgttgactttgctcaaatcctaaagcaattagtcgaccaacaaactcaagcatttcaaaatttgcttcaaaatacccaaccaaattccaatgttcccaatcaatcgacaatttattccaccattaattcccaacttggtgaattttcatacaatccagaaatggattcaacatttcaaaattggctcgaccgttatgggcctttcatccaagttgacgggaaggacctccccgatcagatgcaagttcggctcctgctcggcaagctcggatcggaggagtacaaccgctatgccgaaagtgtgcttccaagcaagcccactgatttcacactggcgcagacgatcaacaagctcaaggctatgtttggtgaaacaaaatccattttcacccgtcgatttgaatgttttcagctcacaaaatcaatttcacaatccccattagatttcgcaagccaggtcaacgcaatgtgcgagcgatcacaaatggatctgaccaaagacgaaatcaaagcactgatcttcctcacgggactttcggacactgatcgagaactccgtgagcgttgtttgcgacttttggaggaagcgaaaaagaagacaccgccggaagcaatctcattcgagaagctcacagaagagtgccgcgcgtttctctctcttcgcaacacttccaactcattggcacattcaactcatgtggccaattcaatcacaataaaaccccaaaattaagggatcaacaaccgcgaaagcggaatttgtcgcaaagctcgtcaaaggcgacgaccaccatcagcaacaatgaacgatcatcccaatttcagcgcaaaccgcaacaaccaccgtcgccatgccgtttctgcaatcaaatgcactgggtcagcgactgtccaaaggcaccgatctgctcaaactgcaatcgtcgtggccaccatcattcaaaatgccgtctgccatcgccctcatccaagtccaattcacaccgcaaccatgccacaatgtctgtcttcaacatcggagacgacatttcggattggatcatggtggattgtcaactcaatggcagcaaagcatcactgatggccaactctggatcacgtttggccgtcattcagcaatcattatgggaacagttaggcagccccaaactaaaaagggaatttcaaaagccaaatcatattcggggcactttttcgaaatctctgggtatttcttttccaaagttttctccccaagcttaggcctttgcaacaaaatgtgtgcgcacctccacctcaagtccggagtgcaacccgtcttctgccgtcctcgaccggtcccacatgcggccaaatcagcagttgacgccgaacttgatcggctcgtcgcttgcggtgccatcaaacaagtcgattacagcaagtgggcagcgccgatcgttgcagttcgaaagaagaacggcgatgtgcgtgtgtgcattgactttgcaactggcctcaacgattgtttggaactgaatcgccacccactcccgcgcatcgatgacattttcgctgcgttggaagactcaacagtattcagccaaatcgacttccgagacgcctatttgcaaattgcgttggacgaggagtcgaaagagttagtgggaataaacacacaccggggcctttttcagtaccaacgcttgccatttggtgtcaaaagtgctcccagcattttttaaaagcttatggatgagctcaccgccggactcagcggagttttttgctacttggacgacttcattgtggccacaccaacactggaggaacaccattcgcttcttaataaattcttttcccgtctccaagactggggcctgcgtgttcatttgaacaaatgcaaatttctgtgttcccaaattaag

SEQ ID NO: 82115 - DNA, 1409 bp, Heterodera glycines
  Genomic contig location: Contig_ID=SeqID_2879; Location=2054..3462; Strand=+
  SCN-specific regions: Sequence locations=1-454,477-484,506-551,573 -696,730-844,934-1102,1124-1188,1210-1311,1336-1338,1374-1409
atgggaagatgcacaaatgcgctgagtgtagcggtcgcaatgacttacactttcacaaatgtgtctttccttaaaacagtgcactcagaggctttttacggcgtaagtgttgcaaaaaggcttctcggcttgcttggcgttcagcgggctatgattttgccttgacgtttcaagccgatgtgttacggggtgggcaaaggtcgaaattgatggaaaatgagtgaaataggtgaagtgccgaccgatgcgagctgctgacaaccaacttcgcaaaaaccaaaatgaatgatgagagaataaaataaataaagaatttgagatgctccaatcgaattgttgacaatttagccaaagttgatttgcgccaaatgctaggcgcaaaaagatgatgaaacaaaaataaatcacttcgctgactgcgccaaaaatgttatgttcaatggtgaacacaacgaagaataaaaatagtttatttgtcggaggcaaaagaataaataataaaattggtgtgtcggtggatgaagaataaatgaataataaaatgatgtgttgaatgagtggaagaagaaacaaatgagtgacaaagtgatgggtatttatggacgatgctgagagatgagtattgacacgaaattgagtacagtaaatggcgtacatttgaatattgagtgatatacacaacattaatcattgatataaatacaattttttattaaacagatggaaaaattttttaatcagaaacgataaattaaataaaagcagaaaaaagatcaaaccaagatgcaagtgccgagggcagaaagaaatatgccacaccacgaaacacgattttaaagtccacaaatttttataaacaaatgaaaatcataaataattttaaaaaatcataaccatattttaaatttaacagaataattaaatataaatttagcgttttaaattgaataaatacaaattctaatattttaagagcaaaatattttcttagtatgtttatttatataattaacaaattagaaacccttcccttagtccttcattcattctgtttttttccttcctatttgtgcttccccaatttgctccgtccctccgacaaatatttgttaatttattttccatttgtgtttaataaatttatttggtgttcgacattccacaaaactaatgaaaatatatcgaattaaaaatgaagataaatttaaattaagcatcaaagcttattgaaagtcaataaatttttaaattttacgcctccaacactaaaatttggaaaaaattaatttgagtgcaaaatttgttaacagattttcaccaaaaatgtccttttttacgataaaataaattttaaaattaaattaacatttttaggtttagcataaggtaattaacgaaaacccccctaa

SEQ ID NO: 82116 - DNA, 292 bp, Heterodera glycines
  misc_feature (49)..(49): n is a, c, g, or t
  Genomic contig location: Contig_ID=SeqID_17606; Location=114..405; Strand=+
  SCN-specific regions: Sequence locations=1-292
atggacctaggattccatgttggtcctgattttttagacaaaaaacccnaggtccagggtaagtctgggttaccgaaaaaccgaaattctgatttgtaaaaacggtttttcaatgaacatcgtttagagcaattcccgaatttgttcgggttccaatcccgaatgccatgcctggacctgagttttcctgacaaaaatcaaggaaaatgcattttattatgatttactagttttttcaaaaaaattttaaaaaaatcgctgaaaatttttgaaatttttttttactttttta

SEQ ID NO: 82117 - DNA, 762 bp, Heterodera glycines
  Genomic contig location: Contig_ID=SeqID_17606; Location=480..1241; Strand=-
  SCN-specific regions: Sequence locations=1-4,26-128,163-347,370 -654,687-762
atgttgctcaacgaaaaacagaaacaaaatccatcgggcgaagctgcttcttacgttgttactggtgctaatgcgatttccgtcagtgaaaatgggcaacaaaaaaaacaacaacaacagcaaatgggtaaaaaattagaaataattaaattaaattaaaatggaaaaatatgcgggaaaaagtgccagcaaaatatttaataaatctcgagtcacttctgggccaagtcttgataaatttccggactttggcattgctccgaaaaaattgtattttaatttatgtacctatataaatttatctctgacaagcattaaaaacagcgaaaatttccgcaggaaaatataatttttgggtttttaaaaaccattatcattttttgaggggggggggggaatcttttacattttttttttgaaaatctttcaaaaatttatgccactgattttgcttacaattgtcttaatttgttttttttcctcaaaattagctattcgtcacgctcgtcgagttggccttacgcccgcactggtgggcaatgtcaaaacgcgcaaatacagcagagaggtgacgggggaagaaaaaatgccacaaaaaaataattcaaaaaaaaatgccatcccccaatattttaggagcgaaatcggcgccgaatggaggaggtgaagaaggaggaggaggaaagcgaaatggacaacaatttaaatgataaaaatgagaaatgaattgttttttgttttttgaaatttatttataataaa

SEQ ID NO: 82118 - DNA, 157 bp, Heterodera glycines
  Genomic contig location: Contig_ID=SeqID_17606; Location=1944..2100; Strand=+
  SCN-specific regions: Sequence locations=1-157
atgtctatggcaataaccaaatgtgctggtcaagcggcagtcgatagcacgggagctgttccgccagcgccgctttgctgcaacaaaattggatggaaatggttcattaatacggtatcacgaatatacagtaacccacacgatgcgattagttaca

SEQ ID NO: 82119 - DNA, 935 bp, Heterodera glycines
  Genomic contig location: Contig_ID=SeqID_17609; Location=2234..3168; Strand=+
  SCN-specific regions: Sequence locations=1-235,258-298,321-676,699 -886,908-935
atgactttttcaaccaatttcatcattgtccttggcaccctcgtccacttaagaaaaaagatattcggcaattatttaaaaaatgaactattctggagtcggagccctcactgttccattccaaagttgacaagcgtcttgttgtatatggacgttgatgagcttgatatggcgtcaaagttggtaaaatcgcagaaaatttgcaattcatttcaggaaggttgccgtccggaccaacaaaaatactccaaataatccgaaatcacgtcgtcattaagccaattgtcaggctgttcattttttatttgaaaataatttataaggaattttcttgtacctttaagcatatgcgggtgtcgttgagtattccgttgcgtacccaccatttatctttgtagcatttacaatgaagttcttcattttgcaaaaaaagaaggcttcgctagcattagggatgtgcgagaagtgatttttgccgggaaccgagaccgagaattgaccccgggaaacgatacgagaaccgagacccaaaaaacccgagaaatttctcgactcggcaatcgagaacttttacgagatacgtcgggtttttcctttgcaccagttcgttgaatgataagcagccctaaaaattctaaccagaaaatcataattgttttcaaattcgtttttagacacctttttgtattttaaagtgttgatgttacatggaaatttaatgggctttattacactcaatggcacattaactattgtggttttttttttgaaacgtaggataaataatgatttatccttattttattgttttttgcaacgattgtttttcgcgttaatttaaaatatttttgatccttcattttaattttcctttttattgttgtcttagtgttctctcaagttttttatatattttgtgcttttctaaaagagta

SEQ ID NO: 82120 - DNA, 1221 bp, Heterodera glycines
  Genomic contig location: Contig_ID=SeqID_17610; Location=155..1375; Strand=+
  SCN-specific regions: Sequence locations=1-147,169-828,850-1057,1079 -1195,1218-1221
gccttcctccatgacatctctgttggccattgcaaacgctttacactcatcggaaaggactcaaaaagcggcgaattcgacgccgtgttcgaccaggacaaatggcacaatcagctgttgatgagcagcaccaatggacgaccaaccgaagaacagcaacaccaattcatggacgaattggccgcgaaattgcctcccgctggacgactttgtattccgatatcggtcagtcagaaaaacgaataaattgatcaaattaacttttgtttgtttttgtttttttcagatttcgcctgctgactggttttttgacgtgattggcatgcacaaaaaccccctcaaaaaactcactttcttctatttttccgaccaactgttcgtcgcattgtgctcgttttacgtctgttacgccgaattaatagattttctgctattctctggggaagaatatgaagtgagcgagcgtaacacgtggccacaacaaattcaacccgacaaaatcgcgtcaaaaattgcttttcagtcgaaatccgatggatttgtttgtggatcaaattgaaattcatttgctggttttgtcgtgtgagtttctttgttcgcgaagtgttcaaaaagcatttaccattgcgtcgcttaatctgtttttgcttgttagatcactgtcaattgggttgccttcgcttctatcttctgctggtgttgctgtgctgagtactccttcagattgctgctccattggacggacttttggacttgcgtcaacttccaagcggatcacacaaatgtgccgttgatcaatttcgtgagtttttttgccatttggttctccctttgccaattttaaacttttttaaggtgttcagcatcagcatggtgtgtttgtacgtcttcgagatttttcttcaagatgcggaatgatgtcgccacggaatgtgccatcgagtgaacataagcagagacgaatggaacgatgctgatgccaacaaaacataaccaatgcgatgaaacaataatgtgatggatgatatatgatatatcagattacctatatgttcataaactgttgtattccattatataagtagatgtatatgttatgcatggttgtataaactcactcagtattttgctgaccaattagttttggagggaatcgccacattttgggtttcacacttttcatatggcttttaattgtgatatttcagttttttattcaca

SEQ ID NO: 82121 - DNA, 1100 bp, Heterodera glycines
  Genomic contig location: Contig_ID=SeqID_17610; Location=1592..2691; Strand=-
  SCN-specific regions: Sequence locations=1-678,700-788,810-903,935 -1100
atggaaattatcaatgccaatggaaaagcattgccaatcccacaaaatccgttgccgaacaaattcatcggattcagaagcattttgatcaagtgaaaaatgaattgaatttgtaaatgttttctggcaatttttttgattttcagcttcttcgaccacaatgtgctcactttccttcgccgttttttcaccaaatgtgaaacaaaaattcacattaccactgaaaatattcgaatttctgagttctttgtgttcaccatttggccaatgttcaaggacataattcatgtgatgattttcaaccccatcacttttcgtcaaaaccgccaatttgccccgtcaatgctcaacttttgtccgtcccttcgtgttgttgcttttgatgacggcattttgcccgaatttccgcccgacgacagtgccaatgcgtcggatggccaagcggtggccaaatggctgttctcgcctaatcccgacaatttgccgaagatgcttagcattgagaatttagctgtgaaccaatggtcgacattaaagggacaaatcaaagcggtgatttgtcaaatttaattcgttcgtttttaaattgttttcttcactttttaggcattttccaatgcttcttctcctgtttcctttgtcatttttgttggctttctgtcgtcctcttctctttcttccgttgtgccattcgaactgaccaacgaatttacccaagagaaattgacactgtcacaagaatatgtcaacgtttttaagcttatccgttgttcaattgcagcaggtggtaagggaaaatggatgaaggaaatgaatgaattggtcggaggacaaaagaacaacaaaattggcattttcatcggagacgacgcaatcgacaataagtgaaaatagataatgtaaaaaatctgctaattttctcattttaaaattgtttttctttcagtcttctcggcgatttgcccggggccaggtgtgatcactgatcagaaacattaaaaaatgaatttgatgattggcttatgagattatttgatctaaatgttgggcattgttatttaaatgttgttgtatttgattttcgttcattcacaaataaa

SEQ ID NO: 82122 - DNA, 307 bp, Heterodera glycines
  Genomic contig location: Contig_ID=SeqID_17611; Location=1926..2232; Strand=+
  SCN-specific regions: Sequence locations=1-30,123-166,195-307
atgacccctggcggtacaccttttgtgctggctgttgttgctgctgttggtgttcttcgtctaattgctgttgatcatcattttgtcgatgttgttgttggtcgtcctggtgatgttgctgtgtactggttgatgtgcttggatcaacaacggtcattctgctgacacttggagttttttgtttgtttgtgtgatcaaatcgacgatggacggacgattaatcgtcacaaattaattgattaatttgttccacttcaattttagagcaattatctttattatgggaaaaagcataaaaattgcataa

SEQ ID NO: 82123 - DNA, 1887 bp, Heterodera glycines
  Genomic contig location: Contig_ID=SeqID_17612; Location=1..1887; Strand=-
  SCN-specific regions: Sequence locations=1-685,707-1034,1079 -1337,1574-1740,1763-1887
agcacttttgcagacaccgtttttgagcctggccgggacaacgcaattgttgtggagttttacgcggattggtcggtcatttgatggattcccttttcttaggcttttcccctttttcaggtgcggtcattgccgtgcttttgctccattctatcgccaattcgcttcgttggtaaagcgatggagcgatatcgtacaggtgagaattgagattaagtaaggcctgatcagaaggccattggtccatttcccgatcaaatttctccctcactttcattaggttggcgccgtgaattgtgccgacaatttcaatggtcaaatttgtcgttccaattcggttgcctattttccgatgataaaatattttcctcggtctgccaattccgtcagcgatggcattttgatggaatccgcgcattccggcacaaatcttagggaccaattggcagcgaaagtgagacggagggagaaatgggacggttaatataatacaaaaatgatgaaacatttagcttctcaatgaatacaaccgatttggctattcgaattggcccaattttcggcatttggaagtgactgtgtcagttggaggaccatttgatggttttacatctctttcactaagttcagaaacactcgttttgaggacctttggcatggcattttcccgtccgccaactttttactcataatctttgaacaatttgacgctgttggtgtccaagtgaggacaaaagcaccggcttttgctcattcgcattttagtcaattctcgacctttggcagaatcggaaacaaatcggagtgagacggacgttgtcaaattcaccgctggtgccaatgttgggtaataattgattaatcggcagggactcattagcaccaaaacagaggaaaaggccgagtgagggagagggcgtattaagcatttgcaccagagaagggatacgatggatttccgttttccgacacttttaggctcggaattccgattcccaattttttgggcgtcggaattgctttctcaacgagtgcccccccccccctctcccccctctccctctgccattttccccccattctccaacgattaatttctcctaaatttaggaatcaaaaaattcccttatgtggccatgttcaagagggacgaccaacagtccatcttcatggagcagtaagagaatgaaacggaaagggaacaatttttggacagatttcagggagccgtcactctggacgaagcgatgcagagagtgcagccaggtaagagatcgggcagacaaagagtggggaaggaaagagtgagtagaacggagagaatagaagaaaagggaagagagagagagagaaggacgagagaatagaagaaaagggaagagagagagagagaaggacgagagaatagaagaaaagggaagagagagagagagaaggacgagagaatagaagaaaagggaagagagagagagagaaggacgagagaatagaagaaaagggaagagagagagagagagagaaggacgagagaatagaagaaaagggaagagagagagagagaaggacgaaaagaaggaacggactcgacccctcccattgaagggaatttcatttctttggacactgagcagcaaaagagcacccaatcggtgcgtccccacgtcgatgtgatcgactgcgaacgttttcccgatcggtctgtcctttcctttgtctgatcacttctttcgcctttcccttcacaatttctctttcagctgtaagcaattgtattttgtgtcggaaactgatctgctgaaggcggtaattcttctgccctgtcgccccttttaccctttctcaggtgagaatggcactgcttgacgaagtgactcgaatggatgaagt

SEQ ID NO: 82124 - DNA, 384 bp, Heterodera glycines
  Genomic contig location: Contig_ID=SeqID_17614; Location=1575..1958; Strand=+
  SCN-specific regions: Sequence locations=1-42,66-229,251-287,311-384
atgaaccgacggtaaaaggattttaaaagtctaaattcagcattatttagctaaactgttttccataatttcagttggatttgcaacgacgtttggatggacattttcccatcctttgaccgtcctcaactcggcctcaaattggcacttctttcgccacgtttcaatgcgttggtggacaaacatttcaatggcaaaagcgaattgccaatttggagatcaatcgaaattcacaagggcaaaggaccagaaccgaagctgtttgtacaaattggtgacaaatataacaaatttatggaatttccattgcccgaccgtccgttgcccagcaaaatccgttttaaatggcttcggattaagtaatttaaaatcagagttatggca

SEQ ID NO: 82125 - DNA, 103 bp, Heterodera glycines; identical to SEQ ID NO: 81019
  Genomic contig location: Contig_ID=SeqID_17614; Location=431..533; Strand=-
  SCN-specific regions: Sequence locations=1-82

SEQ ID NO: 82126 - DNA, 263 bp, Heterodera glycines
  Genomic contig location: Contig_ID=SeqID_17615; Location=739..1001; Strand=+
  SCN-specific regions: Sequence locations=1-232,259-263
atgtcccaagaggaattgctgctgtcgttccaagatgaaactgctctggactggttcgttcggcttgcccatccgtcgttgtcctttcgttctggccatgccgaattggacgcactaaatgccattgtcccgggcgaactggtcgaaattgttgggcgggaatcatccggcaaattgcaggtggaaaatgaatcaaatcgctgaaatgccatagatggtggacctctttttgaaaaaaaaaatttttttttaatttttcgcga

SEQ ID NO: 82127 - DNA, 661 bp, Heterodera glycines
  Genomic contig location: Contig_ID=SeqID_17616; Location=468..1128; Strand=-
  SCN-specific regions: Sequence locations=1-20,42-90,141-145,197 -209,232-470,493-661
atggccaaggatagtaaaaacaaagttgccaaaatgaaagaaatgataagtgaattaaaggaaggaaaagatttcttcttatttgtgagctaattaataaaaattaattgaaataggatttaaattattgtatattattaggaggtttttaatttttagaaaaaattattttttttcaaaaaatttaaaaaaatttgtttagaattcataatggtaaaataatgtttgttttcaataatatttttatcattgataccaaaatatggtttttcgcattggatattcttttttttaattttcaagtgccaacttggctaaatcaatcactcttttttacagtcagctgatcagactgatgatcagccgatgtttttgtgggaggatgggccctccgacgtttctctgttccgcgcactgaaaatttgcgtaagcgaagtggcggatgagtacgaccaaaaatttgtcgacataaaattggacgcccttttccaactcgaactgacgcaatttgccaaattcattctgtgcatggacaaacatttgaaggataaaagaaaaaaagatggtgacgaaatggtggccaaattgcacttggacaaaatggccaatttattggagggagaaaatggggacgaatttggcgcatttctggtcaaaaaca

SEQ ID NO: 82128 - DNA, 121 bp, Heterodera glycines
  Genomic contig location: Contig_ID=SeqID_17617; Location=156..276; Strand=+
  SCN-specific regions: Sequence locations=1-121
atgatacgcgggaaggcaccacaaaagcgccaaagggtgcgaaaggcggcgccgcggcaacaaacgcaaatcgcccattggtatcgccggaagttcagtcccgaccaccgatcactgtccg

SEQ ID NO: 82129 - DNA, 1352 bp, Heterodera glycines
  Genomic contig location: Contig_ID=SeqID_17618; Location=395..1746; Strand=+
  SCN-specific regions: Sequence locations=1-198,225-472,526-772,796 -836,906-976,1005-1189,1215-1228,1250-1352
atgccattcaatggccaaggcaaacaacagcaacagacaattgtaagggatacggtaaaggaaacgggaacagagatactgtacaaagaaaacgggagggaaatcagcagtcacacaaacaaaatgatatcaaatttatcaatagtcataataattttcccatttcgtgtacagtccgtcacccgtcccgcggccggcgctgctccaccgccgccgccgcatgtgatccggacgacagtgcgcgatcggctcaacgccgggccgttcttgcaaaacggggataacggcccgcggatcgcccatgtggccaatgcggcggcagtgctcaaaacgaccgaaaggggcgaagagagcgaaacggggcgcgatttgagtgccgaatttcacaaattggagaggtaagtgacgaaaaagaaactaattatcacttaatattggcttagactgttaaaatcggctgaagattatttggacgaaacggaaccgaacgaagcgaaacgaacggcgaaagaagaaggaaggaaagggacggcggtggggagggaagtgccgtcgtggacggagggacacccccaaggtaaaatgggcaacaaatcccgaaaatgaaacaccgattcaggcgagggcttctcccccctgcgcataaatccgcttcgaaggccgtttatggaggacccaagccgaccccacgcgattttttactcaaccgaaaaaatgccgcggccgaaaagtggggacaacgaaaggtgagaagggatttaagatagaagggtttttattttttaaaatttaaatgccagaaatggagaagaattttatcaacggcgaatccgacgaaacgaaagcgaagaaagaaaagggaaaaaggagaagaaaatgaataaatgagagaagaaagggagggacggagggaggacaaatcaaattgttggattaagaggacaattaaagacaaaccaaaataattttattgctcaaaaattaataataattgttaaaaatatgcaaaaatatatgtttttattggcaatttcatttttcaccacttttcttcgtttttttcgcgtgccatccttcgctttccgattacaatttgtccgaaaatgtctgcgattccgttgcctttcttttccacttccattcgcttgacccaatttcgccgtcaccaaagtgtttatcgatcaaaatcccttcctcccctccccatttctgtccaatttgtaaatgttttttcactttttaaattggctggcagcaggccaaccttggcatttggttttgtcggttgtgttgcattttcttggcattttcactggcctttggatttggtatatctttccaaaagaggtaaa

SEQ ID NO: 82130 - DNA, 506 bp, Heterodera glycines
  Genomic contig location: Contig_ID=SeqID_25; Location=1561..2066; Strand=+
  SCN-specific regions: Sequence locations=1-75,97-460,483-506
atggggctgttagttttcgacagtggtgatatcgacagtgttggtttcgacagttattgatttcgacagtaaagcttatttttaaaaaatttgttccatattgcataagtctcgtaaatttgacaattaaaatgataagaacatggctcttatacattgcagaggggttcgagattttccaatttgtaatggctgatcaaaatagctgtggtagctcaaagtgctgtgggagcaaaagcaacaggggccaaaatgaaggaaagatgactccaaacaacagtcaaccctccagtggtggatgtggtctagtggctaagacaacgggtccacgtaaggggccccgagcagcggttcaaatccggccttccactccaatttttcgcctaaataatatggttacacttggcggacaccccaggtcgtttggtcttcacaccactcgacactccagaaacaacagctggcaatggggcaaaagaaccggaggcgcgccgatccttgcatag

SEQ ID NO: 82131 - DNA, 416 bp, Heterodera glycines
  Genomic contig location: Contig_ID=SeqID_26; Location=6427..6842; Strand=+
  SCN-specific regions: Sequence locations=1-73,100-372,395-416
atgccgttgagaatcggcttctgcatcggcggcttgtgcgccgacaaaaaaagagtgagttttttcccatcccaaaataaataaataaataatttttttcaagaccagaaaacgcttcagtctctctgacgccagggtgcgcaggcgaccccattggtcatggccgccaaccgcccctttgtgtcgcctttggctgggacttcgcaggccgacgtgattgttttttttctcaacattaaatttcagcccaatgtgcagcaccgggtgaaatttgcgcaagatgagctcgtgtactatgtgccggcaggctgaacgaattgtctgagggctaaagagagttagaataggatgatttaattttttaaatcgatctttttatttttaataatttttacatttaacttttgtaaagttta

SEQ ID NO: 82132 - DNA, 307 bp, Heterodera glycines
  Genomic contig location: Contig_ID=SeqID_26; Location=7305..7611; Strand=+
  SCN-specific regions: Sequence locations=1-307
atggagctaaacgaattatcgtcctggtacgacattctgcaggatgatgaggacaatgtaaaaatgttttttcatttttcattttcaaaaattattattccagattttaaattggttcacaccggtgacggctcgcgacgtttgccaggaggtgttagcaattgcacaagagcgctgcatgccgtttgaaaagattgttaaatggaagcaaattttggacaaaatttgtgctcagatcgcccaaaaaaaagtgatcattttgtgaggaattcattttaaacgtatgcgcttttttcacactgttaaa

SEQ ID NO: 82133 - DNA, 737 bp, Heterodera glycines
  Genomic contig location: Contig_ID=SeqID_26; Location=7892..8628; Strand=+
  SCN-specific regions: Sequence locations=1-737
atggcaattaatatttgcgacaagaaagcgcttgtgaatcaaatcctcgggcaagcggacattacagtgacaacaagcggcataaccgtgagtgggccacgtctgtccacaccacggtttattccgttcgatgaatgcggccgttgccgcgcatgtaaagcaacagaggttgagatggacacaatggtgaccaaagaggggatcacattgtggtgcagccgggtcagcaagtcccaattcgtcccatttgatgccgtttatgatctacctggtcactgcttcttccgtgtgaaaaacaaggccagggtgttcaacgtgccctacggtgacttgccctccgacacgtgcaccactcccaccactacaacacaaggaacgcaaaccaatatgcagcaggacctgaagcgcaaagctaaggtagcacttgatttagtggaagccgggctaatggccgataccatgcaggacggcgtgcgttggaagaaggccaaaaccgcattcagtgtactcgggaacctacttttagcggaatcgttggacaacaaagtgacaaacagtcctgtggaggaacagaattatgtccaggaagagcccagacgagacgaagaggaaaacaaggaggaccttggcgacattgacaaaacgcttgacgagttttttgctagtattaaagcttcgacctcaaacatgtaaatcattttgtccccaaaaaatgcttaatacacaatcctttacca

SEQ ID NO: 82134 - DNA, 338 bp, Heterodera glycines
  Genomic contig location: Contig_ID=SeqID_26; Location=9612..9949; Strand=+
  SCN-specific regions: Sequence locations=1-338
atgagcggaaagtatttagttttcaaagtgctggtcattatctctacaattaaagtgattgttgataaatgcgtggattattacggcagttccaagcattgggaaaagttgggcaattcggcaaatgacccattttactttaattgatgtttcttttttcacagattagtcagatgcgaactttccgacccggcaaatcaatccgaaatcattggttacacagtttataacatactgattattgaggttgctgaatttttgtgctacgcaatgctttggctgatcagttggtggaatcagtgtcagtgaatgatcatattaattcataggcacaaaaa

SEQ ID NO: 82135 - DNA, 861 bp, Heterodera glycines
  Genomic contig location: Contig_ID=SeqID_319; Location=1212..2072; Strand=-
  SCN-specific regions: Sequence locations=1-96,118-203,226-331,353 -364,387-861
atgttcttcgccctggacgaagaccgattgccgatggcgtccacaagcatggcggtgtacccaaaaattgcacattggagcatgtattacgtgaaggaacgctaccggggacaccaattgggccgtgcgctcactcgacgagccatggaaatggctggggatagacacattttcggttacggaggtggggaagcagcgcattattttttaattggcaatgcttgagactctcggtctcgactcgagaaaactctcgggtttaagatttatgaatttttgggcccggcggtgccgattggcgcttcatcgaaaaaattaagattgcgatagatttttgtttttcttcgatattttggtcacaaatattttaaagtgtattaaatttttctgatacagtcaaatgctcgagactctctgtctcgacttgagaaaactcttctctcggggttttttttccgctcatttcaactcgagattgagcataattagtcaaaaataggaaaacatatcgtactattattttctccttaagaaaaattacatttcgacaaatttggttttgcttgtattccgttgagagaacccgctttagttgctgaaatgtgggccaaatacgcggaggagtacggcatgtgccatttcttggactggcagctgtggtcactgctcgccaaaagtgccgacgtgcgacccgagcggctggacaacgactcgagtgtggtgctgaaggattggcaagaagtgcccttccagacactgttgaatttcgacgttcaacagacggcgggcatcgaccggtcgatgtatttgcgagaggcactgcgacttcccgaatctgtggcgaaggtgtgccatcattga

SEQ ID NO: 82136 - DNA, 369 bp, Heterodera glycines
  Genomic contig location: Contig_ID=SeqID_320; Location=2400..2768; Strand=+
  SCN-specific regions: Sequence locations=1-132,154-239,262-369
atgtggcgaaaagcgtttgggcccaacaatttcggcatgttcttcgccctggacgaagaccgagtgccgatggcgtccacaagcatggcggtgtacccaaaaattgcacattggagcatgtattacgtgaaggaacgctaccggggacaccaattgggccgtgcgctcactcgacgagccatggaaatggctggggacagactcattttcggttacggaggtggggaagcagcgcattattttttaattggcaatgcttgagactctcggtctcgactcgagaaaactctcgggtttaagatttatgaatttttgggcccggcggtgccgattggcgcttcatcgaaaaaattaagatttttgcgatag

SEQ ID NO: 82137 - DNA, 381 bp, Heterodera glycines
  Genomic contig location: Contig_ID=SeqID_320; Location=3622..4002; Strand=+
  SCN-specific regions: Sequence locations=1-381
atgttcaattggttcagtcggtcgcctcctctcttctccgtgccgtactgctccaatttgccggccccgacccgtccgccaagttcgactcgctgctctacaaaacaccgtcgaccaacgccgagtcctgcgcatcctccgccaactcatccaaaatgggcccgtgcagcggcatatactcactccgcagttcacgcgccattctctgcctttccccggccagcgcattttttcgatcagcgacgaacacgtgtcgctgatctgagcagcaagcagcagcagcgagtggacgaatttagtgctgggcaaaacagtggaatggcacaaaacgatggaaataatgccaacgaattaatggacaatttaaagctagcagccaat

SEQ ID NO: 82138 - DNA, 1166 bp, Heterodera glycines
  Genomic contig location: Contig_ID=SeqID_321; Location=280..1445; Strand=+
  SCN-specific regions: Sequence locations=1-550,572-1166
atgtgggccaaatacgcggaggagtacggcatgtgccatttcttggactggcagctgtggtcactgcttgccaaaagtgccgacgtgcgacccgagcggctggacaacgattcgagtgtggtgctgaaggattggcaagaagtgcccttccagaaactgttgaatttcgacgttcaacagacggcgggcatcgaccggtcgatgtatttgcgagaggcactgcgacttcccgaatctgtggcgaaggtgtgccatcattgatgccaaattctctctatcatttcaatgccaaattccttcaaaggttgtcatatccaaagagacgggcgaagttatcggcatgtgtcaggcacggcatctgatgcgccgaaggattggcatcagtctgttctatgccgaaagatcggtcagtgtgtgaaatttcaacaattttcattatctaattgttgtgctaataatgcctcgaaagtgccttaatagctaatgatgcattactgccttaggcaatagcattacctataattagctaattagttcatacgcacatttgcccaattttcccttttttctctgctaaaacatatgttcaattggttcagtcggtcgcctcctctcttctccgtgccgtactgctccaatttgccggccccgacccgtccgccaagttcgactcgctgctctacaaaacaccgtcgaccaacgccgagtccttgcgcatcctccgccaactcatccaaaatgggcccgtgcagcggcatatactcactccgcagttcacgcaccattctctgcctttccccggccagcgcattttttcgatcagcgacgaacacgtgtcgctgatctgagcagcaagcagcagcagcagcagcgagtggacgaatttagtgctgggcaaaacagtggaatggcacaaaacgatggaaataatgccaacgaattaatggacaatttaaagctagcagccaatgtatttaaaaaagtgccgattatatttatccgtatttattttttgactgttatgccattgtatatatatgtatgatcataaagtttaaagcaaaagcaatgaatttaaaagaaatgcgcagtttaattggatagcttaaaattaaaaaagttgctatttttatattcggatattagcaatctttttaaaatagtca

SEQ ID NO: 82139 - DNA, 1219 bp, Heterodera glycines
  Genomic contig location: Contig_ID=SeqID_321; Location=2143..3361; Strand=-
  SCN-specific regions: Sequence locations=1-551,573-579,605-776,806 -1219
atgcacattctcaagtccctcactgtcatcattgtgttcgtcatgttcggctggactctgaacggactgagcaccttttatatgccacttttgaagctgtcgccggaggacagcatcagttttgccgctgggcttgttcagatgactctcgtcgcatcggccagcaatacacccgttctctatgtgttcaggtgggaaaatgtgcccaggagtgtaataatttaaaccaaaaaaatatgacagcgaaattcgggattggtcataattagagctcgacctggacctggatacaggcctgaatttttcctgggtccaggtccaggacatttttcggcaacctgggtttttcatggacctggatttttgtccagaaaatccaggtccaggtctaatgtgaaaaaaaaatccaggtccaggcaaaacacgaaaaaacctggatttcctggacaaaattttagaatttattatttcaaatgactgatgttttttttcaagttttcaaaaaatgattaaatagatttaaaaacagattattattgtaaattacctatatatttttaaatgttcccatttgtttgcttttaaaacaaatttcaaaaaatccagggccaggcttggatccagaggtctagaagagccttgatttttctggatttttgtccaggaaatccatgttcaggtccaggccatttttcaaaatgtcgagctctagtcgtaacgttatccaaaacgaaagcgggggcgggggaggattcgactttcgccaaaaacctcatttttacttgccaattcccaaaattttaaaaagttcagcgctgaatatcgtcattgcttccaaaaagcctttccttggctcgccaaacagcaaaatgccgtttctaacgttgttttcgttggtgcttcggcatcgaacttgacacgtcgaagaggccaacaaggacaagcagcagctgatcaacaacaacaacaacagcagcagcgcagtttgccaattgtcagtcggacattgtgactcacaaatcagcagagagagggacaaactaaccatgcattacaactcgaaataattcgaatttcaacagtgatctttgtagtttgacccaagctaccattgttttaaactaaaattgctgaatccgtagtgcgagatttgcggaccgacatttgtggcttaactgtcgaaaaaaagaaaagaaagacgactgcatttctcaataaa

SEQ ID NO: 82140 - DNA, 339 bp, Heterodera glycines
  Genomic contig location: Contig_ID=SeqID_321; Location=4196..4534; Strand=-
  SCN-specific regions: Sequence locations=1-339
atgaagcgaacaaacgcaacaaacatcactccgcctcgcgccaaacgttcaatggcacctgcacaggacctggacccaaacactgttgcactcacagaacaagaacgacaccgcacactggttttccttggccttccggaaagcgctgctgctcttccatcggaacgtgtacaggaggataggaaagtggccaccaaaattctggaccatcttgatgttgaggctgagccaaccgccgtttttcgcctcggccgctacgaccctcagcgcacaacaccgcgcccgctcaaggtggtcatgcctacaccgacacatggcactcggaggctggaagcgtga

SEQ ID NO: 82141 - DNA, 58 bp, Heterodera glycines
  Genomic contig location: Contig_ID=SeqID_321; Location=3625..3682; Strand=-
  SCN-specific regions: Sequence locations=1-9,32-58
ggattgctggggtcgtgggttcgattcccaccgggcgagttaccttttatgttctaca

SEQ ID NO: 82142 - DNA, 349 bp, Heterodera glycines
  Genomic contig location: Contig_ID=SeqID_322; Location=343..691; Strand=-
  SCN-specific regions: Sequence locations=1-349
atggcccgtctgttcgtccgccctgcgctgaccaaagaacagctcaagaagaaatacgaagagcgcgtccgaaaacgtcaactgacaccaactccaatggcaccggcaagctcacagacaaatgccccgactcccgttgtcgaagatggacctaaccagaaggaggccagcgacgatatttcccaaccgccggaagttttcgataaaacaatcctcgtctgttatgaaacattaatttcattgccaccaaccgacaaaattgttcaccaaattcaatcgctcaaaaaacaataccctcatcttttcaataaatagttcaaccagacctccaacaatttcttcaaataaa

SEQ ID NO: 82143 - DNA, 1234 bp, Heterodera glycines
  Genomic contig location: Contig_ID=SeqID_2880; Location=619..1852; Strand=-
  SCN-specific regions: Sequence locations=1-7,29-97,119-204,237 -529,569-686,709-912,942-1234
atgctggagaatcaaattgaatctttaaaattttcaattttcttcttattcatctcattttttatatttaccatgcctcggggctgtagtgccaacttcagcagcaacaacaaaaacatcagcaacagacgggtgccggcacttcaatttttggaaacattgcttaaattgaaggatgtcagagttgaggttgtgaagaattggaaaaaaagaaaaaattttaaaattttaattttcagttagccgatttttctggcgatgatcacaacaacaacctagtttcatttcaaagaggtgaatatgactgcactttactaattatacctacatatgtgtataaacaaaattcttttttaagctaaaaataatttttagaattcaaactagacctggatccaggctggattttgcctggatccaggtccaggtcaaatatgaaaacaatccaagtaaggcacaaaaaacctgggttttctggataaatttagaatttgttatttcgtatgacctttttttatttcaagttatcaaaaaaaaatgattaaaaattttaaaatatattaatatagtcaatttggtgcttttagacttcctaagcaattactaatgattttcactcattttttttggtaaatacagtatattttgcacagcaccgtattcgtctttttgtaatacaaaaaaaagcataaatattttgacagcagatgatgacgatgccctgctgattccgggccgacgtggtggcgccgaaacgcaccatcgtcacaacaattttgcaatggctgtgacgaagccgaaagctgtgcggactgaattggcagcgacgagcgccgcaaagcggatgagcggcgctgagacggcactgatggaagcgaatttgcagagggcacttcgaatcagtaacaaaacaattaattaaattcaaaattttttttttacgcctaggagctgttgaggctcgtatgggaaaatttgggcacaatttaatggtttaaaaaagaaaaaccaatttaaaatacttttaaaaaatagaaaccaataattaaaagcatgataaattttgatcaaattttcgggatgtaaagtttttaatgaattgtccttttcaagtgcaaaagcatacaaaagtataaaaaaatgattcatgcacttgaaatttgaaacgcggtgcttcttcaatttcagagagcagcctgttgaagacgacaaaaaatttatgctttttaataaa

SEQ ID NO: 82144 - DNA, 566 bp, Heterodera glycines
  Genomic contig location: Contig_ID=SeqID_2880; Location=3597..4162; Strand=+
  SCN-specific regions: Sequence locations=1-170,299-365,417-450,506-566
atgcctttcgcttgctcattttatgtgtttgttactgctccattgaataagcagcagctaatggacaagtgcagtgaatttttttatcaaagcattgaacacaaaaaaaaaagaaaagaagcaaaattgtcactataaaatggacagacactttgacaaggaataaagagaaaaatttttaaatgctaatttaaatatgaaaaaataataattgattcatttaaaatgaaaacatttaattaatatttaatttcagtctctataatttatgaaataattgattaataaaaaaaaatttgtaagaaaaattgttactacttattaaaatgggcacaaacacttcgacaatgaatacagaaaaaaggtttaaaatgatataatttaaatatgaaaaaaatgtttgaattatttaaaaagaaaaacatcagccataatttaattttggtctccataatttatgaaattattatatttaaaaatattttgtaaaaaaattgtttaaaatgaaaacaccaatcaaaatacctagattttgatttacataatttatgaaattattttattta

SEQ ID NO: 82145 - DNA, 825 bp, Heterodera glycines
  Genomic contig location: Contig_ID=SeqID_2880; Location=5626..6450; Strand=+
  SCN-specific regions: Sequence locations=1-40,62-94,123-429,454 -519,542-751,794-825
atgatgtccggacaggaaacttttgacatgatgatgtcaactagtctcacatttttcataatcgagtcaaactttaaaatccgtgaaaatgcggtaaaattaaaatttaagtttaaaattttggagttttcgggtaattttttgattttggttttcatttatcttactaatttattgtttgtttttttaacagtacaagacaaaccttctcctaataattagcccttaaattgttcatttatatatcgcctcttagtacaataactctttgttaaaaaaacgagtgaaatttaaaatttatcattcatccatttttcattaaatttcgggtgaatttttctttgttgcaaatctcattgttttttagccattaattgatccatttctcgccctcttattgtcttcttccaccacttttttcccaagcttcagtgcaaataaataaataaatcagattaggaaaagtactgctggaattggaccaatttgtttcccctgaaggctcattttgccctgcggataaataaatttattgggttttaatggacaaattgtctttgcccatccatccaaagtccaaacttaccatcaactcagcagggatattttaggttttttttcgaatttctatgaaatgttgctgtttcatttttaagaatcaaagtgtttcacagtttgtccaattttgtttgccctctaaacatgaaacatttgcataatttggccaattcttgggaaatcctcgccgttgatttaattatatcattttataaaaattcataatttattatttcagtagacggaaaattgatcgtttattttcca

SEQ ID NO: 82146 - DNA, 633 bp, Heterodera glycines
  Genomic contig location: Contig_ID=SeqID_17619; Location=32..664; Strand=+
  SCN-specific regions: Sequence locations=1-633
atggactccgatgccgacgaagccgccgaattcgttttcttcgcaaatttggagtctttgcctgtgtctgccgaagaagttgctttgtgtaccgcagatgaagaactgctacaacaagtaattgggtatgttcgttcgggctggccaagcaaatgtcctgccaacgatttactgtcgtttttccaaaaacgtaacaccctctcggttgtgggtggttcccttttatcaggaaacagagtcgttgtgccggcatcacttcgcaaacgtgttctgactgctttacattttgctcatcctggaattgtccgcatgaaagctttggctcgtcaacatgtctattggcccggcctggacaatgacatcgaaatgttggtgaagcattgtaccgactgtcagtccgcggcaaaactcccgaaaaaagctccattgtgtccatggccgacttctaatcaaatttttggtagagtccacattgatttcgcaggtccatgccccgacggcaaaacgtatctgattcttgtcgattcgttgtcaaaatggccggaaatcactgagatgcactccaccacggccttacacacaattacggcactaaatcgcatttttcacagatatggttttccatatgtactt

SEQ ID NO: 82147 - DNA, 841 bp, Heterodera glycines
  Genomic contig location: Contig_ID=SeqID_17620; Location=240..1080; Strand=+
  SCN-specific regions: Sequence locations=1-101,123-841
atgtcgcgaccactccggtgccaaccttgccaattcaaccaacgcctcgtcctcagagacaacgccgccccccaatacgttattcgccgtgaggaaacaaattttaagaagggagatgttggagatggatgttgatgttggattttaattaatttgaattagcgccatacagtaacagtgatgttcctgtttgtttctccgcgccacatttccagttattattttccctccgttgttttcctcctcattcattaattatttccttcttaatttttcggttctaaattaaatctgttttgctccttccattttcgtcattcctctgactccgtcgtcatcttttatttatttattgatttcatttgtctttccacaataaatttaattctgttgttccttgcggacacaacaataataaggacggagaagaagaatacagtacccttataccgtcacagtatccccgtttttgaaaatacattatttctgaagctttttctattcccttttcagctctgatacagcaaaatgggtcactttctgcagctgaatttgaagaggcacttccgcttggctcatttataaaagatttttacggaatggcgttgcgaattgtggcactgtaacttaccaagggcattgaacaaatgcacggaacgaaaatgtgcaaaacaatggtgggtgctgtaatgatagtatacttacgacaatcgaattagttgatgggtgggtactgtaatccaaatggtggcttgatttcctgtaataacttagcttttctccgtccatgctaatgtcagccttttcgatatgcaggtggccgccctgaaaatttctctta

SEQ ID NO: 82148 - DNA, 889 bp, Heterodera glycines
  Genomic contig location: Contig_ID=SeqID_17621; Location=891..1779; Strand=-
  SCN-specific regions: Sequence locations=1-52,86-196,218-289,320 -348,370-378,401-435,457-533,555-564,586-627,649-730,752-889
atgttccaaaacattggctcaaataatctgtcaattcgttatcaggtaatccatataatttaattatataatcattatttattttgaaagctctctgaaaacattcgcattggcaaacagctaataccgccactgtttctgaatttgggcaacattttcgcggggacaatgattttattatgggacattctcaatttgccattttatatacatatattcaatttggttgcgattatcaactcaattttcggccttcttatcgaatttttcattataacgtaaacaaatgtaaaatttaaaatattaatttaatttaaaagttttaagatgccacccatttttgaagagggatttatgccaatttgtgaaccgtattggtaaaatgtttggatttaatcatttggtctataatcatcgaattggtgatgcaactgtaagatttggcacaaataatactgctccatctttggctgctgtcaatggcattgttcagcggaatttgatcagtggaaaagcattgattgataaccaaacaaaaccagaagatcattttgccatgctgaaagaagcatgggagaaggggccgatgaaatgacaaaatgcacattagcagcaaaaatacactgtgatctcccaattttacatttgtgacactaatttttttctattgcctttcaaaattcatattagaggcaactaagttgaaaccgttttttttttgctatgaaattctcaaaaaaccaaaacaaactttacaaagattttttccagtgcgtttctaaaaactgccaaaagggtttttccgacccaatgccacccattcgcgtttcttattattgaaaataagaaaaattctaatttttgacaatataacattgtaaaaaataaa

SEQ ID NO: 82149 - DNA, 1319 bp, Heterodera glycines
  Genomic contig location: Contig_ID=SeqID_17622; Location=116..1434; Strand=-
  SCN-specific regions: Sequence locations=1-5,27-33,55-59,81-105,127 -404,470-555,578-858,882-1082,1118-1162,1185-1319
atgtatgttattcgtgataagctagctacccagaaaacagcaggaaatatgttttcaggttctattaaaaataaaaatttcgtccaaaaaaggtgaatcgcaattgacttaaaaattctaattgattcggcctcgatttttcgcgattcaattctataaaagagttggaataataaaacgatttggggtaaaaacaaattgaccaaaaacgagttgcgtctttaccgtcggggacaatcgaccaaatttggcggagattcaataagattttttttcattttacacctggaaacaaaagagattctgaacaaaattaaattgtcacttttcattaattatttctattaccaaatattttgctattcattaaaattgaaataagaagttacttgtgggatagattcatttaaattgaaataattaatattgtttaaaataatttttatttgtaatattattctaaatttaagcgtggttcctgtcgttttgtcatttgtctgttcaaattttcctttgggatccaattggtgccgaatctatgcaatttttcccgtcacttttaaaaatgtatttcattggcatttacgctcgtaattttgtgccatttgtcgtggtcattgaactcatcctggccacattatttgtccgaacatatgaaaaaaatcgtggccatctgtttaccgttctgtgggcgccttttgcggtgagagtaatcacattttatttcttggtcattgaactcatcctggccacattatttgtccgaacatatgaaaaaaatcgtggccatctgtttaccgttctgtggacgccttttgcggtgagagtaatcacattttattagccaattataactaattataacgaaacaaaatttatttggtattcattcagttgaccattcccatttacatcgctttttctccatctccacaaagtgaacaaaaccaactgataacaaatctgatcacaactgtcgtccatttgctgattggaagcattgagttaggcattttctaccaattatgccgatacaattccaaaatttactcgaataatctatcaattcgttatcaggtaactaaataaatatttaataaaaaatctattttattttgtaagctatcggaaaatattcgcattggaaagcagctaattccgccgctgtcgctgaatttgggcaccattttcgcgggaacaatgattttattatgggactttcttgatttgccattttatagtcagatattcaatttggctgctattatcaattcaattttcggcctccttatcgaacttttcattataacgtaaataaa

SEQ ID NO: 82150 - DNA, 248 bp, Heterodera glycines
  Genomic contig location: Contig_ID=SeqID_17624; Location=1..248; Strand=+
  SCN-specific regions: Sequence locations=1-248
gcttaaaaattagcgcaggacaaaaaaatcggtgggtgtgtgtgtgtttttacatttatgctaattttttccaacttttagcaaaacggcaacttgacgcattaattactcattttatgcggtaaaaaaaaggaaaggaggaagaggaggaggagaggaacaaccaagcaacaacaacaacatttaactcataaaaatacattttttgatcacaccattcattcatttacattttcatttcaaaaaat

SEQ ID NO: 82151 - DNA, 831 bp, Heterodera glycines
  Genomic contig location: Contig_ID=SeqID_17626; Location=2085..2915; Strand=+
  SCN-specific regions: Sequence locations=1-72,94-98,119-377,413 -481,503-566,589-761,783-831
atggctcagttggtaatgcttctgatagacactgttgagcgctttcttcggttcgagcccgtttgcacgcgcaattttttattttattaatttgaaaatatttttatttttatttttaacattggttttttaaaattcagataaaaaatgtaaatttccataaaatataacaatgaatataatatactttttttttcctttccaattcacacgtttaaaattttatatcctcaaactaccgtagctcgttttcaaaaatactgtattacggccgaactttccctggcgcatttttctgatcacaaaaaaaagcttaaatattaatagagggatcaaaaatgtgtccttttataaaaaagaaacttggacatgttgcctattttttaaaattttattttttttttcaaaatttcttacagtattttttcctgtactctcacagattgccgtgttcatcgactacctgctcaccttcacgctgctctgtcctgtcgtcgttctgctctcctcccaccagtgttccgctgttgtcgttgctgatgaccagcagaagcatccgccgcttcttctcaccgccgccgcttctccgcctgttgtgccgtcatccgccggcgatgccgaagccaccggcaaaatgccaccatccaccgctgcgcttccgtgccgtcccgtcgtgttcatgccgtcatcgccgcggtcgtcgccgcttcatccgacgcctccgccatgggtgcaccgctatgcgcgcttcctgcactcggcacagggccggctggcggcactgtgtgtggccgcgctgatgtacgcggtcggcacaagcggagtgctcag

SEQ ID NO: 82152 - DNA, 650 bp, Heterodera glycines
  Genomic contig location: Contig_ID=SeqID_17627; Location=1073..1722; Strand=+
  SCN-specific regions: Sequence locations=1-465,488-650
atgaccatgcacacttgcgccttccccgcctttttgttgctggagggaagcgaaggtgcgtattcgacgccatttaacacagcctaagggaacattgaagttaaatggcaatgatttcgctgtttccttccctcactttccaaaggtatcgccggttgttgtgcggacccgactcagcacaagaaaaatccggattcttccagcgatggcgggcgcactgctccatcagcacggagaccgggtttttgcctgaatttcggggttttcaattcgtttaaatagcagcggaatttgctgtcgaccggcagagtcgagaacactttcccgagtcggcgcccgctcgagacaagagaaaagacctgccaaattgagggaaaaggattaatttaacaaaggcaatttgtgcaccttttctgtccgccttcacatccaatgccaacggctccaattgcccggccctttcacggccaaggccttggcccggctgccagcccatccgctgcagcaatttcaacccaattccgctgttaatctccggggctgttcgaaattggtcctgaaaagcaaaaccttcacaaatgtaaaaaaacacatttggcatttcaaaaaataactgccaatggacggagaaaaaaaattgatttagtaaa

SEQ ID NO: 82153 - DNA, 1795 bp, Heterodera glycines
  Genomic contig location: Contig_ID=SeqID_17627; Location=1481..3275; Strand=-
  SCN-specific regions: Sequence locations=1-383,406-451,474-1173,1196 -1305,1327-1716,1739-1795
cccgctttgccgccagccaccaaattagcgttcgtcccttccgactctggcacaccgatggtattgccaacgaccaaaaatccggcacaaaccgatcagaggacgacaaatggtcaacagagcaatgagacgatgaaggaaacgacggggggccatggaaaggactttttggaccgatttaatacttttgtcgaggcacaggtccttttgttttttggggtgaaaatgcctcaggcgaattgctttgttaaggtcgcccgtcagaaggccgagtcggcactgcaggcgaccattctgtcaacggctgttcagcagcacggcccctccggcggggaattggccaccttttcgagcagttcggccttctccgctcgtccttcctccgccgttttctctttggcctcctctcggcccgaccccattgggctgacgaaggcactctttttctcccaaaatattaattaattaattttgtacttaagcctcaaaagagtgttcaagaattggtcgcggaacggttgcgctacaatcagcgattgcaacgtgacccaaatgattacgaggcgagaaaagcgttggcacgggtggacaaggaagtgagtttcactaccgaggaatgccttgacaatggcattcattcactcccatttcagatgaattcgtgggcccaggacagctcattgcccggcgaatttactggccatactggtgctcgtgtgctcagcgagaaggaattggaaccgtctgacccgcgttttcacgcctgggccaaaaaggtgggcggacagtcgcttttgctttggccgttttaatcttcagtttgagatcacaatgtgcttggacctgggttatttgttgatggtagtgatgctcgtgaattttgagtccgattttgaagttttcagtctcgggcatcgcaatcggtcgggaatttattttctggcaaaaccccagaaggtccaattccggtccaggtctatgtcgagctcagttctcacaacaaggttatattcggaattgatttggatgtccttgcggagatgaacattccttcaataaatatcattggtttttcttgaaggaatgttccgctcctttttttattcagaatttgtttccgactcttcaccaatgggaagagctgtcgccatttgcttatatttatgggacaaaatgctaaaaaaggacaaaatgtcctcttctcattaaatcttttccgagttttttcggttgggtaaaccgagaatcgaattttgtttctttttaatgcctaattatttttttgattccatttttgttagcattttctcccaccttcgatgtctctccccatgttttcctccaattatttcgaatgttgcgcgtttctttatttcttttctaacgcgcaacattcgaaacacgttcgattttataggtgccgacgaggcatttaatattcattgcaatgtttgttttaatgaatttaatttccatcttcgaaattgcggcagaatgcgtaaaagataactgccaacggcgccggaaacaaaggcaaaatttggcaattttattttactaaatcaattttttttctccgtccattggcagttattttttgaaatgccaaatgtgtttttttacatttgtgaaggttttgcttttcaggaccaatttcgaacagccccggagattaacagcggaattgggttgaaattgctgcagcggatgggctggcagccgggccaaggccttggccgtgaaagggccgggcaattggagccgttggcattggatgtgaaggcggacagaaaag

SEQ ID NO: 82154 - DNA, 611 bp, Heterodera glycines
  Genomic contig location: Contig_ID=SeqID_17628; Location=732..1342; Strand=+
  SCN-specific regions: Sequence locations=1-383,406-611
atgagagaaaaagaaaaaactttgtcctgggtcaaaacttttttcatagggtcagattttcttgaaattttgcataggcccatattttgacctcctctatcgattccctctttatttatttgcactgggagcccaaaaattggaaatcgcggttgaaattaatgactaatttgtgacttttaaaaaaattcattaccgtctgttcatttttgtggcacttagcagaatttgccttatttggaataatgtcacacagatagcaaaataagtgtactttagtcaactccccggaaaaaaatggcacaaattatatagccttgtcttggagggggtaccaccgcccggtagaatttgttaacatatttgttcacaaaaaaggttgatttttgggagattatttttaaatttttgcttttaacaacaattttcttcactaattttcactaaaatccccattcttccagagtattttttggtatccgggtacccggacctaccgggtcgggtaccgggtattggattttcaaaaaaacggacccgggtaccgggctcgggtattaaaaaaccgggcgtgcgtcccagtaaaatggaaacttcagtaccgaaaaata

SEQ ID NO: 82155 - DNA, 339 bp, Heterodera glycines
  Genomic contig location: Contig_ID=SeqID_17628; Location=2728..3066; Strand=+
  SCN-specific regions: Sequence locations=1-148,170-339
atgactcatccgacattttttactttgaaatttcgatcaaaaatttgggagggtgagagcaatttgtattttaaatataaaattcagttagtaacattttttttacgtttagctttcccatcgttttcggattcgccgtcaaacagcagacaaaattggacaaaagaatttacccgcgtaatggcacttatgcacgctcaagcaatggcacattttggattaacggatcaccaaaagggccaaatgccgattattcttacggtgttggcgatgttgtcggatgcggctttagtttggccactcggcaaattattttcaccaaaaatggacgtcgtttat

SEQ ID NO: 82156 - DNA, 690 bp, Heterodera glycines
  Genomic contig location: Contig_ID=SeqID_17629; Location=236..925; Strand=+
  SCN-specific regions: Sequence locations=1-53,76-125,213-274,316 -359,386-690
atgattttgttattcgctcaaagtgttccaataattgagggcgaaatgagtggcaaaagaacacatcaaatgtacttgccattcttggtcattagtgtatgtttttaattgtttactaattagacaaattaataataaaaattttcaacaaaaataattttttattgtattgaaaaatgaataatttaaataaaaatatatttgtatatattcagtgtatccaattggcattcacaatgattggaggaattgtgatgttctttacgctgggtagtaaaaaatttatatattttatattattataaatataaaatagatcattcttagctcaaaatctggtaacaattaggcaaataacgcccaaaaatcccacaaatttctgcggcggcgcctgtgggccactgaaaaatcttacacgtcgattgtggcattatgccggccattaatttgtcacattttttaaagaccaaatgcgtcaacaattgggcgggtattcaactggaataattctcggctatttgtttggacttctgttgccgctgttcattttcttctggtgctactccatcgtttttcgagcctacaaatttgtgaaggaaaaaaatgacgagaaaaaccggcacaacgccaagaaggacattcaaatttgatggtgtagagaatttgttaattaaatgttttctaatttta

SEQ ID NO: 82157 - DNA, 980 bp, Heterodera glycines
  Genomic contig location: Contig_ID=SeqID_17630; Location=939..1918; Strand=+
  SCN-specific regions: Sequence locations=1-100,122-301,323-688,726-980
atgagcggaagagcaagagaaataacgggggagatgattggaagatttcgaagaatgccggaagagatgaccgaaagagtaaaagtaccggagggtatgaccggaagaggaacaaaccctgaggaggtgaatggaaggaatacagaaaagccggaagagacaagaggacgaataatcagagcaaagcagcggtggttcatccgtgcccacataaaggtacggtatcaagaagggaccgatacagtaactgaaacagtatcaacaaaggatcactacagtaacagaaacgatggaatgaaggcaaattttatggtactcttatttggctatcggaactagcgaccagacgggatcgggatcttacgggattttctccggatcctgcaggatttaattcggaatcccaaccaaggagtacatcccggttgtttttttcaaaatcttcgggattaatcgggccggcatttggacgtaagcttgtactgctccaactccatgcatgaagttcgagctgtacaggtttgttgcgatcccagagaccaaatctaagaccatattcgaactcaacatacccgatttaccttgtttaattaaattcagaatttccaaaaccacttttaaaacattatgttacttggtggtcttgaaaaatgccgtttttggagaccactttcagtctcggctctccaataattcaatttttgtaattaaaattttatatttttgtgttcttatagtcctaactttgctctatttaatcactatttctctggctctgtatctcttttatttttctttaaatcagccatcaaaaataccgacctctaaaatgaccatttttacttacttaactctaactccctaaatacttttccattggtattgatctcttgccagaataatggcaacatattattgataataatggcgggtattttgaatcatgattgtgttttgttgaaattaaaaaaaaattttta

SEQ ID NO: 82158 - DNA, 759 bp, Heterodera glycines
  Genomic contig location: Contig_ID=SeqID_17632; Location=284..1042; Strand=+
  SCN-specific regions: Sequence locations=1-390,421-590,612-759
tcttctccttcttcgtccgtctctctgcttgccatcgtcgctattttctgtttgctgtgcaaatgttgcatttcggcaccgcgtaattaatctttcttactagtaattaactgtaattaataattaattgcttttcaacagatccgtgctgtcccggcagtcaaaaagtggtttcgctgatggccaattacgttggcactttcgcccattccttttccaagtcatcgctttgttcggatgcccaaagtgttgcgggcgcattgaaaggccaactgatcggctgctcgaagggcggcgacgcaactcttttggccgacatcgaagcatctcttgccactcattctgctggtaatgatggactaatggatcaaactaattgccaaattagccaataattattttatttattttaattattttgatgtttttcttcccctttttgatgagtgtgcccacagcctcggcttcgtccgtgccatgttcgccattgccgcctccgcttcttcccatgccagcaacaacaacgaatggcaggcattgagtgcccagtttggtcagcaaatcagtgaaattgactcgaaatgtgccgagtttggcattggcattgccaaagtgccatatgacggccccaagggtaaaactaataagagacaataattcattaattatgcgatctcttaaggtgatcactcccaacgaaatgtgcatggcacggacagtgtaattgccatgcctggattggccggctcacacaaacaa

SEQ ID NO: 82159 - DNA, 2329 bp, Heterodera glycines
  misc_feature (2134)..(2134): n is a, c, g, or t
  Genomic contig location: Contig_ID=SeqID_17633; Location=96..2424; Strand=-
  SCN-specific regions: Sequence locations=1-326,348-845,871-920,942 -954,977-1004,1026-1027,1056-1075,1119-1681,1736-1832,1854-2174,2213 -2329
atggttgacaacaacagcaaaacacggcttgatgttgtaaaaagcatggaaaataaaggtaaaaaaatcggcaaaaacaaaaaaatacatacatatttctcggcagttcaaatcacgccaagaaatgttgtgccattggctgacgcccacgaattggtggcattggccaattcaattcaatctgcgcgtgattttgtgaaatgtcaggcggttggaaagttggaaatgatcgctgaacagatggaatttctgcgaaaagtgtgtcgtcggacgggcggaagttcttatgacagtttcaatcaaaaaatttttgatttctcgggactcccgagttttttggggggaaatgatcgggaccagggataagtgccgaagcctaaaaaaattgtggaaaatcgggattccaatgactcaaaaattttttggcataaataattgaaaaacggttgtttgtttagcaagcgattgaagtgctgcgaaaagcgcaacatgacaatgagctgcattgtgttgaatgcaaagtgaagaaagtgccgggcaagttgagtttggcacttttgctaatcaaaatacattcataaaatagaggtccaaatttctcgaaaggcttgtcatgggcttgatccccaggcctggagctggattttttggaatttgtttaaaagaaaaaaaatgttaaaaaaaatcatttcattgctgcggaaaagctaaacatctaattaacagagataatgttttgaaacctacatatttaaccattttttggtaactcaaaaaaaaatatttgtcacttggaataatcaaactaaaatattgtccaggtttggtacatacttttccgttttcaaaattagaatttaaaaaacatcaagcacaagaggaatttctggtgaaaaattaaagcgtctctaattcattgtttttgttttgtccaaaattttggaaaatgtgtgtataaaacccctcattttttgggcggcatgcccccgtccggctggctccagttttttacaatgttttctttttctaaaaaataaataattttttcaataattgtttccttattctttttgttttcaggtctattttttgtaccaacaatgccctgttggtgctggtgccgatgacggcgaaccaccacagcaaaaatgccaagaacagcagtgccgccgccgtttcttttccctaatttcgcccgatgaatggggcggagagtgcgcgttagcgtgccgacaaatgcattttgagggcgcctatcggcttgaatttgaccaaagttggagccgagtgcaacaaaatgccacagatgaagcaacaaccaagacaaaaatgccaaattcgggcagccaaaagatgcaaattctggagcgagtcgacagactgttgcagggtgattgcaaatttttttttaattggatatttttgaaaacagcctggacctgggttctatactaggcaaaattccaagaaaattcaggtctaggaaaaacaaggcttacaggagaacattacatagttaaatatttgatgttttctgcgagaaaacatcaaattaaaaattaaaaaactgcgtgcagacggaattgaacccgcgataaattaaacctgtgtggcgcgctttaaccattgcgctatttttacacgacagcagagatgctctttaaaatcatttattcctctctttttattaagaatttataaaataaatttttatttgtgaattaataaaaaaatagcgcaacttttttttatattacttgatagaccaatccgagcctcgaattaactgtaattaattattattgtttggttaattagttaggtattttaccaaaaaataattatttgaattatctgtgtggaaacatgtcaaattaaataaaaataaatgcgtgctcgtggggctgaacccgcaatcatggatttctgtggcgcgctttaaccattgcgctatttttacacgacagcagctgatgctttctgagaacatttattttgtcggttttttttcggtagagattgtgtttttttcaaaaaatccaggttcaactttttgccattttgggtgcaaaaaaaaacattcctttaaaaaaactgaaagtagaaaaattgaaaacccattgaaagaattttncatttcttttatttgtaaaagtcgacaaaaacccgcaaattacaaattatttgttaaaaataattttttctcctttttcagcttcatccttcagcagtttaatgacggcatcaatggagttggatgggatttgaaaagcaatttgaaaaaccaaaatttgaccggaaacattttattttcaaaattaaaaataaa

SEQ ID NO: 82160 - DNA, 62 bp, Heterodera glycines
  Genomic contig location: Contig_ID=SeqID_17634; Location=133..194; Strand=-
  SCN-specific regions: Sequence locations=1-62
cagcaccaattgttcaatttgtgcactgcgactgccgagggggtcacgcgcatccaacacct

SEQ ID NO: 82161 - DNA, 2047 bp, Heterodera glycines
  Genomic contig location: Contig_ID=SeqID_2881; Location=461..2507; Strand=+
  SCN-specific regions: Sequence locations=1-89,111-1013,1037-1345,1367- 1515,1537-1728,1759-2047
atggataaagttttggatgacataaaaaatgtaaatgtttacattgatgacatattgatacattcgaacacattagaagagcatttggaaagtttggatttagtttttaatcgcctacaaaagtacggtctaaaattaaagggagataaatgcaattttcttcaaaataaatgccattacttggggcatattttgtcggaagcaggctatcaaccgtcgttgggcaataaagaggttattgataagttcccggaacctacaaatgtgaaagaggttaaacgatttttgggaatggcatcgttttttcgaaaatttattccgggttttgcctcaatcgctcaccccctcaataaattgacaagaggaaatggcacggaattcgtatggggaggagcagaaaaagccgtgatggatgaattaaaacagcatttgttgaaagcaccttgcctacgcccgccaaactacgacttggccttttacttattcaccgacgcatcagcaatcgcttatggcggggctttaatgcagactaaggataataatgagatgcatgccgttagcttttggtcccgtacactcactccaacagagagtaaattaccacccactcatggggaattagcggcaattgttcatgcgatacagaattttcgagcaattctgtatggggcagaattaatcgtactcactgaccatcgaccattaacattcctcttccaaaaagccagtacaaatccaaaattaaaccggtggctcatggctctgcaggaatttgagccgaaagtaatatacattgagggtaaagcaaataaagtggcggatgctttatcacgagtccctatcccatggaaaatgtggaaacaaaattaaaagaggatgtcccttatgtgttggcaatagaaagtagtttgaatagacaaacatttgtaaaagaaacaaaagatgatcaaattatgtcaaaagtaattgccaaaataaatgaaaactgggcagagccaatagagaaggaactggaaatatattttaaaaaccgagataaattgtatgtcgaaggcggaataattcgaaaacatccccagggccaatttgtggtaccaaagaaattaaaagttgccattttggaacaaattcacaaggctcattttggaatcgtacggggaaagtcaaaggccagaaggtatgtatggtggccaggaatgtcggaggacatcgaaaattttttgaaagaatgtgaggtgtgtcaaagaaatggcccaagcccgccccgattggatccggaacaccgttggcccgcagcaaaataccccttcgagaggctccatgccgatttggcaggtccggtttggggaacaaattttttaataatggttgactcgtattcacgctatccatttgtctttcagacaaatcaaccggtagcgcaactttgatcgcatttttccgggacatttttgccttatttgggtccccaaaaaccttaattaccgataacggcccacagtttatttcggtagaattcgaaaattttttgtgtgaggaaggggttacccatttaacctcgccaacatatcatcccgccagcaacggagaggcggagcggttcgtgcgaacctttaaagaaggaattaaaaaattgttggatgaggggagaaacctccgtattgcacaattcatccttttacaggaataccgatcctcaccatgcccaattttgaaaggaaatagtccggcacaaatgtttttgaaaagagaaatgcgcacgagtttggataaaataagaatttcccaagtggaaagagacaaaggcactcctacgggcgaccccgtgagagataaaggggctcaaaatcagcaaaggcagttgccgaaatatgagccaggagattcggtatggatgcgcgaccaacaggacaaaaagtggacgccggccatactgcttgagccaataggagagaggatgtggcgtttggagatggaagggggcggagaaagaactgcgcatgtggagcaaataaaagcgcgtcgaatggtcgccggacgagcctag

SEQ ID NO: 82162 - DNA, 834 bp, Heterodera glycines
  Genomic contig location: Contig_ID=SeqID_2882; Location=3..836; Strand=+
  SCN-specific regions: Sequence locations=1-412,434-546,582-834
atggagccggtgctcagcgatcagtcgcgctgcattgcggcgctgactgatgcgattgacgagttgtcactcaagggaaccgagcaatcggtaaacccatccacggatggaggtccagctgagttggccaaagaagcaccgatgaacccgcagggcggaggtccagcccctgagctggctaatgaggccccgttaaacccgcagggcggaggtccagcttctgagctggctaaagggcgtaccagcccagctcgttcgaccggaagagcatggcacggaaagcaacatcgacaacccgcacgcaaagccggccgtctaaactacctgatgcgccaattggagcgcgaggtcggcggcagccaaatggtccgatccccgcatccgtactgggaaaaccgccgagggaatggttatggaggaccgcgcggtgggggacgcggaggctacaatgcgtatcgcggagaccgttctgagcgcgtcggcccgtcaaacaatggacgttgaatctgtggtgtggtttggactccggaaggggggagagatgttgaatccccttttgacaaaatcatttatttaatttaatgatcaattttcacttatttattttgtacaacttttcctctctctcttcaccgatttcctctcccatcctaaccaatcgttacactttactgtaaacccaagccaagccaatttgtgtccatcccagctcactctcgactccaccccttttctcttttgctatttaaactgaattcattccttgcattattacccttttttctactcgctttgactcattcccattttactcacctttctcacttttgctaa

SEQ ID NO: 82163 - DNA, 267 bp, Heterodera glycines
  Genomic contig location: Contig_ID=SeqID_2882; Location=907..1173; Strand=-
  SCN-specific regions: Sequence locations=1-267
tgacctcattcggaactcggccaaattgtgctaattagtaattaccaaaaaatgaaccgacggtaaaagaatttcaaaagtcaaaaattcttatttgccctaatttactttcattatttcagttggatttgcaacgacgtttggatggacattttccccagttttgaccgtcctcaactcggcctcaaattggcacttctttcgccacgtttcaatgcgttggtggacaaacatttcaatggcaaaagcgaattgactatttggaga

SEQ ID NO: 82164 - DNA, 1062 bp, Heterodera glycines
  Genomic contig location: Contig_ID=SeqID_17635; Location=1404..2465; Strand=-
  SCN-specific regions: Sequence locations=1-794,817-1041
atgggtcttccaattatccaaatttatatgatcgtcgccagacagttgtcaaagcccatcactggatattttatgggattggggaaagaacacccggcatttcggaacagagtgttaataccaatagggaaaagtgtgtgcaccggagaaagttccaaagaataatcgtcgtcaatttcagctatcacaaattggtccacaaaattgcgaatgaaaaatttggacctcggctcaccaacttcagtggtaaatgtatcggaagagacagcgcttgaacaggtccacatttaaatgacacctttgggtcaccatgggctcctccattttgaaattaacgtataatctgatttttttttttgggggggggggtgatttctgccaccaattagctaatatggttaaattaaaaagataatttccagcatccgttcagttcaggcttcagaagtgatccatcaagtggccattttcggctacactgtcgtggtgttttacgcttattcctatttcacacacaaagaggagaaggaattggcaagcgccgaggaattgagagagctgagcaaaaagacgagccaggagataatgcgactgaatgtgctggttacggaattgcaggacgaaatgcgaatgccgcggagggtgggcaaccatcgaccatttgtaacaaagctaatcatcattttcaggaccgaaattggactttcccatggtctggggaaggcaaaagtgcgttgcgtgaaagcgccgtcgttaacccaatgatgccaagtgtggtgatgaccgacagtcagccgaaagaacagaaaaaagacatgaccaaatcaatctcaaggacggaagcattgaataggcttgcaaatgccaccgaaacttcatcgtaattgctcaacaagcatattgtaatttattattgatactgttgttggggcatgtgtttttagttattttctaataccagaaagtgaattcaaaatggactagttttattcccttaaaaccatgcccttactctgtttgtatgaaagcactgaaaatttcttttattatcaagacaataaa

SEQ ID NO: 82165 - DNA, 56 bp, Heterodera glycines; identical to SEQ ID NO: 58360
  Genomic contig location: Contig_ID=SeqID_17637; Location=420..475; Strand=+
  SCN-specific regions: Sequence locations=1-8

SEQ ID NO: 82166 - DNA, 204 bp, Heterodera glycines
  Genomic contig location: Contig_ID=SeqID_17637; Location=695..898; Strand=-
  SCN-specific regions: Sequence locations=1-204
ttggatttgtggcgacgtttggatggatattctgccatcttttgaacgtgctgaacttggcctcaaaattgcattgctttcttaccgttacgatgctttggtggacaaacattttgacggaaaaaaagaattgacaatttggaggacaatcaaaatttgcgacggcattggcccagaaccgaaattgtctgtacagatcgagga

SEQ ID NO: 82167 - DNA, 654 bp, Heterodera glycines
  Genomic contig location: Contig_ID=SeqID_17638; Location=320..973; Strand=-
  SCN-specific regions: Sequence locations=1-455,478-520,543-628,650-654
atggaaagcaattcttattaccgtattaatattattacttttatatttttcgttcttcccaatgtctttttccgctgttgtgagacaacagaacaattacaaatttgtgtcaaatatgagaaaacagtggcgaaacgagaaaccaaaattgcattggaagaatttcgtataaacaatcaaattaaagaaattaaaaatttgccggaaaattttcaaaatggcgagtgttttggcattttaattgagccagaggacgaggccaaagtggagaaattttcactcacatttgcaatttcagtgaaaccaatggaaaatgagtaccaaccgtcggcgaatgaaaataatgaaaaccaaccggatgatgaagacattcgaacaatggtccgaagaattcgattcaaattgtactggacaaacatggcaaaggtgtacaccgtcaatttaggcaaaattgacccacccgaattgtattttaatcgcacaattttggtggacaagaaaaatgatttggccaattaccatgccttattgtatgccaaaattcatataaatcgacaaaatatgtccaatgttttgacatataattttttgggctatgctcaccttataaaaatcaacgaagaagaagcatcctccagcagctcagaaaataaa

SEQ ID NO: 82168 - DNA, 2006 bp, Heterodera glycines
  Genomic contig location: Contig_ID=SeqID_17640; Location=218..2223; Strand=-
  SCN-specific regions: Sequence locations=1-640,675-742,764-816,839 -2006
atgacggtcaaaaagattgacccgaaaattacaaccgatgacgttaataaattcctaaaaaagcagaaaacatacacgattcacaagcccatcaggaaaagattcccgagactaaagacgataccaagtggcttccataccaattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacattgggagccaaaccgtcttcaattaattttgaaaatgcccgtgcgctctgggaaaaattatataaggatagggaatttaaaattttaaaaaagaaaaaatttaaaatcggtgatatcgttcgtattaccaaggaaaagggaaaattttcaaagggatacctcccaaactttaccgaagaattgtttaaaattgttgttgccaattcgacgacaccagattcatacaggatcgaagatttggaaggaaatttaataaaaggaatattatataaccaggaattagtgaaaatagatggatgccttacattgtgctaccctcgaacacaccgggaccagggaacggtacatcaaaattcacagtacgactccccgagactttggaattgggcacaaattggtcagtagctctctcatcaattatttacccctactcattcaccgcactcagtataaacggtcaagagtttattaaagtatgggaaaacgacagcagtgtcccgactcaagtttatttaccggacatgaattttaaaaccgccgggggcctgggaaataaaattaacgaggcattcagccatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatctcgaattccatccaaacccaactaaacacactacgagaaacaaatcctcacattttagaagagcctgatataaaaatttggtttgacaaaatggttgagatgggaaccgaaattcaaacatcccgaaatgaacttaagtcttttcaagaagaagtagataaagccaaaaacataacattggagcatgtggaaaagaatgacttgaaaaaagcaaagaaatcagccgacgtcgcaaagggaatcgccagacaggcaaagaccaaatatacatcaactctcgagggatataatgataaatcggaaaagggttttagcgggatagtgaataggcttaatgaggcgctcggtgagcatattaaacgtaaagatattgaaaatagacaagtatctgaagctgagaaaggaccacaaaaaagagagagattagccaatgaggatgttcaatttaactacgacagcattgatcaaaaatttattgtctatctttccgctgctgtctcccatatagatttgtcaaaacacctagcctatgtgctcggatttaagaatacaaggctatttcacgcggaagaggcgacttatatgccggatttgacgggaggtgtaaggcagctatacatttatgcaccaaatttaatcgaaaacacaattatcgggaaccagatggctccactcttaggaatagttaacgtcgtcgatgacccaggatcgattagtgaa

SEQ ID NO: 82169 - DNA, 596 bp, Heterodera glycines
  Genomic contig location: Contig_ID=SeqID_17642; Location=303..898; Strand=+
  SCN-specific regions: Sequence locations=1-52,74-228,271-351,373-596
atgttcaaaaaaaacaatttttgttttcgaaagggtctaaccatagaattctgaattttccgggggattttttattggtaaattgactcccataaaatggcgaccaccttttttgatgagcatcgaaaatatgcggttggaaaatcagaagaagggcatcaccgtctcgcgttttgtttctccgccgcttcgtttggtcccttcgtcctccgttcgcttttccctgtccttcttctttttcttcttctccttcttccgctttttctccttttcgcgtcctccgttctcttcggctccgccgctttttgctttcttcgcttttcgttcgacttctgttcggcaaattcacagtataacaatggtctttcattatcataattgcagataccatccaatgtcagttcgtccaatgaccgtttgacgcgctttcgctgtcggcgttcgtcggtggttttggcctcggactcaaattgtgtcgcagatgctgagtgggacagaaatgccgtcgttgtgctggtggtgctgctcgtcggttgctccggcaaatcgaagaagcgattggcgttgggaattgggcctaaagaactgtgtcctct

SEQ ID NO: 82170 - DNA, 1075 bp, Heterodera glycines
  Genomic contig location: Contig_ID=SeqID_17642; Location=2380..3454; Strand=+
  SCN-specific regions: Sequence locations=1-187,209-381,403-506,528 -529,551-1075
  Gene Ontology: Mol. function=GMP reductase activity
atgccccaaattttggatggaataaagcttgactttcgtgatgttgtgagtttatcttatccattcatttcttaatggaataaatttagttgctaatgcccaaacgttcacagctcgccagtcgttcagaagttgacttgaacagagagttagttagctatactgcaaaattacatttttttcatgccttttagatttgtttttaagaactcgaaagcgacgtacacgggaattccaataattgcatcggtgggatagctcgttccaatgttatcagttttgggctgcttttatagaacatggacacagttggcacttttgaaatggcggaaacactcagccaatccaatttgttcactactggttcgaccccttacttttaacattgtcttcttcatttttagtacacaaacattacagtgttgaggaatggaaggaatttgctaatcgcgtcagaaacaattcgaatgtacagtagtgaatcgttttattttattaagggggcaatttcacatgcatttttagcattggaaattttttgtttaaaaaatcgcattcttttctttgtattgctagataagtacatgtaaagcggattttgccttctttaatttggaaattaatttaaggtgctcaacaatatcgctatttcgtccgggtcgcgttccgatgaccttaccaaaatgcgtgacatttgcgacgccgtgcccgaaataaaattcatttgtctcgacgtggcaaacggttatagctttattttttcatcaacattcccacttttaggctattctgaaactttcgttgactttgtgcgcaaagttcgggaggaattccgcacctccacaatttttgctggcaacgttgtaagttattttttatttggcacttttttgtcccctttttgattggattcaattcgggactttgcgagaaatgatggcttttttttaggttaccaaagaaatggtggaacagctgattctgtcgggtgccgatgtggtcaaagttggcattgggccgggcagtgtgtgcaccacgcgtaaacaggtccaaccaacagcaccgtgcccaacta

SEQ ID NO: 82171 - DNA, 540 bp, Heterodera glycines
  Genomic contig location: Contig_ID=SeqID_17643; Location=1184..1723; Strand=+
  SCN-specific regions: Sequence locations=1-127,149-420,442-540
atgattgacattgaggaggaagaaccactgctagaaaagatggacaaagacggtgtaagaaaggtgccagaaaaaacgggtgcatcccaaaatctcgccaccgaaatctcgctgatacaagatcaataaaaaacttcaaaaatagaaatgcaaaattctagcgattttcgaaaattatgatgaattactaattttttcaaaactttttcagaaaaatcgctagagaaatctttacaaaaattttttcttgaaattttcttataaaaaattatcgaagattttttcttaaaattatcttacaaaaatgtttataagattttaaatttaaaattcggcggcacggttttgttgcggcaatatttcggtcggaaaaatttcgtcccatctccgaaaaactctcttggcatttttgtggaattttgaaaaattgaattttagatagaaagtcaaaagaccagccgcggcagagccaaattgccaaaagcaggacagaatggacgggtcagtatttttttttttggcattttgtattaatttcca

SEQ ID NO: 82172 - DNA, 1023 bp, Heterodera glycines
  Genomic contig location: Contig_ID=SeqID_17645; Location=135..1157; Strand=+
  SCN-specific regions: Sequence locations=1-83,106-293,316-563,586 -747,780-794,816-993,1015-1023
cattccaatcactggcactcaattctcctacattccaatcattgggactcaatccaccaacattccattcaacgggactcaacccaccagcattccaatcactgggactcaatccaccaacattccaatcactggcactcaattctcctacatttcaatcactgggactcaacccaccaacattccaatcacttggactcaaccctccagcattccaatcactgggactcaatccaccaacattccaatcattgggactcaatccaccaacattccattcaacgggactcaacccaccagcattccaatcactgggactcaatccaccaacattccaatcactggcactcaattctcctacatttcaatcactgggactcaacccaccaacattccaatcaccgggactcaaccctccagcatttcaatcactgggactcaattctcccgaattcaaatcactggactcaatctcatcaatccttcagcaacacaattaccgggactcagttctccgacatttcaatcaccggaactcaacctcagcaacggaatacagaactatttaaaaggaatccagaaattgaaatataacccataaatcaaaacactatggtgtataattattgcccccaccccataaattcaaattaaaactgacctgtttaaaactttccacctaaatttgatccgcaagtgtcacgtcaatatcccaattgcatataaatattccactcgaacacaggcaaaacataagatgtagcatttatattgctttttctatccatcaaaggctttttctttcattttttattactatcataacatgctttttattcaaaacaaatatcaaaaaccaaatcagataagtacaaaaaacttttttaagtaacaaacctttttcattcaaacaaattctaatgcatttttttaaccaaacaattctccattatcgtttacataagcaaaacaaaagctttcacatcaaaatcaaatcaattaacaaaaacataatttagacaa

SEQ ID NO: 82173 - DNA, 688 bp, Heterodera glycines
  Genomic contig location: Contig_ID=SeqID_17645; Location=1..688; Strand=-
  SCN-specific regions: Sequence locations=1-239,262-449,472-538,563-688
ttccgttgctgaggttgagttccggtgattgaaatgtcggagaactgagtcccggtaattgtgttgctgaaggattgatgagattgagtccagtgatttgaattcgggagaattgagtcccagtgattgaaatgctggagggttgagtcccggtgattggaatgttggtgggttgagtcccagtgattgaaatgtaggagaattgagtgccagtgattggaatgttggtggattgagtcccagtgattggaatgctggtgggttgagtcccgttgaatggaatgttggtggattgagtcccaatgattggaatgttggtggattgagtcccagtgattggaatgctggagggttgagtccaagtgattggaatgttggtgggttgagtcccagtgattgaaatgtaggagaattgagtgccagtgattggaatgttggtggattgagtcccagtgattggaatgctggtgggttgagtcccgttgaatggaatgttggtggattgagtcccaatgattggaatgtaggagaattgagtgccagtgattggaatgctggtggattgagtcccaatgattggaatgttggtgggtttagtcccgttgattggaatgttggtggattgagtcccgagtgattggaatgttggtggattgagtcccagtgaaatattggtgggttgagtccc

SEQ ID NO: 82174 - DNA, 3033 bp, Heterodera glycines
  Genomic contig location: Contig_ID=SeqID_2884; Location=159..3191; Strand=-
  SCN-specific regions: Sequence locations=1-999,1021-1070,1092 -1204,1226-1258,1280-1828,1850-1952,1974-2904,2926-2969,2992-3033
atgtttggaaagcgtccttcttcccatctttctcctctctcagacaacgcatcaaaaaagtccacctctgactacccatacaccgctcttagtgaccaacttgcggcaatttcccaacaaatggacaacaacagtgtcgaccccatcactaaacaacttttgaaaatttgtgtcgaacttttacagcaggttcagcaacaacagaccgtcatctccgaacaagaccttcaactccaacatttcaaacaacagaaaatgatggaagaagccattcaagaccatgagcgtcggcgaagcgtcgtcgtaatgggtctccctgaatcgcagaaacaaaagccgtccgagcgagtcgctgaggaccgaactgccatctcaggcgttctcgatgagcttggcatcgagagcccaatcactgtgtacagaatgggttccccagaccaagcaaagacaggtcaaaaccgcccgaggttgatgaaagtaattttcgggtgctccaaacatcagaaacaaaccttggcacagtggaacaaagggcgcgcgcaaatcaatcaaaaattggggatgagcaacatccgaattcgcccttcactcagccaagaggaactcaaggcccgacgtgtgctgcaagaagagtgtagcaggaaaagaaaggaagatggcggcgagtgggtggtgtacgcggacaaagtgatgctgaggtcagacattgcggcatttaaaaataacaccaattgacttgctgttttaccaaatcacactcataaaacatttataaattcgcacttttccggtcttaagcatgttagactcaataacccaataccgaaaataggggaagttaaagcctgcttagttaatattagatcactttacaacaaaattgatgaaatagctttaaatttggtaaataaaaacatagacatttttctgttaactgaaacatggacaaaggagggaaacccaatcttctttagtccatggataatcgaaaattataactttgttttttgtcatagaaaatctcaaaaattaacacgtgggggtggttgcggtgttttaattaagaaagaaattgagttttttgttaaattttctgaaacaaaatataattgcgaaatcttggtttttcaattacaaaaactaaaatcaattagatttgtgcttgtttatcgaccacccaagacaacatatagacaaaccaaggaaccttttaaatttttagaaacattctatagccataattgtgttgtgttgggtgattttaattttccgaataaagacctggtatggaaggaagggcagcccatttctatgagtaaatttggtgaaattttttgccacttttttagtaagctttcttttttcaatgccacgagtggacccaccaggggaaattcgtggttagacttagttttgccggcaaatgatcaaattgtaaagcaatgtactattgaaggtggtgttttttcatcggatcatttagcgcaaattttcacattgactattccaaaaacactacaaaaaacaaacttcttttacaatcgacggttttttccgtcgaatgtttctctttttaatattatggtttcttctagaattagcgctttatctaacgagcattttagtgtgaacgaaaaatacaacgcatttaataatacattgctagaaaccttaaacgagtgtattccaatgaaaaaaattaccaaaaaagatttgacccctaaatatccaacgcatttattggcctccatcaaagagaaagccagactgtataggcaatgtaaaactgacccaacaaaaaaagcactttatgatagcattagtttacacataaaaatacaaacaaataaatttcactcgcaaattgagaaaaaggctatttcaaagggaagaaattccatttttaaatacctacaaaaatacgatgttaacccctttgaaataccgaatttagtctttgaaaacaaatgctatcatgatggtgatgaaaaatgtgaattattagccaacttatttgcaaattcgtttaacaattctgatgttgacccaggctacctaaacttgggcaatacttttgttaatcaatgttttatatcagatatagactttaacatcatcgagacacaaaaacttttgaaaaaacttccgaataaaaacgggacctccccggataatattagctataaaatattgaaaaactgccattcttcattagcaactgttattactgacctattcaggatttcgttagactctggttctcttccagatatctggaaggaatcaatagtttttcctcttttcaaaaaaggggacaaatttaatcctgaaaattataggcctatttctataacctgctcactttgcagggttatggaaagaattcttagccaaaatatttacaactttctcctaaaaaacaataaaatttcggaataccaatttggttttgttagaaataggtctacgacaagtcaactaataacagttgtggaagattggtacgaggcaattataaatggaaaaaatgttgactgtatttatattgattttcaaaaagcatttgactcagtgccccataatttacttttatacaaattggaaaaaattggtataaagggcaaacttttaatgtggataaagggctttttgagtaataggacttttcgagttaaaattggggattctttatcctcaagtaaaaaagttacctctggcgtcccccagggctctgtcctgggccctttattatttttgatttatattaacgatcttcctgatgctttgccatcaggagtgaaaataaaattatatgctgatgatgttaaattatatatttgttataaagcaagagccgacacagaaattatgcataaagcattgcataatttattcgaatgggcaaataaatggcaaataaaagtttcaatgcaaaaaacttttgtattatatttgggttcaaaaaacccaaaagaaacatataaatttgatggaaatacaataaatgctgtggatacaattagggatttagga

SEQ ID NO: 82175 - DNA, 1553 bp, Heterodera glycines
  Genomic contig location: Contig_ID=SeqID_2885; Location=923..2475; Strand=+
  SCN-specific regions: Sequence locations=1-185,208-241,278-289,314 -404,426-452,615-772,796-1072,1094-1317,1537-1553
atgcgcgagttttgtgcacatctacaaactcttggctttcgaatgataccagggttgtttgggtccgggtccgggaagtgccctaaaaagggagctcaagcacttttggtcggtatttttcccaaaaagaaggaaaaagaaaaggaaattaaaagggtggaggcaagccagccgatggtcaagtggttactgtgcttgcttttggtggcgtggtctctgtggttcgagtcccattgtgatgtttgtttaaaggaaattaaaagggtggaggcaaggtcgagctttttgcaataaaagaaaggaaggaaaatgggcattgaaaggtgaagtggcaagcggccagatggtcaggcggttagtgtgcctgccttttatagtgggttcgggtcccactgcttcagagtaatttgaaaaaatattatatataattctactttttgttttgtttttttatttaattaactttatggaaataaaatattagttattttaaattaatgaaataagatttatttaaaaacaaatttaaaactgaatttaaaatcaaataaaataggtaaataataataaaaaaaataatataataaataaatctaaataatatttaagataaataagtatttacaagtacaagacaagcaatccggtgaacaagtggttagtatgcctttctttgttggtgtagtgtatagggttcgattcccattaattctgattatcaaactttttaattttttttttgataagtacgtttaggaaattaaaaaaaatttacataaagagtgaaataatatgttttttatgcataccgaatgaactcaaaagtaaaaatttgatccttttttggacaaaacttgtaacaaattgaaaattaatttaaactatccttggagcgcctatcatcagccagaccggactcgctcagttcagccctcacgattcggccccagcatgcttttccattataccttttttctttatcatccaaatccaacattgttggtatcatacgaaagctcttcacatgctctattagctttacaaaaaacgaaaagattttcaagcctcgaaaaaattttattaagaaaaacttcaaaatttcatttttttcgcaattttcatgtataacttctttagcaattgtctaatcataaagcaatagcttagacaaagcttttaaacatgttaagatttcaaataataccaacaatgtaacattgttggctttggatgaccaagaattaacagtataaaaattgacaaaaaaaatgtttctgatccaatttaacagaataaattttgatttatggcttacggaaaattaaaaatcgataaaaatttaaataaaacaaacaaaatttagaacaaaaaaatatgaaagaggaacagaaagtggaagaggaagaggaagagaaacaaaaagaggaacagaaaaagaaatagaagaggaacagaaagtggaagagaaacagaaagtggaagaggaagtggaagacgaacagaaagaggaagacaaagtggaagagaaacagaaagtggaagaggaagtgtaa

SEQ ID NO: 82176 - DNA, 1087 bp, Heterodera glycines
  Genomic contig location: Contig_ID=SeqID_17648; Location=412..1498; Strand=-
  SCN-specific regions: Sequence locations=1-163,185-343,372-387,409 -549,575-816,867-1055,1085-1087
  Gene Ontology: Mol. function=neutral amino acid transporter activity; Cellular component=integral to membrane; Biological process=transport
ctcaggggagaaattttcataagaagtcgaaaaaactgaaaccaaaaagtcaaagaaacccatttaaagactaaaattcaaactgtcgcgggcaatggaataaacatttggatttgttaactccgttttccttgtcagattggactttcgctgctcatttcactgcttgctgctgctgcgaccacattgggcgccttctgttacatcgaactcggcacgagcattcgccggtcgggcagcgattttgcctatctctcatacgtcaaatggtcagagtttgtggcgctcaattaaatgtttcgaaatgaaaaaagctcattaaaagacgaagccaaccttcaaaactgattttctcatttaaaaaattatttgagcacagattacacttttttaatttgaatattatttttggccaagtgtcccttttgtccgtcttttatttgtccgtccaattttaggcgtccgctcgccttcatgttcatggtgtccgggtcggtgctcatctgtccgctctattcggccattcaggcggacactttcgccgagtattttgtccagggccttggccttgactcgctgctgatggacgcctctgatcagcacaattcggccgctgcgttcgctcttcgcaaactgatcgccctttgctccgtttggctgatcattttcctcaactttttctcacttcgttcggtggtcgcgccctttcaattggtcaccagcgtggccaaatttctctcggcacttctgatcattggcattggcttctattggcttttatttaaaggtgggcaaagcacaaaaaagggccaattgaattttataaaaaacaaattaaatatttttatttaatttttttttaatttccaaatgcttttcctctttttttaggttacaccgaaaatctgcgccaaccatttgccaattcgtcgtttgatgttggcaacctaacaaatgcattatttgcgggactgttcaactacgacggatgcgacgtgctcaactacggcatcgaggaaatttctaacccagcgaggcgaataataataataataattattattattattattattattatcatatt

SEQ ID NO: 82177 - DNA, 239 bp, Heterodera glycines
  Genomic contig location: Contig_ID=SeqID_17649; Location=607..845; Strand=+
  SCN-specific regions: Sequence locations=1-183,206-239
atgcatgaattggtgccaaaattatttgtcggttatgacagaaacgcacggccaatttcaaaggatggcaaaccgattgaggtacaaaaaagcaaaaaataaaaataaaatgttaaattgaaatggatataatatccaattaatttggcctatctttctcgaatgagcagagccaattaatgattcatttgcagatacaaagtttgttggtcgtggatcacattgaacaattggtgtga

SEQ ID NO: 82178 - DNA, 159 bp, Heterodera glycines
  Genomic contig location: Contig_ID=SeqID_17650; Location=2661..2819; Strand=+
  SCN-specific regions: Sequence locations=1-159
atgtctccaccaaaacgtgccaaagtgtcagccgatgatgatggggagacaatttccgacgacggggagccgtccacgtccgcgggggcaaagcgaaagcaaaaggcgtcgaaaccacgccagcggaaggcgcacgaggcattcattttgctggtggac

SEQ ID NO: 82179 - DNA, 528 bp, Heterodera glycines
  Genomic contig location: Contig_ID=SeqID_17651; Location=516..1043; Strand=+
  SCN-specific regions: Sequence locations=1-182,204-294,350-528
atgcaaaaggatgagacgcatgtgatgcaaaatggacgcaataggaccaaccatgacgaagtgcactccgtcgacgaggcacacgaccatgtcagtggtgcagtaggcgatgcgcatcatgatgatgtaaatttttattattatggcgatggaattcggtaaatggtctcatgaaaactatattttttggaataaaatttgcaaatctgatttttaactaaagtgaggattgtctatcggccaaatgctgattttgaaaattttcagtagggagcgcttgggaaaaattggagtagagagaaagagagagagagagagaaagaaaaggggagaaggaaagagaaaaagattaagagaggtgaaatggtgaaaatttgtattttatgtaatatatgtattaaaatttttcatgtgcgttaaaatgaatttagacatatgaaattatatattataaatgcttataggtgagcagtgtgaccgaatcggttctgccactgtatacttttttttgcatctgcatttatgcag

SEQ ID NO: 82180 - DNA, 744 bp, Heterodera glycines
  Genomic contig location: Contig_ID=SeqID_17653; Location=24..767; Strand=+
  SCN-specific regions: Sequence locations=1-124,146-183,213-744
  Gene Ontology: Mol. function=GTPase activity; Cellular component =cytosolic small ribosomal subunit (sensu Eukarya); Biological process=regulation of translational initiation
gtggccgaaagctgcttccaagttgcggacgacgcgaagagacaatcggcggaacacctaaaagtgacgacggatggccccggagtttcacaggcgacgactgccgcccttcgggagaagccaatgcccacggagaagccgcccagtgacgccgaggaggaggagagcagttccgcagcttcatcggacgaggaggaagaggaggacgagtcgtcggttggggtggcagtcgccaaagaaacgcgcgaggatttattcgcgagggttcgcgccaaaattacggtccgtttatgtgagacaagcagtcctaacgatgagcttggaattgcacgtttcagaagcgcaaggaattggccaattccaaacgcagtgtcagtaatttgaggtcacccgttatttgtgtgcttggccacgtggacacgggcaaaacgaaaatgttggacacggtttgagaaggggacaatccgcatgatgcagctatataatgaatgacactttctgcagatccgtcgcagcaatgtgcaggagggcgaagccggcggaatcactcagcaaatgggcgcgacgcgagtgccggggcaagcgatcaaagagcggagcaaaatggtgaagaatgtgagcagtttgatgatgttgcaaaactgaggagcattttcaaaaactcatttttagttttgcgctgattcaatgcaaatccccggctttctgatcattgatacgcctggccacgaaagctttgcgtag

SEQ ID NO: 82181 - DNA, 1092 bp, Heterodera glycines
  Genomic contig location: Contig_ID=SeqID_17654; Location=102..1193; Strand=+
  SCN-specific regions: Sequence locations=1-844,868-940,962-981,1004 -1092
  Gene Ontology: Mol. function=translation initiation factor activity; Cellular component=cytosolic small ribosomal subunit (sensu Eukarya); Biological process=regulation of translational initiation
gtccgttctttgccaggattaggcacgacgatcgatgtcattctgatcaacggcacactgagagtcaatgacatcatggtactgactggaagtgacggaccaatcgcaacgccaatcagagacttgctgatgccacagccgctaaaagaaatccgagtgaaggcgagtggcagggacaaccccaaggcgtaccctcaaaagggctgaagttattaagaaaactcagaataggcaaaccatttttcatctgtagtaacccccccccccataatcgtaatctttgtcaattttttcccagaatgattatgaacattacaaagagattggaggggcgcagggtgtcaagattttggccaaagggttggagaaagcgattgccggacttccgctttatgttgccacaactgaggaggagttggaggtgttgaagtgagtagacatagcagccaaatcagagggaattcggccgttattttcccttaagggaggacgctgaagttcagcttaagcacgcgctcatggcgattaagaaaaagtcggaaggggtttatgatcagcccaccaacctttagaaaaatgcttgtcatcgacattaagcttttagagacgatagacaagtatcgttagatttggagaacaaagaaaaaagttatagtcaaaaaattggctggggccgaaccgtgcggggccgaactgaggtaaaccgcgtacaaataaacatgcattgacgtggtgcctttataattatcactaaaaatggattaatgttagttttttctgaatttttcattacaaacattaagttcaaacgacgcagaacgaaaacggcgtcaattcgacgacgaacaacaacagaaacaacaacatccgctgctggtgaggaacagcggacggcggtgttggaaattgagtcaacagggcccgtcaaattgaaaattaaatgtaaataatcaaaaatattgttccataaaaaatttgggaatttatttttattgccttttacagtgccatgttggagaagtagcggatgttcaacgagttcgcctggtggtgcccactcatcgcagcaacagaaacagcatttcaatgtga

SEQ ID NO: 82182 - DNA, 706 bp, Heterodera glycines
  Genomic contig location: Contig_ID=SeqID_17655; Location=206..911; Strand=-
  SCN-specific regions: Sequence locations=1-139,161-165,201-429,479 -600,623-706
atggtgaaaaaaattccaaatgaattactttttgaaattatcggtgccattcctttcgacaaaaaatgggctcaaattcacgtgtgccaagtgtttaaccattttctgttcaatcgtatgggctcatggcttagtcaaagcaaaaatttggtgagtgtttaaaggaaaaatttatgtaaaaaagaaaaaaattattttttctttttcaaattcccattggctgatcactctttaagcataaatggctcataaaactgtcagaattttttgtcaaatcatttaatttctttggcaggttgccaaatgtatgttcctctttcgaagcatagtgaaaatgatcagatcacttcctgataatttgctgtctgtcaacgcagattcgaggaaacactttgaagcttcaaaattcgtgaatggttttaatagcacaaaaaaataaattaattacataaaatttcgaataattatttaataatttcctaattatctccccccccccattaatgacactgtttactccattgtacgttggaccaattgttctcaactttttattgaaattaatggtttgccgttcaattcgaacaagaaggacccgaataatgtaagtgatgcagtttagtattcgaacttcggtgcaacaattgcagaacgaacttagtgcctgccgatatttcaagattaaattttgaaaaattttaataaa

SEQ ID NO: 82183 - DNA, 491 bp, Heterodera glycines
  Genomic contig location: Contig_ID=SeqID_17655; Location=1545..2035; Strand=+
  SCN-specific regions: Sequence locations=1-114,138-491
atgaaaagccttttgataaataggaatagaatggatcatttgcaaaagatatggcaattatgtgataatttgtttgggcggtacgattttgatgaatgtttggtgtggaattacaatttaaaaaattaattaattatgcgtatcaaaaacagagataattattgtcaatgaaaaggttattttgtgttttttgctattttcattatttttaaatctgtcaaaaatctcagacaatggcacattttatcctcaaaatttcttgcaccggacgacacacttcactgggccatgtcgccccgcctactcaacgttgtactttgggctgatatgcatgtgtttggcggagatgactggaaaaacattcacattggcaccataagataatacaaaaaatatttattaatgattttgttttaattggtaccattttttaatcgttttcaatgtgagttgtggtaatattttggccttttttgatgagtgccatagaa

SEQ ID NO: 82184 - DNA, 761 bp, Heterodera glycines
  Genomic contig location: Contig_ID=SeqID_17655; Location=2313..3073; Strand=-
  SCN-specific regions: Sequence locations=1-105,138-655,677-761
atgcagccaattagccctatcaaggatttgaagcaatcgatggtaagcaaaaatgttgcggtaaaatctcgaattttcatttttaagaccacttagtcaatgttcaatcattttcattttatttttagtcaaaaagtgcatcacttcgatatgcaatatggagggagggtgcctattctctcaaatttaaaggaaaaacattcgatgaagaaaatttttggcattttctctaaaacctgggaccggccctaagattaaaaaaatgcattttctcccaaatgataacacgaaccttttaaaattattttcagaccaaagacacggaatcgtcgatgcgaagcctgaagacaatcatcctaaaaataggggcggaaaagaggagtgctgaaacgggtgcgccagcaaaggaatacgaagccggccgattttacgagggtaaaaaaagaattaaatgaattttgtaaaaattggagaaaattaatattaatccaacaattccaaatttagcgcttctcattcatacaagcacaggaactttccccccaaacattggcactcgctttgtcattccgcaggattcaaacgcgccaaattatgtaaaatttttagttcgtttttctttaatgcaataagttatttttattattcatagattaaaaggggagtttaaaaacttaatttgccaaaataagggtgcatttaaccgaaaaaattggttataactatttaatttgttgtgaaatatgattcagttaaataaa

SEQ ID NO: 82185 - DNA, 1167 bp, Heterodera glycines
  Genomic contig location: Contig_ID=SeqID_17656; Location=235..1401; Strand=+
  SCN-specific regions: Sequence locations=1-230,254-431,453-1167
atgcgaaccgcagcgggagaacaatcgttgcgcgattggctacaagaaatcggcaatgggatgcatcgagtgggtacggacagccaaggcttcaccaaccaactgcgcattccgcccgaacttctcgtggacgacctcgaccacacaattcacttctgcttcccagaagcactgtttgacgacccgctggccaacgctgacgcaattgcccacaatgccatcctctgtccaaccaacaacgacgtgcagcacatcaatgaggtagcgcttggcagaatgagcgggtgcggaagggaattcctgtccatcgacgaacctctggagccaaacgaagaaatgcacaatttccgcaccgacttcaacatggaggcggtgcacaatgaaatgccatccggaatgccgccccacaaactgaccattaaagtgaactattttttgttttaatcatttttaaccaattaatccaggtgggtacgcccgtgatgctgatccgcaatttggacgtcacccagggactgtgcaacggaacacgacttcaagtgatgcgcacttcggagaacaacctgttctgccggattctcaccggaccacgagcgggtgcgcagaacatcatcgccattccacaaattcaattcgaatatggccgcgcacgacaccaccgtggactacgcttccgccgtctgcagtttcccgtccgcctttgctttgccatgaccataaacaaggtgaaatacagattatttaaggattgaaatatataagcacaaaaaattaaaggcacaaggacagacgctgcagcggatggcgctcgtactcaacggccggcaatgcttttcgcatggccaagtgtacgtcgccatgtccagggtcacgcagatggacggcatcagggtgtacgcgccgctctgccaaagtgggtacggaacgcacatcgagaacgtggtttaccacgaactgttggacttggagccgcagcagccaaggacaccgattcgtggactgatcgacgtggacaatgacatggacgtggcaataccggacgtgggcacaagagtaccggacgtggacaatgacccggacgtggaacgagataatggaaacgcagcgggtgcgaacgatcaagaaccaaatgatcttgatagttcttttgatgatttttttgattga

SEQ ID NO: 82186 - DNA, 400 bp, Heterodera glycines
  Genomic contig location: Contig_ID=SeqID_17658; Location=266..665; Strand=+
  SCN-specific regions: Sequence locations=1-158,181-400
atggcggcggaatggctccaaaaaattgattttgtggtgccagttgagaccacaaaggctgttggatggcaccaaattgttggccacccggttgatttggagtggcatgctgctgatccgagcccgaaaggtttgacattgcactaaatttttaacacataaaaaaatattataaataatgaaagagcaaaattatgaggaaaagaagcagcctaaagaatcaattttcaaaaatgaaaaaggcggaaccattgggagggccaagggtgagaaaatttgccaaaagaagcatcatcttttactgatgaatcatttttattttggaatatataaacattaatatggcgctgagttgaagggtgtgtgaaaaaaaaaaacaaaccgtcttagcaaaaaaaaa

SEQ ID NO: 82187 - DNA, 1131 bp, Heterodera glycines
  Genomic contig location: Contig_ID=SeqID_17659; Location=386..1516; Strand=+
  SCN-specific regions: Sequence locations=1-114,136-236,258-306,328 -1095,1117-1131
atgggcatgtcccttccacttgcaccaaagtaagggatatgctgccgacatattagcgcatcccgggcccacaccgtgaacctgcacatttgcgggtctggggtaaatttaagcactaattttgtcttttttattcgataattctgggcatgcggaagaagactgcagactgtgaacgtttatgacttcatacagagcattggccagataaccaatatgtgttttatttgttttgaggttcaagagttttttcagttgtttttttaacggcaactttcggcaggcagggcctcgcccaatggaagtgacagaagcgcacaaacagcgcacagccgtaccacccgccaaagccaaacaccgccagcacatttggttgtcaatgctgaacatgaaccgcacgacaaccaagctggtctgttgatcgctcaacggcaacctaacgcacaacagcgcgattggtttggacggttcaatgcggtgacaagcgcacagaagctcgacgacctgttggcacatttggttgtcaatgctgaacatgaaccacacgacaaccaagctggtctgttgatcgctcaacggcaacctaacgcacaacagcgcgattggtttggacggttcaatgcggtgacaagcgcacagaagctcgacgacctgttggacgagttcaccaacgccgtccgacaacaggcgcaagcgactttcacacaaaggcccgctcaacaacaacgacggccaagacagctaccgaaccaacatggcagacgccgcaaccaaatgaatgccgatgatggtccgccatttgatactgtcgccgccaaaagctgtaccgcgcttcacgcgcgagagcgtaccgggagattactgagcaggcgtcatcactgtgccagctctcggctgaagtgcttcatgggcatttcacaaacgtgttcggccccagcccgcctgtcgccgagcaaatgcccaactccgtgccatttcacgagccgcccggcgacaacagcccgttctcagccgactaacaacagtgaagtgcggctcaagcggtgcagtgcagcaacaccgcaccgggacccgacaacatccgctacgcggtgtggaaaaggtttggcccggctgccatatgctcactga

SEQ ID NO: 82188 - DNA, 3131 bp, Heterodera glycines; identical to SEQ ID NO: 17660
  Genomic contig location: Contig_ID=SeqID_17660; Location=1..3131; Strand=+
  SCN-specific regions: Sequence locations=1-348,495-509,531-970,992 -1613,1635-1866,1888-1931,1953-2380,2402-2573,2597-3131
  Gene Ontology: Cellular component=cytoplasmic vesicle; Biological process=regulation of synaptic growth at neuromuscular junction

SEQ ID NO: 82189 - DNA, 67 bp, Heterodera glycines
  Genomic contig location: Contig_ID=SeqID_2886; Location=1419..1485; Strand=+
  SCN-specific regions: Sequence locations=1-67
atgagttggatggggctgtggtggctggcggtggttgtggtctttcatcttttggtgctttgcttag

SEQ ID NO: 82190 - DNA, 1209 bp, Heterodera glycines
  Genomic contig location: Contig_ID=SeqID_2887; Location=50..1258; Strand=-
  SCN-specific regions: Sequence locations=1-184,206-436,462-534,581 -891,913-1072,1099-1118,1142-1209
atgccaaatatggacaaatatggaaatatggacataaatcgcgaaatatggaaggttgtgagacaggcgtcgaaatttttcgcaattttttatttccatatcacccacatatttggggcaaaatgcagcccaaaacgggtcggggtcacttcggcgcggaccatttcggcgccgcaaattttgaaatgctataacttttttatttgtcagttagctttagccaatctggcatcatttgaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgaagagctatcgaatgataacaaaaatttttaatttggttgatcaggaaaaaagttgttagcaacggcgccgaaaaggccggcgccgaagtgggcggttccccccaaaacgtcgctttaaaacatttaaaattaaaaaaaagtttattttcaattttttttgaaaaacttagatgtacatacatacataaatgaaaaatgctttgctattagaaaattgagaattttttttatttgaaattcttaggaaaactttactattttattgcgggcgccttttttctcggcgacattttgtcctgctccgttttggggccgagactttggtccatagatcgaccacattctcgggccatatcaccacaaacagattattactctccgccactttcctcctctctatttccatatttagcactttccttttttcggggtttggcggtttggccaccctccccctcgcctgtcgccttttttggtttcattttagaattggcgggcggtgaccacacgggcaatcccatcccgaccgttaatggatgggataacacgcgcatcatcaccttctttaataccatccattatccacaaaatccaacggcacccccacaaagtgtccaagccacgaaatgtccaaaagagtaaaaacccacgaaatgtccaaaatttttcaaaatttataaaaacaaaatgagtataatttaggatttttagggttttcggggtcgctgaatacgaatataccctttatattaccccttgcctaaccttaggcccatctgaataataaa

SEQ ID NO: 82191 - DNA, 241 bp, Heterodera glycines
  Genomic contig location: Contig_ID=SeqID_2887; Location=1..241; Strand=+
  SCN-specific regions: Sequence locations=1-117,141-241
ccacaaaatgtccagcccacgaaatgtccaagtctcgaatttgagtttttttattattcagatgggcctaaggttaggcaaggggtaatataaagggtatattcgtattcagcgaccccgaaaaccctaaaaatcctaaattatactcattttgtttttataaattttgaaaaattttggacatttcgtgggtttttactcttttggacatttcgtggcttggacactttgtgggggtgcc

SEQ ID NO: 82192 - DNA, 771 bp, Heterodera glycines
  Genomic contig location: Contig_ID=SeqID_2888; Location=127..897; Strand=+
  SCN-specific regions: Sequence locations=1-223,247-307,329-713,742-771
atgaaacttttcatttcgaatgcttttcctttgttagccctttctctgctcgtttggctgctccgtgccgaccagggaaagcttgaaaagcgaaacacggcggaagtgacaatgagaaatggcaacgcaatggcactgaatgagcagtgggagtttaaagcacagccgcaagaattggacagaatggcagtggcgataatggcaagaaaaacattggcatttgtcacaaaaaacattcattggcatttgctgtttttttttgatggccaatatacaaaaatgcgtctttgggcctactaaataaaggccatctctgctgaaggtgcaattgaaaattggtcaattgctaccacccaaaatcctcacttttttttcctattttgggacactccaaaccccaaaaaggcgtgccgcctttttaaacactaattgtcatgcatttaaatgtttaggtgatggactcttttggtgaagtgggccattgcattttgggcgatttgtcgggcgccgatgcgacgggggcgcagcaatggcacgaagcgatcgaccgacctggccaaggcgtgacggaatggcacccactgagtgccaattggtgaaagctgtcgcaaatgatgccctttttgctcttttcaaatttatttggttaaataagaattttaaagaagaataacaattagttttgtgtttgatttttctggtcccaatttcgaccaaagaaaaaacaaaacaaatatttgtccatttcagtttgtatgtaaaaatatgtaa

SEQ ID NO: 82193 - DNA, 1912 bp, Heterodera glycines
  Genomic contig location: Contig_ID=SeqID_17662; Location=19..1930; Strand=-
  SCN-specific regions: Sequence locations=1-1,24-122,144-147,214 -305,327-360,382-431,462-546,582-662,699-895,933-1014,1047-1132,1210 -1210,1232-1239,1263-1297,1347-1695,1717-1912
atgaaaattttgttaacatttttgctttcatgtatcattcttcttcatccggaagtgaacggaaatcaattcaatgaagttgttgtttgggatgcgaaatgccgaaaacacatcagagaagtggaaattttggccaaatatggtaggaaatattaaaaataaataaaataaataaatattcaaataattttgcaaataattaatgattttaatgagaacatacaatttagaaaattattcaacctaaattcagaaattaaaaaaaaaactcgtggattttgattcggcttatggttagggtattcaataataaaataatgtttttacgaaaccctgagctcgacattattacttaatttgttcaaatatttttattatattcagaagtacttaaaaaaattcgttttcaatggtttgtttattaaactgtgaattttaaaaatttattcaaatttttttatggatttcaagattcaattcctgtttttagaatttaaaaaccgaggttgggatcggttgagttcgattttctcggacttagcaccctaaaattactttaagaataattttaaattaaaaatctcttgaaaatatttgtatcaattgacattacttaaaaaaaaataattcattttaaaatcactcaataaatggtggtgacgttttaaaatttgttcaaaatttttttttattaaattgagaatcttcgttgttgagttcgattttttcatggacttagccccatcgggaagggatacgggaacgggattcccgggttttcccacgggaatcgcgttcccgctgggcccttaatataaaatgaaattataacatggttggtcacttcacaaaaagtgcaaaaatcaaaaatctgatttctctatgattttttgtcaattttttaattataaacatattaaattaattaaattgatgtttaaaacacattcttctaagagttttttgaaactcgaataaaaatgattaaagtttacctaatattaaaaaaatccgtagccagatcattttgaagcttaaatgggtttataaattttacaaaaaaaaaaaaagtctaagcaaaggcctagacctaagcaatttagcttaagttgaaacggatacaaatatttccattttttatataatttgagttcatttttaatttaatttcatttgtaattgaactttaaaatattaaaaaatttaaaagtaatctgactaatgatttagttaatactaagaaattttacagttatttttattcgaaatccaacaaaaattaggtgtatttaacatcaatttaattaaattttaacatgtttataattaaaaattgataaaaaaatcataggaaatatcagatttttgattttatttttttaacttttttatgaagcagccaaatttgcacttttgtaagtgacctagcaccaattataactattaagaaaacagtgcaaatctaagcagagctttgaataatttgacaaacgaaattcgccaaaatgtcagatgcgaattgtcgtacgcaattcacaaaaattatatttccgatgctaaccaaaagaacaacaaattcgacgcctcaaattcgcactttatgtatgaattggacaaaatcaacaaaatttcaattgaccaatcaacgaacacattgccaactgcattgatatggattaatcaattgcgcaccgatttcgccacgttggtgccagaaattgggctggtggacatttggcaaaacgttgacagttacacggaaacccgcaaatccatggagcaattatatcaaaaaattgctacaattcaaaccgatgtattttatagtggcagtaatttggttaatcagatcatcagtgaggcaaaagataaattggaggacttcaaagaaaaaagcggtgggtcaaattga

SEQ ID NO: 82194 - DNA, 1278 bp, Heterodera glycines
  Genomic contig location: Contig_ID=SeqID_17663; Location=1275..2552; Strand=+
  SCN-specific regions: Sequence locations=1-134,158-206,292-318,392 -422,444-825,858-991,1014-1115,1139-1160,1213-1278
atgtgtggcaggtgagcagcgccgggtgggccgagtgcgactactgcttgaactacgacgcgcgcagctgttgcctggtgtttctgcccattgggttggcactcctctttttcgtgtggctgttttctcaggtgaaataatttcaaatttttgtttagagaaaaatttttctaagattttttttcaaagagaatttgctaattagcaatttttatttttaatcaattttttattttaacctattttcatataaattataataacatatatttttatataattaaaatttttgttgcctagtttttctgcaagggaatcaaaaaaaatatatttttttgttattttccagtttaattaaataaaaaatatattgaaacaaaataaataaatacatacgatttcgaacaaaaaatattgttcattatgaatttaatttagaaaaaatgctagaacatatataaaagcccttaatatcctatattattattctcgcccggatttttaaacacatttaggtaattaaacctcaaaaattcttaaatttagcatgaaattatcataaaaaagcaaattatcacaaaaataaaaaacccaataaatttcagcgatttttcgaaaattagaaatttaaaaaacttttagagccttagatttattgcaaatttattgatttagtagatggaaaaaaatttagactcagttgacccccccgccgcccatgtggggggggggcttgtctgtgttgaaaaagtttggtgattagaagctgtaaccaagttcgaaatgcagttttcatgtttccttttgtttgccttagggcgtaagattttttaaattatatttattttttaatttaagaagggccatttcgcggttggcctcgtcattgtccaactgttggctatcattttgcttggcatcgccctttttctgctgttcatggcctttcatcggtgtttgcgccggcttaaggcacgcaaaaagtgctgtacaaaacaacagcaacaaacagttgaagaagcataagaaactaatcaataaatggccaaagaaaaatcgataattaatctttgatcagctcagtaaattatccgatgaatgaaacagacaagccgtgaagaggaaagaaaatcgaagacaatgtccatttttgaaattggaaaatttatataaaatatatttttcttttacaatatatcttttttattttttccttttttttgactaaattaaacagatgctttatgtacatttatttataaatatttgtcattgaaa

SEQ ID NO: 82195 - DNA, 968 bp, Heterodera glycines
  Genomic contig location: Contig_ID=SeqID_17664; Location=631..1598; Strand=-
  SCN-specific regions: Sequence locations=1-229,263-308,330-371,393 -408,480-864,886-968
atggatgagccaaaagcggagaaattcgtttccgatccaaacaaatccaacggcacagtttcgatggaaattgaaaaattatccgaatttgcgcgagaaatctacggaagtggaagtaaaagtgaaactgtgtatataaagggagtgccatggaaaatattggcacttataacgaaaaatgaaagcactgagaaatggttgagcttttatctttggtgcgactttactgaaaaaggtttgcttataaaattatataaagaattacaaattattttgtctataacttggtgtaattaatagctctattgaaaataattatttaatcaatagggttaaagttgtatgcactaaaaattgccgaatatgcgcataaaatatttggtgttcaaatttatatatgaaattgcgaattttttaaaatttttataatataccaaaacaaattatatttttatataaacaaatttttttcaaaatttcttgcaaaaagctcaaaattttcgtttttaagtatgtatttttttattcccaaaagtcgatccttggggggtgtatttttcgtttttattgcatttttcttatgaaaatttgccaaaaatgactaaaatatgctctaaaaccttgaaaatggtgaatatgtatttattctctaaaagctccaaaatatgcttttatatgcattaaaaaccttcaccaaatcaaaaaattttaacgtagaaatgctatttttgaacccctttcttcatagcatatgcgcagaaaaaatatgcaaaagcatataatttatagccctactaataataaataaatttaacgtacaatttgaagtgtttttttatccaaagattttccaaggtcatgctcattgtcagtttttcattctcaaaagttttcgattgagtgatgaaaaactaaaattaaaaattgttttaattgttaaaccttttgaaggtcgactcccagaatga

SEQ ID NO: 82196 - DNA, 101 bp, Heterodera glycines
  Genomic contig location: Contig_ID=SeqID_17665; Location=911..1011; Strand=+
  SCN-specific regions: Sequence locations=1-101
ataaaagtcaacgtagaagcctcaaaccaagtggaaaatgcgttttttatgcttaatatatcgaaactagtgcgcagaaaaaaaggcatatgcctcaaaat

SEQ ID NO: 82197 - DNA, 428 bp, Heterodera glycines
  Genomic contig location: Contig_ID=SeqID_17668; Location=80..507; Strand=+
  SCN-specific regions: Sequence locations=1-44,69-140,162-238,262 -356,385-428
atgcaaaatgagaaaaacaattcagatgatgaacatttttacccgcaacaacagcagcagcaacaatcgttggcacagctggtggagaaccgcatacagcttggcaccgcgattgatgagggcggtgagaagccgccgccgcagcagcagcagcagcagcacagtcgcgagttggccatggccatcgtcgacccaagcggtggcacgacgacgacaacacccgcaacactaacagtgaaggaggagcagcagccgcagcagatgaacatggagcatcagcagcagacacattttgtagctgctccaacgtcgtcgtcagcagcgggcacagcccaaacgatgcctaacgcagcacaaccgcagcagcagcaacagcaacagatgaactcgttggaaagtccatgcggagggtgtcgagaattgaaacg

SEQ ID NO: 82198 - DNA, 1885 bp, Heterodera glycines
  Genomic contig location: Contig_ID=SeqID_17669; Location=425..2309; Strand=+
  SCN-specific regions: Sequence locations=1-78,112-188,211-226,249 -520,542-722,761-1604,1626-1704,1729-1885
ctataaaagccgcccaaattcacttctccattcagttcaaccaaaagttggattttgctaaaataaaattgtgcgctcttatttaaatatattaaatttaatttaaaaaatgacttcaaaacgcaacggaaatacggaacaagccgggccgtcgaccaaaaaatgggattttagatcaatcgggtaagtaatttttaataatatatttaagagacaattttaatcaataatttttcaggaacaattttactgaagaaatggaaaattataaattaattgacgaacggtcgacgatttgcgaaaaatttggattcacgaagaacattacggaatttcggatcaattcggatgtgagacgccctgacgaagcgatgagggacgcaatcgacacaatgattaaggcggcttttaagactacggaagaaaggatgaagcggaaagtgcggatgtttggagtggcaataacgggtgccgggcttgcttccccggtttgggtaccgtacagggcgtacccgcagaacaatgcggatgttattatgcaggagattaataagttggggcagagcggggacggagatgaaaataagaaaacgcttttgttgtcggagcctattatgatgaaaattacttgcgtcacactgcccagtggagaagggccgaggaatgtacataaatttgatttcggatttaaggaacaccaacggataatgtaagtttttgagaaaaaaaagaaaaaaggaaaatagaaaaaaagaaaaaattataattatttattaagtatttcgaatgtggataaattttgtttgttttacgcactggcgtcgtcgatgaattatttaattatggaccgttttgcatttaatcgatttatgaacaatattatgagacagagggacgcagctactgagcttttacgtaattgtggaattgatattaacgaatatagctatggagtggagcacttatcgagggttcagaattatttggtgggttctaaaattttggaaaagtgataaattaatggattttcaggatgagatttaccctggaaagtaccgagtggtggcatttgaaaagtcagctgatccacggaaatcaatccgtgttttgtggaagggccctataggacgtgaaaatgtagtgccgatatttttggagaatggtcactgggatggtctgaagaattacgtctgcttttttaatcgtgggagaaaattctgtaaggctggggctttagagttgccgctgtccctttacaatttaatcgttttttcgagttttaacaattactctttttctctaattctctcctctctcctatagtgaatgcgcatctctctgcccaggggggggggcccacatttctgtcctaatactactgagggcgtatggaagtacgaacagttgcgccagttttgcctggagctcagcgggttggccgtacttttacaggttttgttttttgacttattgcgaaacaatttcatcagagatgttttttggattttaaccatgtgaattatcaaccccttccccaaataggagcagtgtcaccccgaaagttgcacacaaatgaccgcgactgagcagtggatttgtgagtcttccttattgattttctgtctcaaaatagttagttgagcttggcttaggcctgggtttttccaggttatgtacgaaaaatcttaatttccaggaaaatacttaagaatttgctctttttattgttgcggtttagtcggttttacgcgtcctatgaatgaccatactcagtttcttaggccataacttttttctttcttgactaaggcctccattcttggtatcaaatgaatgcttaaactcttggtaatcttatgtataactaaattctgagctaaaggca

SEQ ID NO: 82199 - DNA, 725 bp, Heterodera glycines
  Genomic contig location: Contig_ID=SeqID_17670; Location=254..978; Strand=+
  SCN-specific regions: Sequence locations=1-725
atgaagcgaaccaacgcatcaaacatcactccacctcgcgccaaacgtgcaatgccacctgcactggacctggaccaaaacactgccacactcgaagagcaagaacgccaacgcaccctggtcttcattggcctcccggaaagcaacgccatccgcccatcggagcgtgttcaggaagacagggaagccgccacaaaaatcctggaccatcttgaagttgaggccgaaccaaccgccgtctttcgactcggccggttcgacccccagcgaacaacacctcgcccgctcaaggtggtcatgccgacgcccacacaccaacatgtggcactcggaggatggaagtacgagcgtgctcggctccgttcccaacagaacctgacccgtctgttcgtccgtccggcgctgtccaaagaacaactcaaagaggaatacgaagcgcgtctccgaaaacgccaacaaaacccagctccgatggcaccggcaactcagctcccacagacaaatgccccgactcccgttgtcgaagatggaccaaaccagaagaagaccagtgatgacattcccaaacaaccggaggtttttgacgaaacaatcctcgtctgttatgaagcactaaactcatttccacccaccgacaaaattgttcaccaaattcaatcgctcaaaaaacaataccctcatcttttcaacaaatagttctaccagacctccaacaatttcttcaa

SEQ ID NO: 82200 - DNA, 85 bp, Heterodera glycines
  Genomic contig location: Contig_ID=SeqID_17671; Location=350..434; Strand=-
  SCN-specific regions: Sequence locations=1-85
atggcaagcgttgatactgaaaaagaccgcgatgtgtgtttatgcccaccagctcctttgactcttcgtccaattcgacttggag

SEQ ID NO: 82201 - DNA, 2367 bp, Heterodera glycines
  Genomic contig location: Contig_ID=SeqID_17671; Location=718..3084; Strand=+
  SCN-specific regions: Sequence locations=1-326,349-1094,1116 -1863,1888-2106,2128-2235,2257-2342,2364-2367
atgccaccaccgcatgacttacaaactctccgatcgttcttaggtgcactaaattattacggacgcttcattaagcaaatgcgtgaactccgtgctcctctcgacgaattgctcaagaaagacgttccgtggcattgggaggaaaaacagcaaactgcgtttgaacaggcaaaatcgatcatgcagtccgacatgctcctcacgcactatgatccgtcaaaaccgatcatcgtcgcagcggacgcaagcaaagatggaatcggatgcacgataagtcacaaatttccggatcagtcagaaaaggtggtcgaacatgcctcccgttctctctctccagcagagcagaactactcccaaattgaaaaagaggccctttcactaatttttgccgttcaaaaatttcacagaatgatttatggacgacgcttcacactgttgaccgatcataagccgctcatcgccattttcagttcgaagaatgggatcccaatctacgcggcgtctcgacttcaaagatgggctctcattttggctaattacgattttgaaataaaatatatctcaacgaattgttttgggcaggtagacgttctctcgcggcttgtggcaaaacaacgcgagacggtggaggcggaagaacgagtgatcgccagcgtcgacaaaacttcacttccaatttcagatgattcagcgctcgatgaatctgaaacggccgctgtcgaatacatcttcatggccaacattgatcagctgcccgtcaccgcggatgaagtcgccgagcacactcaattggacactacgctcaggaaagttttcgatttttgccgtaatggatggcccaagaaatcgcctagtgatttgtctgcctttttcactcataggcacaaactttccgaagtgaatggttgcctccttttcggggaacgtgtcgtcattccggcagctttgcgtcagcgaattttggccgctcttcatttcactcacccgggaatcgttcgcatgagggcattggcacaacaacatgtctactggccccgcatggaccttgacattgaacgttgggttcgccactgcatcgactgtgcgatggcggcaaaaacaccaacaaaaactacactctctccatggcctcgaacaaataaggtctatgagcgcattcatatggattttgcaggcccatgttctgacggcaatctctacctcatcatcgtggacgcattcactaaatggcccgagacttttcaagtgaaaagcacttctgcggacaatgtcatcgttcaactcgagtggctcttttcgcgatacggttttccacgtgaaatcgttaccgacaatgggccaccctttcattcgaaagatttttcccatttttgcaggattaaaggtatcaagcaaacatttagtccgcctaatcacccacagagcaatgggcaagccgagcgttttgttgacattttcaaaaggcaaatgaagaagtgttcacacggagacaaaaagtggatcaccaattccctgttagcctaccgcaacacaccaaatgctgcactgaaaggacaaacaccagctgaacttttccttggccgttcacctcgaacacaactgtcactgctcaagcctgacatttcttgctcaaatcgcaatcaaaatgactacacaaacaacatgccgaagcaattcgatcgcaaacatggtgctcgccaccgaacatttgcaattggtgacgatgtgctcatcatcaactaccgtaacaacaaaaagtcttggctacagggtaaagttgtctcaggttctggtgttatttggaaaattaaagtccccgtccttggtaacgtcattgtgcgtaggcacactaaccaaatgcgtaattttttccaattccccaaaaaagtcaaaatggaaatggacccggcacacagcatggttctcctggtcttgttcaaaagcgccacgttcgtttcgctgatgaagtggatcaaaacggtgccattgctcgagaccaacaacaaatcgccgatgtcgccgacaaacaaatcgaagtccggcgttccaaccgtcaacggcgttcaacaaagaaattggatttagacacttcaaaaccgcgttatgattacatttaatgatcgttttactttcgcctacccattttttttaaaccaattcaaatttaaaaggggaggtgtagagtacattgtaaatattcaaatttacgccattttcggattactgtaattccactctttttcctttctctcgctttcataaatacccatctcttttcactcatcaattgacttcgcttttcattattcaattcccttctcatcgctcgtcttctactccgactttttatttatttacttctgacaa

SEQ ID NO: 82202 - DNA, 1109 bp, Heterodera glycines
  Genomic contig location: Contig_ID=SeqID_17672; Location=1553..2661; Strand=+
  SCN-specific regions: Sequence locations=1-27,50-496,537-559,591 -644,667-827,880-1109
atggatattggacgaaaggtatgtcagataaataatatattttttaattccttggtcttactgatgactcgttgagagttttattttttgaaaaaatgacgaaacaattcaaattttttgtgtttttcaaaaacaacctattgttattatttggaaacgaataattgctcttaattaccccacccacgccggtacaattaagtccaattaaggtgcactttctcaaaatgttgcgtcccgcccatgccaacaatgagcagcaacaatcgctttgtgcccaactgcccaccaatgtttggtgcactccgtccgccatcggtcgcatggccaccattttgcgccaaatgcacgcggtggtcagcgaggaaatgggccgggaattgatgggacggcaacggttgatggaccatctgtgcctggtccatggctacttcttcatgttgcgcggcgattttgcctccgcacttgagcacatcctcttgtaagacaaggcatcaaaaaaaaaatttaatttgaaaaaaaaaaaattttttttaggttcacctcgaaaacattaaacaaaaaatttttttgtaaattaaaaaaattatgtaccccacaccagtgatgccaacccgaaacccgaggtttttctcaacccgaacccgaaattttttgagtgccgacccgaaacccgaaatttttctcaacccgcggcatcactgccccacacagctataatgtgctttttcaagcaaacaaattgtgtttttcaatgcctttttctttgagttatacgggtgctaaacaatttttttcaccgtcaaaagcacggactctccgatggcttatttttttttgtttgaaaaaaattttccaaatttttaaaattaattttaactgttaaaggaattttgtttcctcgaaaaaagcaaatatcatatcgtgtcccgacatttgcggtccagacatttgcggccccgaatttgcggcccgacatttgcgcctttgtccaaaatctggttcaaaactaagttttttcaatcactgatcgcataaatagctttaaataagcgattaaaagtgattgtacatgatcatttgatcttcaaaaaaatgttgaaaaaata

SEQ ID NO: 82203 - DNA, 1172 bp, Heterodera glycines
  Genomic contig location: Contig_ID=SeqID_2889; Location=451..1622; Strand=-
  SCN-specific regions: Sequence locations=1-14,36-312,334-344,366 -377,399-435,465-629,651-1172
atggcgccgcgttatagtgttggccaagtgttggagttggttgagaagatgcgcaacgcgattccagtggtttggtggaaaagtttgagctatcattacatgcgacgaacacggcgagtgctgaggcaagaaaaatgataaaattgggaaaacattaaaattaatggccaatattgaatttaaaatattaaagaaaaagaaataaggaaaaatattgaaatgtaaaattacgaatttatgccatttttaaagggttcattgagttgaataggcaaaaataaaattagggtcaaatagacaatagtttataacttaagaataacctatattattaaaaagggtaaataaagttcatttaaaatgatttaatttaataagccaaaattattttaaactaacaaaaatatttgaagaaaaagcgattggaaatgaatgtttttaaattaattttcattttttaatttcataggtaccgtaatggggacgcggtcagcaccacccaagtgtactacgaacgagtcaactccaacagttccggcaatgtgtaacactgctaaatgcttttgctgtaaactaaccaaattttagatttttgtatgacgaatgcggatataaggtaaggattaatgaaatttttgaaaaattggataatttgtttaaaaaattgttcttggcactttttaggacctatccaagcatattgttgatttgcacaaatttgcggctgtccgaatgcgcttttccaagggcttcgtgttcgcctgtgtgcaggcggccaacgaatttgaggagcagcggacacgcttctttgccgagaacgaaatgcgcgacgattacatggaggtgctaacattaagcatagagaagagtgccattgatcaaagatgttgatatttgtgatcgacacgtttaacattttccacagttaaacaaccggtaatggtaattagaagtctttaccgttacatttgccggaaaatcgaatttgtggtcactactttatagtagattataaaatagtcgcataagcatttctgagtgccataatacattctactacaagaggatggattacggtaggaatgtagaatcaggagcatcattttgccagggttttaccgggaatgattgcttgactataaaaattcacttttaaatgcttccatattaaa

SEQ ID NO: 82204 - DNA, 890 bp, Heterodera glycines
  Genomic contig location: Contig_ID=SeqID_2890; Location=821..1710; Strand=+
  SCN-specific regions: Sequence locations=1-108,184-252,312-370,397 -460,498-890
atggaagaactattcttttcggttgatggcattgagtacaataccgtgaaacggatctcaaattgcgaaggtcaaccccaatttcgcggtaatttttttctcctttccattattataaatttaagttttaaaaaattgattcaaaaaataaaatttaaattttcaaaaataaaatgtatttttgcacgaaaaatgtatgaaaaaaactcttgaaattcttcgaagtggagaccccaaacgttatctctcagcaatatttagttaatttaattgaacataatattattattattattttgtttaattttaatcaattaccacttttttgttagttgcagcggtttctattgtatgcatatggaaccttttgcttttttctatttattttattaaataacgaaataagctaattctgtaaaggcggtattaatctgaataaattctgatatatcgaagaaactttaaaaaaaaaattaaaagttcattttattaaatttccaaattaactgagaagagttttgggcgtccgtcacttttgccaaagcgatgccttccattcatttttggattgcccccaaggcttttcgacgcccggcagggcggcacaacaacacaaacattttttagaagtgtctttgtgccggggacgtttaagatggattgattatttgccctttggttggcgagagttagtatgggccaataaatttggacttttttgacagttttggcacttttttagggccacagacggaggagggcgtgccaatgccaatgttttggttggcatcctcaaaagcagggaaagaagaaaggcaaaaaatgaaaaagaagtgccaaaagaaaaagaaaaaatattcactgacattttattaatgaaaatgaaagaa

SEQ ID NO: 82205 - DNA, 2329 bp, Heterodera glycines
  Genomic contig location: Contig_ID=SeqID_2890; Location=3500..5828; Strand=+
  SCN-specific regions: Sequence locations=1-89,122-582,604-664,700 -840,863-1520,1544-1756,1865-2284,2316-2329
atgaccatttacacggtgttcaccttttttggccaactgatttttgccattttcatggtcagcaaaagcaattttaatttcttaattgcaataataaataatttcaaattattatttttttgaaggttttcgtttatgtgaccgccacaaattttgttgacgaacagaacaatcgctattcatacgcacagaaatggtttaacattagcttggagatggatgacttgctttttattgcaaatttcaatcaatacccgtgggtgaacgatttggccacggtggccataccggcatggtaattaaaagaaccaaattgttaatttcatcgtaatagtttattcgggttcgcaatttaattagtcaaaaagaataagttcgcaattttaatggccgatttaggcttttgctgtgggtgtcgtccaaaatgcgcgaaattcttgccgaaaaattcaacaaatttactagccacttaaagaagcaaaagttgggaagcattcaactgacggctcagtccaaaacaaacaaagttcaacccaaaacaatcaaagttcaaccagcggcaaagaatgttatgggataaatggaaaaggaaaaggaatggaagcataattaaagttttaacgtttattttgataattatcttaaaattaaaaattagtcatcgtaaaatatgaattttaaatttttttttcttaaattggttttgaagttttaacaaaaaatattaaagaaagccatggaagcataattaattggctacgcgataggcgcagcggtagaaaaaatcggtaattctgaccatttttaacagattttcaccgaaaaatggcaatttttaggtcaaatttaaactcttagggaaattctgtggacggaacggcgccgatagatgccgccgtgaaaatttttgggatttttaataaattttgttaagaatgttttttcaaaatttcaataatttttccccttcgccagcgacccccccccaatggtcatccttaacagtgtaaaaatttctctgtttccgagactaaaaaccagagaccgagatgcgaaaaacccgataagtttctcgagtcaagaaccgagactctcgcacatccctaatagtaatgcgcgtgtagctgaatagccaattcccttttttcgaaatttaaggaatgctaatgttaattagccttttgtgtggtgtataccgatactgaaaactaataaaattaacttcataacattgctcaaaacattcttgattgcatttgataaccctaaatgttttatataaggctctcatccgtccttgggtgccaggacgtccttggattagggcctcgccgattggaaaattgaaaaagtccttgtttacagagcatcttaaattccaaaaagcgaaaaaggggattgctattccgtcgccacgacgcattgccatgttcaagtcgttgatcagggcagttttaatttttcaaatagtaaattatgaaatcactttatgcctatttttaccttttaatccctaatttaacccacaaaaagaaaaataatgagttttattagttaattagccgttttagttcgatattctccggtagtaagtaattcattaatgtctgctggttgtgattttttctaatttttattttaaattgcaatcttcaaaagatgctttcacaaatatttatctctattattcttttgccgttcttttcaattccatgcatccattgctgagataatgttaaaaatagagaatataggctaattaaaataaaagaaaataataaattccaaaaaataaaactgatactatcttaaattttagttaatagttaaaaaataataataaaattataaatttttaaaaaatcagtttcagaaatgatcacttcaaacaaaagcgaaacccaacggaagaagaaaagcatggacaaattctagcaatttatttcaaaaattggacagtaatggacagtatagaaaacactcgaaggacaaaaggaaattgtgaaaaatgcaggcgtaactatagtaacatttcttcagttaattgtttcattcactattaatgtataatgacaaataatatcttgtcgtagatgaaccaccaaaaacttgaacatgctggtcatctttatgtctttgataaacttagtgcgtatggttttaacaaattttggaggtgtgggaacaaaaataacaaggacatatgttgaaacaagtcaatgagaatgtctgtagagcaaaccctgcgcgattggaagcaaacgcgtcattataggttaggcaatagcaaatgcaaaatattttgtatgtatattcgacaattttagga

SEQ ID NO: 82206 - DNA, 106 bp, Heterodera glycines
  Genomic contig location: Contig_ID=SeqID_17676; Location=1540..1645; Strand=-
  SCN-specific regions: Sequence locations=1-106
gtggtatcattcaacttcatgatgcgtatcatattccgcaattcacaactgctagacagtttgattaccctttggtctaccgacaccgacaaacatctatgcccaa

SEQ ID NO: 82207 - DNA, 581 bp, Heterodera glycines
  misc_feature (50)..(50): n is a, c, g, or t
  Genomic contig location: Contig_ID=SeqID_17679; Location=2168..2748; Strand=-
  SCN-specific regions: Sequence locations=1-160,195-285,332-394,416 -423,445-546
atgtctcttaggggattttcatcctatatttgtggtaagtttagctttcnatagagtatatattaatgcagattatgtattacctaatgtatcgttgctttaaactcattgttgtgcaacgcaatgaagaaataattttgactattggcagcattgtttcaaatataaattttaattaaatttattttattaaactagcgcctttgtgttttattagttttatattagggttaatcatttgaaaacaaaattatttactttctttattcaatttgtttttagtacaattttattaatatattttgttaattttggtattaataaattttatgaaaatcatagaatcttaagtttatttcttattatttttaggtggtatatttttgggtgcaattgattttgaatttcaaatgatcaacatagaattttataattatttcttgtcaaatatcgtttgagcgtgccactctggcttgtctgtattcagatttaatccagtttaaaaaccataacccaggctttttctcatatgtgtattaaaaagagattaaaaatttttaaattaattaatattaaataaa

SEQ ID NO: 82208 - DNA, 627 bp, Heterodera glycines
  Genomic contig location: Contig_ID=SeqID_17681; Location=158..784; Strand=+
  SCN-specific regions: Sequence locations=1-236,275-315,339-372,394-627
atgaaaaaatttctttttttgacaattataattctgttgctatcaaatactcatagttcgaacaaacagagacatcggaaacaaagggcagtttcggctttagctcgtttgacagtggctttatcacgtataggcacctacattaaagcccacccgtacattaccgcctcgacaattttgatggaaatgggctcagtttccctcaacatttatttgctaatacaagaaataaaaggttaaaaatctttattttttgaaaaatataattattttagcttgcgaagagaaacagatcttaaaggactttttcccatttgtgctcactctgaattcttatgaattcagtgtgaatgttgatgactacaaccctggatatatttttggaaaaataaataccgaaatagggcgaccagtggaagagatttgttttgcaggtcagccacaaaaaattaattcgttaaaaaattcatttaaagcaccgaacaaagtcacccgaaagataagaaaccgaaaagatgacctcggcattttgttgctgtacgcaattagacagcaaagtcggctggaactttttgaatgtccttgacggatttctgttcccgttggcccttgggaaaggcactttaa

SEQ ID NO: 82209 - DNA, 283 bp, Heterodera glycines
  Genomic contig location: Contig_ID=SeqID_17681; Location=1015..1297; Strand=-
  SCN-specific regions: Sequence locations=1-283
atggctacccgacttttggggatttgcaacttggggacccgacttttggggatcccgacatttggggacccgacttttggggatccgacacttagggatcccgacatttggggatcccgacatttggggacccgacttttggggatccgacatttggggatcccgacatttggggacccgacatttggggaccgaacgacatttgagcaaaagacacttaagaaaaccacggacatttggcaacccgacatttagggacccgacatttggggatttcaataaa

SEQ ID NO: 82210 - DNA, 1165 bp, Heterodera glycines
  Genomic contig location: Contig_ID=SeqID_17681; Location=1313..2477; Strand=+
  SCN-specific regions: Sequence locations=1-634,670-789,830-1019,1041 -1064,1086-1165
atgcgcgaaacgcaaattaatttaactgcaattagagtgaacagcaaaaatgaataccgaaatattaaagaaaatataaaaattggcgaatgttttgacatttccatccctcagcaggaaaataataaaacgaaaaaaatcacttttcaatttacaatttatgtcaaaccattagaaaatgagtaccaaccgccggcggatgaccacgacgaaaacccatccgatgaggggccgtatgaaaaccgaattttagacatcaaaatggacgacattcggacaatggtccgacgcaacaactttgtgatccatgagcctaatccgtcaatggtgtacacgttcaatttgggcaaaatcgatccgccagggtttttgtggaaacgcaaaatttttgttttgccggagaatgatttgagcaattaccatgcttttttgtatgccgttgcctacagaaatcaacggattcaggacaatttgaatagtaaaatttgcacgaaactgttgggatatgcgccatttgtgaaaattgacaaagaaattgcgcccacctttgaaacggatgacaaaagggtggaagtaaattttaaaatcccgaaaaattagtggccaataaatgggaagacactaaattaaatggatatttattgtttttaaaaaaataaaataaaaatagtcgcaaagttattaattaaaagaagagtaagtgaaacattttttcaccttcaataattttttgtgcataaatttctttgactaaaataggtatttacactaaaatattaaaggaaataaactaaacatttattcatttttataatttcagctaaataatgaataccaattaacaataccaattgatgcgagcaatctgttcaaacattacatttttggcttcaatttggttatttattcctatgaaaaggtcaatcattatttatataagcattgaaagcggccggcaaccagaaggaattagctaaacaattcgttaaatttggttcttaaggattttgcgtgaaagatttttctttacaaccaaaacacataattagtgccaagatttttagttgaaaacaaaaatccataaagtccttcaaaatcgttgcaaaaaaaactttttgaatattaaaatattgtttcaatttattacttgcttttatttcataaa

SEQ ID NO: 82211 - DNA, 815 bp, Heterodera glycines
  Genomic contig location: Contig_ID=SeqID_17682; Location=346..1160; Strand=-
  SCN-specific regions: Sequence locations=1-199,221-239,261-322,345 -457,612-644,683-815
ttattaccaccggagattgccggtgaacagcttcgcttcatcggccttgtgtttggccagctgctttttcgtgaaaatccaatctttgatgaagccaaaaatgagtttcatttttcggctaacattgagcccgaaattgatgcgtttaatccaacggagtgccaattaatatccaatcaatttgatcgccaattaaatgcccaattaacccaattaattggtcaaccgttggataaccctgaagaaagtaaaaatgaggagaatttttgcgcattttttgaatttttggtgcgacgaattgccaacgatcagatggaaccgggagacaaagaaaaatgggcagaacttgagcaaaaatcacttctgatcgccaaatatgggcctgagtttccgttaattgcgccaattatgcgcgcttttatcgtttttggcacggatgcgcccaaattaattgtgctttataaagtaattttgaaaaattattttttacatattaataaaataagaagaaataaaaaaaaaattttattaggctattttttgcaaaaaaaaaaattatttttaataaaaatgaactaataataaatctatatacatatataattaatattcaactgaccttctaaaaagccttttaaccatacaaatttttttcaattttttttaattttaaaaaattatacggaaaattatgtttgtatttgttctataattaatttttcaggctttgttgggcggatttattaatgaagcccaattggatgcatttttgggtgaatattttgattcaaaaacactgaaattggagacaaaat

SEQ ID NO: 82212 - DNA, 995 bp, Heterodera glycines
  Genomic contig location: Contig_ID=SeqID_17683; Location=491..1485; Strand=+
  SCN-specific regions: Sequence locations=1-205,253-483,507-578,600 -806,840-873,896-995
  Gene Ontology: Mol. function=helicase activity; Cellular component =chromatin; Biological process=establishment and/or maintenance of chromatin architecture
ttttaacgcaaaaacaaaaccaaaacatttccatttttcaaatcattttttaacgcaaaacaaaaacaaaacgccacatattgcgaccgatgtgggtaaaatgaagaatattttaccaaaccaaatcccataattgctggacgttaattgcgggttttaaactgtatgtgaaatcctgcaagggtaccaaatttcgtcctcaaaatttttaaagtaaaaattttttctcatttttgttatgatatcttaaatcattcaaacaacagttctgtctatattatttaatgctattatgttgggtaaccatcaacaattaactattgccagtgcaaatgcgtttttgcttcaaaatggtatgtccgttattttagtatagatatcacttaattgatcgatttaggacttaaactgagaaaacatcagattgaaggcatcaaaacacttttatcatggcacaaagagggccatggcggaattcttgcagatgaaatgggccttgggaagacatgtcaagcaattgttgtgggagctattctagcggaccaaatcggcaaaaggatgcgcatgttggtgatttgtcctctttctgtgattagccattgggagaccgaagtgagcaggtaagcatatgatgaaatgatcgagttttgtttcctgttatatattacaccgtccatttaattttctcgtgtagattttcttgtgatcgcttaacagctttccgttaccacggtgacaaccgaaagtccctcgagaaaatgagccactggaatgtgcttttgacaactttcgaaatttttttgaatgatcatcggaatctgcctttcaagagttgggacattgttgttttcgacgaggtttgtttctataactgtcatatattgagctaaactgaacatttattcattataaggcccatcggctgaagaacagtgaatctctgacgcaccaggcactgtccaactgtaaattcgactggcttttgatgatgacgg

SEQ ID NO: 82213 - DNA, 380 bp, Heterodera glycines
  Genomic contig location: Contig_ID=SeqID_17685; Location=641..1020; Strand=+
  SCN-specific regions: Sequence locations=1-68,90-226,248-380
atggaaagaaaatgccgtcaaagtccggtgccgggagcggcggagcacggctacaaattcggcggcatggactttgtggaccacatcgagttcaacccgtgctcggacgttggcgaaccgtttgacgagcgacagtcgcgtcgcgaccttcacacgggcccaccacggcggagaggcgacttttacgggttggactacacgacgatgttgccggacggacagtggcgacagcccactgaatgggaagcggaggacgcgcagaattaccacggctaccaggcattgccgccgcggaagaacttccgcctgtgcgggcgatacaccgcggacccggacgcaccactgaacatgtgagaaaggcggaaggggaggcggaaaga

SEQ ID NO: 82214 - DNA, 598 bp, Heterodera glycines
  Genomic contig location: Contig_ID=SeqID_17686; Location=160..757; Strand=-
  SCN-specific regions: Sequence locations=1-81,115-115,138-138,592-598
  Gene Ontology: Mol. function=structural molecule activity; Cellular component=microtubule associated complex; Biological process=N -linked glycosylation
atgaatttcccactaattttgctgctctcgttggcgttctgtgcgctgatcatcgaagcatgtaagtggaagaattaatgctttataatttaaatttataattgaatttatttagacccgaaaaacgatgggccaattgtgcgccgagaggcagacaatgaaaaagcggcaaaagcgcaacccggcaaagaggagaagcaagcggtgaaagcggaggagaaagaggaagaaaagccgaaggacaaaaaggaaaaacgcggtgcagaggcagaggagcagaaagaaggaggagaaaagaaaggagaagaaaagcccaagggaaagaaggagaagcgcgctgcagagaaagaggaaaagaagacggaaaacaaagaagcagagaaaaaagagaatgaggagcaaaagcctgctggcaagaaggagaagcgcgccgcagagaaggaggaaaagaagtcagaaagcaaggaagcagagaaaaaggagaatgaggagcagaagcctgctggtaagaaggagaagcgcgccgcagagaaggaggaaaagaagtcagaaagcaaggaagcagagaaaaaggagaatgaggagcaaaagcctgctg

SEQ ID NO: 82215 - DNA, 1426 bp, Heterodera glycines
  Genomic contig location: Contig_ID=SeqID_2891; Location=531..1956; Strand=-
  SCN-specific regions: Sequence locations=1-139,161-214,248-281,303 -310,332-557,581-746,772-834,856-932,954-1017,1052-1262,1284-1426
atgcgcgagaacagagcacttcccggcttatggaattttccttacatttggatgtttgaacaaattcgacaacgtgccaatgagttcgacattgtaaataaattgagaaaattcactaaataaattctgttaattaatgccaaaattcctgttttatttcttattgactaaagagcaaaaaatgcgggaaaatttgaaaattccaaagtaaatgaaattaaaaataaataaattaatattatttaatcacgaattgacaatcattgacccaaatgatcaaagattttcagatccatttcaacaccattgaacatcttgttcatatgaagccgtacattcacaaagcattgacaacactgcatgcacagcccggtggcagtacggtagacaacgagttactgtcccaattaacggcacatcagcaactgtttgatggtgccaatgttgcggtcagcagtgatcaagcggctaagagtttgaaagcgaaaaaagcgcttcgattttgtcaattgcacattgtcaaatcgtacaacggcacatcaaatcaatggcaacaaattgctaatgaatatgtgaaaatttaccgcacaattagccgacttaatgagttgaaaaatgtcaaagcatcacttttgcctgctgttggttcgtcatcaattgctaatgggtcattagcagaagcaaaaaatcaagaacaaaaattaatgttagtgagttaatgagttgtaaaaccaaaatcacaaaagtaaaaatttaaaataaaaaatttaactcaaattctcaaacattcaacagtgttgaaaattaaaaattacaaattatcagccaacgtcccaggagaaaagtgattttgagattttaaaagcatacctttttaacaaaaaattttgttttaagaaaaatttacctttttggatttttaagcgaaaatgaatttttttatttttataaatggatgttaattttacttatgaattttttttctgcttatcagatttaactcgttaaaatcgattgataatttttatttttaatatatctttttaatttagtgcgaaaatgtttatgatattttaaacaaatcaaaacctttgcgcattgccattgtcactccgccaattttggacgcattgcccccaacaaaaggtggcggcacggaacgaatggtctactttttgaccgaacaattggcacaacgtggcaacaaggttaacactattctggtgtaaatagaaattgtccttgtattatgacgtacttgaaagattgggaaaaaagaaaatacctaggagggaatcgaaccctcggcctccgccggtgcgttgatccgcttctctctaagccagtggtgctcttaccatctgagccagggctgttttggcgacgccttcaaaaaattcggaaatcggaatttcaacggattaaa

SEQ ID NO: 82216 - DNA, 1311 bp, Heterodera glycines
  Genomic contig location: Contig_ID=SeqID_2892; Location=855..2165; Strand=-
  SCN-specific regions: Sequence locations=1-357,420-555,585-1089,1123 -1275,1297-1311
atggagaatgtaacccacaaatttttaggcattttcgatctgaattggattggcacggtgcacaacggcattccgcttgaccagctgacatttcgacctaatcccggcacatccgagtgcccctatttggcatggatgggccgaatggcaccggaaaagggcgtggacattgccattgaatttgcgcttcggtccggcatcaaattgaaaattgcggcacaattggtggacgagcacaagcattcatattggcacaagcaaattgagccgttgatcaatgctaatcaacatttggttgaatatgttggcgaaattggcggtgacgaaagagagtgcgtttgccattattttcaatacattttaatttatgatttttaattaaaaaagaaataataattacataaacaaatatatttttagcagttttttgggcaatgctttggcatttttgttcacgccaaaatgggacgagccgttcggattgtccatgattgaggccatggccaccggaacgccggcgattgcaaatcggcgcggtgccgtgccggaagtcggtttttatattattcataaaataatttattctttgaaattaccgtaagattaagcaaaacccaagagatatactaatatttaaaaagttccattactaggtaattaataatgccactgtaattactggtatttagcgaccgttaaatttatcacaatcacagattgtgcaaattggccgcaacggttatacttttgactacaaagatcggcttggtgttgaacaggtggccaagtttgtgcatttgatcaaccaagcggccaaattgtaccgtgccacggtccgacaaactgtcgaagaaaaatggtcattggacaaaatggccgaaaattatgaaaaagtctatcgccgcatgttgaacaaaaatttcatagcaaactgtcatgatcattagtagtttagtaaatattatatgaattatatatattacaggatgatgaacacaattaattgacttggaatttatgaaattaattttagacagttgaaaatttcgaatattttttcaggctaatgctaaattttttgctattttctatttaaattaaatttattattaaacttattatgtaaacggtcatcatccctgttgcatataattagcataatatgtctagtgaacattcgtatatgcctaaactttgaatttgtgtatatcagatatgcaattatttaattagttaattctgtctatattgttttttgttataactaaccacctgtattgttttattttgtataaattgagattaaataaa

SEQ ID NO: 82217 - DNA, 865 bp, Heterodera glycines
  Genomic contig location: Contig_ID=SeqID_2893; Location=296..1160; Strand=-
  SCN-specific regions: Sequence locations=1-573,597-712,734-763,789 -807,829-865
atgcgtgagaacagagcacttcccggcatatggaatcacccgtacatttggatgtttgaacaaattcgacaacgtgccaatgaattcgacattgtaaacaatataaataaattcggtcaattagtgcctaattagttggaacaaatattgataggctaattaatcagaagtgctaattaatgctcgcgtcttaataatagtcctagaaatatcactaatccgttgatccaattcttatttacattcctgaaatcatcaaattaatcggtcgtgatcttttcaaccgaaaaaatcactaaattttagatccatttcaacaccattgaacaccttgaacacatgaagccgtacattcacaaagcattgacaacactgcatgcacagcccggtggcagtacggtagacaacgagttactgtcccaattaacggcacatcagcaactgtttgatggtgccaatgttgcagtcagcagtgatcaagcggctaagagtttgaaagcgaaaaaagcgcttcgattttgtcaattgcacattgtcaaatcgtacaacggcacatcaactcaatggcaacaaattgctaatgaatatgtgaaaatttaccgcacaattagccgacttaatgagttgaaaaatgtcaaagcatcacttttgcctgctgttggttcgtcatcaattgctaatgggtcattagcagaagcaaaaaatcaagaacagaaaattaaagttagtgagttaatgagttgtaaaaccaaaatcacaaaagtaaaaatttaaaataaaaaatttaactcaaattctcaaacattcaacaaagttgaaaattaaaaattacaaattatcagccaacgtcccaggagaaaagtga

SEQ ID NO: 82218 - DNA, 620 bp, Heterodera glycines
  Genomic contig location: Contig_ID=SeqID_2894; Location=1068..1687; Strand=+
  SCN-specific regions: Sequence locations=1-166,224-280,302-494,518-620
atgaatcatagaaaatataattccttatacaatattgactgcaaaaaagacgtgtaagtgaaattttcgtatgggtatgatttttttttttgatcggagatagaatactgtaagcatacctttttttttgcattttccgcccatagatgaaaaaagatatttgtgcaaaaaatttttaaacaaaaattgctaatttttatataattcttttttcaatttatatcaatcagcatcaaagatagcctcgagcaagcactaattaagtatcagctttctgtcattaatttaattttttggaaatattgaaaattttaaaatggattcatatcataacattttttgacagttcagctgcaaatgtcggtccgcatatgtcggtcgcactacggataaaaggcaagctgccgtttattaaaattgttcaaaataggaaggataaacaaaataaccaacagaaaatagaaacaattcataaattcgatgcaattaaagaaaaattgaaacagaaaggaaaatatcaatgggaaaatagttcaaaaattgagacaaaaattggaaaattattaggcgcaaattgccaaaaatatacaaatggaaaaaagaattgatgccaaattata

SEQ ID NO: 82219 - DNA, 2825 bp, Heterodera glycines
  Genomic contig location: Contig_ID=SeqID_2894; Location=2079..4903; Strand=-
  SCN-specific regions: Sequence locations=1-129,171-179,201-551,573 -574,596-806,844-1090,1112-1182,1209-1332,1354-1506,1545-1743,1789 -1872,1895-2825
atggaagtgtacaaatcgcttggcgtcgatttggtggtgttgcacattgtgtccgcacttagtgcagtgttcaaactgatcaaagcgtacgaggcggaagggcgacttgcagtgagaatggtacgagcaattttgggggcagaaatgaaatttctgaaatttaattttttcgactgaattaacaaaaatcgatttcaaaaaacgagagatgaaccaaaaagggatagtgccagagaaaaatacgtatctcattggcgtattttttcggctttgtctcagttaatagaaaaaaatagaaatttcctttttcgaattaacgttttttctcctagattttaaatccaatacacaattttgcaacagtggtagagaaaaatgttttaaaagcttctccttttcaaggctttcgaatgattccaattttaaattgttttcaaaaaatctgaaagattttgttttaacacttttctacttggaggctccacgatgcttttctcaggcctccaaaaatttttatagcaccattcggtttaaactgatcaaaattgaaaaaattttaggaattataaaatgaaatacaagaatttattaagtaaacaataaatatgcaaacaaaagaacttaatgttcacagatatagcaagatccaaagaaatttgattccagaggttaaactagggttagacggggttcgggaacccgaccggggtccagacccggacaccagcaggctttttcagggcttttttataatttgtcaacaaatcttaaatgcatttgcaaaaaaattcttaattttttatattccgcacaaaaatcaataaaaatttgtttttaatcaattatttacctttccggtttgtagggattcaaattaccaattttgaaagcgatgaattttgatcccgaattgcaaattgaatattcggggcaattagccatggcccacgaatgcttttacgagtttcgagaaagtgccaaattcatttcattgttggacttggacgatttgcttgtcacgacacaatttacttcgtttggcgacgcattaaatgccgcccttctccaacacccgagggcaccattcttttacataaataaactcgaaagtggcattttattaccacggcacaaaaaagaatcttcaagaagtttgttttctttataaaatcaaatattgtagaaaaatggaaaaataacaaaaaccatcatactgtataccgtatttccctaaaatagagccctgagggctttatttttcattttaggggagggggctcgaatttacgaaacacggcatttataagagattcctgtaaaaggggcaatccgcattttgatgataattttgttataaacatttgtaaaaattcaataccattctgtggaataatttttggttatactttaatattaccatattttcaagttttcacattctccgtttaattctcataataccgctttaattttgacgattttatgccaataaaatttaaactttcgaaatttattgaattaaaatttctaatttattattaaatgagtttcatatttcagattttgtgaacaactttcgtgaattaattttcaccaaaaaattgtacaacagtgaaaagcttgtgctcagaccgccactaattgatgccttttgggtgcatttaacgcgtcattataaagggaaagacaaaccggtgcaattgtccactgagtatatggcaattttgcacctttcaaaggatgtaattaaaaaaaataatttaattgttttgaaattattttaaaaatgatggacttttttgtgacagatccgagcaaacgcaacaaacggttacaatgacaaattgctaacaaattttgatggacaattgggaaacggaagtgcttttctgaacgacacgaagataatgaaggtacagaaacattgagaagcacaaaattaacaaaatgaaaaacacgaaattaatttaatatttcgttaaataaaatgaaaaaatgccctttagataattggccatatgccgaaaaggcattattattttgacgccattcggcattgttcccgcttcatcaacaattacccaaatggcatcttcactatcccttcaccgtgcctctcgtacaaactttgcgatttaccgaaggcaaaagtggaatgtaccgtaaccaaaagcaaatattacagaagcaccattatgccaatccaagtatacagggtaattagtggaaataattaatttattattgcgcactttttaaacattcaggttcacgttttaaagagaaccctttttgtgaagagaaaaggcggatgctttgccagaaaattgagattttgacttttatttattgagaactatattttttacaaaattggaaatcttatgcagaattttaattgaatttgaaaaaaataatgtcgaattttcgtggaaaaattattgtcaattttttttttttgttcatttggcattaaattaaggcaaaaacgaaaaagctaaaggaatgttttgacaaaatgccaaaaatatgtcgatcaatttagaagtcatttgtgctgtagtgacgctagagactagagtagagcggtaccggtactggtactgaaaaaaacggtacaactgagtacctagtaccggttttgaccggtaccggtactagtgcctgtttttttaccggttttcccagccaaaaagtaccagtttttcaacccgaaaattaccggtaccggtttttttttacaattaccgattaccgctctaccctaatcttaaccgatagattaggtaattcctgaaaaagccagtaaattgtaattaaataaa

SEQ ID NO: 82220 - DNA, 1000 bp, Heterodera glycines
  Genomic contig location: Contig_ID=SeqID_17688; Location=176..1175; Strand=-
  SCN-specific regions: Sequence locations=1-93,115-364,387-402,468 -692,715-749,771-787,810-1000
atgcttctccgtttctccctcactgttcaacttttgctgcttttcttcgcttttggtgcgtttcttcccccccccccccaaatccgtcatttttaaacaaaatttccaattttgagaagtttttggcgctgacccgccagaaggtacacaaaatgaagaagcccaacgagacaacaaaagattggaaatggccaggaaagggctgaacgttcacatggtaagtcatcagagaggggggagggcagtgagcccggggattaatttcaatgagcggtcggtaaaattatgattccatttttgctcattagcttttgactggttcgttttcagcttttttttggttcgaaatctgaaaatcaaatgtaaaatctatttaaaaaattggcttattcgacgtgaatcaaattttatattttttgttattgaaaatacttctaacaaatttataaattatgatttttaaaattcgggtattcgaagtttttgattttggaaattgaccaaagaattgtcaaaaacgtttcctaacagtgattgtccctcttttctccacagttttcctcccccaatttcgccccaatgtttggcattatcgccggcctttccgttgttcttatcattgccattgttttcattgtcgtcggattgctcagcatggaacccgcgaaggattcggtcggttggggcggccctaacataaaatttgacattttatgtgcaagacaacaattcctttgcttttttttcataaataattgttttctgttttatattatctatcggatgacaacaactcgcctaaagaaggactgattgtgagcaaagtgtgggagagagtgccgtgccgaaaagtccgtcccccattaaatgatttgtttcatttgatagtgaatggtcacccaccctttgtcggtgttgcaatccgcaacgaatcatcaaaacatttaattttatagaatgtctatttcttcccattcattgtaatcatgtagagaataaa

SEQ ID NO: 82221 - DNA, 89 bp, Heterodera glycines
  Genomic contig location: Contig_ID=SeqID_17689; Location=761..849; Strand=-
  SCN-specific regions: Sequence locations=1-89
agtgtacgcgtacacaaattcgaccctccaattggccattctgtccacattcaccgaacttctttaccgtttccaagacattgccattg

SEQ ID NO: 82222 - DNA, 1297 bp, Heterodera glycines
  Genomic contig location: Contig_ID=SeqID_17690; Location=1..1297; Strand=-
  SCN-specific regions: Sequence locations=1-184,206-427,451-711,733 -777,802-870,892-955,980-1297
  Gene Ontology: Mol. function=transcription factor activity; Cellular component=transcription factor TFIIH complex; Biological process=DNA repair
ctctccgggccaattccgtttgagttgaatgtgtttactatataaggtgcgaattgtaggttgttgtggtgatcattcgcattttctctcccaatttgccccccccccccctaagaattgtttgagtcgcgtccgtgcgtcgtcgccattttccgtcttttgcccgcctttgcccaacaatctgtgcttcagctgatgttccacaaatccaggcaaccacgtgctttgctttaaaatttatctccataattgtcgtcattttgtttaaaattgtccttttttgaatgttcctttagcgattggcgttcgtggactcggagtcgcttccatttggccatgtccagcgccgttcagctccttttccgactgcgcattttggaaggcaattcgaacggcgactttcaaattaatgtgtcatctttccacttgaatttcacttaaatttaaaaattgcctcagcttgatttccgcatgaattacgtctccagccttttggccaaccctttggaattgtccaacctcaaaatgcaccatttggacgaggaaaaagcgcgcaaagcgaccaaagacttaatgggcaaaagtgtggagcgatgggagagcattctgtgctatttggcactgccgagcgaagcggcggagaaaagcgtttcggagacgacgaaggaccttttccaattcatcggattggtgcgcggaagtgcgccgattcctccaaaaagcctttcaaaacattgtccgcttttgaggagccaaagagcccgaaatctcttcgattggcttccaatttttgcttttgggccgctccgaacaaatttgggcctatctgatccattacatgcgcttcatcgcttcaaagggcgaagaagtgtttcccgttttggactttctgctacggctcacgctttgcatcaatggcgacgatggtatttaattagaactgatccaattggccattttatttttaatattaaaaatagcgcttgcccaaccgctgaggctcgacccgaattggcccgaaattgtgcaggcattcgttgtgactctgcgcgaattgggactgattttcatacgcaaacggaaggacgggtgaggcaaaaatcagcaaaaggaatggaccgtcgaagaatgactcattgtccgatggtcactttcttcccttttcagttggtttctgctcactcctctgatgactcagctttccgttgccgcctcagctgaagccttagaggaaaatgccggccaaaatggcgtcgctttgcgcaattctccacttacaaattcacacgcaacaaat

SEQ ID NO: 82223 - DNA, 693 bp, Heterodera glycines
  Genomic contig location: Contig_ID=SeqID_17692; Location=151..843; Strand=-
  SCN-specific regions: Sequence locations=1-53,75-170,193-693
atgataccaacaatgtttgatttggttgacaaagaaaaaagttatagtccaaaaactgcgctggcgccgaaacgcgcggcgccgaaacgcgtgtgtcccctcaaaattgactcggtgtgtaaaattacataaacactttttatgactaaattaaaaaaaaatcgaaaatataccatgaaatcctccccctaacaaataggtgttgctatagaagtactgaaaaactttttttactagttatacaatttaccggtcagggacgttttcgtaccgccattttcgtaaaataggcgctttaggcacaaaaaccccgaaataggcaaaaataggcattataaaagtcatcgtagacaccccaaaccaagcggaaaatatgtttttcgggcttatcctatgcctatcaagtgtgcaattgcctaaaaaaggaagccctacaaatcagcattaaattcaaattcaaaaagataaatttttcaagccaaaaatttaaaactacgcgataattggcataatgttattcaattttaaatgaaagcactttcctatacagtataatacagctctccgcaaactcgtttaatctgcttaactgtctgacgatgagctgcattttgtaaagttttacaatttatcatttagaagctatcggtttgtttattcaatgcgattaaaaaataagttccaacaaataaa

SEQ ID NO: 82224 - DNA, 890 bp, Heterodera glycines
  Genomic contig location: Contig_ID=SeqID_17695; Location=1028..1917; Strand=+
  SCN-specific regions: Sequence locations=1-282,313-890
atggatcctaaatcgaaaaaagaggagaaagccggttcagtggcgggtgctcgagaggatgctcgagagtcgcttcaactgcgcgcggagcagcacattgaactccactcatacagagatgcgacggacgtcaattaccagcgaatggtaatttgatcatttttataaattggtcaaaagtgtacggtatctctgattattttttgtccattttttagtgcctggacagcgaggcatcagccggcgtgccgccgaaggaattgccaaggcggcacggtaagcaaaaaaataaataaataaaatatatttatagtgaacataattattcactagggcttgaacttttatatttaacacacctaatagctcaaaaaagcattttaccttttctttcaatcatgctcagtttttggcacctaaatttttaatgatgctcaaaaaacaaatttttgcatttttgattttttaatgattttttttatttctacggaaaattttgaaaattttgcttttttctttcaggtccctgatcaaggccttggagctgcgcagcgcgtacatgacccgcattggcacacacttcccgacgacgacgcgcaatttcgtggacggtaagaccatcacaaattaattattggcttaaaatattttgggtttttcagcaaaatacccggacgaattgcgcaagcagaagctgaagagcaaaaaacatgtaagcgatagggggggggggtttattttgccatgctttatttatttactccattaagccgacacaatgtacccactcgaaatgtcagcggaacattggggcgagcaagtgccgacttacgagcagcaattccaattgcgccgcgccaacggaattgtaagaaaaagatttggaaaaa

SEQ ID NO: 82225 - DNA, 1816 bp, Heterodera glycines
  Genomic contig location: Contig_ID=SeqID_17696; Location=763..2578; Strand=-
  SCN-specific regions: Sequence locations=1-626,648-785,807-982,1004 -1100,1135-1280,1302-1816
  Gene Ontology: Mol. function=pre-mRNA splicing factor activity; Cellular component=spliceosome complex; Biological process =nucleobase, nucleoside, nucleotide and nucleic acid metabolism
atgatgtgtcggctgggagacgctgtgggctattcggtccgatttgacgagtgcatttcggcacgcactcacattaaggtgtgtttggcatgccatggcaatttttgaacgggtccgattgtttgttcccaatctgtccatgccatttcttgcctcttcttcagtttgtcacagatggaattctgttacgtgagctgatgagcgacccgttgctgcaggcgtactccgtggtcatcgtcgacgaggcgcacgaacggtcagtgaacacagacctgatcatcggcttcctgcgcaaaatcgtcgccattcgcgacgatctccgcgtgatcatttcctcggccaccatcgaagccgaggtaaaaagcggaaaaagacaaattcggacgaaacaatcagcaatttggctttgaaagaatcaatttctcttcgtcgatgatcactttttttttgcttcagcttttccgcgactttttcgaactcaacgacaacccacagcaaaagccggacaaaaatacggccacaataatttctgtcgaaggtcggatgttcccggtcaccactttctacacaaaagtgtacgttttgctcacaattagttttggaattgatttatgacttactgcacagttgttttaaactttaaaatgactccgttttattttcctcttttgccattgttttttttcttttgcttaactctctccacgactttttcagtggtgttcccgactatgtgcagacgacagtcgagactgtgctgcgtttgcatgacgaggagcccccaggcgacattttggcttttcttacgggccaagacgaagtggagaaggcgtgcgatttgttgcgccacgcggccaaaacgatgagcaaagacaaggacaaattgttggtggtgccgctttacggaggtgcgaaagtgtccgaccgatcagaggggcaatcagtgaaatgaaaaaaacaaacgatcaataattgactgatcagagagaaaccaaaagctgatcagtataagaatagatgaattgaattgagttgtgagttttggatgtccgtccgactgatcggtgggatgggcagtcaaattggcactgattgactgaacttggcctcttcccctcctcctttccgcctttgttaggtttgcctgcccgtgaacagttccgcgcgttcgattccgccccctatcagagcagaaaggcgataatcacgacaaacattgcggaaacgtcggtgacaatcgcaggcgtttgctacggtatttttgtggggaatctgtacggtttttgcggacaaaacattgtgaaatagatttttgccactatttaagtcattccgatttttatggcacagtgatcgactgcggtttcgtcaaaatgcgcgtgttcagccccaaactcggcatggaaacactgatgatcgtcccctgctcaaagtcttccggtcagtcaaatcgtcttttatttgaattttccattttcgatcatttttctaaccgtttttgccattcactcccatcccttgccaacacccgacattcttttagctgaacagcgtgccggtcgtgctggacgcgtacggcccggcaaatgttaccgcctttacgctgaaagcgaatttcgacgcttgcgcagcgcgacaccgcccgaaattcagcgctgcgatctctcctcggtggtgcttcggatgaaggcgcttggagttcagaatgtgctcaggtgggcggacgaaagtacaaatttaaatgcaaaatcgagaaattaaagaaattacgctcggatattcattcattcactagacgaagcgggactgtaataaa

SEQ ID NO: 82226 - DNA, 2414 bp, Heterodera glycines
  Genomic contig location: Contig_ID=SeqID_17697; Location=878..3291; Strand=+
  SCN-specific regions: Sequence locations=1-735,757-821,850-968,990 -1135,1157-1568,1590-1911,1934-2016,2038-2414
cctttcctctacacggcgcgcgattgctgaccaacagcaggtgttggacattctggacgtttgtgaaatcgaggcaatgccgaccaaggttttcccggatgggccaaagaaaggaaggaagacccagacttctcaaagtggaaatgccaacccgaaagatgacacaatcatttctccgcaataaaaaccgacttaaaaactccaaatttcaagctgtctctgtccgtccgtctctctctcctgaacaactcaaggagcggcataatttgatcaattgtttgcagacagcccgcgcccaatttcctaatcacaatttcattgtttatgctggacacatcattccccgaaacgatgtctctgtttttcgtgatgaccctggtaattattcttgtttttgccataaatccaattcataaaatcttgcgggaaccacccatactgaaatttcaaaaaattttacaaacgtaaattccggtaccgcaagatttttcaaaagtcctcataaggttaataaatgtatacaaggtgctttagttaatataaggtctatctataacaaatgtgaacaaatagaaacaatttttgaatccttaaatttagactttatctgttttactgaaacctggggtaagaatgaaaaccaatttccttttcattcaaattttcttcaaaatcataccatttcttacactaatagattgaataagcgtggaggcggcatagcttttgtcgctaaaaaatatttgggtgtgaaatactaatattgcaatttcaaaattacaattcactaaatttgattcttatttatcgacctccttctactatttaaaaaataccaaaaatctttttaaattccttgacctttacatttcagaaaactgttgtatacttggggattttaaccttggaactaaagatttaactataaaaaataaaaaacctttccctttaagtaattttggtaatttattttgtgatttctttaataaatataatttgacatcctgcattaatgaacccactagggagcaatccttcctagatttaatcctttcaacaaaaactgacttaataaatgcggtagaagtaaaaggtggacttttagatacagatcatctaacaattctttttgatttttgtgttttaaagcaaaatgcaaccaagaaacaaattgttcttaggaaacacactaaataatattcctgaaacttttttatctattaagtccgccaaaaacttttacccaccgcatttattggcttcaattagggaaaaagcacggctatataagctaatgaaagaaaatagaggaaaatatgaacctttatataaaagtatctccttacatattaagactcaaataagaaatattcaatcccgtaaagaaaataaaatactatccggtgataagaatagattattttcgtatcttagaaaatactttaagccagtagaggatccaccagttattcagtataatactttgtttgtttcagactcaacttctaaagcggaaatttttgcaaaaattttttccgaaaactttactgtaaataattattctcttgattttgatacttctttttcttctccaacaataaacgacgttgaatttaatattatttctgttggtaaagttcttaaaactttacctaacagaaataacacatcaccggacggtattacctttagactgttaaaaaattgttctctttcgtttactccttttgttactgaaattttcagactctcccttgatacagggaagcttcccactatatggaaacaatcgattattatccccttgcataaacaaggggaaaaaagtaaccccatgaactataggccaattgccttaacttgttctttatgcaaaattatggaaaaatttattgtttgggctatttccgattttcttttaaagaacaatttattctccgaacatcaatttggatttataaagggcagatcaaccacaacacaactaatttcaacccttgaaaattggtatgatggtatttataataataaaaatatcgattgtgtctatatagattttaggaaagcatttgacgtaatcccccataatttacttttatataaggttcataaaattggtattaggggtaaaatcctaaattggatatctgactttctttcgaaccgtacctttagggttcgggttgataatactctctcttctgagtataaaatgagctctggcgttccccggggttctgttcttgggcctcttttgtttctgatatatattaatgatttacctgaattaattcctaaacaaatttctataaaattatatgcggatgatgtcaaattatattccgtgcgtaaaacaaaaaatgatagaattgctatgcaccgtgctttaaatattcttcttctgattggtctaa

SEQ ID NO: 82227 - DNA, 365 bp, Heterodera glycines
  Genomic contig location: Contig_ID=SeqID_17698; Location=784..1148; Strand=-
  SCN-specific regions: Sequence locations=1-26,49-365
atggcgagacgcttcaataagcgatttggaaccaaattaagggaatttccgatcggaaacaaagtgtttgcccgccaccgaatttcccaaaattggcaacagggccaagtttcaaagcgaactggtgtgatttacgacgtggcattcgccgatagaagatcagggcgctaccacgccaaccagcttcgtccccgaaagacgtccgactccgatgatcagctctcggtgatgttcgaaaccttcgacatcccaagaccgattgctgttgaggatcagagggaaatcccagtggaaatgccattggagtacccgcatggcgaacaggaaaattttggaggtcaaattgaccatggacagcaacgacg

SEQ ID NO: 82228 - DNA, 2533 bp, Heterodera glycines
  Genomic contig location: Contig_ID=SeqID_17699; Location=1..2533; Strand=-
  SCN-specific regions: Sequence locations=1-924,947-1007,1039 -1056,1078-1716,1738-1910,1932-2108,2130-2533
ttcaaaaccgacgtggcggtagatggcaaagacatcaaattcgtactcgacagcggggctgaaataattgtgatcgatgaactatcacatgaagtcatcggcagcccccgactccgcaaatgcaccgaaagtggatgcatgttcgatggaacacaagtcaaattcatcggaaagggagtcgccaatttcaaattccgcgatatttgcatcaaaagcgaatattatgtggcaaaaaggggatcgctaaatttgctaagtgtgcaaatgatggacgcttttggactcctgaacgaactcaaggccaaaattaatgcgccagtaaatctgtgccgagttggagacgagacaagaggttttacaaaagctcaaaaaccgtcacaaaatttgacagtcaaagcgcacatcgaccatctcaaagcgtcattccccgaaattttcaaaaacgaattgggccgttgtatgaaatttaaggcgcatctgactttgaaagcggacgccgcaccggtctacagaaaggttcgcccagtcccatacaacgctcaagaagcgattgatggagaattggagcgatgggagaaaatgggtgtgattgggaaagttgaatacaccgaatgggcagctccgattttggcggtgaaaaaggccgacggaagcgcacgcctatgcatagactattcaaccggtctgaacaatgcccttcaagaccaccaacacccacttccgctacttgaggatattttcgcaaccttaaatggaggaaaatatttttcgcaaatcgacctcagggatgcatatctccaaatcgaattggataatgaatcgaggaaaatctgctcgatttcaacacaccgtggcaattatgaagttaagagacttcattttggcgtaaaatgagcgccagccatcttccaatcggtaatggaccaaattttggcagaatttgaattcgccacagcttacttggatgatgtgatcatcgtaagcaaaagcgccaaagagcacgctgatcacttgaagaaagttttggaaaaattccaagaatggggattccggatcaaattggaaaagtgttcgtttttccgagaagagatcaaatatctcggacaaatcatcgacagaaacggacggagaccggacccggagaaaatctcagcaattagcgaaatgcccgcacccacagatgtgccatcgctgcgttcctacctcggaatggtgaaccactaccagcaattcgtcaaaaacatgcgttttgtacgaaaaccgctagacgatctgctgaagcaggacagcgaatggaagtggagtgagaaatgcaaacaggcattcgacaaaattaaggaaattttgtcatccgatcttctgctgacgcattacgatccaacaaaagaaatcgtggttgcagcagatgcatccgaactcgggattggagcggtaatctcccacaaatttcccgacggaacaataaaggcaattgcacatgcttcatcagctctaacaccggctgagaaaaactattctcaaatcgagaaagaaggattggcactgattttcgccgtgcaaaaattccataaaatgatctatggacgaaaattcacgttgctaaccgaccataagccacttcttgccattttcggaagcaaaaagggagtgcgccagtgcagtgccaaccgacttctccgctggtcgctgatcctcctcgcatacgatttcagcattgagtacatcagcaccaatgattttggtcaagccgatgtgctttcaaggctgatcgcaaagggaaaaagcgacgaagatcgagtgattgcatctctccgatcagattcggaaattgacgacattttgatcggatcaattgaagcactgccaattaaatttaaggaaattgtcgcagctgctgaagccgacaaaaccattcaaaaagtcaagaaattttgacgaatggttggccaaggaacgtcggagacgaaagtgccgaaataaagctttttcatcggatcaaagaacagctttgcatcacgagaaattgcctgatgtacgccaaccgagttgtcatccccgaaaaacttcggcagaaaactcttcattcattccacaagggacacccgggaatcaaaagaatgaagcagttggcgagaaattatgcctattggccaaatatggacgccgacatccaacagatggtagaaaactgccaaccgtgtcaaatggaagcaaaggcaccagttaaaacaaacttcaaccgtggccaagaccatctgctccatggcaaagagtccacatcgactatgccggaccatttttcggcaaggaatatttaatcatcgtcgatgccttttcgaaatacccggaggtattcgaaatggccacaaaatcgacagcggcaacaatagaaaagcttcgatatttgttcagccgacacggcatcccggaaattttggtggtccgacatggcacccaatttacgaacaacgaatttgctaaatttatggcccatcacgggtgtcaccacctgttttcagcgccgtataatcca

SEQ ID NO: 82229 - DNA, 1523 bp, Heterodera glycines
  Genomic contig location: Contig_ID=SeqID_17701; Location=754..2276; Strand=-
  SCN-specific regions: Sequence locations=1-6,29-48,70-437,459-491,514- 768,791-1523
  Gene Ontology: Mol. function=protein phosphatase type 2C activity; Biological process=cell cycle
tcattttttgctgttttcgatggacacgctggcaacaacgttgcctttcactccgcacagaatctgctccaaacactgctaaacacagcagaatttcaagcagtaataaataaaatgtgtcgaaggaccaattgttttttttgccgtttaggtgaaggaagaacttaagaccaatggccctaaaatcacggaaaaggccaagtcgcttatccaagacggaattcgcatgggcttcttggagttggactcctcacttggcgagttgcagggaggcggagagagggagagaagcggcacaacggcaatatgtgccattctgaccccggattacatcttctttgctaatttgggttcgtttcctttttgagtgtggagattcacaataagatttaaccagagcaaaaaaaagtgtggtagtaacgatggtattcaaccccattttttggaaatactaaagttatttgggtgataatccttggctttactggtcccataataaaatgcaaatgcataataatcatcatcaaaattttcatatatttgaatcgcttttttgcttaaatgtcaattttttgtaaattgagttttcgatttattgtttcaattctggttcggggttcgaaatgagtctaaacgggtttcagaatcggtttagccactcgttttggcgttataattttgggtgaaaaaatgaatctccatttttaaggcgattcgcgtggattgttaagccgaagaagcaacaccatctttagcacggaagaccacaagccttaccttgaaaaggaacgcgaaagaatcattaaggtaattgccagccaattcaaaggaattttccagttttacttggccataggccggcggttcggtgatgattcagcgagtgaatggcagcctcgccgtttcgagggcattgggcgacttcgagtacaaatcagtccctggcctttgtgtcactgaacaacttgtttctcctgagcccgatatttacatcgttccgcgagacaaagtcggcaaaaaaaaggcgaagggagggcaccatttatgttggcttccctttaggaagatgatgagtttttggtcctcgcctgtgatggcatttacgacgttcttgccaacgaagacctttgtgcgcttgtgcgttctcgactttccgttacggatgaccacaaaatggcttctaaccaagtgttggacgtgtgtttgtcgaagggatccagagacaacatgaccatgatcgtcgttatattcgatgctgcgccgaagattgaccattctcttgtagaatttgaacaaaagtggctgatgaaaatcgaaaaacgagtcagaggtgggacgagggcgtttaatttcccgctttaattcaaatttagaaattttcactgagtcagcgcatgaaattaacgacgccgacacactgacgctgctgctcaaagaggaagggttcgacgactgcaactccatccccagcggcattcacttggcacgacctctgctcgaccgacttctcgcggaaagggagc

SEQ ID NO: 82230 - DNA, 904 bp, Heterodera glycines
  Genomic contig location: Contig_ID=SeqID_2895; Location=1261..2164; Strand=-
  SCN-specific regions: Sequence locations=1-504,526-722,744-904
atgaactgctccttcttcctctgtctcttcactgttcagctgattctgctcaatttcgcagtcgaaggaagagaagacgatgaactgaagagaaaggtgaaaagcgtgggggggcgagagaggagagggatggatgaatcaggggaggattaggggacgaattagggaagcaattagggaagtaattggggaagtagggaaagacaggagaccattacgagagaattgggacgcatgatgggccatggatgccaacctcaaaatgaaaggcccaaaaaactctttggcattttgcagaaacgcaacacggacgtggacgtgctcggcctggtaaatattcacgcgccgtcgcgaaagaatgtgaacgtcgacgttggcggagaagaaagagaccgaaatgacaaattggtcaatgtgaatgtgcaggggcacaggaaaaatgtgaacgtcgacgtgggaggagggcattataatgagggaaaagtcgtaaaatacgaaagggacggagagaggggaagggaagtgaatgtggacgtacgagtgccgaaagtgaaggtggatgtggaccgagaagacggatatccgaagaagaagcgggtccatctgaaggtgctggacaaactgaggaaatacgacagcgaagagagcggcgaacggagacggcaccgcgtggtcaaaatcgaacgggacgggggacgacggcacaaaacggtgtacatcgagagggaaaactgagggagggaggacggcggacggactgatcagcggaaaaaggacggacggaaagagtgatcagcggaaaaaggacggacggaaagagtgatcagcggaaaaagggcaaaacgaaaatgatcgaagccccgggtgatcaaaactgatcagagtgataccggtgcgcaataaa

SEQ ID NO: 82231 - DNA, 234 bp, Heterodera glycines
  Genomic contig location: Contig_ID=SeqID_2895; Location=3517..3750; Strand=+
  SCN-specific regions: Sequence locations=1-234
atgaaagatgaagaggaatatcaaaacaatcgtgttcggcttttcgaaattgatcagacaaggggcattgccgatcgaccacgtcttaaaaaatacatcgaaaatgactcagctattaggcaattggtaattgcttatgacgcgaaagaagaaaaaaatgacgatgatttgatccgacatattcatgcattgcaataccgtgtggggatgaagggattcgaaggatgggattag

SEQ ID NO: 82232 - DNA, 258 bp, Heterodera glycines
  Genomic contig location: Contig_ID=SeqID_2896; Location=788..1045; Strand=+
  SCN-specific regions: Sequence locations=1-67,89-130,159-177,234-258
atgatcgatcagccgacgacgccgcgggcggagaaaattggcgaaggtcgtcgcgcgacaattacaacacacacagattttgtggagctgagaatgagaatggtaagcatgaatgacgacgacagagcacaaaatataaattaaaattatttaaaaatgggaaaattattacagtcgataaataaaaataataaaaataaataaataaatatttagcaaaaataaaattttatgaaaattggaataagtagtcgataa

SEQ ID NO: 82233 - DNA, 629 bp, Heterodera glycines
  Genomic contig location: Contig_ID=SeqID_2896; Location=1692..2320; Strand=+
  SCN-specific regions: Sequence locations=1-59,81-629
tttcaactactcgaccaaatttttgaaattttattggcttccggcattgccggactcagaaattttactaaaccaaatttaccaaaatgtaaaactgatcccctccctgccctccaaaaattattttttgaataatgagctaaaaaatttagtgacaccgaaaggcagaaaaaaaaaattcgttccctcatttaggagaaatgtttatgaaaatcttattttttgagtcaaaataattagattttaagacttttaaaagaaaaataatccatttttgccaatttcggggtttttgttccgcacattttggcattttcttttccatacaaacaaacagttgcccttttaaaagaaaaccgtagaatcaattctaaatttaaaaacctaaatttttttttgcactttttgacattttttggtgaaatttgattcatttttttgtgcgtgcccttcggcgggagaccgaccgcggcaccttttgtgtgccatggtgagaaaaaatagggcgtatggcccggcaccgccgccggcgccgccaaaattggatttgaatttgcttttggcgcctatttgtggcgatgtgtcgtcaatatttgccatcaaattctaccaccatcattcgcacaacc

SEQ ID NO: 82234 - DNA, 381 bp, Heterodera glycines
  Genomic contig location: Contig_ID=SeqID_2896; Location=3835..4215; Strand=+
  SCN-specific regions: Sequence locations=1-59,139-232,255-381
atgcgtcaatggacaatccgtaagtgaacaatccattagcaaattttattttaaaacccaaaattttatataaaattagaataggaatttaaattgaaaaaaacttaataaataataatttgattttattttataaaaggaatgaataagcatttcaaaaaaacgataattactaattactatagaatgatggattaaattgattaatactggaaatgttgtaaactcatccgatttttcaaaattaaattgaataatctcaatcgaaaaattttagccattaaaatgtaccgaaaagagtgccaacggggacgagaactgcagattattggtcaatcattgattgggtggcaggcattaaatggcactaatttggcttaa

SEQ ID NO: 82235 - DNA, 1495 bp, Heterodera glycines
  Genomic contig location: Contig_ID=SeqID_17702; Location=1..1495; Strand=-
  SCN-specific regions: Sequence locations=1-63,85-101,149-258,280 -704,776-844,866-1025,1048-1214,1236-1263,1307-1495
atggtccatttattggctgttcttttatttactatcatccaatttgaatcaggagattctatcgatcagaaaacatcagacaaaaatggtgtatttcatagaaaaataaataaaattacaaattattataaaatattatttttatttagcatttaatgccgaggaattgtgccgtccgatcgatggcactccctttcacgaacagtgccttctctcgacagtggtcaagcagaagggcttcatcccacggcatctgcgtccgccatggctcggctcgtcgctgtttgaggacaacgaactgagcgaagaaaatgcaaaaaatgacggatgttatgggtgttataaggggacaaaagcgagcaatggcatggcaccgcgggaagagtactgtgcatgtacggtaggtcaagttaaaataattaatgaacaatgtacggactaaataagcataaaagctgtataaattaacatcggaaataagatatggcacgaggcgccaaaatgatcagaaaaatacagtttttcgagcttttttggccataattattttttgtcacagcgaaatttttggaaactttgtaagctaaaggaactattaaaccatttaaaatcataaaagattatttaattgggggacaaataaaaatatgatagaacattttacgtcaaaatggcttgcgtcaaagtgagcgggagaaaatcacaatttttctttttaattatgaacaaaattaatttcaaattttcttaaaaatataaaaaatcaaaaaattttggtgaagataaaatgaggcgataaagaaatacttaaaatgtatttattaaagtcttttaattttatatggcattttttgttaaaacatttttcaaaaaacgcaaaattacgcacaaaaagcagcaaatgtcaaattaagcataaaaagcatattcgaatacatttactaattgtttgattcagtacaaaggaaaaatgccaaatgaaaaatttggcgtcgtttttggcacaatcaatcgaaagcgcctaatttgtctaaaggatttgcaagaaatggcattcgtaaatttaatttgttttttttatttgaaaattaactttttacagaggccaacctgtggaaacaaatattttgacaatttaaaacattgtgccatggtaattgatacaaagcttttattaaattcaaatttatttgttcatttaaaggtccatttctatgacaatgagccagaaaaagagccgaaaaagccaccaaacaaagagcgtaaaaaatttaaaatgaatttttaattttaaaaattaaaaaaacggttaaggaattctcgcacttttggacggttgcattattggagcaaacaaaaattgtcgtactgtaactgtgaaagttgaataccgtgaatggaaaaactttggcaatttaagccacaattgtaaaggcgaagtgaaaaaagtgttcgtagacgggaaatgaaaatggaataattaaagaaaaataaa

SEQ ID NO: 82236 - DNA, 377 bp, Heterodera glycines
  Genomic contig location: Contig_ID=SeqID_17704; Location=91..467; Strand=-
  SCN-specific regions: Sequence locations=1-95,177-322
atggatttggttgattatgaggctaaattggtggcaacaggacgacgttatgacagccgaccgttaagtcgaaatttggacggtaaatacacacaaatttaattcagttaattgtgattttgttttcaatctattttaattacaaattaaatttaatcaatttaattatatttaatcatttttaggctatttgagcgccggcggggacagtctcggctccagcggtccgcgcgggcggcctcggccacctgcgcaattggcgtacgacagtgacgagcacaaatatgcggcaccatttgaagggtaaaatacttacaaatagatttaattattattttaaatttaaattatttttatttaaaaaaatcaaaaataaa

SEQ ID NO: 82237 - DNA, 1341 bp, Heterodera glycines
  misc_feature (829)..(829): n is a, c, g, or t
  misc_feature (832)..(832): n is a, c, g, or t
  misc_feature (839)..(839): n is a, c, g, or t
  misc_feature (844)..(846): n is a, c, g, or t
  misc_feature (852)..(853): n is a, c, g, or t
  misc_feature (857)..(857): n is a, c, g, or t
  misc_feature (860)..(861): n is a, c, g, or t
  misc_feature (863)..(863): n is a, c, g, or t
  misc_feature (866)..(866): n is a, c, g, or t
  misc_feature (880)..(880): n is a, c, g, or t
  misc_feature (882)..(882): n is a, c, g, or t
  misc_feature (890)..(891): n is a, c, g, or t
  misc_feature (903)..(903): n is a, c, g, or t
  misc_feature (906)..(906): n is a, c, g, or t
  misc_feature (922)..(922): n is a, c, g, or t
  misc_feature (928)..(928): n is a, c, g, or t
  misc_feature (930)..(930): n is a, c, g, or t
  misc_feature (933)..(934): n is a, c, g, or t
  misc_feature (937)..(939): n is a, c, g, or t
  misc_feature (948)..(948): n is a, c, g, or t
  misc_feature (951)..(953): n is a, c, g, or t
  misc_feature (957)..(958): n is a, c, g, or t
  misc_feature (962)..(962): n is a, c, g, or t
  misc_feature (1008)..(1009): n is a, c, g, or t
  misc_feature (1017)..(1017): n is a, c, g, or t
  misc_feature (1021)..(1023): n is a, c, g, or t
  misc_feature (1025)..(1026): n is a, c, g, or t
  misc_feature (1035)..(1036): n is a, c, g, or t
  misc_feature (1038)..(1039): n is a, c, g, or t
  misc_feature (1050)..(1050): n is a, c, g, or t
  misc_feature (1054)..(1054): n is a, c, g, or t
  misc_feature (1058)..(1058): n is a, c, g, or t
  misc_feature (1060)..(1060): n is a, c, g, or t
  misc_feature (1063)..(1063): n is a, c, g, or t
  misc_feature (1070)..(1070): n is a, c, g, or t
  misc_feature (1076)..(1076): n is a, c, g, or t
  misc_feature (1078)..(1078): n is a, c, g, or t
  misc_feature (1082)..(1082): n is a, c, g, or t
  misc_feature (1086)..(1087): n is a, c, g, or t
  misc_feature (1092)..(1092): n is a, c, g, or t
  misc_feature (1094)..(1094): n is a, c, g, or t
  misc_feature (1107)..(1107): n is a, c, g, or t
  misc_feature (1111)..(1111): n is a, c, g, or t
  misc_feature (1114)..(1114): n is a, c, g, or t
  Genomic contig location: Contig_ID=SeqID_17704; Location=668..2008; Strand=-
  SCN-specific regions: Sequence locations=1-118,140-366,390-964,1006 -1196,1242-1341
atgccggaacaacaacagcagccgagcaccagcaacattattgtgccaagtgattccttacagcagatggacacaagcagttcgttttccgtgacagcatcgccacgaaaaaggacatcattggtgagtagctggtggaggacttttgggactgatccgggaatctgtgacatttggactgatcgatcgattgactgatcgtttaatatattgaattcactgatcagaatatagcgattgctcagccagccaaccgatctgaattatgtgtgtttgaattttggctaatcgatcgacagattgatcgatttttaggtaccggaattcggtttgatcgggcttttttgctcatttggctttctgaactttcgctgtcggattgcgactgatttgattttattggccgcaaaattcgattgattctttggccattagaattattattcatatccgactgatctgaatatgtgcgcttgaattttggctaatcgattgatagaccggttttcagctaccagaattcgattggccggggttttttgttttttttttggctgatttggctttctgcatttccactgaatttcgattgatcaggggtttcatcggccgccattcgatggtctaaatttctgctattaaaattacgattcaattcacgtccgactggtctggattatgtggtctggtcgtatttcgacctttttgatccaagcaaattccccgaaaaatacgaaatttttaaatgatttatttgtttttcaaatttcgattttttaattttgaatttgttaacattcttatcctcccaattagcatgactccactnctnccaaccnaaatnnnttcacnnacanccnnancancaactccacaattntnttccacanncatcatctccantcntcacaattccacaacnactccnantcnnacnnnttcacctcnacnnnaacnnttgnccaaattaaaaaaaataatttttaaaaattttttaaattttttcannccattccnattnnnanncatcaaaanntnncacaacaacanattncacntnccnaaaacancaaaancnacantttnncagantnccaccaaggtttncttnacncactgtttagaaatttttgtataaatttgaaacaaattttaaggtgtacggcagcaacggtggccggatacggtagaatttgaaattttaaaatttaaatgtatttattatttttatttttattaaaggaaagtgaatttgaacgtgaaaaaagtggcggagaaggaagtgcccgattaacacaagaagtcagatatttgttttatgatggcatatttggaaataaa

SEQ ID NO: 82238 - DNA, 176 bp, Heterodera glycines
  Genomic contig location: Contig_ID=SeqID_17704; Location=3189..3364; Strand=+
  SCN-specific regions: Sequence locations=1-176
atgacgaaatttaaaaaattccccccacaaaatctgataaaacagaaaaaacaatttcaaatttgtcatttcctccgcggcaatgaaaaaattgccgccactgacggcacaaaatttgcggtgaaattgaagcggccagcaaataaatatttggtggccccgggtgcagcaggaaa

SEQ ID NO: 82239 - DNA, 155 bp, Heterodera glycines
  Genomic contig location: Contig_ID=SeqID_17707; Location=501..655; Strand=+
  SCN-specific regions: Sequence locations=1-155
atgattgcacgtaattgccgaaaaaattcgagaccaatttccgaatgttgaccgactaattgcaaaacgaaagccgtctttgtcaaagcgtcttaccgagtcaaaaaatttggaaatgtatctcatatgcaatttcaaccaataaatttgaagaa

SEQ ID NO: 82240 - DNA, 301 bp, Heterodera glycines
  misc_feature (294)..(294): n is a, c, g, or t
  Genomic contig location: Contig_ID=SeqID_17709; Location=131..431; Strand=-
  SCN-specific regions: Sequence locations=1-4,26-301
atggtatttattttcaatttagacacatttgacattcgaatcgcaattattgggaagttggaccaattaatagacaaggaaaaaaccgaaaacaacaagttgcttaagaagtaaaaaatttcaaaaaaagtttttttttagatctttgatctttgcaactgtccttgacccccgttttaaattgaagttgtttgaacaaatgaaggaacaaattcgggaatggatgagagcggatttacaaaaaatgttttccgggtttttaaacacgacgttggttcgccaatcaagtacatncgagtag

SEQ ID NO: 82241 - DNA, 1037 bp, Heterodera glycines
  Genomic contig location: Contig_ID=SeqID_17709; Location=565..1601; Strand=-
  SCN-specific regions: Sequence locations=1-15,37-141,194-311,355 -525,547-974,997-1037
cagaatgggatccatcagctcacagggcaaaggacatggaaaaaacaataatggaatacatttgtgttgacggtttaccatttcttacagtcgaaaaggcgggattcaaaagacttatgcagaaggcacaatctcaatttcaaattaagtaataaaattatacaaaaaattttagttgaaaaattaaatttaaggagtcgcaggtattattgcagtaatgtgctgcctgaaatttttgatcgaatgttttcgagaataaaaaatgatttaaaagcagtcgaatttatttcgctgacgaccgatttatggagttcaaaagaaaattcgcattcattattgggtattttttattttaaaacatttcgcaattattttcttcagcactaaccgctcatttcattactgttgaaaaacaacccgcttttgtcgttttgggagccatcccaatcaaggaaaagcataaaactggcacagttatttcagaatatgtgcaaaaaaggcttgaacaattttaaataccgcaagcaaaaatacatttggttcttcgggatgctggctcaaatatgatttttgcatgtgatcattttggagtttccagttattcgtgttttcttcacaaaataaatttagcggtgaaggtgccttttctttttttcgatcattaactgtaatattaaggccgggctaaatgctattggattcgatgaatcagtaacactcgaaaaagttaagacaattgttcgaaaaattaggaaatcgtcggtccaaagaactttgtttgtggaacttcaggagaaacttgacatgccggtcttaatcctacaaagggtctgcatcaatgtttaaagcgtaatttttcagtattttaggacacagaagtacgatggaattcgatgtttcaaatgcttaatcgtttcttacaatgcaaagctgccgttcaagtatttatgacatcggatgaagcaaagagaaacaacaaaggaaaaggcattccaatcattagcaatatcgaatgggaccaaattgagcaaatataa

SEQ ID NO: 82242 - DNA, 1057 bp, Heterodera glycines
  Genomic contig location: Contig_ID=SeqID_17711; Location=782..1838; Strand=+
  SCN-specific regions: Sequence locations=1-425,447-546,568-723,745 -1057
  Gene Ontology: Mol. function=phospholipase C activity; Cellular component=intracellular; Biological process=intracellular signaling cascade
gccttcgtctcgtccactcccatccctcttctctctaccgcaattttcttcttcgggtcactcccaacgcccaacgcgtcgattcctccaatttgaatcctcaagagttttggaacttcggcttttccctcgtcgcgcttaattaccaaacgccaggtctgatgatggatcttcaggaggtgcgccgagtcgaattaatggcattcaaaaaatgccaaaaaatgaaaattaagggcaaatttcttgcaaacggaggctgtggttatgtgctgaagccggccattatgtgtagtgatcagaacgaattgatcagtgacaaaacgaacggcgatgaaaatgcggaagaacagacggcggaggggcggcggagagtgccggcgcagccacaaattctgcacctgaaagtgttgtcggcgcagcaattgccgcgaccgagggcatccaccgccaaaggggacacggggctggtcagttgcagaagcgaagcattcctttggttcatctccacctttcccccttaggaccctttcgtcgttttggaagtgttcggtgtgccggccgattgtgcggaagagcgaagcaaaaccgtacgcaacgacagcttcaacccgagctttgacgagagcttccaattcgccatttctgtgcccgaacttgcgcttgtccgctttttggttttggacgacgattttattggcgacgatgtgagtaattggagaggggcagaggcaatcagaagcaacaaaacgcattaattaatgtgtaattaattgactgcagttcatcggccaatacacaattccgttcgactgtctgcagagcgggtatcggcacattccgttgctgaacaacgagggcgacccgctggagggcagcacccttttcgtgcacattgccatcaccaacagaaggggcggcggagtgcgtaaaaaaactcgaaattggacggcggaatttgagaatgaatgtgccatcccattcagaagccgaagaagcggggcctttcggtgaagcgcaaaatgagccgagttcagacgggcatgaaaagtgtggcatc

SEQ ID NO: 82243 - DNA, 93 bp, Heterodera glycines
  Genomic contig location: Contig_ID=SeqID_17712; Location=198..290; Strand=-
  SCN-specific regions: Sequence locations=1-17,39-93
atggaatgggaagaccgtgtggaaaatgtaaaaatggaaataaatggattaacggtgaaaataaatgaggaaaaggaaaaaggaaaactctta

SEQ ID NO: 82244 - DNA, 1315 bp, Heterodera glycines
  Genomic contig location: Contig_ID=SeqID_17712; Location=679..1993; Strand=+
  SCN-specific regions: Sequence locations=1-141,163-398,424-1315
atgtcatcgccaatccaacagaaattaggagccgctctaaaaatcatcaatcgcatcagaaccgcagctgaactcacgattttggccgatgctacagcaagcaacctcgaaaacgcactgaacttcgaagcgcaattggagaaagtgcaaaaagaagccaaatcattggaaatctttatcgacgacgtccgagaatcgctctcagcatggacggaccttttacgcaaactctcagcagtcgaacgcgaagctggagaaaccgagttcagcaactacagcaaaaaagagaaaatcaacgagaaagtggatgacgcagcactcaaattgcgcgatttacgggacctcatcggcacactcacaatcaaagcaaggctcttccgcaacaaatttgaattggaagaaagaacagcacaagcaaaccacgccaaagcaatgcaacaaaccgcaaccatgccacaacaaacgcaaccgtcaaccatgccgttttatcaatttcaaccaattcaattggacaagttttctggcaataaacgacaatggccggaattctatgaatcgttcaaatctgcaactggcactcacgcactcagcaaagcagaaaagtttaacatcttgcgcaacttacttaccggagaagcaaaacaacttgtggctggctttcgtcttgaagaccaaaactacgatgtggcattgcaacttctcaaggacacctacggagctcccgaggaacacattcgagcacttcactttgaactggccaacttgaacacatgcaaaaatctgcgcgacactaaagaatttctgctgcatctcgaacgacttacgcgggaactcgacaacgcaggcgaggacatcgaaggcccgccaacttatcttatgttggaaaagaaacttacgccgcctttcctccgaacaattctcaacaaaaaaggagaggatcccgagcattggaacacaacaaaattccgcggcgtgctcagcgaagcagtcaggaaagaatcacaaattcaagaggttatgagcgaatacgggcatcatcagcaacggccaacaaaaccattcaacaccggaccgagattccgggatcgcgcacccttcaatcagacgagggaaaggtcattcattgccgcaacaatcgacgacaaaaacaaacgttttgggaaacaaccgatgccactaaaacccgcaacaagtggtcaacgaacaacaacgcaaccgcagtcacaattcaaacccaagttcaatcaaatggatcgcacagcacaagcgcgtcctcagcagaaggacagcaaacaacaatcgccaccaagtccat

SEQ ID NO: 82245 - DNA, 103 bp, Heterodera glycines
  Genomic contig location: Contig_ID=SeqID_17714; Location=132..234; Strand=-
  SCN-specific regions: Sequence locations=1-103
atgacaaaagcaattgagttggaaatgacaatgggtaatgatgctgacgaagcattttatggctcccggaaaattttgtcagtgacagatatgtcagtgatca

SEQ ID NO: 82246 - DNA, 289 bp, Heterodera glycines
  Genomic contig location: Contig_ID=SeqID_17714; Location=586..874; Strand=+
  SCN-specific regions: Sequence locations=1-18,40-289
atgaattcaaaaactgctgaaaacccaaaggtttcttttgatttttacacgaattttactaagaccatttagacttcgtcgctggtaatgcgtttacatccgtgtgcaaaatccggcggctacaaaattgttcaatcggtaattttatttacagttaattgcttaaaaacattttaggtaaatgggtggccgaatggcaagagcaagataataaataggcggaaaaagagtgcaattggaaccgaaaacatcgagccaaatggaggcgcaaatcggtaaaataaaatga

SEQ ID NO: 82247 - DNA, 579 bp, Heterodera glycines
  Genomic contig location: Contig_ID=SeqID_17715; Location=769..1347; Strand=-
  SCN-specific regions: Sequence locations=1-579
atggcaatggaaaggcaaaaccaaagtttccccgaaagtattattgccgaagagacggaaatggacgaagtgccggcaaaccaaacgaatcaagggacaaaaaagcgcaaattgaatgagtgtcagccaacgacaagcggggcacaaaataatctatcgatggaatcaggaattgagggcttggtacaggcaaatccgttgttagtttcgcaactcgccacagttgctgggcaactgcttggaacagcattgaaggaagagcagcgtggcacgggcccaatgtttgccatgcaaggacgaggtggctactatgggcgcagaggaacccgacccaacttcgggtttgcgtcggcaaaatggcaagaaggacgacaacaatgccatgcagcatcaattccatcaacctcagcatctgcctccgcatcatcatccgccgccaatgcttcagacaccgttcaccaacttgcgacacaactgcgaaattctaaccctgaattggcaatgcttctctttggcatcgcgtccggattggcagaaatcgcctactattgcaaaactggaaattggtgcaaacgatga

SEQ ID NO: 82248 - DNA, 247 bp, Heterodera glycines
  Genomic contig location: Contig_ID=SeqID_17716; Location=244..490; Strand=-
  SCN-specific regions: Sequence locations=1-247
atggccgaacgagaaattgaattggttgttttcgccgcagaattgttcaattcgaagcccgacaacgtgccaagaatgatgagagacaactttcgttgtctcaaaagaatcagggacgaagtggcacgaatttccgaacgaggagggcgaatgtggagcaaactgtgtgcgaaaaatatgggcaatttgattaaaaatcgttgggaatgggaaattgtgatggaaacgcctatgggaatggctttcg

SEQ ID NO: 82249 - DNA, 363 bp, Heterodera glycines
  Genomic contig location: Contig_ID=SeqID_17717; Location=1818..2180; Strand=+
  SCN-specific regions: Sequence locations=1-136,158-173,196-363
atgcgttgttttgcatgtactgcatttgtgagcgtgaacaaggaagtgaaaaatgaaggcattggatggatcaaaaatcaattaaggagttactgccggcttgacccattttttagtgcagattgctaccatttgcttgtggacacagtgctatataatattgtaagaaaagcatttatttatttatgattttgctacaagttggagaagctttctttgaatgagctgaaaccgacggcgatctgtaagcaatatggtttgtgtagtgaagatcaaggaaattcaacggtcaaattgttgcatgcaagtctgggaccattggaggcaccacgttccaagactcaccattctgtaaccaaatga

SEQ ID NO: 82250 - DNA, 1368 bp, Heterodera glycines
  Genomic contig location: Contig_ID=SeqID_2898; Location=1499..2866; Strand=+
  SCN-specific regions: Sequence locations=1-87,111-163,210-687,769 -931,953-1136,1170-1368
  Gene Ontology: Mol. function=RNA binding; Cellular component =cytoplasm; Biological process=reproduction
atgccattaaaatacgagcaaagcaacgcattgtcagcaaaaattgccaaagaaattggcgagttatctgaacagagaaaacatttcggaggaggagaagttggagagaaaaacattgatgagaagctgaagaagaagctcagatcactttcaagtgggcgacattttttaattaaaggaaaataagaaaattttattaaattaatattcttactaaatggtatataacagctatgcatttttcgacttacagttcgggtggtttccttgtataagacccaacctcctgagattttcatattcgctgttgacaataagctatatagagtttaatttttttctttttttaggtttcgaattcagctcaataattttaaagcgaattttggccactgaaaatacagaaaatggaaacggaaacattttacaaatctatcgcacttttttactgatgatcaaattttgggcaagaggtaataatttaattttcacagaaagtaataataaattaacaattcttttgccattggcactttcagagcatcacatttatgacaacaaattgggcttcttcaatggcattagtctctcccttttggtggctaaagtgatgcttctttacccaatggcatcacttccttttttcattgaaaagttcttcttcaccttctccacatggtcattttgttttaataatttatttttttaaaaatttttaataaaattaattgccaattattttttgaaattttaaatgtataaattattctatgcatttttttaggccttggccaaccccggtaaagctgacagatttgccaagcttgtccattcttcgctggaacgcatccgatgagagtgacaaacggggggtaatttactcgagacggggcctaatgcccggactgacaatgccaattgtcacgccgggacatattgaacaaaatgccactttcaatgtgaaccgatccaccgcaacaatcattcgcgggaattgcaaaacggtgaatggaaagtcgggacggaattagccgcgggagagaaatttgttatcggaaatccgggatatatgtaaaagccgagaccgggagcagcagtcaaacccatatccctcacaaatcagttttgtataaacaatgaaaaacaattatttatttttagctattaaaatcattcgaaattggccgatggatttgcaaaattttgccaaattcttctttattcggtacgccttctcaatggtcgcgtcaaattgatgaaaaagcattgagtttaatctctgaatccactcatctcccactgttgcgattttatcgtccaattcaagcccaattagccaaattttttgataatgttcactttaattaa

SEQ ID NO: 82251 - DNA, 212 bp, Heterodera glycines
  Genomic contig location: Contig_ID=SeqID_2898; Location=3232..3443; Strand=+
  SCN-specific regions: Sequence locations=1-136,158-163,207-212
attctctcccaaaatttgtcccttttcaacgatttgcttcgcatggcccaatcgaatgcgatcaaatcgttcgacatcgatcagcaattggagacgaattcgcgtctccacgtagcctcaaaagtcgtaaaagtcggccaaagcgaaggctttgcaattaatgcgaatgaaatgggaaaactgcgaaaaatatttgaaattttaatttgtag

SEQ ID NO: 82252 - DNA, 1457 bp, Heterodera glycines
  Genomic contig location: Contig_ID=SeqID_2898; Location=3432..4888; Strand=-
  SCN-specific regions: Sequence locations=1-87,111-163,210-687,766 -1295,1337-1424,1446-1457
atgccattaaaatacgagcaaagcaacgcattgtcagcaaaaattgccaaagaaattggcgagttatctgaacagagaaaacatttcggaggaggagaagttggagagaaaaacattgatgagaagctgaagaagaagctcagatcactttcaagtgggcgacattttttaattaaaggaaaataagaaaattttattaaattaatattcttactaaatggtatataacagctatgcacttttcgacttacagttcgggtggtttccttgtataagacccaacctcctgagattttcatattcgctgttgacaataagctatatagagtttaatttttttctttttttaggtttcgaagtcagctcaataattttaaagcgaattttggccactgaaaatacagaaaatggaaacggaaacattttacaaatctatcgcacttttttactgatgatcaaattttgggcaagaggtaataatttaattttcacagaaagtaataataaattaacaattcttttgccattggcactttcagagcatcacatttatgacaacaaattgggcttcttcaatggcattagtctctcccttttggtggctaaagtgatgcttctttacccaatggcatcacttccttttttcattgaaaagttcttcttcaccttctccacatggtcattttgttttaataatttattttttaaaaattttaataaaattaattgccaattattttttgaattttaaatgtataaattattctatgcatttttttaggccttggccaaccccggtaaagctgacagatttgccaagcttgtccattcttcgctggaacgcatccgatgagagtgacaaacggggggtactaggtcgttgcataaaaaagggcgcttttttataatggcttataaaaaattttgttgttaacataataaaatgttttatataccgttttgttaagctaattgttgtctacaaaatagtatattgattttgttcatatctcaatttgcaaattttttatagctaaaaaaatgaacgctaataaggagcacgcacataagctattacaccagcaatttaaaaaaggcgaaaaagcggcgcctgcggcgcgaaaagtgaatgaatttctcggcgcggatattcggcgggaattgcaaaacggtgaatggaaagtcgggacggaattagccgcgggagagaaatttgttatcggaaatccgggatatatgtaaaagccgagaccgggagcagcagtcaaacccatatccctcacaaatcagttttgtataaacaataaaaaacaattatttatttttagctattaaaatcattcgaaattggccgatggatttgcaaaatttgcaagaagaaaaatgggaaaatctgttaaaagataaaaagttcgaagaaaaagtaatttaaaaaaataatatttctacaaattaaa

SEQ ID NO: 82253 - DNA, 1265 bp, Heterodera glycines
  Genomic contig location: Contig_ID=SeqID_2898; Location=5341..6605; Strand=-
  SCN-specific regions: Sequence locations=1-38,60-304,326-456,481 -587,820-863,885-1006,1051-1187,1209-1265
atggcattggcacttttatcggagagagagaaaataggcaaaatggtgaaaaatttgcaatttaggaggaccagtttgagacaattagagcttttgtgcgacaaagcatggcttattaaattgaatgacgaagagcgagaaaaactgctgatgacggcattttttagaaacgaatttgaattggagaaatttaatgagtttttcggccactttttgctaatgaccaaacaaattgagcagggtaaatgccaaaataaaaatgaattgaacttcctatttagatcaaaaattgtacaacgaaatgtcaaagtttacaaaaacagaagaccaaattttaggaaattttggaatatctttgcatttgcaagaaattaaattatttactgggcgaacaaatttggttgaaaatgatagcgcaacaataaaaatggttgatgataaatagttttttgtttctaaatttaattaaatttaaatttagttgacagaatttttgtcaaaaaatggttttggaatggttgaaaatgaaagaaaattgaaaattgacctggcaattgaaagaattgaacgagtggtgaaagaatgggtaaattaattaaaaaataataatttatcaaatatggcaaaactattaaaaataataatttatcaaatatagcaaaactattaaaaaataataatttatcaaatatggcaaaactattaaaaataataatttatcaaatatggcaaaactattaaaaataataatttggtaaattatgccaaaattattaaaaataataattttgtaaattatgccataaaaataataatttagcaaattatgccaaagacatcgatgccatttgtgtgggacccgcttttttggaatttcacttttttgggagtgaaaagtgtgaaattcaccggagcagaaggagttgcccggactggtcactttattgccggctttgtctggtcggcacttttaataatggcgacattaattatcattcttcgaagcaaaaattaaaatttagcatttatcaaaaatatttatttatttttggtaattcttagagctcgacattttgaaaaaagcctagacctagactccatgttggacctggatttcctggacgaaaacccaggaaaacccaagtccaggaaaaatccaggctcctcgagacctggatccaggtctggacctgtattttttgaaactcattttaaaaatcaaaaaatatttcaaaaaaatcaataattgcttgggaacaaataaa

SEQ ID NO: 82254 - DNA, 612 bp, Heterodera glycines
  Genomic contig location: Contig_ID=SeqID_2899; Location=847..1458; Strand=+
  SCN-specific regions: Sequence locations=1-18,74-548,570-570,592-612
atgcgcagcggtgccccgcttctcctcctcccctcccccgccgttgtgcttttcctcctcctccgcttcttccggtgccgtgttgcagtggtggctgtcgcaaaggttgcacccgccgtgtccgttcagcgactggcactgcgcattaaagcgctcgcaagtcgtactcgccgttgaacacgcagtggtgataggccaaataggcatggcgactgtctgtggacgaaaagcattgccaagcgccgcagaaatcgccggccgattttgttggactgaccgacacggcacgtcgcattcagacacatggaccacgcataggaaatgcagctgatgttccgcttctcctccgtggcccgcagagttccgctcacgtcgttgatcaaatcgtacagctcaatttcccatggacccgcgtggatgaacgaggaggagcacttgaggaaatggttgaagaacccttggaaaatgggggaaattgagcaaaaaacggggaaagacccaaaagtggtgggaaaagcgagaaggaaagggcgaaaagcattggaaaaagcattttactaaattattggaattttggaatgattaaaaatgggggaaaatgaagcaaatgaa

SEQ ID NO: 82255 - DNA, 96 bp, Heterodera glycines
  Genomic contig location: Contig_ID=SeqID_2899; Location=193..288; Strand=-
  SCN-specific regions: Sequence locations=1-96
aaattcacttttatgttcgtagctgtacagaatgaccattctttgatattccaatggtttgtgaccaaatttagcatgttttaatcaatttaggaa

SEQ ID NO: 82256 - DNA, 193 bp, Heterodera glycines
  Genomic contig location: Contig_ID=SeqID_2899; Location=1988..2180; Strand=-
  SCN-specific regions: Sequence locations=1-193
aaattcatttcccattttagccggcaaaattcacattttttctagttccaatcgcttcttgaccagcgtaatcggaggatatgtgacggagccaaggggcgaagtgattataaaggtaattagggggggggggaatttttgttaataaattgcctgattaattcattagggcaaaggtgtgatggagacattt

SEQ ID NO: 82257 - DNA, 468 bp, Heterodera glycines
  Genomic contig location: Contig_ID=SeqID_17722; Location=56..523; Strand=+
  SCN-specific regions: Sequence locations=1-275,313-348,370-468
atggaaagcggcggcacagtaaacgacgaattgtactacggtagtgcagcgatgccattgttcacgcgatgttatgatgtcatcgatttgggcacggccgagcgaatgatggcgcggatggatcactgggacaacaaggagcacgacaacacacggatcagcaccagcaatcaaccgtttggtgtgccagcgaggtgctttttttgtcggcattatgtcaaatttaaaaaaatcagaaaaatttttccaaaaaaagctgagcattgagcaaaacgaaaaatattttttctaaatattaaatattaaaaaaaactttgaacaaatttttagccaataatgggaaatggaaaaatttagaagaaaatgaaatcgatggaaattaaattgtgctcaaaatggtctaattatttaattttggaagatgataaatttacaaaaataatatttgaatgagaattaaaaaacaaa

SEQ ID NO: 82258 - DNA, 170 bp, Heterodera glycines
  Genomic contig location: Contig_ID=SeqID_17722; Location=697..866; Strand=+
  SCN-specific regions: Sequence locations=1-170
atgataaatgactcatcacatcaatgggattttccaaatgtttttccggtagaatttttatttttatttttctaagcaccaaaaaaactgaaaaacttttcagcccttacaaatgatggttatcgagggtctgcgccgatctggcgttaaaaagtgagttatttattcaa

SEQ ID NO: 82259 - DNA, 566 bp, Heterodera glycines
  Genomic contig location: Contig_ID=SeqID_17724; Location=1505..2070; Strand=+
  SCN-specific regions: Sequence locations=1-340,362-476,531-566
atgatttttggtcttataattttggaacagattgtaagtctaaaaatgttgttccagggcctcaaaactcgaaattgaatgtctgaggggaatttgttggctctgttggagttaaccgaccataaaaaacattagaaattctcaatcagattggaggaatataggggaatgaagagaaaataaaccgtattccccattaaaaaaagttggctaaatgagttcagaaatttcagcgtaaattttggaattttcattaaatcgcaaaaaatgatcggcactttttgaatcaaaatatacaaaaagcataaaaatgcattttaatgcattaacaaaaacatttttataaatttccgagagtttgcttaaattttatataaaagaattttttcagaaaactgctcaaaattcaacacaaaaccaggccaaatttgatcgttaaacccctccacaaaatttggaaaaattacacgtgggccaatttaatttttaaaatttttcaattattttcgtaatacaattaatttaaatttgttttctacatttctacatagggggaatatagggga

SEQ ID NO: 82260 - DNA, 735 bp, Heterodera glycines
  Genomic contig location: Contig_ID=SeqID_17724; Location=2172..2906; Strand=+
  SCN-specific regions: Sequence locations=1-735
atgaatattcgatgtgagttttgcgatgctttgcattttgttgaagagaaaatacatggtcgtggcaatacctttaaggattgttgtcactatggtaaagtttttgttcgcgagattactgaacaggattttcctgaggaattgagggatttgttcatgaaatttgatgcgagacacgtgaatttctttgacaatattagacatttgaatagcagcgtttcatttgcttcaatgaatccgctgagatatagatacccgaataaccgaggtccgtattgctttcgcatttacggtcagatttatcatagaatgaatttggctctgaatccagaaaatggcgatgatcctgcttatgggcagattttcatcgtagatactgagcatgcaatgagagcactgaggcatgccaatgtcggtattgaccctcaattgctgacaactgcgtatgaagtgattagaaatgtgaatccgtttgctgaagcatatatgatgatgaaagaagaagaagatgaagaagttgatagagcaagaaatgagaacagagagccagccgagatcaagcttttgtttgagaccggaaggcaattggacagacgtttggggtacaatgtacctcgagcgaatgaagttgctgcagtttatgtacctggagctgacggtgaagtacctaatgccaagattgttgtgagagaacgtggaaaggaattgaagattttgaattgtactaattcaatg

SEQ ID NO: 82261 - DNA, 970 bp, Heterodera glycines
  Genomic contig location: Contig_ID=SeqID_17726; Location=542..1511; Strand=-
  SCN-specific regions: Sequence locations=1-2,71-361,383-609,633 -704,727-970
atgccgtcgtcgtcgccggtggcgttgctgccgctgttggcgccgctgccgccgctgccgttgctgccgctgaagcggtgccgctgggcactgttgggtaagtaaggggggaatggtaggggtggagaagccatttggtggctaatcgccaaattggcactaaaaagacgctcgtctgtcggcattatgcaaatgtaaatatgatggagggaaaggaggggtgggggggatgaaattggacaccaaaattggaccgaaaattgtaagcaaacaaaattttatggaaaaatctctctttttccgcgctataaatgccccgcctcggccccgcttacgcggtccgaatgccgaaaattgttgttcaaattgtctgttttttgaatgggcaccgaattacattacccgaaaaatccgttttttgacgattcgtactgtcccggttgtattagtaacccgattcgaatcccaattagtaatgggtccgatttgtaagccacccgattcatacttaattaagaatgattcatgccaaataaatacacttatgcttcagctaattgttttagaagtgtgaaaatgtcgatttcgatagtggttaactttgacagtaaaatttaataaattatatgaaagttttaattgttttttggttctcgtatgactaaatggcgcgaggttttgttttaagtcttgccaagcctaaaatgttttattgtttattcttttgtgttttacagtatgaatcagggccagtgcgaattgaaatttataaaatctgaaattgaaattttgaaaattccaactaaaaattagtgccatactttcaacacaaaaatgtgtaaaatttaattttccatcatttttttcatttacaaaattcagcactcggaatacaaatattaattttttttttctcacataaaatgactcaataatcccccaattgtcccacaattccctagggaataaa

SEQ ID NO: 82262 - DNA, 136 bp, Heterodera glycines
  Genomic contig location: Contig_ID=SeqID_17726; Location=2303..2438; Strand=-
  SCN-specific regions: Sequence locations=1-77,103-136
atccccatcgttatctcagagcattatcatttaagtcaacagtcaaattcatgatcagagcgattttaaaaaccttataacttattttttggctttttaaaatctcaaaacattttcgaaaaagtggcttccaccg

SEQ ID NO: 82263 - DNA, 99 bp, Heterodera glycines
  Genomic contig location: Contig_ID=SeqID_17727; Location=1..99; Strand=-
  SCN-specific regions: Sequence locations=1-3,25-99
attaattttttcaaatttgggaaacacctcgtagactgggggataattggagactgcgggattaatagagactgggctataattagagcatatacggta

SEQ ID NO: 82264 - DNA, 488 bp, Heterodera glycines
  Genomic contig location: Contig_ID=SeqID_17728; Location=765..1252; Strand=+
  SCN-specific regions: Sequence locations=1-39,61-229,253-488
atgaaatcaatgtttgcattagattgcatggtttttgtgttaaaagtgattttaacagaaatgacaaaaatgtaagaactcagaaacaaacaaaaaattttgttcctttctattgcctattaattttttttccaaattaaaataatctttcgttttattaatctgctgatgatcataaataaaccattacacattggcggtgtaatttgacgaaaaaaaatcgcaaatcaaattattattattataatttttgcactttatattaaagatttttttcggcattcgattgaacggtaaattccgcccggggataggaaaataataataatataaactcatacatatatacatatcattgcttaatatatgatcatacttttttttaattttgcagatttcgaattattcaatatggtttacaattagaatcttttacattgaaattgttcaggaaaacagagaacttttgagctatatgtagtattata

SEQ ID NO: 82265 - DNA, 62 bp, Heterodera glycines
  Genomic contig location: Contig_ID=SeqID_17728; Location=1414..1475; Strand=+
  SCN-specific regions: Sequence locations=1-62
atgtcgaccgccagtcaaaaggtccgaactcgcgaggacgtcatttacggaggtcggcacca

SEQ ID NO: 82266 - DNA, 1547 bp, Heterodera glycines
  Genomic contig location: Contig_ID=SeqID_17729; Location=22..1568; Strand=-
  SCN-specific regions: Sequence locations=1-205,239-278,300-311,333 -909,932-1019,1041-1547
atggacaatcgaatcgcctctataggaacagaggacgccaaattctccagcgattcacgtcaaaaaactgctcattcgatggctaacaatttggtcagaatttcaaaaatattgaattagcgtatccagaattttcgtcaatgtaaaatcgagttttttttaataatcctagaggtcataagcagtgtgattgtaatgataaatgaaaaatttttttttaaattattaattattaaaacaacagaattattattccgaataaactagaagagtgtgattttcttaactttaataattttaaactatctgagatgtaaaaagttaagagatttggacttacaatacaattacgcacaatgtcctggcgtaaatatattacatgtacaaggagtactttccaaaatacccaccacttcgccgttcttttttgccatatacgataaagaaaagttaatcgcttgaggggatggggagttcaactactcgaaaccagggttaccatcttaatcccgagtcgcgaaatccggcatttctttttacgagtcacaacccgacattttactcgactcagtccgacaattttctcgaaccgcggcaaccctgctataaaccagcaccagtctggccttgtcagtaccgagtttttgttcgagaaagagtaactgtttttcgaattttcactgacgaaaacccatctgaaatgagatatgttttctttgaaataatcttttacaggtttctgccggttcacagcgtaaggaaggcattacggaattagaagggtcagctgcaccgccgaagccgctgcgacgagcgccaacaaattcgaacagttcaccaacaatggccagctcattattgctgggcgtccaattttttgaacgtctctcttttcatacgcttaaaggtaatttaataaatacatttaatagtgatacaaattgcaggcataaaaatcgcaaaataggcacataaaaagcacccaatagacaagaagtaggcaaaaatgccacaatcggcagaaaagtaggcatttggaattataaaggactgactgaaccccctaatcattaggaaggaatttaatgtttcagaaaagctcgaaatatacaatttatcgcatgatttggtacctccccaaactgagtctcaaaatttacctcctatatcatgcaaacccacgaaaacttggtcggcaattttttatttctgatcaggaacggacaaaatttcattcttgacgagtagcaactttctattaatagtactcattttgacccttgttcttcaaattttatctaatttttgcatatttacaattaaattaataactatcccattttaggcactctgttccctctgatggtcggtactttgcatgtggacgagggctccgccaacgcattcattttgctttgtatcggagtcacagttttctcgccaattgtcggtgctgcaatggccgatgcgaaaaatggcaattacgggtgaagcatttttaaaagtaacaatattatttgaaatcaaaattttaggtaattattaaa

SEQ ID NO: 82267 - DNA, 131 bp, Heterodera glycines
  Genomic contig location: Contig_ID=SeqID_17729; Location=2877..3007; Strand=-
  SCN-specific regions: Sequence locations=1-131
caaaattttaaatttgcaaagaaaaaattgaatttccttcacctgtcacttttggtgacaggtggatgattgatgaccttcccgcggcgctgcgcggcgcgggtgaaaaaaaacacccgcaacaatttggg

SEQ ID NO: 82268 - DNA, 1504 bp, Heterodera glycines
  Genomic contig location: Contig_ID=SeqID_17730; Location=320..1823; Strand=-
  SCN-specific regions: Sequence locations=1-71,96-529,551-810,833 -1106,1136-1504
atgacgaagatcatttttcactgcactccaagttgcctcaatgtcctgtgagtgatcaatgacggattacgtttttaatatttaaattattatttctttttgcaatggttggtaccttatgtcaaaaggatgttcgaattaggaaaattttgattggacacataaatttttgattggacgcgcaaactgtgattggacgcgtaaacttttgattggacgcgtaaactgtgattggacgcgtaaaagtcgattggacgcgcaaactgtgattggacgcgtaaaagtcgattggacgcgtaaaatgcagtagagccctgattatattagagcaaattgcgaaggcataattaagtgtccggatttttcaaatagctgtacgcgtccaatcaatgtttaggcgtccaatcagagaccaccctcataagtttttttagatcataacttttttatttcgtggtcaatccaaacatttttagtatcattcgaaagcttgaagtctacagaagttttctattgcaaaattctgggataaatgcaacagacaaaaaatattcttgattatacgcgaaaaatggtgaacttacgagttttctcattgcaatttttttcttaatgcaattatttgctcttttcttgtatttataaattccctaatcttaaagctttcgaatgatacgaaaaaggtttggattgaattgaccaagtaagaaaaaagttatgatttaacaaagtgagaatggtcactgattggacgctaaactggaatagagcaaaaaaaaaaaacttggtcaccctgaatatgtaaaacaattttattttttagggaatttactgaagaaagagtgattattgtacataacacttcaaaattataatgtcatttaaaagacgcttttttgaactgcggcgtatcttaagacgacagtaaatatcttttctacctaaattaaaatcaacacaaaattttcaaggtcagttctcattctgatattcttatcttccgtggcggcttttgtgttcttctttaacagtgaaatattggtaattttccacaaaactaacaaataggccaattggtcactggtgaaatctctctcatttttcccattttattttgtttaattatatttattttcattttcaaggctgttaaaacgaacgaagaaattcaacggcacccaaaaagattgagtttctctgacgatgagctgcccggcgctcgagactcgaacacagttttacgcgaaggacaaattggcaatttcgaacagattccggcggtgctgccccccgaagacccaaatggcgaaggttgtgatcctttattcttactttgtttacgtatttacgaaaactcatttattgcaggtgaggatggacgtgccattgtcacagatcttaactcgcccgaggttcgtcgtgccatgtccgaatacgccttcaacacattggccagcgacagagcttcattgaatcggtccatcccagacgtgcgaatggaaga

SEQ ID NO: 82269 - DNA, 838 bp, Heterodera glycines
  misc_feature (650)..(650): n is a, c, g, or t
  Genomic contig location: Contig_ID=SeqID_17731; Location=567..1404; Strand=+
  SCN-specific regions: Sequence locations=1-497,542-661,783-838
atgtcttcattttggaatgtgtctgctgttctcatgctgatcacactgatctctttgcttgtcaacagcagtgaagcggtgccgttgccttcaaaaaagtcgtcgtcattgtggtcgaaacttttttcaaagtaaaatttcaaaattttgccgccttggcattttttttaatttggcgtttcattttagcgatcgtgaaagtgctaaaaaattggggagcccttcctcgacatcggctgctggtggtgaattttcagtgcagtcccaaatgtttataccgtatgccaacaacggcaacggtgacttctttctaccgtacccgagtgaaatggacacagtcaaacgcagcaacacggaagaccatttccttgacccatatgatggtggctcatcgtggttgagcctcagcgatccgagccgacttgaatggaacttcaacagactgcgctaatgaggagggcaaagatcaacattagaaatttggactcatcgaattcattttataatttttaatgaaatgttttgaaattttattaaatttgtaaattgtcttgccagaaaaatgtttttttttaatgtattcaatagggatgtcaaaaatatgaaaaaaaaaatcccaaggaaatattaagaaaaactcaaaaatatgntagcaaatatgtaaatttttagtattttaaaaagtaattttgttttcaaaaaaatatttgttattttttcaaaagaaatttctaaaaattttcagaaattctcaaaatattaaaaaaaatatatgaaaatatgtaagaaaaaagttcaaaatatgtaacaaatatgtaaaaaaagcccgtatatgtaa

SEQ ID NO: 82270 - DNA, 1821 bp, Heterodera glycines
  Genomic contig location: Contig_ID=SeqID_2900; Location=2425..4245; Strand=-
  SCN-specific regions: Sequence locations=1-672,701-798,820-973,995 -1170,1192-1821
atgacgatgaacatcacaggggcatccacatttctggcagaacaattagagggcgagacaggtcatgttattgggtttacatataatgtgagttcttcagaagaaaagctgctggttctgaagaatgtgctcgactcggccatccttttgtgggtcatcatccatcccgacatgttaggcactaaatatgccactgaaaatgctgcgcttactaagattatggccagcattctgcgggaactcgacaaattttcggtggttttctttgtggtttcacctttgactttttttaaggaaactttgctaatggattccgcattgacaattgccagcaatttgcccaaggacaaaatcggtcgtatgtttggtcgaattcgtgccaaattggagacggaaccgacggacaatgtctactttgcccacttcgttgaagctttggccgcttgggacatgagtaaactaatcaacattatcgaactggcattgcaacgattgcggaatgcggttgtggcggtgtgcgacccgaactgctcgaccccgcggcgtaggcgagggacgatgaataacaaaagtgtgtttcttgtacaaaggctgggtaaaccgaaattttgtgaaagggcgctgcatttcctgatgcttttttgcctggcatttttctatatcatattcctgtaagtttttccaaaaatttttatttctgtggagtttataacaaatatgatcggcctacagtatgtcggtaaatatggatgattaaagtcgatacaaattattctaattaaattaactgttttttcacacataaatgcattttggtttatatttcagctttgccttcgtccttcctcagtacgtcctctatcgactcaccacgagcaaagcgcgctcgttttggagaaggacttgtggatttttttcgtccattagaactcatccaaattctgttggcctgcccacaatcatgcacatgtctcaagaataattttggcatacatttggaaggattttttgagtctctgtgcgtcatccgatgcaaatttggcgaactgttaatgaacaatgggtgggaaacaaaatttgatccccgaacactgatttgtgcctatgaaacgttcaacatcgtggcactgatcactaagagaattgaagtgagtgagcattaaacacggctttcttaatttatttaatttggcgttttgttttttgtgcttaaaatatctgtttttttcattatttatcattcagcaacctcgtcgcaacagtcaaggcgaagaaattggtgtaaatgaagcagagcgggggttatccctgacagatcgaattttgtacaatgaaatgaaatggttcgcaactgtcctcaacgagcgcactccttccttctccatcattcaggtgaccacccaaactcatcaagtcgcttttccccttcacttttcagatgtttcttcgctgcctcagtctccacctgtgcgcttctcagctgagtgccgtggtccttaacgaaacggcctctttgctgaacgaacttcgatatcggctggaaaatgtgtacgacgcgcgtccagtgatgtcggcactcaaaaaatgtgtgaatcatttgaacgaggcattggaggtgacccccaaattatgatattatgtatggtaacaaaatgttatccttttaaggggtgcgaagagcgcgaccaagcagaaagaataattgagcacaaagtcagactgatggaggaatattttgaggcggaggaacggggcgacacgacgcaaatggcagcggaagggaacgacgcttaccacgagattgatgacggagaattataa

SEQ ID NO: 82271 - DNA, 996 bp, Heterodera glycines
  Genomic contig location: Contig_ID=SeqID_2901; Location=1017..2012; Strand=-
  SCN-specific regions: Sequence locations=1-158,186-245,267-367,389 -545,567-653,675-790,834-974
  Gene Ontology: Mol. function=scavenger receptor activity; Cellular component=collagen type IX; Biological process=skeletal development
atggaaggatcgcccggtccaatcggaaacattggcccagtggggccgcaaggtaattccgacattgtgtaatgtcagaatttcattctttaaggtccacctggaattcctggtcgtcagttcatcacggaagggccacgaggctcaccgggaaagccgggccccaaagggcccaagggattgcccggctgccaaggggtgccgggcattaccgtccagggagtcaaaggaccgccgggggacgcggggaggtgggaaaaggaaaactcagcgaattcccaagaaaaacatttgctttgtttagaccggggaaagacggacgacgagggcaacaggtgaaacaagcaagaaatttaattatcagagaagaaatggcatttttaaaagggaacgaatggcacgccgggcttaaagggcacttccggcgattgtttccattgtccaccgccgcggacgccacccggctattgaaaaaaaatgaaataaatttaacaatttatcgaaaaagaattatgaatctgttttttgctgttttgatcgatcagtttatttttatttactataaacattttgccattctttcgcgtaattaataaaaatgattcaaatgttttcttgttcacacggcttttatcagtgaatcagtgttgttctgttgttaattaattaattaagcatgactttttttggcagtttcgaaaacgcggaatccatttttatttctttagattgacagttttcgaattaccaaaatggaaaaaaatagtccatgaagcaaaggcttgttagttgattgaactcattaattttatgtggattcatagaatgaattgaactcaaaaagctctggaaccctattaccggcagttcgatctaaattaatttaatttcagtcgtttgtcttttattaattcacttgaaatcaaatttatatattatcaaaaaagtaaccgatgcgtctcaaaaaaggacttcaccaacaaaaagcaagcatag

SEQ ID NO: 82272 - DNA, 2201 bp, Heterodera glycines
  Genomic contig location: Contig_ID=SeqID_2902; Location=1846..4046; Strand=+
  SCN-specific regions: Sequence locations=1-47,69-926,969-1521,1559 -2094,2116-2158,2181-2201
atggactgcattgacggctttgacattcgtctggagaaagtcaacacaattaaaatggtaaataatgcaaaaaatttgaattttaggacgttttttacccaagtgagacgataaatggcgtggtaatactcgaaacaaatgcaccacttcggctgagaggtgaggccaaactcagaagcaaaaaaggagtcaatttaaggcatcagagtgtttctgcgggggcgggcgcgtgtccaatggaaagtgctgaaatcgggcgaatcgaagtgagcgcacagagagagagagagagaagagggaaaaagattgattagctaacaaaaggcttaaaatgggaaagtgccaaaaagcaatttttttttggcatcgtttggctttttccaccccttttcatatgctcgagagtctcggttttttcgagtcggaaattaatctcggccatcagttgcggaaaattttgactctcgagcactcgttagcctttaaggacattgaaggacgaccaatatttgttggatgaaaagttgcttttgtggggccgcgaccgacgcgacggcggcgacgacgaagaaacggcgcagattctgccgcgggggacgcacgagttcagcttcggtttccgcttgcccgccacacaaatgccgagttcgctggaaacgaaggcaaatttagggattaattgggcaaaaatttgttaatttaggccggcacagttcgctattatgtgaaggtaaacaaaagaaaagttgttttgacttccgattgcattttcaaaggttatagtcgacgttccttacgccagttcgcctcagggcattaagtgaaaattaataatttaaaacgattatttcgaattgtttagatattttacactgatcggcccacacattgactgtatggaggagaaatatttggtaaaaatactcaaaaaataaaatatacgaattaaataaaattaataattttttggacccatctctgtgcccaggaccaccaaattcgttgttttggctgttgcaagagaggagtgattgccctcagagcggtgagtcattctccccatttcccaaatggtcattttctaccctcattgtctgccattttctcttttctccacttttgaggttcttgaacggagtgcctattgctgtggcgaggtccttcgccttcgtttgcaaatggaaaatcgccaacatttccccgccattgtttgcgtgcgtctaatccaggcaaaaatcacttattaatagagaccggatttttatgtttttacatattttttttgcggcttagttatggcgagagaagcccaaaaatagcattatctccgaacaatttttgatttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcattttttggggtttttagcacatatttcagcattttttagcacatattttattacatatttcaggatttttagcacataaaaatccggtctctacttattaaattcaaatttgttaaattacttaagcacctcgagtaccgtatcgaccgtggggtcattggtacggtagcggacgcaaaaaacagtgatttttcgtataatattttatttttcaaacatttctcaatttagttcaatcaacagcctttgaatggaggtagcatttcttagaattaaatttgaaaattttaaaagtaaaattaggtcatttccgatcggcgaacattcgcaatttcgactcgacgccggccaagaactttccctgaaaatccccgtccttcctccgacaatg

SEQ ID NO: 82273 - DNA, 595 bp, Heterodera glycines
  Genomic contig location: Contig_ID=SeqID_17734; Location=2134..2728; Strand=+
  SCN-specific regions: Sequence locations=1-595
  Gene Ontology: Cellular component=cytoplasm; Biological process=cell differentiation
tccgcttttgggtcggttaaagtgaacattttcgggaattctgagcgttatccaattgttacctttcacgacattgggctgaatgcgatcgccaattttgagaatttctttcaattccaaactttttctaaactgacggaacagttttgtgtctacaatataaatgcaccaggacaagaattagacgcaaggaagttgccagaaaagtatggcaatttgggtcgcttattttaatttgttgtcttgtcgcgtttagtttccattatccgacaatggatggtcttgctaacattgttggcgatgtcgtctcacattttgggtaatgtttttataaatgcaattgccctcttttatgatcatattccacgaagtttcaagtcgtttattggcattggagttggtgcaggtgccaatgtattgcttcgtttctgctgtgcgttttccacattagcaactaattacaatttaaatcccctgcattttctccattccagatgagtcatcagaatctgttggatgccctccttctgatcaacgccacctcccaaaaggcggagggatagaatgggcctaccgaaagagtgcgtttcggttg

SEQ ID NO: 82274 - DNA, 2352 bp, Heterodera glycines
  Genomic contig location: Contig_ID=SeqID_17735; Location=49..2400; Strand=+
  SCN-specific regions: Sequence locations=1-394,430-980,1009-1071,1116- 1746,1768-1834,1857-1929,1951-1952,1974-2038,2085-2134,2156-2352
atggataagagtctccaaaaattgcaaaatgaattatgtgactcatcgaaaaatgaaaattttcaaaatacgatggaaatatttcaaacgacaaaaattgaaaagaaaacatttgacaaaagccaaatggacacagccttggcaaaagatcaaactctcaattacaacaataagggaatgttttcagaacttgtcaatttttcaagcaaacttcttaaaattaatgaaaaattaattgaaggtaaaatttaatatttttgaaaaaaaacaattaatcgtttcataattagtgccaacttggtcagttccgacaaaattccttctaagtttggcacaaatgtccttcataagacttaaaaaattcattgctacaattaaagtgacaaaacaattcaaaattttattttttaaataatactaataaaaaaacacatgcagcaccgaaagatgctaaactctgaccagggcttgacgcaattacggattacggatttgtgatatttttttgctccttttggattttttagagatgatttctttgcaagctttttttaaaaccaacaattttttctatgtttaaagtattacccatagtcttttctttgtatttgtagtattatttaggatagataccccataatttgggttttccaaaataggggacgtcctttttcgtcgcctcgtctaattttttccccattttcgttttttgaaaattcttatcgatattgaaatgaaatcccgggcatgaggatatttctaaatatggtctcgattgcttatttttggtcgaattttattaaatttttttgctcggttcaactcccacatacagcaggaatatttttttgagttttaaaaatgtcttatccaatataattttttcgaaattatttaacaaattctccaaaattgatgatttttttgacaaaatctgttaataagtcgcatcacaatcttcggaaaaatttcacgccggcaaaattattattttcttatataaaattacaaatttgttatccccgtttccccggcttacgaagcaccgttgtcgggaatcgccgattaaatttgcaaataaaataaaattgttgatttattatctaatcagttgcgtttttcagctaaaaagcttgccgtgttccatcaaaaaccaaaggatttactcggcagaagaacaaagcgtgccgacgacaatgcaattaagggctgcatctcgtcagtgcttttaacattaatctctgctccatattttggttattattcatttcaatatgcccacgagggcaatgtccaaattgaatacactgaatgttataagcatttgttctcctatcgctgttacccagcccattcttcggttgtcacggagattgttgaatggacaattatatttgccattggactgatacttgcactgctgttttgttcttgtgcccgtggatgatcgtcatactgtatgattacgtttatgattatggatgcaaattatatggaaatccattttttcaggactatgggaggcctgaaacgtatgaaaaacatgtttttgggctttgaggcttctaggatggattcctttattccatatttttccatatttcgcgattcatgtccatatttccacatttgtccatgttttggcattatgtccatatttcgcgattttatatccatttttttgcatcccttttcatgaccatgtgctacagttttttattctaccaatgttttatttgattcaagtttgtgatttttgctacattgtaaaatttttgagggaatttcggtccatcggtgctaatagcgcctccggagaaaaatttgggggggtttaacaaatttacaaagaaaatttactttatagaaattctttatgtatttttcataacgaaaaatcaaaagcttaaaattacccaatttgtatttgaaattgaacccttctgtttaaggctttctctgttctatgcttctttctttatcaatttgcaagcatggctgtctttattatggacaaaaaaaactcacaaaaattgtcattttttagaaattttgtaaatttataaaaaatatgaatattttttggagtaaggggacctgaacaatttctaagcaattttgactgaatataatttttgacaccatttctattgttattttcacatctcgcagatcttttccgcaaaaagcaagtgatggttgtcccacattgtaagctgcataagcatcgagtaaattatccaaagtttctggaaatactcaccaaatgatgggctcaagaattgaatttacttttttataaatttttccaaaaatttttatgattttcgtaataatacttgtttacctcca

SEQ ID NO: 82275 - DNA, 546 bp, Heterodera glycines
  Genomic contig location: Contig_ID=SeqID_17736; Location=1103..1648; Strand=-
  SCN-specific regions: Sequence locations=1-69,92-114,143-521
atgggtgggcctgtcggcatgacgagagggaaatataaaagaaatagaaggtattgtgaacttttcatcttactttttaaaaattattttaccaattttgtcgccttggtgtgctttttattttattttttttatatttttagacaaaaacttttacaatcattagattttcagtgaggttgagccaagaatttattaaaaatgtttttaattgatatatttcctagactgatttattttttattttttctcatttcctcgcattcatactcattttttatcggtttaaagctcttccttcgttgtaatatattaataattcttgggtgcatattttgtttattttttttttattcattttaacaaaatttgtagaattatgtttcaattttttcggtaaatatttttaaatttttctcattttttattactcatttaagttttcaaattcaaatttttgaaggtggtgaccatattggttggattgattttatttataatgggtaaagctagattcttctgaagtatttacatttttgtaataaa

SEQ ID NO: 82276 - DNA, 65 bp, Heterodera glycines
  Genomic contig location: Contig_ID=SeqID_17737; Location=83..147; Strand=+
  SCN-specific regions: Sequence locations=1-38,60-65
gccaagtttcaaagctcgaagaagcactaaggaagctggacaaagagaaggcaaaggcaaaatga

SEQ ID NO: 82277 - DNA, 2044 bp, Heterodera glycines
  Genomic contig location: Contig_ID=SeqID_17738; Location=572..2615; Strand=+
  SCN-specific regions: Sequence locations=1-86,123-203,225-411,433 -724,757-865,887-1059,1103-1586,1611-2044
aaaatgctgccaactcccaaaatgttagtcatcgtggcgttggtcagcttctgctccaattggcaatttggctatcaggcaaattcaaaatttaaataaaataattaaaacaattattaaatgctatttgaaatagccttgcaattattgaccaattaattaattggtcaataattgacccattccttctttgcctgtccacagatcacttacattaacactgcccattggtccttttacgctttggcggacgaagtttatcaaaatgaatcggtgacaataattaaacactttcaaattttaattgcctttttccttttttgcctttctctgcgcatttgccacaaagcgaatggaatttgctgtggagtttcattttggcctcattttacggcggcactttgctcggttttgttgttgttagtgggcatttgttcaatttccattcaattagtgtttataatagccatttccttttttgatttgatcaattcctttttatgtgccccgtttgattcgttttgccggcggtgttcgcaatgctttgcttctctcttcgctacccgcaattttcggctgtgccgttcaattggcggtgcgtttgtccgcgagtaaattttgccaaaattcgaattggttttaacccgtccccaatttgagctttgcccactctttgctttctgctctccgtcggccgtcttctcgtcggtgttcaggcgggctgttcgctgtgtctgctgcccctttttatcattgaaacggcgccatttaatcaccggccctttctctcatctcttcaggcacggacggaagaacacttctgatcattctcactcagttgctgatcagtctgagttgatcacagcaatcactcactgatcactcacatttgatcattttcagctgatcctctgatactttcacattgatcaaaaaccctcaaactttttaaggtcgttttccaatcattggccactttgatcggactttcggttggctctgatcatttgttgtcgttgggcgagcacaaaattgaatggcttcaggtccgactttttcaataaatttttttatttgttcaattattttatcatttttaattcatttgattccaattttgagatcataggccttgctcccacaatgtttttcgccatttttctgctgtggttgcccgacacgccctttcgcctgttggaaatgtgccaaaaacttttggactttgacgacggggcggacgaagacgtcgaattgagtgtgccttttgttacatatgtattatctcaaagattttgacagaattcgtactgtcctccctgttttacttcggcacaatcgtcgtcttcggcgccattcgttccgaagcatttgagcggtggtccctctcgccggaagggcgcaaaggacggcaaaaatgggcggacaattggaagggtggtgaatctccgcgcttttccctcaacccccccccccccccgtaggacttttggtcggcatttttgccgcagtttcctttgcttttactgccgatgatctgatcgattcgtattctgccgactttttctacgtaattccaaaattaaatccaaaaaagtttttattttaattttcgaatttcagcgcttttccttctcgcccaaggcgaacgcggaatttttaaccgccgggctcggcctcttgctatttttcaccagcattttgggcgctttccttgtcattagcaaattcgtttgctcagcttccctaatttgttgcaattaggccgatcgcttcgggcgccgtcgtctgctaatttccggccttttgggcacagccgtttcaaatgccatcgctgcgtttggcgcgtcgaccaattcgacttcgaccgttaaattagacaaagattgatcattttatgcatttcatcaggattatttctgtgtcaggtcgccattggcttcgccctcaccaaaactttcattggcttcggcgccggtgcccccgcgtggtttctcacctccgagttggtctccccactttttgtggcccaggggcaggccattag

SEQ ID NO: 82278 - DNA, 812 bp, Heterodera glycines
  Genomic contig location: Contig_ID=SeqID_17739; Location=739..1550; Strand=-
  SCN-specific regions: Sequence locations=1-156,182-353,387-418,458 -467,489-561,607-812
atgagtcaaattcattcaaaaataattcacacaggttgccattttgctgcttttgtgccaatggttggtgccgttgatgtggctatggcgccaggtcagtgtgtcatcttttcccgccataaatggcattattcattgatgccatttttgattggatttcccctcccacccccacttttcagaaccctgacaatgccgcaattccctatctgacagcggtgggcgacctgctcggcaccaccttccttttcgcggcattttccgtgttggcattgttgaagcccgaagaattggtgtccattgtgtccagcagcactgcctcgccacccacgggaatgccgccgtcgccgggctaattaatcaatcaattaattaattaattaattttatcatcactgtgattatgagtctaatcaattttaatgatttgatttgccaaatctcattgtgtgtgtgttctcccggcttttgtttttgttattaaaaaagaagcaaattgttttccttcaattttttctcgtcagcttttgtttgttcttctgcgtcaaaatactcaaaagatattattattattattattattattataattatcatattattatttcatttttatgaattctctctttttcaaaattaattccttaaacatttgaaattcaattcaaatcgccttcttcttcagtcaatcattgttcaattcaaatgtgaatttcgcagctgcattttggctatttaattatgcatttattgttttttgtttattttttgccctgaaagaggtgtcaaaatggttttctctttggaataaa

SEQ ID NO: 82279 - DNA, 406 bp, Heterodera glycines
  Genomic contig location: Contig_ID=SeqID_17740; Location=190..595; Strand=-
  SCN-specific regions: Sequence locations=1-112,167-406
atggttaatttcctctcccgaaatgaaaaaaaaacaaaaaaaacattgggcatttttaggcacaaatttacgacaaaatccaaccaaatttaaaaaaaaaaccaatccgtccatttatataaaacagtattaaattttattattattttttaattataaattattacgcctttttcctcaactcatccaccattaaggcgttggtggcaatttggccgcagtggccgcctccaaactgtccacattttatcaccgcactgcacagcttggcatattgccaaatgagtggaccatgggccgtttctgctccatttcgagggcatttttttcgcccgattcggtacttaaaagagcggaagggagagcaaatccttcctcctcgaaacttcagaaaattttaattaaa

SEQ ID NO: 82280 - DNA, 555 bp, Heterodera glycines
  Genomic contig location: Contig_ID=SeqID_17742; Location=598..1152; Strand=-
  SCN-specific regions: Sequence locations=1-66,88-170,192-213,260 -295,317-555
atgccatgggtatgggaaaacgctgcgcaggatcgccgtcgtcaacaacaacattatgcaatggtgaaaatacttttaaatatttaaattatgcgggatttttttattcactaagttttgtcataaatccaatttcatcatttttttaatagtatttgccctcctttttagccacaaaattaaaatgtgattaaaatcgataaaaaatttccgattttttttaaatttgttaatttgaaataaataaataaatatttatgggtccaaaaattgaggtgaggcgaaaccgtccactctcttcctcttcctcggccttgcccccagacccatggctcgaacaccgccgccgggactaagccatgcccaaattgcagaaattttttccaccattgaagtgtaagaaaacatttcacaaaaaatatgttccatctgtcaggaacaatttgaggtgggttctttgggggcgacaatgacaccgtgccatcattttttttcattttggatgtgccagggaaaatgggcggagccaaaaaatcaataatggtgccaaataaa

SEQ ID NO: 82281 - DNA, 796 bp, Heterodera glycines
  Genomic contig location: Contig_ID=SeqID_17745; Location=397..1192; Strand=+
  SCN-specific regions: Sequence locations=1-365,387-737,759-796
atggacgaggagggcgacgaaagggacgacttttgggccaacatcggctcggacgatgtcaaaaacgtcggctattggtaagtttaggcattgttctttatgttccatttttttaaatgtcgctcgaggcaatttttattccaatataaaaattgccaaaaaaaaattagtcgaagagcggcgacttttttttgttcacagaaattatctttaccatttggagaatgcatgcattttccgggaattttagagtctaaatttattttgaccaattttgacaataaactctaggcctgaattcgaacaaaattcgataattcaaaaagtatgaattcagacgaaaaacttaataaaaccaacgcttgataaaaatcatagataaatctaaaattttcaaaacccaaaaacataatcgtgtttagcacgtgtatttttttttacccaaaactcaataaaaaaaaattttttagctaaattttcctgattgtgagggtattaccatgtttttaaaccgtctcgagacttgaccaaatactgcccgtttgtttgaccttgtcattccctttttgcatttggcagttccaaacacgacaattgcgagctgttgccgccgcggaaaatcgctggccgcaagacggactggcgcgaatacattgtgaccaaactgaatgactgcaaaactttgactggcaaatgggtgcgcgagcggcaactgtcgctggtcgaaggacggtttaaggtgggcaaaaaatgggcaacccaaaaaaaaaactatgggattattttttggatttga

SEQ ID NO: 82282 - DNA, 1017 bp, Heterodera glycines
  misc_feature (12)..(12): n is a, c, g, or t
  Genomic contig location: Contig_ID=SeqID_17748; Location=44..1060; Strand=+
  SCN-specific regions: Sequence locations=1-301,323-507,531-1017
atgacgagctcncaacccattatttatgagaaaattgtgcaacaaaatggtagcaaaaacagcgctgaatggtgtctggcctcggaacggcgactgctccaaaaactgatccatcataagccggtggggatcaatcggcacttcaacctcaacttgttggtcatttacatgaacaacattttcgactttgaggaggacattaactttgatgttggtttttgggtttctccctctttttttgtaaacttttatcgacattcttttggattcggagtcgacaaaaatataaggacagaggccgaaaaccaaagggggcggggcggcactttttcggtttgcaaaaaaagaatcaatttagctttttatagctggaccgagacctggatcccggtccaagccatttttcagcaacctgggtttttcctggacattgtccaggaagcccatgtttccatgtccatgcatgaaaaagctggatttcctggactttgttatctttatgtagcgaaaatgttaagcttttttaaaatgctcaaagacaatatttgttcgtctaatggacgcggctgggcaaaacttgaaaatttcaattaatttttctctaaaagttgatgcttttcaaaatttctttggttttcgaccccctttggtttttaaacccaactaattttgccaatccctaaaaatttattatttgccctctaggactatctgagcgaaaaggatgttgaacagttgaagaggcggcgtatggagggcaagcaggacgagcgaaggccaatggcattttcaccgtcctacgcaattcgaccgaccacgaaacaggcaaaaaaaagaccaaaataatagccgaacttatgctaatttgtctgttttaaggttgaagaaaagttgaacgaatacttcgacatggagctgatcggggagaacgagtccccctctgaagaattggaaaagaaagctgtttttgaactgccccaagagtaccaattcaaggaggaaatggtcccacgataa

SEQ ID NO: 82283 - DNA, 457 bp, Heterodera glycines
  Genomic contig location: Contig_ID=SeqID_2903; Location=560..1016; Strand=+
  SCN-specific regions: Sequence locations=1-370,395-457
atgactattgtcgggaaagggggatctgctgtcaatgccattagtaggtctccttttggcgacgacaaagactcgcgccgttcggtgtcgccgccgggcacaaagcgtgtacggaacggcggtggcggtggagacgatgacagcgcacgacgcaatgacagggacagcaagcggagcggtggacgaagggaacgtaagttggaagctgggtgcaattttcaccggaaacttattcaaaccaaaaaaaaatgtttgaatttttttttttgggtagggggaggggaacagcggcttcattaaatttttcatttttttaatcaaaaagaaaatccaggcaccgctcgtcatgacgaggaggagcgagaccggagtgacagggaccgggagcgggaccaccaagagcgggaacggcgacgcattggactgccgggcaagccgaagtcggaccatgtgctga

SEQ ID NO: 82284 - DNA, 1928 bp, Heterodera glycines
  misc_feature (67)..(67): n is a, c, g, or t
  Genomic contig location: Contig_ID=SeqID_2905; Location=1..1928; Strand=-
  SCN-specific regions: Sequence locations=1-76,103-126,209-248,274 -819,842-883,919-920,951-991,1013-1324,1393-1480,1502-1573,1676-1928
  Gene Ontology: Mol. function=single-stranded DNA binding; Cellular component=nucleus; Biological process=regulation of protein activity, epigenetic
caaagatttttagcgccacctccgtcgccgaatggcattcgcccgccggcgtagaaggcaccaccgncccccgcgtccaccgccaccaccacgaccaccaccgcgtccgcctctgccgcccatcggactgccaccaccgccaccattgtcccaaccgcgtccacggccaccaccgcgaaagccaccgccacgccctcgctcaccaccagtgaacggctgaaaaccgccaccagcgccgggacgaaaagcgccgccgcctctaccgccgcctccaggcgaatctttgaaattgggtcgcatgcatccggttaacatggtgataaacatggtttatgaaacgcctactgaatcgttgctggaagccgccgccaccaccacgtggaccgccacgacttcgccaattgcctctgctggggtcgccaaatccgccagttgggtagccgccgcctgctgccaccgcattggagaagccgacattggcaaaaccgccaactaaaaagtcatttacaattagtgccaacaacatatgacatttttgctccccttttttatccatgtcgaaattggccaatggatgttgacccataatcccgaattaatagcgaaaactattttgaaaattcttaacgattttttggaaaattgtgaaaaatctaattttttttttaatttctcgagggaaaacgttgtgcacccaaaggcaaaagctacgtaaagagatggctaatcgaacggcgaagaaaagggaaaaaggtgtccgcaaagggatccaagggaatgaaagcaagaagcaaggccgcaaggaaatcaaaagccttttgtggccagtcggcgggcgggaacggaagggtgtaaaatgaagagaaaaaaggaggggggggggataatttttcattggaaaataaagggattttatttgtagggggaaaggagggagaagaaaacacaaattatttcgcaaatcgcgacatccacatcttcccaggaatgtacccccacacccacacagaatgggccgggggtatgaaatttttatgaaaaaaatgaataaagcagaaaaaaggacccaaaaatccacaataattgagtccgtcacaaaaaaaatttgaaggagagattgccggcagtgccgatggcatcgccggagaaaattttttaacttcttggggttcgtaccccacgtacgccttccacaccccgcccaaccgcgagaccatccctgtccccgtcatttgccctccccgcattcatacgcgatgttggtggcgcggacgctggtgttgacatcagcgcggcaattgcgctgctcaccggagtcgtcaattgctgttgttgatgctgctgcgctattgctgtgtctgtttggtgctgttgttgttgttgttgctgctgggactgacgtgttacgcttggcggtgggatgttcggcggtgggaaactgaacggcaacaaattgccagcaaatgccatttgagcggccgctgcagcggcagcagcttgcgtgaacattgctgcgggctaaacggggggaaaatattacaaattgggagagagaaaggtggaccccgacaggattttttaaaatttttaaacagaaaatttttcaagaaaaaatcttagaaaattttccatataagaaaattacaaaaaaaaaaatttagaaaattttttttatcaaaaaactcgaaaaaaatttaaacgagtcaaaattctgagaaaccctaaagaaagtgcaatcacaaacacataaaatgttcataccatgagtccagcggcagcggtggccaccgatggcatcgccgcctgcggcaacgtgacggttgttggcattggcgttgttgtgcccagcgcggcttgttgttgctggtgttgttgttgcactaaatgagtgacggcagccgaagtggaaagcaacaaattgtgctgat

SEQ ID NO: 82285 - DNA, 1179 bp, Heterodera glycines
  Genomic contig location: Contig_ID=SeqID_2905; Location=420..1598; Strand=+
  SCN-specific regions: Sequence locations=1-8,30-117,186-497,519 -559,590-591,627-668,691-1179
atgttcacgcaagctgctgccgctgcagcggccgctcaaatggcatttgctggcaatttgttgccgttcagtttcccaccgccgaacatcccaccgccaagcgtaacacgtcagtcccagcagcaacaacaacaacaacagcaccaaacagacacagcaatagcgcagcagcatcaacaacagcaattgacgactccggtgagcagcgcaattgccgcgctgatgtcaacaccagcgtccgcgccaccaacatcgcgtatgaatgcggggagggcaaatgacggggacagggatggtctcgcggttgggcggggtgtggaaggcgtacgtggggtacgaaccccaagaagttaaaaaattttctccggcgatgccatcggcactgccggcaatctctccttcaaattttttttgtgacggactcaattattgtggatttttgggtccttttttctgctttattcatttttttcataaaaatttcatacccccggcccattctgtgtgggtgtgggggtacattcctgggaagatgtggatgtcgcgatttgcgaaataatttgtgttttcttctccctcctttccccctacaaataaaatccctttattttccaatgaaaaattatcccccccccctccttttttctcttcattttacacccttccgttcccgcccgccgactggccacaaaaggcttttgatttccttgcggccttgcttcttgctttcattcccttggatccctttgcggacacctttttcccttttcttcgccgttcgattagccatctctttacgtagcttttgcctttgggtgcacaacgttttccctcgagaaattaaaaaaaaaattagatttttcacaattttccaaaaaatcgttaagaattttcaaaatagttttcgctattaattcgggattatgggtcaacatccattggccaatttcgacatggataaaaaaggggagcaaaaatgtcatatgttgttggcactaattgtaaatgactttttagttggcggttttgccaatgtcggcttctccaatgcggtggcagcaggcggcggctacccaactggcggatttggcgaccccagcagaggcaattggcgaagtcgtggcggtccacgtggtggtggcggcggcttccagcaacgattcagtaggcgtttcataa

SEQ ID NO: 82286 - DNA, 741 bp, Heterodera glycines
  Genomic contig location: Contig_ID=SeqID_2907; Location=474..1214; Strand=+
  SCN-specific regions: Sequence locations=1-55,77-100,214-214,241 -424,480-607,643-741
atgatgaaaatccagtggataactctgtttgtggtgcgttaagtcttaattgggcttttgttaatacatttaaaaatgctttttaattataaaaaaaagtattaaattaaatttttccaataatttaaatattaaattttatttatttaattaaaatatataaaattttgtttaaaataatcaaattaaaaaaatgaataaacaattaatttatttatttaataaacaaatatgtatattattttagttgtccaccaccatttcggcaattttttgtgcttcttccgtcaaattgccaagggcaattgccgggccaccgaattcgtacgtaaaaaagccgaactatgcgcaacagcaagcagttcaaaagcagcagcagaacggtatgccaagctcggcaggacgtgttcaaacatcggttggcattttttaaatgaatttattaattattttaaatttgaaaatattatttaaatttacttcaaaaataacaatggcattttgatcaaatttgtttaatttatctttttagtttggccctaaaatcacatttgctaatggaactgtgttcacatcagtttccgaccaaggggtccaattaaaatggaaaatttttttaattttatgaaatttttatttttacaggttgaagcttcagtccaaactagtgaaaggtgactaaacaaattattaatttgatttaaataacagtcataggttgattgatttaaaataacaaaa

SEQ ID NO: 82287 - DNA, 374 bp, Heterodera glycines
  Genomic contig location: Contig_ID=SeqID_2908; Location=982..1355; Strand=+
  SCN-specific regions: Sequence locations=1-166,252-309,356-374
atgtttaatgcgagttttaggaaggatttcaaccctaaattgaatggcggtgatccgaatcagcctgggatcaaagcgcgcttaaatgccgaggcatttcgctatttgtcaggcgaacttgtcggcatattgagtataacattgcattttaatgaatgaattggtttttaattaaatttcctaattaattgaaataaattttaattataattttagcagttttaatttaatctaattaattaatcaaatttcagactatcaagtgaaacgcgccaaattgcctgacattgatcagtgcattccgaaggcaattttttagaaattatttatttatttaaatgttaattaatttttaggccggcggatgtttgaga

SEQ ID NO: 82288 - DNA, 1191 bp, Heterodera glycines
  Genomic contig location: Contig_ID=SeqID_2909; Location=153..1343; Strand=+
  SCN-specific regions: Sequence locations=1-35,87-240,265-268,313 -324,378-383,416-433,455-468,503-600,848-956,991-1149,1173-1191
atgtcaagtcccctggtcaaaaaagaaattaagtgttaattaatttttttttaggtaaaattttaattaattttttaaatttaaaaccattaaaaggtaaaagtggggattggaagttttgttgaagaacagtgcaacaaatgaggcaaaactttgggtggttttcttgggaccaatttttgttttaatttgaaatttgaaattttcaaaagcaaaaacaaaattcaaaaattttagattcaatttcttttattgtttttctttactctaattaatttaattaaaaaaaacaaattaatttataataattaaggatcatttttcataataatttcaattaatttattgttgtgttgtttttcttagaaatgatttttgattgctaattatacaaattaatttttaataaataaaaccaaaagaaaacattaatatgaaattgttttaaataatgcgtaatcttaacacatttattatattttatttttaatttattattaatccaataatttcaggctcaagtcgttttggccgaattgacacttccatccaatatggcggcttattaggcgacattgccaaccaacagcttaaagtgagtaaaattataattgcaaaatttaaattttgagtttaattttagtatgaaaatattttaaataaatttaaaagacaaaagttaattagcaattttatttatgatctaattaattaaatgaaatttatttaaaaaataattaataatgttattttgaattagttcatctataaattaaacatttctttggacattaaataattagtttaatttttttaaataaaatttcatttgaaaatgcccttggcaatatttccctaatttaaatttgttaacatttttcaattttgaattcagcaaaaaatcaacaaggttgttcgtcgccaaatcacttcacaagtaccacatttgcatgatcattttttaaaatattttttaaaataaataattaagcaattttcaatttttttagctttgtaaacgcgtcccacaaatggtcgatgagcaagtgaatccccaaattgctggcgttgtgccaaagaaaattgcgttcaaatccatctcatcggttgcactgaattcgtcatgtcttgcagctttgacgggcgacggcggcgcagtaatttaaataaaattcagaaaaaataatcaaa

SEQ ID NO: 82289 - DNA, 902 bp, Heterodera glycines
  Genomic contig location: Contig_ID=SeqID_17751; Location=196..1097; Strand=-
  SCN-specific regions: Sequence locations=1-167,195-400,422-634,771-902
atgctggatcagctgaaaactttgctaaagcagcctcaggaggggcaaaggctgatcagaccgaaactgttgaccaatgtgaatattttgccaaacgaatggagcatttacccggcgccgcggaacattggggccaaaagtggaagtgatcgtgatcagaaattggaccaaggacaacaacaacaccaagaaacggcagatgaagaccgatcaacagatcagaaagtgtcggtgcaaaccatcgaaattggagcagacaatcaacggggagaaggtgagcacgaaaacggggagaaggtgaaattcgtggactgaagcaatcagtcaatgtctgaatttcgaaaagacgctttcattattactttggtctttgctcgttaaactctgtccatttctgcattgaagtgccatcctctgcaagtagaagcactccaacgcaattcccgaccacatcggcagactcaattctgacacaaccgcagttcgaactgaaggcgaccattcgaccgccaattgtccaatcagtcgtattggtaattatcatttcatttattagggcccaattgaaaataccttcaaattatgtaatttattgcgttcacaaaattggccaggtgcccgatcaaaaaacaacagaaaaaacagcaaaagaagaaaaaaaagagacgaaaaaggagacggaacagcatcatcagcagaacaaagaggaggaggaggaggagaaaagggcggtcaaaatggaggcgaattggcagacggaggagcagaagctgatggccgaaatgcgcatggcggtgcaaaaggcggactcagccatggaaaaattggaaagccaacggcgcaaagagtcggcacaggcaaacaataaagcaatttggaaaatgataattgacactaattag

SEQ ID NO: 82290 - DNA, 759 bp, Heterodera glycines
  Genomic contig location: Contig_ID=SeqID_17753; Location=1238..1996; Strand=+
  SCN-specific regions: Sequence locations=1-10,43-330,354-582,606-759
atgcaacgaatggaacagatgaaaatggcgagtaccaaaatttttaaattaaatccgagtgaccccttcccaaataattcatgttttttcttctagacagaaaacaggctaaggaaattgccaaggcatttgggatgtatctgaagcaaatggtgccaaatcggaaataatttttaatattgtaaggaagaagctggctgggcggttaaaacgcggaaagcgggggttgataagatccataaaagaaagggcggatgtgcctcggtagcttaatggtagagctgcccacggaaagggtgcatgagtgtgttcgattcccacccgaggtttaacattttgcccatttcttattggtagcaccggatggttgccccaccgcgccagcagcaattaactaatggaccgagggaccggtcccgatgaggatggtactgtaaggaagaagctggctgggcggttaaaacgcggaaagcgggggttgataagatccataaaagaaagggcggatgtgcctcggtagcttaatggtagagctgcccacggaaagggtgcatgagtgggttcgattcccacccgaggtttaacattttgcccatttcttattgtacggaccccggcccagtccctagcaactcaatttactgtaaagttatcgaaagggccggagaatgttaaatttggctgagtttagacaattttatttttatttttcatcggtaatagctcataggttgcggaatataggaaaagcatcagtaa

SEQ ID NO: 82291 - DNA, 1338 bp, Heterodera glycines
  Genomic contig location: Contig_ID=SeqID_17754; Location=1..1338; Strand=+
  SCN-specific regions: Sequence locations=1-366,388-1182,1206-1338
ttttaaagaggccaaaaagattgaccgggaaattacgaccgatgacgttaataaattcctagaaaagcagagaccatacacgattcataagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagttcaccggccaagtcaaagaagagtgaggacatgatcgaggctttttatcgggtgttcgaaaagtctaaaattatcccgatgaaaatatatagtgacagcggtttagagtttcaggcgggaaaatgaaaaaatattttgaggaaaaattcatcatcaaaaacgtaatgtatagtcctgatctgcacgccggagtcgttgaaagggcaaatcggacaataaaggagcgcttgtacagatattttacaaagaaagacactcttcgatgggtcgacgtaatagataaaatagtctcaaacattaagaacagtgtgaataggacactggggatcaagccgtcttcaattaattttgaaaatgcccgcgctctctgggaaaaattatataaggctagggaatttaaaatttcgaaaaagaacaaatttaaaattggcgatatcgttcgaattaccaaggaaaagggaaaatttgcaaaggggtatctcccaaactttaccgaagaattatttaaaatcgttattgttaattcgacgacacctgattcatacaggattaaagatttggaaggaaatttaataaaaggcatattttataaccaggaattagtgaaaatagatggatgatttttacattgtactaccctcgaacacaccgggaccagggaacagtacatcaaaattcacagtacgactccccgagactttggaattgggcaaaaattggtcagtagctctctcatcaattatttacccctactcattcaccgctctcggtataaatggtcaagagtttattaaagtatgggaaaatgacagcagtgtccccattcaagtttattaccggacatgaattttaaaaccgccgggggattgggaaataaaattaacgaagcattcacacatcattacaaaatcaaaaaacaacgtggaaagagagaagccaaggctgaagaaaccaacgactcaaaaattgatgtcgcaaagagggccgcagaacgcgccgggagagatgtagaaagacaactcaatcatatcaacaatgtctcgagttccatccaaaccaaactaagcacactaagagaagtaaatcct

SEQ ID NO: 82292 - DNA, 108 bp, Heterodera glycines
  Genomic contig location: Contig_ID=SeqID_17757; Location=1..108; Strand=-
  SCN-specific regions: Sequence locations=1-58,85-108
ggttcgatgaaacttttattaaatataagcctaaacttttttgtcctgtttaaaagggaattaaaaatttttaaaaattttattcatctcccccttttgatagaaaaa

SEQ ID NO: 82293 - DNA, 154 bp, Heterodera glycines
  Genomic contig location: Contig_ID=SeqID_17757; Location=264..417; Strand=-
  SCN-specific regions: Sequence locations=1-32,58-154
taagcctaaactttttggcctgtttaaaaaggaattaaaatttttaaaaattttattcatctcccttttgatagaaaaagcatcagagagccttatttaacttttaattaacatttggtgcgattcagagcacgttctaaaaaatatttatgaa

SEQ ID NO: 82294 - DNA, 436 bp, Heterodera glycines
  Genomic contig location: Contig_ID=SeqID_17757; Location=1350..1785; Strand=-
  SCN-specific regions: Sequence locations=1-56,83-162,209-209,235 -390,420-436
agttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcctgtttaaaaaggaattaaacatttttaaaatatttattcatctcccttttgatagaaa

SEQ ID NO: 82295 - DNA, 444 bp, Heterodera glycines
  Genomic contig location: Contig_ID=SeqID_17758; Location=290..733; Strand=-
  SCN-specific regions: Sequence locations=1-18,40-309,367-373,395-444
atgagccacctcaaaaatgagcacaaaaacgagacgaaatgccaaaatgatccaccatttgtcttggaattcgtaattgtcgtcgcagacagtctcaaacgcatcgccccacacttggcgactgatcggctgactgatcagtgagcatggtgggcgccggtagtcttggtaacgacagtaggtcgtgttcggaaattccgtatttgccacagtcaaagttgacgagtcaaaataggcaaatgtatcgtcggcatagctaaatgatcaaaatgtgacaatttgtatatggggttttgtcattaaaattggtaaaaaaaattttttttttttttttttactaaatttcaatatttttataattaatttcagagtaccatgggttgagactcccaaaaacagggtttggcgatcccaaaagtaccaaaaataattgtaaggattaaa

SEQ ID NO: 82296 - DNA, 1450 bp, Heterodera glycines
  misc_feature (421)..(421): n is a, c, g, or t
  Genomic contig location: Contig_ID=SeqID_17758; Location=478..1927; Strand=+
  SCN-specific regions: Sequence locations=1-217,239-254,325-348,383 -538,608-638,691-1088,1111-1125,1167-1450
ctatgccgacgatacatttgcctattttgactcgtcaactttgactgtggcaaatacggaatttccgaacacgacctactgtcgttaccaagactaccggcgcccaccatgctcactgatcagtcagccgatcagtcgccaagtgtggggcgatgcgtttgagactgtctgcgacgacaattacgaattccaagacaaatggtggatcattttggcatttcgtctcgtttttgtgctcatttttgaggtggctcattttttttataaattttaataaattcattttaatttaatgatttaaatttttcaaaagaaaatatttttgttaacagtgtcacttcaattttgaataaatttttaaaataatttttaatgaaaaaatcccctaattatttttttaaatgcatttttcctctttttnagttggtggtcctctcgattaaagcattatttgcttatgtaagtttttgatatttaatctaaaataaattaattgtttgaaaattatttcagttgatccctgacatgccgactaaggtaaaattatctaaaaatttataataaaaaatgacaattattttttgttttactatatttgtatttatttcagattgtcattcaacttcaacggggtagcctaaattaataattttatatttaaataaaaattttaaaaaattctaaatttaagagcgttttttgatgcgccaagcaattctccaacgccgagattcacccgaagaactaaaagcggcagatttggaggaaaaggaattgtcacaattgacaactgataggtgatgaaaaaaaattggcaattttaaaattttgcgaatttgcttaacaaaattcattaaaattccaaaaaaaaaactccctggcggcatttaaaaaatgtaatattggagtgaaatcaattcctgtcactattagtgccgattatctattttggattacaaatacttaatttaaaaccgattttgggcataggcgcaaatgtcgggaacagtgatcatttctatgagaccaaagtttaataatattttagtgaaattttgggtaaataatgggaaacgggaaatcattgtggtgtttttcgttccccacccccctcgccgagaatttttaaaatttttgtcacaaatttttaagtaaataaaagttttcgaacttggctgttgaaaaatttttaaaactaataaagtaatttttgctttttttcccaaggccaaagcttggcggcagttggcacgacattgactcgctggcttatcaagcggatgtttgcgactcacaaaagagccaaccagcggaacaacaacggcggctatcaaatgccggatatgaaggactgttttccagacgtgacgcgcccgcactgtccccccgagcatcatttgttaatgagctgccattaagcatggaggaagctgacaccaatgaaaagatg

SEQ ID NO: 82297 - DNA, 839 bp, Heterodera glycines
  Genomic contig location: Contig_ID=SeqID_17759; Location=227..1065; Strand=+
  SCN-specific regions: Sequence locations=1-86,108-108,157-157,179 -388,420-628,650-692,733-773,795-805,827-839
atgagccacccaatttggcaaatcggtctttttaaacgcattaaagaagattcagtcgattgcttggagtgtaagcaaaaaaacgttattaatttttcatcttcatcattttttggtttaaaaatatatttgaatacttttttatactttgaaagacttttttattaatacagaattttttgaaatttcctaaaatccgcaatcctgcgcaggatcctgcagattttaaatgcaggatttgcaggattaatcctgccggatcctgtcctgtaaaaaattttgaattccaatcctgcaacaggatccgcaaatttgaaatttccggtctctagttcatacatattcagcagatggaaaatttcactgcctggtggaatttttttggtagattttatctaaaaaatttaaaatttatttttggacagccttgaattttgaaaattttaaccatatgattatggtatgacatttaagaaattatggaaatgtatgaaaaggtataacagacattgtttttttctttattccattctttgtcacctttcttccacaaatggacttgcctttttttaattgcttgtcaactttctgtccatattttttgtattcaggtactctgtcaatttaatttttcaggttttctaattttctctttattctatcattattgcattttttgagaattctcggtgtaaaaattcaatttaatttaaaattttttttataaaaatagcttttttgaaatatgtgatttacttttttcaatagttaaaagttaacaaaaatatgtccttatattttttgaccttacaaaaatttttaaaattctttagaattta

SEQ ID NO: 82298 - DNA, 282 bp, Heterodera glycines
  Genomic contig location: Contig_ID=SeqID_17760; Location=1358..1639; Strand=+
  SCN-specific regions: Sequence locations=1-39,61-127,157-282
atggacccaaccctcgtggaaattgaacaaactccggaactgaaaagcttcattaaatggctttaccaacgtcgtgagtttcttcagaatcatcaaaacagaaattgtgagaaaaatgacaccgacgataaaaaagtaaaattaattaattaatttctgtttaaaatcatccaattattatttaaggaatcagcaattaatcacgaagcaaaatgtgaatcatttgacaaaggcatctcttcttctaaaagtcagttttgtttttgtttttcattttctata

SEQ ID NO: 82299 - DNA, 1178 bp, Heterodera glycines
  Genomic contig location: Contig_ID=SeqID_17761; Location=312..1489; Strand=+
  SCN-specific regions: Sequence locations=1-192,215-747,769-769,791 -1094,1149-1178
atgagcgacttcgagattggaatgctgaaagcgatgcgtcatgtcttcccgtcatgcgaacgctcgggctgcagcttccacatggcgcaagcggtgttccgaaaagccagaagcatgggcatttttaatttgttgaacgaagatgacaacgaagcaccggttcaaaggaaatccgttcacaaaacattcaggtgtctttcattagcttatgtgtatttatttgttttttcaatcagatctgttctctctttggcactcattccgccactttacgttcggcgcgctttttgaactattgtcagcgcggcaccgcttggagttcaaggatggctggcgtattttgccaaaacctacattggcactactcaattcgagattgatcgcggggcggaggcatttgaaccgcatgctgatgtcggacactttcttctgcgtcgcactcgaagcacaactcgtaaatgcacctattctgtcatgaaatttatgaaatttttcaattttagcgttcagtatttcccaggcatccataatgacaggcagtggaccaatacaattcggactgcattcgccacaaccttcaactccaaccattccattgtcagaagaaagcagcttgcagcttattccacgctgggaacaagacatcgtctgtcctccacgtttcccgatctcgttttggaatgtatacaccagggctcaaatggcaattgagcgaacgaacaacggcatggaagccgcgcatggacaatttgcaataaaaaatttcatcggaaaacattattttttggtattttcagcgtgagctcaaccatcatccatcattgagtgacttcattgctgcattcacgaaggacatcaacaaacagttggacatcggacgcgcagaacagctccagaaaagcactaaacgacgacaacggtacgtcatcaaagaacaaaatgtggtgcggatccttgacgaggccgactttgaatcggaagaaggattgacaaacgccttgcacctgctcgggatcgtgatgcaaggctttgcggagggacttcacgtccgtggaaattcagagtggtgaagaaactgaggccgatgaaaattgattttaaacattttcatattattgttttttttattgatattttatatattttatgaagatttctttgcttgaagcacttttata

SEQ ID NO: 82300 - DNA, 266 bp, Heterodera glycines
  Genomic contig location: Contig_ID=SeqID_17761; Location=1804..2069; Strand=+
  SCN-specific regions: Sequence locations=1-110,134-266
gaagcaaatactgatgaaaacactcgtgcagacctacagcgctggggccgacttcacgcggtgcgcactgtccttggcttaattgccactggcgtttatttatacgcagtaagcaaagaataaaaggagaaaggaactttaaatccgacaacataacataaaatgacatatttttaatgtcaattttgcatattcacaaatttgtgtgcgtacactttcaatcacatttttatatttacactttattacataaaaacattagcgtt

SEQ ID NO: 82301 - DNA, 652 bp, Heterodera glycines
  Genomic contig location: Contig_ID=SeqID_17763; Location=687..1338; Strand=+
  SCN-specific regions: Sequence locations=1-120,142-652
atgtcacctcaatatggtaagtgatagcttatcaaaaagtattttgtaaatgactgtagaagtacagtatccttatacacagtattccgaaaaaaagaacaaatgcataagccaaagctcggaccttttcatttttaatttctgtaaaggctccatcgacttgaaaattgtactttacagtacccattaaaggaaaatcccaattacagccattcatttccaattaccgatttcttatggattgcaaactcattcaaatacaaattttaatatatttgcataatcagatttggtccgtaccgtgtacagcagttgcgccactttatgcttctcacttggcatgctgttcaacgcattcttagtttggctgatcctcaccaaaacgccggcaccgatgttggtctacagcaaattgttgttgaccccatgcatgatggtaaaaacaaagttttcaaattttagtgctctttggtgctttgaacacggtgtatattatgagtaaaaaactgactgattttaagtaggactgcttccgaacttcgggaagagaataatcggagagcgaaattccgcgaaaaaaaaatttgtcggaatggttttcggggagcaataccctcgtcgggggcgaaattttcataaaacgttggaaaaa

SEQ ID NO: 82302 - DNA, 4497 bp, Heterodera glycines
  Genomic contig location: Contig_ID=SeqID_324; Location=50..4546; Strand=+
  SCN-specific regions: Sequence locations=1-97,119-126,148-538,560 -639,661-862,884-2023,2054-2086,2108-2683,2719-2891,2913-3205,3227 -3504,3526-4009,4032-4497
  Gene Ontology: Mol. function=myosin light chain kinase activity; Cellular component=myosin; Biological process=cytokinesis
atggactcgctgaaggagcacaacgatggataccggtatattcttgtctgtattgatgttcttagtagacagatttatgtcgccgaagctgagtcgaagaagagtgagcatatgattgaagcgtttgaaaaagttttcaaaaaggcacaagtgctgcctaataaaatgtacagcgacagtggcctagaattccaagccaaacgaatgaatgagtactggctttcaaaagatatcattaaacatgtaatgtacagccctcatctacatgcaggtgttgtggagagagcaaatcgcacaattaaggaaagactttaccgttattttagcgaaaaaaacacacacagatgggtagacattattgataaaatagttaaaaacctgaacaattcagtgaaccgtacaacaggaatgcgtcctgttgatgtgaattttcgcaatgcaacagagctgagaaatcgtctatataaagacatggaacaacaaaagcgaatacaaaaattcaaaattggtgatatcgtaagaattaccaaagagaagggagacttctccaaaggatattttccaaattttactgacgaattattcaaaattgttcgggtaaacccgaccaatcctccgtcataccgaatcagtgatttagaaggtgaaaatataaaaggtattttttacgatcaggaactggtaaagactgttgctgctgaacagacaactcatcgagcagaaattttgaaatccagggtgcgaaacggtgttaagcaacattttgttcgttggataggttattcagaaaatcacaataagtggattaaggattcagatctcgttcgttaggcatggacgatttttatattgtactgccatcaaatgttccctttccgggaaatacggcatcccattttaccgtaagacttccacataccttagagctagactcaaactggtccgttgcgctttcctccatcatctatccacactcgttcccttccgtaggggtggatgaggacgactttgtcaacataaaacttctcaatcctgactataaaccagacggtacaggtccgactactgtaactctgaaggtaaaaattccaagcatacagtttcacagcgtagagcatatgcaaaaatcattgaacagcattattcaatcggcctatgatgtaaagtttccaaaagaaaaaagggtaaaaagagcggcggctgcttctgcagacaaagaattggaaccagaaacgcgaccagaaccggataaggaactgacacgtgaagtgccttcatctaaaacattggataaggaactgatacgtgaagcgcctttaccagcaacacatgacattgaactacaacgtggagatgagccaaaaccatcggagaaggaactaggacgggaaacagaaccagcgcaactttctgacaaacaattgggtgaattagaaggtgaaaaactgcaaaaggaacaactgccacccactcccattgttgatcatggtgaaatatctacgatagaccaagagcgcatggacttagccaaacgagtaacggaacaatcgtggaaagagaccgttaaattggctgctaatgcagccgatatcgcggaaaaggctaaaacagccctcaaccgagctgaacaagcccgcaaacgggcacctaatgctccacatgtaaagaaatggttcgacaggctatcaaatatggagaataatttgcgtgaacttgtggaaaagatttcacaagagtcgaaaaaggcggccgaagcaaaacggaaattagatgtacattatgattccaagaacttgaatgaatgccgtaaacatgcagatatgtcaaaacaagctcttaaaaactcgaaaaactacattgctcagcttacacccatgtattttagcacagtacctgaggatcagcttggcgtgaatgagcttgcaaatcgtgtagtgacggcagtgaacaattttttaaatgcagaattaacggttccaaggccggtcaaagaccctcagctctctgccgggcaaccgaaacagcagcaagaaaaacaaatggaaaagctgaagccaaccgtagaaaaggaagttggaagcataatcaagccaccagttccaaaactgtctgatgaaaaagaaacgaaacgcgaacctacaaagccaaccgtagaaaaagaaatggaacgagaaccagtaaaaccaccggaaaaggaattggagcgtgaaagcccaaaaaaagcggacaaagagctggaacatatggtaaaacaacagtccacgcaagaagacaatttgttagaaaaagcaaaaaaggaaatagaccaaacagcacagaatgcagccctaaaagctgaatatattcgcacactagttgccaactcaaaacataatagaggcgttgcagaaggtaggcttaacacatattcaggtgtccctcaattcaacgaatggcttgaccaaattgttgaattagataagaagatagacgaattggcaaaaaaggtaggaaatgaaccgtcaaaggtaataaacgctaagcaacaatttgataaaccttatcgaatgaaaaatttgacagaagcgcgaaagctaatcgaagctgcaaaaaatgcgtttgaagttatactaaactattcactggaaataaaacagttgaataataaaatgcatgaattaaatgacaaattcactgttgcagtcaaagagaaggaggaagaagaagccaaagaaggtgcggcgattaatatacaacaagaaaagaagctagaaaaggaaattcctcaagtcttaaaggaactggagcgggaaaaaagtcagcatgatattaacaccactgctgagaacacggaaaccgaatttccctcctccgaatatgaaattgacgacagctctgagaagcagccggaacgagcggaacaacaggcagaggtatcgtatgtattgaagaaaaaggaaggaaaattggaagaagaaaaaattgaaaccaaggatgataccgccattaatgaatttccatctacagaatatggaatagaagagagtgaaacggaggagacagagaaatggtcaccggatcaagccaaacaaaaaatattgaaaggaaaagaggagccgtttgagcagcccgatggccaaaaagatgaagagacaattttagttatcggtaccgataaaaaaggggaagaatttccatctaaccaatatgagattgaagataattattcatcgtcgtcatcatcatttattgcccaaaacgaaccatcggtaacgaccaaagatgaagaaggattgttaacggtccaaattaaaaaactaccaatgacaggggataatgagcaaaaaacaatacaaatggtaccatcagattttccttcatataatgacgatgatagcagagatactactgtcaatgaattgtcagaagaacagcatgcttctactgttcccgaagattcgaaatcggagccttatgatgtagatgagctcccagatctgcctgatcctcaagcgctttctgccaaggggagaggaggtgataaaaaaggagtaacttctgtgtctgacagggtgaaaatgctcatgggtcatcagaaacagcaaaggaaagcagtagaatttcttttcaatgagataactcaaagattttacattaacataggtagtggagtacaacatgttgatgcgagtagccatcttgcatatgtacttggatttgagaacactcgactgtactataatcatccggccaaatacttaccagatctgtcgggtggtgtaaggcaattgtatgtttatgcaccaaagttggtggaagatacaattattggagaccgtatggctccattgttgcgcgttgtcaacgtgtcaggcacagttcctctggacgtgccagaggttatatataccaatgagttttttaaaccgatacagaacaaacgaatttccgaaatcaaaatcgaaattcaaacagcgtttggacgttacattaaatttaactggggtaattgtgttctaacacttcattttaaacgaaaactattttaaaatgactcatgtctttttcaaccctgactccatcgaatggtcaacatttctagcctcgcagcaagaaggaagaggcgaacagcagtattttgttggtacacgttaccaacgcggaggcggtcttctgcaaaatgtagcccgatttttgatgccagtggcatcaaatctactctccagtgcatcgaaggagggaattgctgcaggaacacgtgttcttggcgatttgtcccaaggtaaagcattgaaagaatctcttgaaacgcatgctaagcaaggtttcgaaaacctggcaggaaaattacaacaatgtgggaaaggtggaaattatggtgccgatggtagaagaggacaacgagtgtcaaaggttaaaaaagctagtggcatcagctccagtgattctattattggcagaattgggactgttaaacgccgacggaacaaaatcatggatcagttaagcttcccttga

SEQ ID NO: 82303 - DNA, 482 bp, Heterodera glycines
  Genomic contig location: Contig_ID=SeqID_324; Location=7618..8099; Strand=+
  SCN-specific regions: Sequence locations=1-274,296-482
atgcaacgagcaatcaaatattttattgactattacgccataaacgacattactcaactgtatgctctgttaaaattggaaatcgactcacacccgtccaactatttcccaaaccctctgctatcagtctcctgtgttcatattgtgaacaccgagttcgaaaatcaaccggtgatagtggaaggaacgcttgatttgatagacgagctgctcttttcgacatgctaccccaagacgaggcagggagtcggctggtaagtgagggattaatgtcaattatttaatattttttattcaggagcgaacctctgtatgtggaactgacggatctaatggtttgtccgggcgatttgccaatatgtctgtcacacttcggacaacggaaggaacgacgacccagcttgatggtcgacgaactggattggcacgacagcgacgacgacgccgcagacgaagcctggtgaaagtgttatgcgaattca

SEQ ID NO: 82304 - DNA, 3014 bp, Heterodera glycines
  Genomic contig location: Contig_ID=SeqID_324; Location=9268..12281; Strand=-
  SCN-specific regions: Sequence locations=1-132,154-187,209-263,286 -479,504-1061,1083-1755,1778-2537,2560-3014
atgaacagacacgatttttgcaaagactacgaggcattcaatcgtctggtatcaaacattggtcgaatgcaaactgcagttgaagagctgatgaatgcgtcgggcattcaaaaggaccagacttcttatggaattgaacatattcagcaggttcaacaatactgggtatgatgtataacaaaattttaatcattaagtgttagaaatatatttcagaatcgtgtttttcccgggacataccgcttagttttgtttgaagacagaccagaagagttacctcggccaatatggaaaggcccaggagggcatcgttttaacgtcacactttttctatccagcgatcattatgacgtaatcaaaaaaattcattgtttcttcaaacttggtcggaaatattgcattgagtgtgagtgcacgtacactgttgacgctaaacatacaatgcattgtaagagcagatgtcctcaatgtgctaaaggttagaaaaataatgttaatattttctataaccaaaatgtttagtcggacctcaacatccatgcccgaaacaagacggtgtccaaattttatgcacagaatgcaaccgttattttttttcgcgattctgttacgatggtcaccgggggacaacatgtagactctataaacggtgttcatcatgcaatagagtttatcgatcggataccggccagaagcacaaatgtaacacacgctattgtaaacgatgcaaagtgagactaagctgtttggaaaatatataaaaaaagaacaacactgtcttcaggtttatcatgcggaaaagaggagctgtttcatcaaaaaaattcgagtatcaccggaagaacaacgctatcgtatcattgtctgggatactgaaacacgccttgaacaacttgaggacgaaggccagcgtatacatagggtcaattttctttcggcccgtgttacttgtaccgattgctgtgaatcaacggaaacggacgacgacaattgtgagatttgctgtcaaaacgatggagcgttggaacgagcaaaagaatggtgggatatgattattatttaaattaaaggtaaatttcaaataacaggagtgaagcagatggcgaggatcaacctgttgccgcttttgttgagtgggttctgagggcgtggaataatgaatacaccacatacatatgggtaagtgatttatgagcaatttgtcttacaaaaaaatcctaggctcacaatgcatcgagatttgatggccatttcgcccttaatcatctttgcaaaactgcaagacgtccggatgttgtgatgaacgggctcaaaatcttcgaattccgcgtccagcatagcagaaagcattcaatgcttatttggcgtgactcctgtctgattatgccaattgcactcgctgaattaaagaagactttcaaccttgactgcgacgacaaaccattcttcccatacgcattcaacagaaaagagaactattcgctcagaatggaaaaccttccggacgaaagcgagtacgagccgggcactatgaaggctgacaagtatgaaaagttcaaaaaatggtacaacgacaacaaaaggacaccgtttttcttgcccgatgaacttagggcatactgtctgaacgacaccgaaattctactcaaagctttggtaaaattccgccagattttgatgaatgagatcacggacggatttgatgtggtgccgattagctgtaccatagctaggtttaaaaaaataaattgctccgttaacatttgtttattttacagtgcatgcatgaacatcttcaaggcgcaattcatggaacctgaacagttggcaatggtccctgaactgggatatgaaagaaacgatagagcaagcgtcctcgccatcaaatatttggactggcgcgcaaaaagtgaaggtattgaaatccaacatgcaggcaacggtcgggaaaaacgatggaagcagttcaagctcgacggatggattgagagccagcaacggtgcatagaagtgctcggctgctactggcacggttgcgagcgatgcttcaaacctgatgagcagctcattgatggaaaaacatgtcgtgagctgaatgatactacacaagaccgtcttcgtcaacttcgtgagtatgatgaccatggacgttgtctgcaagtcgaagagatctgggaatgtgaaataaacgaccagctgaagaaaaatgaaagaatgaaagcattttttgacgacatatccaatgagcgcggccctcttgaccctagacttgcatattgcggcggaagaactggcccgttacgactttttgctgaaccggcagaggatgaaaagatatccgtattcgacattgtctcactgtacccatgggtcaactacgacactgattacccgattggaattcctaccattattcatccaaacgcagacgagatgaatgtcaactggacaaaacctgaacatctacagtaccggggcctttaccgtgttcgtgtcatccctccgcgtggactgcgagtacctgtactgccgatgaaaattgacgagagactgctgttcagctgctgtcaccgatgcgcagcattgttccgtaaatgtgtgacgcgctgttctcacaaatgcacccattcggatcagcagagggccttcactggcaacttcacccacattgaactcgaaaaagcgttggaactgggctatgttgtcgatcgattttggagggcctggcattacgcagaatggagtgatcagattttcaaaggatatgtccgtcaattcataaggctcaaggttagcgaattatccaaaaaaaatttttatcaaagttaattgcacaggtggaatcaagtggatttccggaaggtgtggaaacgtcagaacaaaaacagcagtatatcgatgagtatcggcgcatttacggggttgatttggattttggtcgcatcaaaaagaatccgggactgcgattcattgcaaaattgatgctcaacagcttatggtttgctccaaaataa

SEQ ID NO: 82305 - DNA, 216 bp, Heterodera glycines
  Genomic contig location: Contig_ID=SeqID_2911; Location=1715..1930; Strand=-
  SCN-specific regions: Sequence locations=1-59,82-216
atggcggaggtgccgccaacggtaccgtcgacgaggccgaccgaagcggatggacaatccgtggaggaggaggaggaattgtccatggcggcgagcagtttggccgaattgacggaagacgacggagcggagacagtgctgaagaagcaaggcattgaactgctaattgaagcaatgcatttgcattttcgaaacattttcaatggcagaccataa

SEQ ID NO: 82306 - DNA, 822 bp, Heterodera glycines
  Genomic contig location: Contig_ID=SeqID_2912; Location=363..1184; Strand=+
  SCN-specific regions: Sequence locations=1-179,201-410,509-515,537 -550,577-786,809-822
tgcaaaaatgtgatgagtttgcgtgccaatgccatcattcgtcgctaccgcacgcgcaccaacgaatgcggcctcgtgctgaagccggtgcacttcaaaaacggaaacacgcgactccgcgtgttccccaaattcatcagcggttcgtttggcactttcaaacgaagtgaggcgcaacagaatgccaattcagaggaagaatgtctgccaatccctccggcgcagatgggcgaattgcggacgaaaaattgcagtggcggagacggcgagacggagcagcggacggtcggcgagctcggcggaattccgctgggacagaaaacgctgagtctgcgcaatttaacaagcgccgggggcagcaaacgatttagtgccattgaggtactataaaggaaatgagtacgctaaaaagaggaagagagagagagagagaaggtaatatgtagtgagagggtgagagtgagagagagagagacagcatggtagagagagagagagagagagaaagtgtgtgaggagtgggagtgagaaggggacatggtagttggttgagagagaaagagagggagagagagatgagggaatatggtagagagagagggaaggcgattacggtagagagagagtaatgcgtaagagtgcagagaaaaatttattgcttatttcaggacgatgaaatgcgtcccgtctcctccccaaaacgggccacctcccatgatggcaattttgtcgagctgttcacttcagccactagcgccggcggcgatgagccatccctcgtgccggccgggctccacctgctgcccttcgccctgccgacga

SEQ ID NO: 82307 - DNA, 708 bp, Heterodera glycines
  Genomic contig location: Contig_ID=SeqID_2913; Location=438..1145; Strand=+
  SCN-specific regions: Sequence locations=1-109,132-560,597-708
atgcgtcccgtctcctccccaaaacgggccacctcccatgatggcaattttgtcgagctgttcacttcagccactagcgccggcggcgatgagccatccctcgtgccggccgggctccacctgctgcccttcgccctgccgacgagttcgacttcttccgatgcattggcacaatgccaaacacaatcggcgtgtctttttgccaagacaccgaatcgaagtgaaaatgccgccaatttggagtttcaccagcaaaacattctgtcgctgaacagcgcgagaacggcgacggagggagggcaaacgatgcaattttatgggaacaattcgacggcgaatgtgccgataaatttcgcaattggggcgacaaataatggacaaccgcagcagcatcaacagcagaacatcgttagtctgctgggaccatttagcggagcatcgacggcaaacgacggacaattgggacaaaatgcgacgatgggaaacgtactgacaatgacgacaaattcaatgggcggactgttcatgtgcgatcagcagaaacagcaaaacctatgggtgcagcagcagcagcagcagcagcagaaacagcagcacattcaggtgatcaacagcagagaggacatgttgatcactgatcagtggggacggacggagcgaaatccccgggattatcccgggaatttccatgcaaacagttttctatga

SEQ ID NO: 82308 - DNA, 891 bp, Heterodera glycines
  Genomic contig location: Contig_ID=SeqID_2913; Location=2468..3358; Strand=+
  SCN-specific regions: Sequence locations=1-891
atggctaacccaattgcaaccaaaaaacaaaaagtaaaattgtcttacaaagaccacctttgcaccttcgctaaaatgagttctgatgggatgacaaaattttggagatgcgagttcaaaaaatcaatttcacatagtgagttggcgaaacgtccgaatttggcttagttggcgaaatgtccacttggcgaaatgtcgtcgtgccaatcacggcccctctaactgcgaaagaggcgaacagagtttctttaattttttggagtttgattaaacactaagtaatgcccaatggttgttgagcaaatacgccatatgttaatttaaattccatctgtccaacagcatctcttcccaacattgccttgtcccatttgcctccgtccgtcgccgtgccgcgtttgtccgccgttggtgacaacgaaacgacgcggcccatccgtctgacggaaacattggcattggcaccggacgcgtcccattggctggcggacccgcattttagccaattcgtggccatcgtcggacagttggaacggcatatgctcggcattggcccgcgcgagcagacgacgcccgcgacgcaaaacaaaagcggacaaaacccaccctcatttgtgttctgaagacaacaattaactgagttaatcgaatgctactgactgattatggacatttatcagcgattgatccccaacattccgatcggagaaaacaatgagaaccaaatcagaacaatcggacaaatacgagttcctatgttttcccttttcctgctgctgctattctcgtccttttttagtgatattacatttttaattggcttttgtgtcataattaggccatattcacattttatgatttgcaattggagggctaaattttctttaaaca

SEQ ID NO: 82309 - DNA, 713 bp, Heterodera glycines
  Genomic contig location: Contig_ID=SeqID_17765; Location=922..1634; Strand=-
  SCN-specific regions: Sequence locations=1-149,171-201,236-258,291-713
cattctgatcaatgaaccgttgggcactgaccgtcccgaaattgtgcactgctgtgacgaactgttggctcgtcagccgccgtgcaactcgtcccatctgttccaatttctcatcgacaaaattgcggacaaaatgcgcgaaaatgcggttgcaaatgagcaacaattgacagaaatggcacaaaaaagtggcgaagttggaattttattaataaattattattttgttatttttcgtgccaaaagggcgttaatcgcaaaaaaaaaaatttttttttaattaattttaagtacacataaaatctactcattttggagtggagaattgagtagatagtagagatattcattcattgaaataccaacaatacgaatgcatataaaaacaatttctagaacatggatttttgcggacctatcaaaaatttttgaattcaaaaaattcctcccctaaaaatatccgattttcacttacatccctagttttttttcaaattaaaccggaattaagtttggctccccgttttcctgctgcttatcattttttttttgttcatgtattaccattgttttagtatttggatgtgttggagcggattgacccgattcggcacaatttctggaagtacaggcgggcacagctgcaaacattggccgactcggtgaagttcaacagcagtaacagtgccagtgctgctgcagcttcggcatga

SEQ ID NO: 82310 - DNA, 287 bp, Heterodera glycines
  Genomic contig location: Contig_ID=SeqID_17767; Location=765..1051; Strand=-
  SCN-specific regions: Sequence locations=1-119,141-287
  Gene Ontology: Mol. function=calcium channel regulator activity; Cellular component=integral to membrane; Biological process=G -protein coupled receptor protein signaling pathway
aacggtgcccagtgacaattaccaggcacgggcgatgattgacatcgccgtgcatttcagctggacttacctttcgctggtcagtgtcactccgagttttatcttctaaattgcttctattttttgcctttttgaaggtttattcggcggatgaatacggcgaattgggggcggatgcgttcaaaaaggaggcgcgaagggcgaacatttgcatagccattgaggagagagtgtcgatgaagcccgaatcattgcgcgactcaatcgccaatttggtgaagaagtga

SEQ ID NO: 82311 - DNA, 1482 bp, Heterodera glycines
  misc_feature (894)..(894): n is a, c, g, or t
  misc_feature (902)..(903): n is a, c, g, or t
  misc_feature (911)..(913): n is a, c, g, or t
  misc_feature (917)..(918): n is a, c, g, or t
  misc_feature (926)..(931): n is a, c, g, or t
  misc_feature (939)..(940): n is a, c, g, or t
  misc_feature (944)..(944): n is a, c, g, or t
  misc_feature (947)..(947): n is a, c, g, or t
  misc_feature (949)..(951): n is a, c, g, or t
  misc_feature (957)..(957): n is a, c, g, or t
  misc_feature (962)..(962): n is a, c, g, or t
  misc_feature (966)..(966): n is a, c, g, or t
  misc_feature (968)..(972): n is a, c, g, or t
  misc_feature (981)..(981): n is a, c, g, or t
  misc_feature (984)..(984): n is a, c, g, or t
  misc_feature (992)..(992): n is a, c, g, or t
  misc_feature (996)..(998): n is a, c, g, or t
  misc_feature (1005)..(1007): n is a, c, g, or t
  misc_feature (1010)..(1010): n is a, c, g, or t
  misc_feature (1017)..(1018): n is a, c, g, or t
  misc_feature (1022)..(1024): n is a, c, g, or t
  misc_feature (1030)..(1030): n is a, c, g, or t
  misc_feature (1041)..(1043): n is a, c, g, or t
  misc_feature (1048)..(1056): n is a, c, g, or t
  misc_feature (1060)..(1062): n is a, c, g, or t
  misc_feature (1072)..(1072): n is a, c, g, or t
  misc_feature (1077)..(1077): n is a, c, g, or t
  misc_feature (1083)..(1083): n is a, c, g, or t
  misc_feature (1092)..(1092): n is a, c, g, or t
  misc_feature (1095)..(1095): n is a, c, g, or t
  misc_feature (1097)..(1098): n is a, c, g, or t
  misc_feature (1102)..(1103): n is a, c, g, or t
  misc_feature (1106)..(1107): n is a, c, g, or t
  misc_feature (1110)..(1110): n is a, c, g, or t
  misc_feature (1114)..(1115): n is a, c, g, or t
  misc_feature (1123)..(1125): n is a, c, g, or t
  misc_feature (1129)..(1130): n is a, c, g, or t
  misc_feature (1135)..(1135): n is a, c, g, or t
  misc_feature (1137)..(1138): n is a, c, g, or t
  misc_feature (1147)..(1147): n is a, c, g, or t
  misc_feature (1151)..(1151): n is a, c, g, or t
  misc_feature (1153)..(1154): n is a, c, g, or t
  misc_feature (1157)..(1157): n is a, c, g, or t
  misc_feature (1164)..(1164): n is a, c, g, or t
  misc_feature (1171)..(1171): n is a, c, g, or t
  misc_feature (1174)..(1174): n is a, c, g, or t
  misc_feature (1178)..(1178): n is a, c, g, or t
  misc_feature (1180)..(1180): n is a, c, g, or t
  misc_feature (1195)..(1195): n is a, c, g, or t
  misc_feature (1201)..(1201): n is a, c, g, or t
  misc_feature (1231)..(1231): n is a, c, g, or t
  misc_feature (1244)..(1246): n is a, c, g, or t
  misc_feature (1255)..(1255): n is a, c, g, or t
  misc_feature (1271)..(1272): n is a, c, g, or t
  misc_feature (1278)..(1278): n is a, c, g, or t
  misc_feature (1287)..(1287): n is a, c, g, or t
  misc_feature (1290)..(1291): n is a, c, g, or t
  misc_feature (1299)..(1300): n is a, c, g, or t
  misc_feature (1311)..(1311): n is a, c, g, or t
  misc_feature (1319)..(1323): n is a, c, g, or t
  misc_feature (1326)..(1326): n is a, c, g, or t
  misc_feature (1333)..(1334): n is a, c, g, or t
  misc_feature (1340)..(1341): n is a, c, g, or t
  misc_feature (1349)..(1349): n is a, c, g, or t
  misc_feature (1351)..(1351): n is a, c, g, or t
  misc_feature (1359)..(1359): n is a, c, g, or t
  misc_feature (1362)..(1362): n is a, c, g, or t
  misc_feature (1364)..(1364): n is a, c, g, or t
  misc_feature (1366)..(1366): n is a, c, g, or t
  misc_feature (1373)..(1373): n is a, c, g, or t
  misc_feature (1376)..(1377): n is a, c, g, or t
  misc_feature (1383)..(1384): n is a, c, g, or t
  misc_feature (1395)..(1395): n is a, c, g, or t
  misc_feature (1399)..(1400): n is a, c, g, or t
  misc_feature (1415)..(1415): n is a, c, g, or t
  misc_feature (1418)..(1418): n is a, c, g, or t
  misc_feature (1423)..(1423): n is a, c, g, or t
  misc_feature (1427)..(1427): n is a, c, g, or t
  misc_feature (1431)..(1431): n is a, c, g, or t
  misc_feature (1437)..(1439): n is a, c, g, or t
  Genomic contig location: Contig_ID=SeqID_17768; Location=1..1482; Strand=-
  SCN-specific regions: Sequence locations=1-76,99-727,750-1482
  Gene Ontology: Mol. function=metabotropic glutamate, GABA-B-like receptor activity; Cellular component=integral to membrane; Biological process=G-protein coupled receptor protein signaling pathway
agcaaatataaccaattagcactgggccaattatttcacttatttgtttttgggtttattaacttaatgagttttaattgaattttttattctaaaaagtgctttgacttttgtcggccaccccatcattagttgctcaaaatgttctctttgataacgatgacacttcgcactttgacccatgttcatatgttggcaaaagcagtggacggtgccgggggcgttttcgggggacaaccgacggagaacatgcgccagctgagaatccccggggatttgataatcggcggagtattccccgttcacgcgaagggcggtggcacttcgccctgcggagaaatattcgagacgaggtcagtcgagaatgttgtcgacttggaggagcgggaccggacagagaggggtggccaagaattggcaaagtgatgcccagttttcaggggcgtccatcgagtggaggccttcctctacgctttggacatgatcaacgcacagaccgacttcctacgcggctataaattggtgagtgatcggacttgttttctgatccgaattgcccacttgacttggtcagggtgctttgatcctcgattcatgttcaaaccccgcctatgcgcttaaccaatcgctcgacttcgtccgtgaaatgatcggctcatccgaactaactgattacagctgcgcagacggtagacagccgacgctgcggcacccgagcccaaaaaagagtgtggtggcggtggtgggcgcgagttactcatccgttactgtacaggtccgactgaccctcgaacggttcttactgtaactgtttcttccttttaaagattgccaatttgcttcgactgtttcgaattgtccaagtcagtccaggtaatcagaacaacttttggnttcgcttnngcctctcnnnttcnntttgctgnnnnnntcctttgnngccngcncnnntgcggnccttngcgncnnnnntcggtttgngtnttttgcgnggtnnntttggcnnnttntgctcgnngcgnnngtcttntcgcggctctnnnttgcnnnnnnnnngcgnnnctcttttcgnctcgncgccgncgctctcgngcntnncgcnnttnnttngcgnnctgtgccnnngggnntttcngnncggtgcccngtgncnnttncccggcncgggcgntgnttgncntcgccgtgcctttcngctggncttccctttcgctggtcggtgtccctccgngttttttcttctnnnttgcttctnttttttgcctttttgnnggtttnttcggcggntgnnttcggcgnnttgggggcggntgcgttcnnnnnggnggcgcgnngggcgnncctttgcntngcccttgnggngngngtgtcgntgnngcccgnntccttgcgcgnctcnntcgccaaattggtgncgnagtgngcgntggntgctcnnntcgccagcaaaaatgggaccaaacaaagcaattcgaaattggg

SEQ ID NO: 82312 - DNA, 864 bp, Heterodera glycines
  Genomic contig location: Contig_ID=SeqID_17769; Location=74..937; Strand=+
  SCN-specific regions: Sequence locations=1-35,57-218,360-619,641-864
atgccaattgcacacagttctgcagctgatcaagcccatccaccattgtcagaaggtacaaccaataccaatttgacaagcgataaaagtgatcagacaggcccagaaacaccaaacagtcaacggaaacggtcaagacagcgaaagcaaagctcaagcaatatccagcggactgaatttttaggatttgcatcaacagaaacggaaatagcagttatcaaacaaaaagatcaaagaaatgatcaaccaaggaatcaaagaaatgatcaaccgagtgatcaaagaaatgatcaaccgagtgatcaaagaaatgatcaatcgagtgatcaaagaaatgatcaatcgagtgatcaaagaaattatgaattcaatgagcaacaaagttatcagatgcttggactttatgatcatgatgatcaaaatattgaaccaatgtttgttgacacaaatgcaccacaaatgatcgatacaagcgacttcgatcaaattgctcaactggctggtgacgatttgatgttcccccatccgatggaggtgtatgacgagccgaacaatgccgaagaacaatttgtgatgatcccggtcggaaacagcacacaacaaattgcagcagaaagtgttggcaaaacaaaaagcaattcaaaaagtgggcacggaaaaagccgtcaaagtgctgatcagagcatgcgcgactatgcttctccatcaattcaacagaagcaaaaagcgggtcggccaaaaaagccgaaaattgacgagaaaatggaaaaggccaaatcaaaaatgggagtggaagaagcgctgatcaaaccggcaaagcacaaatcaaaaatgacaatgggaaagaccactgatgagaaataa

SEQ ID NO: 82313 - DNA, 454 bp, Heterodera glycines
  Genomic contig location: Contig_ID=SeqID_17772; Location=1129..1582; Strand=+
  SCN-specific regions: Sequence locations=1-71,155-223,245-365,440-454
atgctttattggagtagttcatttattaaaatactcgttttatattttcatccattattaccattttttggtttatatattcattaaaagatattttgaatttcttcatttttaaattattttattcttaattttttttataaaatttaattttcaagcgataacatttaaaagtagaaatcgacattttgaaaaatgcctggacctggacctggatttcctggacaaaaatccaggaaaatccaggtccaggaaaaatccaggctcctcgagacctggatccaggcctggacctggatttttttaaactcattttaaaaatcaaaaaaatgtttgaaaaattcaattaattgcttgggaacatctaaaaatatctaatttacaataataatttgcttttaaatatatttaatcattttttgaaaactttaaaaaatatcggtcacttgaaata

SEQ ID NO: 82314 - DNA, 332 bp, Heterodera glycines
  Genomic contig location: Contig_ID=SeqID_17774; Location=933..1264; Strand=-
  SCN-specific regions: Sequence locations=1-332
  Gene Ontology: Mol. function=DNA binding; Cellular component=nucleus; Biological process=protein targeting
agaaggcaaagcaagcgtaccaagaagcgttcgacctcgccaagaacaaactccggccaatgcatccgattcgtctcaccgtggcgctgaactttgccattctccaattcgaagtgcagaaatcaccagccgatgcttgccaaactgcccaactggtgatgaacagaaaatttgtatttcaagtttaaccgctcgaattttttttaggcttatgacgacgcgacttccgatgcgcagacaacgggcgagagtatttgcgcggagtccgtcacgatcatgggactgttgcaggacaacatctcgtactggagtggcaacacctctaagacgga

SEQ ID NO: 82315 - DNA, 1124 bp, Heterodera glycines
  Genomic contig location: Contig_ID=SeqID_17775; Location=386..1509; Strand=-
  SCN-specific regions: Sequence locations=1-631,655-972,994-1124
ttggatttgcaacgacgtttggatggacattttgcccagttttgaccgtcctcaactcggcctcaaattggcaattctttcgccacgtttcaatgcgttggtggacaaacatttcgatgccaaaagcgaattgacaatttggagaacgatcataatagacaaggacaaaggacatgaaccgaagctgtctgtacaaatggatgacaaatctttgtcatttccattgcccgacgatcgtccgttgcccagcaaaatccgttttaagcgccttcagattgagtaattcggaatcagagatttatggcaataaaagcattcattccatttttaggtacatggatcactccgtcatcgcttttcttcgttcaaatcaccaaattttcgacaaaagaggcaccaatttatatttgtggattccatcaccagacaccacggatggccagcggatttgggacattttaattcgtgaaatttggccaattttttcgacaaacattcgccacttgcgctttaccggtggtgatgatttggactatttgcttcgtcgcacttcgccgacaattttcactgatctcaatcagttggtttcaatcaattcctatgatttgttgcctgattcgattggtgatgattttgatgggccaaatgcaacaatttctgctggccaagcattgtccaaatggttgcactctccgagaaaagatggccaacccaagcgattgcgttgcgcaaattacaacgaacaaaggaacactactgattgggtcaacaatttcaatgaggtgtggtcccgaggggcgggggagcagaacaaaatgtcgccgtttcaaatcaattgtttagcattttctccgtgccaatgccatttcttccgtcagttaccaaattcatttttctgttcgtgtgcagtcaatgcaaatagtgccatttgaatttcttaacgaatggacaaaggaaaagctgacattgaccaaagaaaaggaaaatgaatgggacaacagttggataatgaagcgttgtaaaattattggggagtccgcggcggttcattggaaagacggaaattgggacaacaattgtaacaatgtgtacttttggctttttgctggcactaattgcattgg

SEQ ID NO: 82316 - DNA, 308 bp, Heterodera glycines
  Genomic contig location: Contig_ID=SeqID_17776; Location=617..924; Strand=-
  SCN-specific regions: Sequence locations=1-112,137-169,199-308
atggaggtagaggatgctgtgccgccgctagccgattgttggcccatcaaactgttcagcaacatattctggcccgaaaacaggtggccaaatgtgccgtcgttgttggtgccagccgctgccgcagcagcggctgccatgaggccggcgggcgacggctggagaaacggagatggttgttgctgctgctgttgtgccgcggatggagaggaaaagccattggaagtgggtgtggaggaagaagcggctgtcgccaattggccaaaagaatggaacggaaaagctggaacaggaaatgcatttgatag

SEQ ID NO: 82317 - DNA, 1037 bp, Heterodera glycines
  Genomic contig location: Contig_ID=SeqID_17776; Location=1721..2757; Strand=+
  SCN-specific regions: Sequence locations=1-63,158-258,280-370,393 -406,429-445,467-478,534-534,564-622,644-711,825-888,910-957,1023-1037
atgcatgccaatctggcagccggcggcggcattgccgggcccaccgatctgccagccgatgatcagcaacagcttcagcagcatggtggcaccaacttcaacccgttcaacaatgccaacaacaacagtagcgtgcagcagcagcaacaacagcaacgctttgtgcgtacgccgtccgccaatttccaatgtgttcgttgcaaattggtgcggcgtttaattatggctaattaactaattaattaccgattggagaagttttaaaaaagcataaaggaaggcattagtagttttctatcaaaaatgataccgaaaaactatttgcgcttgtccattatttgtatatattcatggttttggctgcaaattgatgtaacatttaattagggtcattaattaattaaatgttggaaaaaatcaattaaaaattctgggcggactcacaatttgaatattttgaaaattatcatttttaaggtttttaattaaattaaaatattttttgattttaaattttcttttcaattaaattacgtatttaaaaacaacaacaaccacaacaggtgttccaacgttatttggagcttgtccagcaccagcaacgcgtttgctttgccggcgatgaacaccaacaacagcaaaatgacaacagtaccaatggttacagtaacaacgagccattggtgtcttcatcggcccttttggtggacgaacaaaagcagcagcagtacaacagcaacaacaacatgacgacgacgtcgagcagtaacagtaactacaactgcaacacaaccaccacaaccacaaccagtgcagcaacaacagacgcaacttcttctgcagcaactgccgcaacaatgtatgcaatggagcagagcacgcaggagttactgcgccagctggtggccgcgcattgtcaccagaatttggggccaacgccgggccatggccatggccatggcgatgatgatgaacatgaacatggtgctggagatgaatatcatcatggtgatgaggatgatcaacaccacgaggag

SEQ ID NO: 82318 - DNA, 279 bp, Heterodera glycines
  Genomic contig location: Contig_ID=SeqID_17777; Location=74..352; Strand=-
  SCN-specific regions: Sequence locations=1-93,153-178,200-279
atgacatcatttttttatttattgcttgttttattgagttttacacaaaaagtaaacggtaagtgccacaattacaaatgcacctaattgcgtttaattaattatttaattgactcaagcaaataattaatattcattgaaataaattaattgtagcgcttcagtgttggtcgggcattgtttttaacatttttgacacaattaatgtgaacgccaccagaaaagatgaatgtccgcgaggaagaaatttctgctcaaaaactgactgcaccgcaacag

SEQ ID NO: 82319 - DNA, 421 bp, Heterodera glycines
  Genomic contig location: Contig_ID=SeqID_17778; Location=955..1375; Strand=-
  SCN-specific regions: Sequence locations=1-71,93-421
atgaccactccagcaaacgcggcgagggcccggagtgccaaggcgaagctgcgcgatgccaagctgaggagggcggcagctggacgcgcaggaaatgtaagtttaataaaaatcaaaaaaaaaatgagttcttccaaattttagctgctgaaaaatatgcggggcgagcgatgcgcgcatgagaaacgtgagcgccatcacgcggacgatgctcggctgcacccatccgttccatcatcgctgcttgtaccgctggctccacgaccacaccaattgccccgtgtgccgctacaacttcgcgcgcaccataccgcgcagtgagcgtcgtcaaccgctgtgagatgccggaaatagggctaatatttttagggttttccttttttcataaagacataaaataggaatatgtgataagaataaa

SEQ ID NO: 82320 - DNA, 909 bp, Heterodera glycines
  Genomic contig location: Contig_ID=SeqID_17782; Location=646..1554; Strand=-
  SCN-specific regions: Sequence locations=1-306,328-582,604-816,840-909
atggtaatcgaaaagattgagcccgtgtttggtgccgtgtcttttttcactctgatcattatttcatttgttctctgtggtggctttttcttccgtttctttcattatttcggtcccttttctcgcctcatttcgctcctccccttttctgcttcatcttctgatacttctcgcccgacccgagcatcatgtgagtgttgcagaaccaaagcgggccgacgtaacgacaaagcgaatggtccaaagcgcaggcgccgacagtcagcggaacgtcgcaaatggcacatttaaagcactctctgtgcacttcaaaagaacaaaacaaattaagcgggaattagaaaaggaattttatttatttattcaagtaataaaagtccaaaagaagggacaaaggccgcttatactttcggaagagaatgatagtccgggaaacatgatggtgacagatctccaacttgaaattaatcttgtaaaatactttttacttttttcttgaaggtgggcaatgaatttgatattgaaatatctgaatttttgcagatttcttgtagatgttttgtggttctgttagtaaaggagtgctctgttttggtaatttttcgtttagttaccaaaataggaaaaggtgatcttcctatttgaaaaattataaaggttttttgggttaaggtgagtagtatttttgataattttaaaggctgttatgatatcaagatattttctcctggtttcaagcttggaaagttttagaaattttagcctttcgctgtatgagatgtaggggagacagcattttctgaaaacattttttgtaaagtttttctgaaaattttccaggcgatttatttcttttttggttcgaggattccaaatttcggttgcgtattctaaaaggggtcgaataaa

SEQ ID NO: 82321 - DNA, 86 bp, Heterodera glycines
  Genomic contig location: Contig_ID=SeqID_2915; Location=146..231; Strand=-
  SCN-specific regions: Sequence locations=1-86
atgagactagagcgaagcgaaaaaggccgagggcccgagtacctggtgtgcgaaacctgggaacccgaaggaaaaagaggcgactg

SEQ ID NO: 82322 - DNA, 2702 bp, Heterodera glycines
  misc_feature (2613)..(2613): n is a, c, g, or t
  misc_feature (2640)..(2640): n is a, c, g, or t
  misc_feature (2679)..(2679): n is a, c, g, or t
  Genomic contig location: Contig_ID=SeqID_2915; Location=1221..3922; Strand=+
  SCN-specific regions: Sequence locations=1-721,743-878,911-1151,1173 -1236,1258-1394,1416-1453,1494-1564,1600-2702
atcgcacctcctgacttaccaagattaaatgccgtagaattgaaccaacaaagcagcgggaataaaaatgggaaaacaacaaatggaaaaggccaagccggggacttatcgcatagagaattgtcgaaagtggtggtcccgagttgttataatgttattggcgatggtgattgcttctacaggtaaaaacaacaagacagccagctgatttattttcttcttacagatccgtttgctattcaatgtttcgagttgacaaaacatcaaactctgacgaattacgaattgctgtaggcaatacccttcaagcaattgtaaataacaaagaatatttcccgaaaaatcgcctcaaaaatcacgaagaatttgtaagagagttagagtatgcattgttggagaagccatcaacagaatggtttaataaaaatctagaagcatatgccaaattcgtggcaataccggcacgaaatggaaaaggccgatgggctcagcttgaagatgcgcgtcttatttctctttttctaatgcgacccgttgtaattcttcatccaattgcggaaaagaaggtgcttgtagaactacagccaaaatatgacgattcgtcgataatgagacgcattgaagtttatttcccagacggggaaacaatggtatgtttttgttcaattattctggatagagtgaagcggggcctgggaacttttggaaaatcgggaccggaacttgccgggacccaaaaatcttggctctcggaaccgggaattgcaatttcaacgacaaacagtagcgaaaagtctgaattttcaacccaaagtttcaaaacttgaaagtctccgaatgaaacttttagagttccaaaaactctcggaaaattaaggaattataaattaaattttcttttttaatttaaccataaaaaggtaaattttattcaaagcaaaaatgatttatatttatttcttaaattcttccttttttgccatttccatcatacatattcttcactcagacccccattcctaccagtgcctattttcctcgggttcccggtttgcacaccggtactgggccctggccttttcgctcgctctagtctcattctaaagaacaattttaggcaaatagtgactttattggagttgagaaactgcacaattttgtaataaaatgccagtattgtgacactaaaacaatatgccaaaaatgtaaggataagcgtttggaaagactagttgaaaatcctgtgataatttggtataatggaataaaccattaccaatccatcgtatttgatcagaaaacaaaaaatgaattaccggttggagaaagcagatatgtcatttatccgagtggccagtataaaattatttttgcagttggcccttatggtgaggattatatttgatttaaaatgtttattataatgtagcattaaaattgaaagatcatataatagagcaattttataaaaatgaattgtgcatttgttgtttaagacggcccaaaacagtataatcttttgactgacaaagaaggcaatctcgaatggaatttctacaaaaacatacacaacaataattttttaaaggaaaattacataagcactaaatcggcagaaaaaataacgattttggcggagaagggacccgataaacgtattataagcgaatttgttaattacgctgaaatgaagaaaacgatggatgaaactaacggacaattatgcaattcaactttcatcaattttgacgcacttacggtatgcttgaatcacaagcaaaagtgacttctttgtgaaagtagggatctgtgtgagtctttcttagttaatgcattttggtggcaaaaaatgctataatattgccaaaaataatgctaaaatgttgccaaaatatggagcacttattaaaatcttactgcttagaatttttcaccgtaaacaaaattctgataaatagttaaaaaatagaataactcgtacctattaataacgtgtcaatcaaaaattcctgtctgtaatttactgcttatttacattcttccgtcatcattcagatcgcacctcctgacttaccaagattaaatgccgtagaattgaaccaacaaagcagcgggaataaaaatgggaaaacaacaaatggaaaaggccaagccggggacttatcgcatagagaattgtcgaaagtggtggtcccgagttgttataatgttattggcgatggtgattgcttctacaggtaaaaacaacaagacaggcagctgatttattttcttcttacagatccgtttgctattcaatgtttcgagttgacaaaacatcaaactctgacgaattacgaattgctgtaggcaatacccttcaagcaattgtaaataacaaagatttcccgaaaaatcgcctcaaaaatcacgaagaatttgtaagagagttagagcatgcattgttggagaagccatcaacagaatggtttaataaaaatcttgaagcatatgccaaattcgtggcaataccggcacgaaatggaaaaggccgatgggctcagcttgaagatgcgcgtcttatttctctttttctaaagcgacccgttgtaattcttcatccaattgcggaanagaaggtgcttgtagaactacagccanaatatgacgattcgtcgataatgagacgcattgaagttnatttcccagacggggaaacaatg

SEQ ID NO: 82323 - DNA, 294 bp, Heterodera glycines
  Genomic contig location: Contig_ID=SeqID_17783; Location=129..422; Strand=-
  SCN-specific regions: Sequence locations=1-39,73-226,248-294
atgaaagcaatggcagcccatgcattcatagaaagtttggaatgtaaggaaaagtgcaaaatacaaagataagttcaccaaacaattttaacatgcatttgaagtaatgttcggcttttattgtaagtcgacaaatgcctatattgatggcatgatgaagaaaatggagaacggcgacgagttgaagcagttgttagtgcagaacccatgtgaggaggccaaaatgaaagtgaagaagacaaaaatgagttaccaacgcgttttttgaatgattggaatgatacggtcaataaa

SEQ ID NO: 82324 - DNA, 352 bp, Heterodera glycines
  Genomic contig location: Contig_ID=SeqID_17787; Location=1061..1412; Strand=+
  SCN-specific regions: Sequence locations=1-113,349-352
atggcatgtcaaaaagtgaccttggatgaatgggaatgtgctccaccgatgatgatttatgcacttatgcagttccaagttcgtctgaaacgtacgatcaatcaaaatagtggaaaattaaaaaaaaattcaatttggaaaataaatttgaaattataattattaattaaatttcaagtttttgaaaaaaataattaaaaaaatataaaaattatttctataaagtacaatcaaaaacaatgaaaattaaaaaaattcactttgaaaacaaatttactttatttatttaaattttagggaaaaaattttaaaagtattttttataaatttaaaaaaaaattaaaatttgaaa

SEQ ID NO: 82325 - DNA, 1298 bp, Heterodera glycines
  Genomic contig location: Contig_ID=SeqID_17788; Location=447..1744; Strand=+
  SCN-specific regions: Sequence locations=1-63,85-102,124-757,780-1298
atggcacgccgacgaagaaagaaggagacgcgaaaggtgtcgtacaaggtgcggtttacaacgaaagcaaaatgccaaggaaattgtgtcaatgattccccgtttttccccctcatttcagttgtacgttcgacgggtgctgaaggaagttcatccgggcaaggaaatctcaatgcgtgcgttgaacatcatgaactcgtgagttgcggctgctgctgaaagctcaacaacaaataacattcgttttccccatttttttccagcttcgtcatcgacgccttggatcgcattgcaacggaggcgacgcgcatggcccactacgaccggcgcaagaccgtcacgcttcgcgacatggagttttcgtgccgactgtgcctgcccgacatcatggccaaacatgcgaaccaaaaggcttcggtggggacaaatttatgattagcccgatttgtaaagcacactcataattattttttgaacatgaatcttaacacccgcaattgaattcgaacaaaaaatcgtaaattctcagagcccatggggattgggactcccgcgggattcacggttcagattgcattttttgctcactgggagttttacgtgattcccggtcgcgctcccgtcaatttttcaaatcccaaatgacccaatcgccggagaacggactttcgccttaaaaactcagattcggacacccagttttttttcaaaagtccacaaagaccccctaaaagctcgaattaaaatttcaaacacctttttggcttttactttttattcgatttaatacatacagtaagacagaggcatacaatatgagatatgacatttgtaagcagtcacagcgttgaaaatggaaatcacatatacaatacgaataatatacacacaattacaaagtggcaaaatgcagattttatcggtgaatcaatttctgcctaagtgatcatgccctcggagcggctcgtcatcagttcacacacttgatattgcgaagattggcagcctcggcgtagtcctctccagccaaaacaaaccgcatcgatcatgacgagtgcattcttcggcaacttgaccacttggaagaagctgcgcgcagggtacgtgtccggattgaagtcgaaacgaggacatccatggttacgacctgtagccctccgcagcaggcgctttggacgtggtgatgggacgcatggagggagcagacatttggagaatggtggtttcagaaattaggacgttggttgtttgttcgctgaaaatttgttaattgaaaaaaaattatttgagacgaagaa

SEQ ID NO: 82326 - DNA, 1871 bp, Heterodera glycines
  Genomic contig location: Contig_ID=SeqID_17789; Location=192..2062; Strand=+
  SCN-specific regions: Sequence locations=1-60,82-173,195-443,465 -918,942-979,1001-1755,1778-1871
atgttattcggcaggaaattcaccttatttactgatcacaagcctttgcttgccattttcggttccaaaaagggaattccgatttattccgccagccgattacaacggtgggcgttgatcatggcaaattatgatttcgacatcaaatacacgaatacagcatcatttggacaagcagatgtcctctcaaggctaatagccaattatccaaagcctgaggaagatgtgttgattgccaacatttgcgtcgaaacagactgttatattaacaccattttacagtcgcaaaccgatcatcttccagtcacggcacaagaaattgcggaatcaacaaccaaagatgagacactccagaaaattgttaattttgttatttctggttggccaacgaagtgcagggaacccgaaattgcaccatttcatccgaaaagaaatgaaattttggaaattgggggctgccttctctacaaaagtcgtgttatcgttccaagccaactgcgtggccgaattttaaaggcattgcattttgcacatccgggaattgtgcgaatgaagcccttggcacgccagtatgtatattggccaggaatcgattcggaaattgagagagttgtacggcaatgtgatgaatgccaaggtgcacagaaatgtccgattaaggcaccattggccccatggacagtcaccgacaaagcatttcaacgcgtacacatcgactttgctggaccctgccaagatggatatgtttattttattctggtggacgccttttccaaatggccggaagtctatcaaatgtcttcaattacggccaagtccacagttttcacacttcgttccataatccatcgccttggcattcctgaggaaatagtgtcagataatggcacacaattcaagtctgctgaatttgccgctttttgtaaagaatttggcatcaagcacaccttttcaccgccatttcacccgcagtcaaatggccaagtcgaacgatttgttgacacctttaaaagagcaatgaaaaagtgttcaaaagacgataaaaattggaccgaaaaggtgctgctcgcttacaggacaacgccaaacaatgccattgatggctattctcccgatcaattattcttcggacggaaactccgaacgaaattggcattagtcctcccgcaagagcacaaaaacaattcagagaacattgacaaaattcagcttaacaaaagaaggaaggactactcgaacaacatggcaaaacaattcgatggacggcatggtgtcaaagaaaaagtgtttgtccccgccgattctgtcctccttttgaactataggaaccaaaagacatattggctccacggtacaattgtagagcgagtcaggaactcgcctacataccgagtccatgtaccggttcttggtcgaattgtccatcgacattcgaaccaacttcgtcggaattgtgttttcgaagagaattcgaaacataatcctggtgccggtcaacagccaattccaccagccaacggacaaactcaaaatttggcgcatcaaattgctgatccggtcgatcaacggactgatcaacaagccgcaaatgacccgccgacattggctcttcgacgatcgcagcgtaagccgaagccggtgattcgcttctcgccttccggccgctgaaggagttagaagcttgagaagggaggtgttggagatgttaaattggcgttttgacctttttaattattttcatatctgtactttgttctccacgccccaaccctcctctttgtgtttataaggagaccattcccctcctttttttgactcttccctcattcattcgtttttattattatttgcatttgtccaccgaccgatca

SEQ ID NO: 82327 - DNA, 773 bp, Heterodera glycines
  Genomic contig location: Contig_ID=SeqID_17791; Location=357..1129; Strand=-
  SCN-specific regions: Sequence locations=1-246,283-773
atgtgcccgacttttggcggagtgttcgcagtcgcttcttccaatggctctggtaattccccccccccccgtctctctttcttttctttctaattgtatcctttttcggctttcagtgggcctttactccacccttacgaattcgtgcgattgccttttgaatggctcttccgatggttctgctgtcacacatttgcaatattcttccgatgggaatttgctttttgctggcctccgaaaggtatttttccttttgttttatgaaattgttttgtatagaaaccctcgattcaatgcttcgatttgcgaatgcctgggcatttgttggcgaattatcagagaacagttgaaaccaaccagcgctttttcttccaattggacccattcgaccgttacctttacagtggcagcagcacaggcgaattgctcattttcaattgcaaaataaacgttcaattagccgaggatgggaaggaggttgagccgacattcacagcaaaatgcagcaaaagcgcagttgccggactgaggttggatttgagtgggaataggagagaaaaacttgactaatcaatctaaagactttttcctgcatttttctcgttgccattcacttacaaataacgggttatgggtttttgcaattttttcacttagtttgaattcataatttgaatttagaaaattttcttaaaatacaccatcaaaattaaaaaaggtttttctgtctcaaaaaaaaaaaaattctttcgaatgaaacaaaaatgaataaa

SEQ ID NO: 82328 - DNA, 1934 bp, Heterodera glycines
  Genomic contig location: Contig_ID=SeqID_17792; Location=1..1934; Strand=-
  SCN-specific regions: Sequence locations=1-387,410-492,514-927,949 -1146,1168-1289,1311-1934
  Gene Ontology: Mol. function=GMP synthase activity; Biological process=purine base biosynthesis
gcgtccatgtcggttaaaattcaaattttgcctcaaaaattcaaaaaaattacgaaaaaagtcgcaaaaactcgaaaaagtcataaaaatcccaaaaagtgtaaaaaagtcacaaaaaagcatgttagaggcttcagacaaagtttagaacactttaagtcattttaaggccatttagagtcagcaaaaaaaagtcatttgacttaaattcccagccctagtcatcatgaaaatttgtccccggtgtgttttttgggtcactgatcagtgatcacgaatccgacatcaattttgacaaaaaagacaacttttaaatagcacctaaaagattagtgacgaaataaacaccttctatttttgtaattcattagtttttcacttattgtcttttagctattaatttattgcatatttaatggaacccatggaaacagagaatacaatgacaagcgaaaaaattaaaatgccaccgaaaattggcgatgcatctccaaaattaaataaatcatccaacgagccaaaagagtgcggaaaggaattcacaacggagcgcgtggccattctcgactttggggcgcagtacggaaaggtttttctctggagaattcggacaatttcgacttgctttttcccgattcgtttagctcatcgaccgtcgtgtccgcgagtgcaatgtgtgcagtgatttgctcccattcagcacaacaatgaatgaactggtccacaacggatacaggtaatataagaacactttcatggcgcatttaaatgtcaagaaaaataaatttagtgccgtaattctcagcggaggaccaaattcagtttatgtggacaatgcgcccgtgtacgacccggaactgctcggtggtcgtcttccgctgctcggcatttgctacgggttccaagtccggtccaaatgattcatatttattgccagaatttgagtgcattttttcatatttgcaatccttcccattttagctaatcaacaaacacttcggtggctccgtcagtttgcagccgcggcgggaggatgggcgaactcagatccaagtcagcccaaagtcggaccttttccactcgttgaagccggaccaatttgtgctgctcacccacggggacggagtgacaccggaaacgtcagccaaaaatgggtttcaaccaattggcttcagcggggaatttgtggcgggtaattaattaattggggttaatgaacaacaaaaacttgagaattcagccatcgaaaatactgaacggcgcatttatggtcttcaatttcatccgggtaagagaacaaatatttaaatgggaattggcaagggatttacgtattttgcaaatagttcgaacccgcactttttcagaagccgacctcaccgaccagggtattcaaatcatcgacaatttccttcgtcggatttgctcactgaagtgccattacacactgcgcaatcgcgaacaaatgtgcgaggaacgcattcgaagtgcggtgggagagaagggtgaagtgctcgttttggtgtcgggcggcgtcgactccaccgtttgtgccgcgttgtgcaccaaagcattgggcgcagagagagtggtaagggttgaaggcacggatttgaaacctccgacaaatttttccattccaaacgattattttttgttttctggcggcgattctttagcgttaagacctcccaattgactttccggctttagcatgccattcacattgacaatgggttcatgcggttgaacgagtccgaccgagtgatgaattctttgcatgacattggactgagtaagcaaattccaaaaaaatctttcaaattcacttccatattaccgcctcttacaatcagaggttcaccgcttcaactgcgtttctgattttttgtcgggttcgattgtgcagaacggaatgactctagaggtccccg

SEQ ID NO: 82329 - DNA, 318 bp, Heterodera glycines
  Genomic contig location: Contig_ID=SeqID_17795; Location=60..377; Strand=+
  SCN-specific regions: Sequence locations=1-176,198-242,290-318
tgaaagccgtggtggaagagacgacgacaaatgaacagggcaaaactgagacaaacgtcgaacagagcgaaaaggaggggccgatgaactgaccgaaagggtccgactgatcggcaggaacgtcatccctgacggggatttgtcacggagaatagaaacaaaaaaagccacttgcatttgcgttgttttattttgttgctacagtaatcacatagttcacctttgtagatgctttactgtactcttttcatttttctctctttctctgtccctctctttcttttctttccgcttttggcttataaattcctttttctc

SEQ ID NO: 82330 - DNA, 613 bp, Heterodera glycines
  Genomic contig location: Contig_ID=SeqID_17796; Location=433..1045; Strand=-
  SCN-specific regions: Sequence locations=1-468,492-613
  Gene Ontology: Mol. function=transcription co-activator activity; Cellular component=transcription factor complex; Biological process =neurogenesis
tggaaaataagttttataatacagaaatttatcaaaatttttgtttctcgaattgtgacgtctatgttttgaaaaggattttgcaggatcaaataaggctcatgaccttcaacattaaaaaagtaaaaacaaattaggcacaaatggcaaagtaccgacactaattacacaactgcaaaattttaatctcgtcttgcaatgagaaatggccaaagggtttggcctctggtgctttcttactgtacattatatcgtatactctattctcaggacgactgtcgttgctcagctccactcccaaataccgtgtcacagttggcgaaatccaccggtttattttaccgagaatttatgataacaatttttccatgccaacttctcacagacggatcaatccgcccgagtgtttgaatgcatctgttcttggcggcattctgcgccggtatggaaacagaatgccaacaaatgtatatttttaaaatttaaattttcagtgcaaagtccaaagatggtggcaaatcgttgcgcgaccaattgaagacgtacggtttggtgttgccggcgggcaggcggaaaacggcaaacgtgtcaacactgactgcattagttgaat

SEQ ID NO: 82331 - DNA, 1234 bp, Heterodera glycines
  Genomic contig location: Contig_ID=SeqID_17797; Location=315..1548; Strand=-
  SCN-specific regions: Sequence locations=1-117,181-377,432-561,583 -1018,1040-1234
atgccggaatcggatttcctttacatccctggtatgtatattgtacattcatgcattcaccatcagcagcagtctccgcttgactacatggtggcactgaatccggtgcacacattgcaacaacaacaacaacaacagaacgcaacatcatcccaacaacaacaacatgccaacaacaacggcaccaccgtgtttatacaccagcaacaacagcagggcacttccgctagcggtggtgatgtcgtcggtgccggcaacggtggcggtgccgtcggcggaacattgctgcgcgtgttgccaccctttctccaccactcgccgcgcgaggcggtggaaatgaagatggacaacagtgatggggtaataattaaatcatttatatatatatatatatatatatatataatatatatatatatatatatatatattaaatacaatttaaaatttgcaatatggtgggcgcgagcagggggcggcacaattagagtgcccccggaaaatgcgtcagtattacggtagttctcaaataaagtactttacattaagtatttgtagtacaaaaggtctaaattgtacttgagaacctcgttcttaaatcgtcaattcattttgctaaaagcttcaaaaattcttgaataatttttgagaaattaccaaagtccgtaaaaacgaatatactgtattggattattgtatgtttgttcccatatcatttacgcctaaaattttcaaatcattatactctaccgtatcttgttttcaagaaattctaaattctgattttctgcccttgttaaggcgctttatgctattttaggagcaaagttcggactcggattcgccatcaatgaacggaggccggggaaggggtgtaaaacggcacaatgccagacgaagaggtggcggtgccggcacaatgactggcgctgaaggcgtcatccgaaaaggtaaaaaacattggcaacaacagcagtgagtgcatgtccagaaattttatggtccgataatttggttcttcccattttgatcagaaaatgatcgattctaacagtgctgatcagttaaggggatttattgttagccctgaacagaactgggtactagagcccggaatcgggaattctatactcagtcaggattttcgcttttattcaaaaattcttaatgaaaaaatctttaaaaatttagcaaaaatatttgccttaatggattaagatcaaaatctgactga

SEQ ID NO: 82332 - DNA, 1259 bp, Heterodera glycines
  Genomic contig location: Contig_ID=SeqID_2917; Location=993..2251; Strand=-
  SCN-specific regions: Sequence locations=1-39,61-234,258-696,720 -1186,1208-1259
atgtctgacaaccgaaacgaagcggaggagaaaatggcgaaagcaatgtaaaattaaaatgccaattttcaatttcaatttttaaattttgttttccttttttcagttttatctctggcgacggttggctttgtgtgttcgaattgcttccggcttcacaacttggccttggaattgcgatgatcagccaccgttttgacttctacgtggatgaacacttcaagactcgctactggactctgagatccatgaaaatcaaaatgaagttcgaagcggatggcaccaaggaaatggatgttgtcaatgccaattgggaatcgtttggaattacgcaaaagccgttgccaaagagagtcgtcggattcaaagccatttcattgaagtgagattttgatgatttttttttctgtttgtaaaacaattccatcatttttcacaggtacttcaacaacaatgtcatcacttttctccaccgttttcgtccaattctcgccgcccgccccattcatttgaccatcgacacgtacttcgatcaacgcactttggagtcgattttgctcaacatttggcccatgatcgcgacaaacattcgtggcatccaattgtccaaagaaagtttctgccgtttgcgtcaattcgtcccgtcaattctcgacgactgtccatcacttcgcgttgtcaatgcctattccagtggtttcttcaccaaatttccatgcgatgacagtgccgaggcgtcggaaggacaggcggtggccaaatggcttttcactccccgtccggacaatgtgccaaaggtgttcaaatgctggttggaatgcggtggctggcatttggcgccaaggattgaagccttcaaagaggtgattttgatgtgattatttacctatttgccatttttacgggctttggcgttcgctgacaaaaaaaattatacccaaattggggcatctaatcgtaaaattcattcatctatcatttcatatttttccctattttaggaattttacgccgcttcatctcccgtcaatttcatcgctgtcattcgctttcgttcgtcttttgatcatctggttgtgccatttgttctgaccaacgaattgacccgggagcaattgacgttgaagaagatgaacgatatcgaccgtgttcttctgatccgttgtccgattgtgcgcgacgaaagcaaatgggccaaatgggagaaggaagcgattggatggaactttatggaccagtggaatcggatcgacatttga

SEQ ID NO: 82333 - DNA, 556 bp, Heterodera glycines
  Genomic contig location: Contig_ID=SeqID_17801; Location=251..806; Strand=-
  SCN-specific regions: Sequence locations=1-128,150-203,225-292,315 -361,403-556
atggaaaatggaagaaatgccatgtacggaagaaatgtttggttggagatgatggatggagtaaatctcaaaggcacacacaattcataaccaacttttcttactttagcatttgaacattaatttcaatttttactgagtttaattttgttgtccttccattttctttcataattatcaattttttttttgttgtccgtccattttctttcataaacccgacggtgcctatcggcactaccggacccccagttccaacaagatttcggaaaaggcgcgccgcaaaaaaacgatttaaaagtaaaaaatgtttttactatagacgcgaccgggggaccgggacttgccgggacctgagaagccaggaccgggaccgggaccttgaaatttatttttaaaatactaaaaggtgataagctgaaaaccaagctaaaattaattttcgtgtgaattaagccgtagaggtaaggaaaaaaggcatatgccttaaaatccgggctttaataacaacgaaatattcattcaatgagacgaatgtaaaaatgaaaaaaataaa

SEQ ID NO: 82334 - DNA, 550 bp, Heterodera glycines
  Genomic contig location: Contig_ID=SeqID_17801; Location=1786..2335; Strand=+
  SCN-specific regions: Sequence locations=1-127,149-291,314-360,402-550
atggaaaatggaagaaatgccatgtacggaagaaatgtttggttggagatgatggatggagtaaatctcaaaggcacacacaattcataaccaacttttcttactttagcattgaacattaatttcaatttttactgagtttaattttgttgtccttccattttctttcataattatcaatttttttttgttgtccgtccattttctttcataaacccgatggtgcctatcggcactaccggaccccccagttccaacaagatttcggaaaaggcgcgccgcaaaaaaacgatttaaaagtaaaaaatgttttcactatagacgcgaccgggggaccgggacttgccgggacctgagaagccaggaccgggaccgggaccttgaaatttatttttaaaatactaaaaggtgataagctgaaaaccaagctaaaattaattttcgtgtgaattaagccgtagaggtaaggaaaaaaggcatatgccttaaaatccgggctttaataacaacgaaatattcattcaatgagacgaatgtaaaaatgaaaaaa

SEQ ID NO: 82335 - DNA, 260 bp, Heterodera glycines
  Genomic contig location: Contig_ID=SeqID_17803; Location=1426..1685; Strand=-
  SCN-specific regions: Sequence locations=1-126,148-198,258-260
aacattgggcgatctgatcagcgaatatcagcagtatcccgccccactgctgacgaagacgtaatggaagaagaaaaaagcgaaacggaaggagaaaaagcggacgaagcgaattgagggaggacaattcatttcatttgtcaatttaacattggacaaaatgccaatgaaaactgtgccgatcatttcgtcactgagaattaattttaaaataatataatggaaatcttgattttatattttttaatatatttttacca

SEQ ID NO: 82336 - DNA, 1178 bp, Heterodera glycines
  misc_feature (901)..(901): n is a, c, g, or t
  misc_feature (1041)..(1041): n is a, c, g, or t
  Genomic contig location: Contig_ID=SeqID_17803; Location=1..1178; Strand=-
  SCN-specific regions: Sequence locations=1-466,488-1178
  Gene Ontology: Mol. function=oxidoreductase activity, acting on the aldehyde or oxo group of donors, NAD or NADP as acceptor; Cellular component=mitochondrion; Biological process=serine metabolism
ttattttgaatacatattaattttggttttcttctaagcattgtctgtctgttttacccttttgcctatgaattccgactttcgtttctccgccgattatcagccgcccccgcgcctcgcccataattatgcccaattaaaagccttttcgcaaaatgtgtttcctcttcttccttatgcttttgcgccattttgtgctttcgccgcttacaaattaattaaatatttattcggcggacaatcgcaaaaaaaactcgaattgaaaaacaaaactgtgctaattgttggcgccagctcgggacttggccgttcacttgcctttgagttttacgcaaaggtcagaaaaaaaattaatgaacgattttcaaaaaattctttttctgttaaataaagttttccttaagggctccaaattgattttggttgcccgaagcatcgaccgcctaaaagcactgtgtgccgaactaatcaaatggggggacgaaaatggcgttgaaaatgccaatttgcctgtcttccgctatttggacatttcggaacttaacggcgatggaatggaacaaataagggaattatgcgaatgttcaattgatgggaaaaccattgatgttttggttaacaacgcgggactttccagccgaggatcatgtgatgagacatcgatggaagtctatcggcgattgatggaggttaatcggaggaggccgaaccgaacgaggggggggagagaaaaggggagacagagggtgtaagagttcgaatcgaaatggtgagacaaaaggtgtaagggaaggggtcgaaattatccccacagaatcattttagtctacacaaaactgtgaatatttatttcatttttcaggtgaatttcttcggcttcgtggccatcaccaaatccctntttggggtgtattcccgacgatggtgccattctaaacatcaacagcatccaaggcagagtggcacttccctaccgcagtccctattcatgctccaagcatgccattcaagtaattcggctaaattcccttcttttcaaantttttttaaggcattctttgacagtctccgcggcgaagagcgaccgcaactccaaattctaactgtgaatggccggtacataaattggttgagtttttaccattcgtaaatgacattccttccattctgttatcctt

SEQ ID NO: 82337 - DNA, 1707 bp, Heterodera glycines
  Genomic contig location: Contig_ID=SeqID_17805; Location=57..1763; Strand=-
  SCN-specific regions: Sequence locations=1-229,251-415,437-437,460 -562,585-592,622-1267,1294-1567,1590-1707
  Gene Ontology: Biological process=DNA replication
atgcccaaattttgtacgtggaattccaaacaaggaaaatggttattgcgaaaaaacccggaaataagtaaaacaattggtagaatgtacccagttaatccgactgaaggtgagaaatattatcttagatatcttttgcttcatgtgcatggtaaaaattttgatgagctaaaagttgtaaatggtgaaaggtataacacattcgcaaaagcatgtttggcacggggtttaaccaaaaacgatgacgaatggaaatattgcctaaaagaagcatgtcagtttcgattcccagctgcactaaggagtctattcacaagtattttgttatttggcgatccaaaatatcccgaacttttatgggaacaatttaaaaataatttatcggaagattttttaaaaaaaaattctgaaagtgttgcttataaattgtcattaacaattataaataaaaaattattacaagaaagtaaatccttagctgatttcaaaaacctacctcaagaaacaaccacaaaagaagaacaggaaaacataaactatgaagaagaaagaaaaattgcggaagatttatataaatttatgaacaacgaccaaaaaaaaatttatgatattattaaaaaagtgttaacgggtgaaattaaacaaaaattaatatacattgatggtcctggtggcacaggaaaatcttttactttaaatacgctttatcatttgattcgtggttataaaaaacaaataactaatatggccttttcaggaattgctgcgactttattaaaaaatggtagaactatacataatcgatttaaatttccattaaatcttaacgcgtatactgtttccggtgttgttaatggtacaaaagcatctgaagaaattttaaggagtgatttttttgtaatcgatgaggcgcctatggctccaagatttgcgcttgatgctattgaaaaaaaattacgcgaattaactaaaagcaatcaattgtttggaggaaaaacaataatacttgctggtgattttcgacaaacactacctgtaaaaaagtttgcagtaaaatctgaaataattgatttaacgattaaaaggtcgattttttggaataaatttgagcatatgaaattgattataaataacagagcaaaagatgaaagtttttcaaaacaagtactcgaaataggaaatggatttaatcaaaatgggtttattcaacttccaaacgaatgtatattatctgaaaattcaaatttagttcacgaaatatatggagatatatttttaaataataattttaatgaacttaaaaaccgtattattctttcaccttataatgatttaactgattaccataatgcagttgctttagaacattttccgggacagttagttagctatttaagtattgatgaagttgaaaccacaaacaattttccagtaactactgaaataatgaattcttttaatgcacctggctttcctttacacgagctaaaactaaaacagaactgcaaagtaatgttgttacgtaatattaatattgaagaaggactttgtaacgggacaatgttgcaagttttagaattaaaagaaaacgtattaagatgtgtaattctcgggggcgataaaaatggttcagaagtttacatacatagaatttctttaataactgaaagcgaattccccgttccgttaaaaagacatcagtttcca

SEQ ID NO: 82338 - DNA, 275 bp, Heterodera glycines; identical to SEQ ID NO: 71924
  Genomic contig location: Contig_ID=SeqID_17806; Location=908..1182; Strand=-
  SCN-specific regions: Sequence locations=1-219,262-275

SEQ ID NO: 82339 - DNA, 892 bp, Heterodera glycines
  Genomic contig location: Contig_ID=SeqID_17808; Location=56..947; Strand=+
  SCN-specific regions: Sequence locations=1-80,102-554,577-892
atggtgcaaaaagagctcattgggaaattcgcatcgggagactatgccaagaaaccaataagtttccgtgagtcagtttcatgtttaggggagaggaaagaattagtaataaacagtccaagatgaaaaccaatgaaagttcatgggaatcgggagacgaactccacccccatcctatggatgaatagttttaaataactaatattttcaaatgggtaccgtaacaattgtttagtcggataaccattactctttgcaaaaggaatcgacgaaattacgcttgcgggggcggcagcacagaaggctttcaatcctggtccaacagtcgctgagtactttttgaagaaaaatggtattacacttaaacatccgcaattgccttgtttggtgcaaagcggcggtggaaaccataaaagcttttatcccatggaactgttgttctttgcccaataatttgaagatgtccatttctttttcattttttatttgtttatttttctataagtaaaaatttcgattgttcgattatgctaattaatttgttttattacaatattcaattacctttttacttgacttttcatttcaattgtcctatgttaatttgttacttactgttagctattacaacaatttcaaatcgtccagcaaccacgaacgtcttttcttttcagaatatgccgatcttcggcgatccttcctccccttatgacgaagccgtagagaaagcgactgcggagacgatgacaaatgagaactggacattgatgttgtgagtgcgtacggattcacacaattaacggcgaacaaattgttgattcgttgcagatattaggaagggactgaaggcggacagaaaccttaagtaatggaatgaatgaaaggcaaacta

SEQ ID NO: 82340 - DNA, 291 bp, Heterodera glycines
  Genomic contig location: Contig_ID=SeqID_17809; Location=289..579; Strand=+
  SCN-specific regions: Sequence locations=1-30,53-164,186-291
ctcgattcgacaaccaacaatcattgtcagaagaagaaggcgattgtcagcaacgatccgaatgtcgtgtcgagtgagcaggaagaagcggacattgcgaagggtcctttttggttggcttaaactgagaatttaaatggttcagccattgctttgtcattgcaagagggagggaagcagcagcaatcctcacaaaatttctacccgagtgccgtcgttggcacagctccgacaaggttttggcatatttcagaaccttcaattgaaatgggacaattattcaaatgttaa

SEQ ID NO: 82341 - DNA, 152 bp, Heterodera glycines
  Genomic contig location: Contig_ID=SeqID_17809; Location=956..1107; Strand=+
  SCN-specific regions: Sequence locations=1-152
atgaaatgcatcgaactgctcgagaagtgtgaccccggggccgacccgtcgtccgaccctgccgaattgccttttctcgagcaaatggcgaaggctcaagcaccactcatcgatcagaaactcgtcaaaattgacaaagtgagcaaggacgg

SEQ ID NO: 82342 - DNA, 1360 bp, Heterodera glycines
  Genomic contig location: Contig_ID=SeqID_17811; Location=681..2040; Strand=+
  SCN-specific regions: Sequence locations=1-332,359-386,408-452,635 -724,746-773,832-1360
  Gene Ontology: Mol. function=translation initiation factor activity; Cellular component=basement membrane; Biological process=nucleobase, nucleoside, nucleotide and nucleic acid metabolism
atgatttatcacattaaaaagttgccactttgccatcgactttggtgccgagaatggaagggacgacaacaacaacagaaagcgcaacaacagaaacagcaatcgaagcagagaaaaatgccaccgaaattggggcaagtgaaaaagggaaaaattaaggacaaaaaggcataattaaggacaaaaaggcataattaaggacaaaaaaggcataattaaggacaaaaaaggacagaagaccgaaaacaaactaatttctttttagatagaaagtgaaaccgccacttcgatgcttttcagtcagccgatggaattggccggggatgtgagagacgaaacggaagggaacggaacggaaaaggtaaaggaaaagcggaaaacggaaaacaaattagcaaacaaatgaaggtgatcgagacgacgggagaagcaaaaattgaaacgatcactcaaaaaggaaaaacggcggaggaggaagaggaaaaagaggagaaaaaggagcacaaagagacaaaggaggagccggaattctcaatggacgaagagaatcagacagaaaaggaaaaagaaacggtaagggaaaagagaaagaaaagaaagagggaaaaagggagagaaagagagtgaaaaaaagtaaatttagacggaagaaagcacaacagtgacggacagagtgccaacattgccaattttgataatgaatgaacaccaaggcagtgaaggaaggccaaagtcagtgggaatagcagtgccaagcgaaacgaacccaacggcaacaacagcaacaacagaaggatcagaagaaggcgaagaagaggaagaagcacaaaagaccagggaaaacggcacgacaaaggcagctgatcagccgatcagcgaaagaaaagtcatgttgaaaagcgaagaaaaggtgcaacagcaggaggacgatgtaaatgcaacgacggcatcaagcagtacagaagaaacagcagtgactgtaaaggtggaacagcaggaggacgatgtaaatgcaacgacggcttcaagcagtacagaagaaacagcagtgactgtaaaggtggaacagcaggaggacgatgtaaatgcaacgacggcttcaagcagtacagaagaaacagcagttactgcaaaggtggaactgcaggaagatgatgcaaatgcaacgacggcttcaagcagtacagaagaaacagcagttactgcaaaggtggaactgcaggaagatgatgcaaatgcgacgaaggcttcgagcagtacagaagaaacagcagtgactgcaaaggtggaactgcaggaagatgatgcaaacgcaacgacgggatcaagcagtacagaagaaacagctgttactgcaaag

SEQ ID NO: 82343 - DNA, 611 bp, Heterodera glycines
  Genomic contig location: Contig_ID=SeqID_17812; Location=2418..3028; Strand=-
  SCN-specific regions: Sequence locations=1-316,338-353,390-401,458 -514,537-611
atgtactttagtgcaagcattttttataaagtaagccgaaattaaattgtccgataataaaatccggtggagaaacttgctgctgtctgtcacaaactgctgacattcattttaacatttttttttatttgaaaatgcaaattcaatttgctttcgggttcgaagtaatttgaaaggcaaaaagtgccatcgacaattttcaaaaaaatatttaggaatttgcatttattttcaaatctttaaatttttatttgaaatgttctttcgaattttgcatttttaacttttcaaatcctttcgatttctgtccaagaatttacattttaaattttgcacaattttctcgaattcacatttaaacttttttgttttataaaaataatatttttcgagttttgaaatattttaagttaaaattcttttgaatttttcattgaatttcaaattaatgcccccataaaataaacagtttcgcatttcatttattccttcagcggatatccaaaagaaatggatatgtttggggaaaaaatgaacgaaaataatagaaaaactgagcccattcactaaaggccttccttaaagcaatcgattcaaatttaaagattaaa

SEQ ID NO: 82344 - DNA, 1548 bp, Heterodera glycines
  Genomic contig location: Contig_ID=SeqID_2920; Location=978..2525; Strand=+
  SCN-specific regions: Sequence locations=1-424,463-516,543-668,712 -749,812-891,956-1394,1440-1548
atgccacgctttgtggtcaaggacatggagacgttgttcatcgacgaggttcgccagtccatcaatctgttgatctccaacttggagtcggtgccggtggcgcctcggcaaacaatgggccgcaaaaaggagaaaagccgaggaaacaggtgagtgccaaaatcacggggccaacaccaattaaaattatcgcgcaaaaattttggtgtctgataactcagtagtcactgatcggagaaatggctaacatatataattataatgtggagttgatcaaatgtaaatccgattaatcagcgtctcgttcccgttttaattgctgatcagtaatgaatcgtaatgaccaatttctttcgttcaaaacatgatcaatcaaaaattgttttaaattacttgttagtgaccagctttaaacacatttgaacagatttttcttttatgttcaacaacaaaattttggttcattagtgtttgacttttttgatttttttggtgtgctaattaactaactacgtataattcactaattaattaattaattacgccttaaacctcagcaaaaatgtcttaacaagaatatttgttatttttgtcaatttgtgaagtgcttttttgttcatgtttcagatcaagatcaattgaggatttgtcgttgttcaattcgtaagtttttttgttaatacaaaaaataagtaaaaaataataatttttctaattacgcttcggaaaagtttgttcgttttttgaactttttaatttttgttttaattactattaaaaaatttttgtttttaataattttaaaaattttgtggctctattaacactaattaacccaaaacaaaaataacgatttgtttgctgaatttgtatctgaataacaccatatacatttttatttgaatttaattttaagtattttaaattatttatttaaaaaataataatttttttagtttgaagcgcagaacaagctcaatgtcgttgaacaaaacagagaacggggacgacgaagtcagcctgaccaaaaatgatgtcgtgctcaatttcaacatggaggtaggtgttttgatttgatcaaagataatctataggattagggaacgattaggataagtgatctggaccatttgtgaatgattatcttcgaaaaggcactggtctgagactgtgactgatcggaaccgtttgatttaagctaatttgtaagtgtgattgcaatgatctctaatcagtgatcggctagtaagggtgatcaggaatccaagtgatcactgaacagtggtgagcctggtttgtttctggtcagcctaggagcgatcagacttctgagaattgggttgggcccatgttgactgatcattatgtaatttggcattgatttgtaccaattgatttaaatttgttttaaaaactctttaaaaaaattaaatttttaaggttgttgtgatggaagtgcagggactgaagtctgtgcagccaaatcgagttgtttactgcacaatggaagttgatggatgttctaaattgcaaacgtatgcattttaa

SEQ ID NO: 82345 - DNA, 771 bp, Heterodera glycines
  Genomic contig location: Contig_ID=SeqID_2921; Location=293..1063; Strand=+
  SCN-specific regions: Sequence locations=1-371,531-618,642-771
agctgggcaaagtagtgatccaaccgacgccgaactgttcccggcagcccgaatggtacaaaatgacggtgccaaaaagcagtgccgacaaaaacttgaggtccgtggcttttgaaattaaaggtgcaatggaacaggcaaatatgagagagcctggacctgggtttttttcatatctgacctggatctggatttcaaagatcaaaacccagggaaatccatgttgccgaaaatggcctggacttgggcctggggatccatgtcaaattcgaactctagataaaactttttttttaaaccaatttgatttccagttaattttgcagaattcgtctcgcaattcgaatggaaaaaccgctgaatttggtgagtttttaataaaatttttaaattttaaaaattatttagcgccaattttgaaactcagttaaaaaataaaatagattaaaaaatttttaaaaataaaaatttttttttttactttttgaattcagaaaaataaatttatatttatgtattttagaaaatttgcggctacctttacgggttggtggctcaattaattaataaacctaattaataatgattaattaattacccctaaaaattataattttttctctctctctctctctctctcttcagaattggccgaattgcgtggaagaaatggaagcggcgcttcttctgccttgtccaagtgtcccagtacgctttcgcaatgtgcacttatcgggagaagaagtcggacccgaccgaattcagtcagtt

SEQ ID NO: 82346 - DNA, 675 bp, Heterodera glycines
  Genomic contig location: Contig_ID=SeqID_2921; Location=3714..4388; Strand=-
  SCN-specific regions: Sequence locations=1-467,489-675
  Gene Ontology: Mol. function=ATP binding; Cellular component =extracellular space; Biological process=embryonic development
cctgcaggtccgtcttaagccttcaggccaagacccatccagggacggtttgctttgaattttactttggaagtgagcggctgtcagcaggggacacctgttttgtatttggagcatgtccaagtgattacgaccattcgttttgggaagcgaggcgacttgaaattgactcttttttcgccgatgggcactcgctccgtccttttgccgccccgtccgcaagtgcgtcatcctttgccgtcggtcgtaaaccttgaaaatcgtttaggatttcaatcaaaatggcttccacaagtggccattcctcaccgtgcaggtttatcttaatcttggacattgttatccgtctcattgtcaatcaaatctcagatgtggggagaggacccccgtggtgtttggacattgctggttgagtccatttccaacaacccaaacatcggaggtatcgttcgccattgtgttccttgtttagttttgaacttttgctttcaggaatattcagtgactgggctctcttgttgtatgggactgaggagcctgcccagccaagcgaccagcgatacagtccctacgccccgtcggcgtaccgtcgtccgggcattgggcaggccctcacttctcaggtaggcggcttccgtcggcgtgttggtggcccctccttgccttttcaaaagc

SEQ ID NO: 82347 - DNA, 2875 bp, Heterodera glycines
  Genomic contig location: Contig_ID=SeqID_2922; Location=196..3070; Strand=+
  SCN-specific regions: Sequence locations=1-86,108-451,473-1156,1179 -1197,1219-1537,1574-2066,2090-2530,2553-2595,2621-2703,2726 -2796,2847-2875
atgtgcacaaaagtgcaaggctttgcggacaaagccagtaagcatggcatggacgagctgatacaggtgagaaaaatgctgatcagaacactgataaaaatgccaaaatgcaataaccaaccggtgatccgagaaaaaaaatacccaagtgattgggaatagattgagactgaccaagctgattggagacataaattttgacaagaatattattcaagagtcacaaatgctcatcagcttttatacgggagatacagtaacttcgtttaaaaaattttatcgataaagaaaaataatagggcaatcaattttaatcaataccttattatttgatctatggatttatccaagacagacacataaagaaaatgagagagagctccataaatgttagaccgattattcttacggtacatatgtgatatactgtaattttctgccaaattttgctacaggcggaccctgtccaaattgggcatgaccatctgtttgccaagctgcaatcgctgacgttggacttccgtctgaatgagcacatctgttcgctgggatggttctcgcctggccaagtgtttgtgctggacgagtactgtgcacggtgtaagtccaacgggttacggtaggtgcctgggctgttgatgatttgcttggataatctcttgaccgaatgttgctgtcaatccatatcattcgagatttggtcgagattttttgaaaatttccgagtctcaggcctgagactccaaaaaaagccccaaggcgcctttcaaagactcgtgaacaaaaggcctcgaaaactccgccacaatttcggcctaagcctcgagaacgggaagcctaaaaaaacacctagacactttaagatatggccaaactcgagatgaacacctctaaaaatccggcaccctttttcaacctaggcccaagaatgagacccaccgagacttttttttggcctaaaaccgggaccatagctctgaaaatgcatagattttcacggaccgattctcgagattttccagatatggtgcgcggatgccatcggcacgtctcgttgctcaacgatttgttgaacaaagcggacgatggacatttggtggacccgacacttattcattactcattcgcattctgtgcatcccatgtgcacggcaatcggtgggcaaaatgccaaaaaactgggaatgaaagtgccagaaaattgtggaaattatttaacttatgccaattcgccatttcaggcccgacggtgttggcactgtcacattggaggagaaggagaagttccaggacgtgaaggagcgcctgcgcggtctgctcgagaaacagatcaccaattttcggtacgaaatctttttttggtttttgaattttaatcttttcttttagctattgttttccattcggacgccctgagggtacggtattttctcgattagattagtgaaaatttgacgctaaacgaacctgacttctattttgaccagtttttaatccctaaaccgaactttgaaaaaagtcgaaaattctaatttctcattttatgattttcgttttgttcaaatttaggttataaaattggaattagtcaatgttgatgtcagaccatgatcagggacgacaaaaaccccgcgggcgcaatttttcattattagaaattattttaccaaaaaaaaaacttaaaaccaaaagggtccaccctctctttggtttttttttttttgtataaaattcaaaggatacgatatgactttgcagcgaaaatttcgtgaaatcgaaatttgccccaaatttcaggtgcgcttaaaggcactctgtcactgttggagcgggtgctgatgaaggacgtcgtctcaccggtgccgcctgaagaagttggtgatttgccaaaaaaagaaaaatgcgaatgccgaaatggtggctaagtgtgtgtccatgcggcacacaaaatcggcaatcaaaatcagtacaattctccaaattttttttttcgtgattcgggtcctgatcactaattaacattgtcagcttgaatggcattctgatcagtttcaaaacaattgttcaacaaaagaatgccatttgcagcgattgatcggttgatttctcttcactttgatcaattcaatgactctgatcatcttcaaattcgttctgatcagcaattgcaactatgtccctgtgtttttttgccaggttcgcgcagtgatcagaaagtgcctggaggacgcggcgctggtcaattacacgcgcatttgcaacgaggcaaaaattgagcagcgcatgggcctggacgtgagcccacaacagcgcatcgaggacatgatcagggtgacggagctgtgcattgatttgttgaaagagaacgaggaacaccacggcgaggtgggcacggcacgggggggcgagagtcggagggtgggtgccgtagaacgaaaatactattttgggatcattatcgatgctagatcgtttcgtaaaatccgccattttagctattttttcaacaaagtatggtataattttgcttcaaaataacaaaattttacattcttggtatcgttcgggtagtccttattttttctattagcatgcaaaatttaaaaaaaaatttaaaaaagccataacttaaatgaatttgatttgtaatttttgcaggcccgatctcgcctaactttaggtcgcttatttttatcagaaattttcaataatttaatttaaagattggagggggtttagcgctttgcgttctccatttctatcagaaaatttttgcaaatccatcgaattttttcgtttttaaattctttaaaaatttttcaattaaattttttattttatttaaagattgacaacgttttaaattgatctttta

SEQ ID NO: 82348 - DNA, 801 bp, Heterodera glycines
  misc_feature (756)..(756): n is a, c, g, or t
  Genomic contig location: Contig_ID=SeqID_17816; Location=1594..2394; Strand=+
  SCN-specific regions: Sequence locations=1-244,266-479,512-801
atgaagcgtattatggctgatcaaaataaaaaatacaaaaaaggcatttaccagtgtaagtgcatatactttgtttttgcgtgtgttggcgttttgttttacgccaattattttttggcaatttttttcgttttttaccgtccatgtttaaaactatttcacccactcttgaagaaaattttttttttattgttgtggcctaattgtaagccaaattttaatgcgatttcattataaacaacacacaatcatggtaccccttttgttggttcaaacaaaaattacaaaaatgaattattttcgttggtgtccaaaatttatttgtcgttgtcaaagaccaaacacaaaagcgcatggggaagaaaccacgcgttttacaaatgtataaaagggcgaacaaacagcggagagagagggagagaatgcattatatgtataatatatatttttttgtatgacatatcacaacaactcattcagtgtctttttgttttgtctgtccaaatgtgtgcaaatcgttcgcctccagcctccatgaatccgtccgttccgtcgatgacattatttggggtgtgttggtgtcgtgttttgctggcagttcgtttaacgtctcagaattgtcgcggccttttccggggcggttggttcagaatgatgggcggcgtctgctgggtggccaacgccttgaacacctgctcgagcaacggcgggtgctccttgaccagaatcttccacccgtccgactccatcacctgngagaggtggaaattgaattatgatgaaaagcgaggaaatgttcca

SEQ ID NO: 82349 - DNA, 358 bp, Heterodera glycines
  Genomic contig location: Contig_ID=SeqID_17818; Location=247..604; Strand=-
  SCN-specific regions: Sequence locations=1-358
atggctggtcagatggtttccgacctcaccgccacgaaccgcgagctgactgcctcgaaccgaagttaccaaagacaattgttaattcatcgcataattttgggggttctcgttgcgctcaatattggtaagtgttttctcacttaatttctttatacacatatatagtgcttatcattcttgtggtttttcttgtcggaggttctgggcccactcacaatgagtgcgtgaaatgcagcgaacgatgtggcggattattacgaatggaagtgccagtgaggagggtgaattgtaaaaggtgatttgatgttgacatcttatccatttataaacgttttaatggattttcataaataaa

SEQ ID NO: 82350 - DNA, 758 bp, Heterodera glycines
  Genomic contig location: Contig_ID=SeqID_17820; Location=236..993; Strand=+
  SCN-specific regions: Sequence locations=1-160,185-264,296-440,462-758
atggacaagtgtttggaccgaaaagatgttctaatgtgtcgtgaattggcagacgaagcgaagggggcttttgaaattgttaagcagtataggttggatgccggtactgcgtaccgtaacgcctacactcagtcagacctcggaatcggggaattggccgataaagttaaggaaacaatgaaggaatatttatcccgccccggaccttccccaagaccaacatttaaagaccaatttatatctgattaatgtataaaagagaacaaaaaaaagataaataattaatttaaaaaatggttcaaaaaacagaaatagggacggcaattttgcttgaagctgtgaaaaaagaggcagaaagggcatggaaggaagtctcggtattggcagatgaagttgatgattattccaaatccgcccgtggagcccttaatcgggcaattaaatcccgagaaaaggccccctatgccccgggggttcgagaatggtttgtaaaattatcagattgtatctgggaaatttacagtgttctagataaaattaattccgagtctgatagaacggagtctatttggcacgaggtcgaacgatgcaaagacctcgatcaagctacgaaattagaggataaggtatttaagggtttgagtgaatcgagaaagctacacttagaatctcgcaaaattcacacaaaaattttggagttggaaaacagaattcaatctgttgtttggcgttttattgagtttcacgagtaaaaaaga

SEQ ID NO: 82351 - DNA, 845 bp, Heterodera glycines
  Genomic contig location: Contig_ID=SeqID_17821; Location=619..1463; Strand=+
  SCN-specific regions: Sequence locations=1-51,91-103,157-460,494 -796,825-845
atgtggagtgatgatcggtacagtagcccggagcagatgaaattgtgcagcaagaagaaaaagaaagttgaagaaggagaggaagaagaacatatttacccggttaaatacaaataaaaaaattattaaaaataataatattgttttattattaaaggtttcatctaaatcggacatttgggcaattggcatgatgctgattgagttcttgttgatgacaccattgttcgacattgacccagtggtgattaagcgttccaatgatcaaaagaacatttacaatgccgtcatcaacctgaataggttttgagtgaaaaattgcaaattaaattttaaataataccattttcttagatcttattatgatgcagaattggtgcaagaacccaaaagaacatataaaggctatctgagagagattaaacgcaatttccccaatttttataaaatcattaaggtcattttaattatttataataataaaatattttttcactttgaggcctgtcttcaaatagatccatatcgaagaccaactgcacggggaattgagaactttatgaaaggcgaatgcgattttaaatggctaacgctcaagccatgcgacgagggagccgcagtgaactagcaaaaaatgggcaaattttgagagaaaatgtacaaggaaagaaagttatgattagggcatagaattatatttgtgcatatttcgctatttatgtgcatatttggatatttgtgcaaattttggcatttcaaaagaaattttttagcaaaattttgtcgaaaatattgactaaattaaattttcttaaaaattgattaatttatgtctaaaaatagca

SEQ ID NO: 82352 - DNA, 207 bp, Heterodera glycines
  Genomic contig location: Contig_ID=SeqID_17822; Location=1230..1436; Strand=-
  SCN-specific regions: Sequence locations=1-207
gtttttcaatggccgtcccattgagccgtcgcggaaatttgaattcaaaaaagagcacacagagttggtgatttatccatttttggagcacgatgtgggcagctatgcgtgcgaagccacaaatttgaacggtcgagtgaaaagtgaggcggcacaaattggactggttggcaattactgaaactaattagttgtaatttaaataaa

SEQ ID NO: 82353 - DNA, 885 bp, Heterodera glycines
  Genomic contig location: Contig_ID=SeqID_17823; Location=780..1664; Strand=-
  SCN-specific regions: Sequence locations=1-76,125-288,310-471,519-885
atgttgagcttcatctatacggaagagttgagtgaattaaacggagacaatgcaatggcagtgctttacgccggtgaattttatttatagtaattaaattaaattaaataattatttttaattagccaaaaagtacaacatccctggtctagtcgatccatctttgcaaattccaattttaaaactacgcaatgttttcttggcatatgcccaggcctgccttttggaacgagacgaattgcaaatccgtggagaaatttcaatttggaacgctgtaattttactataaataagaaagaaattcaataattcgttattctcattaataaaggcactttgttgtgcagacgcaaaatgccgtcaaaatggcattgaaagttcttcagaaaatcgtcgtgccattctcggtccagcacttttaaaaattcgcttccctctcttctcaaaaaaggaattttttgataaaataggtaaaaaaaatattaaatttgaataattttcatttttctataatttttcagttccttcaaaggttttaacagccgaagaaaagattggcatttatcagttctattgtcaacagaattttcgtggaatgtattctcaactatttcacccactgaaatttccgagtcattggcgaatttggacatttgggacaatttcgatgaaaattgaaaaagtgtccgaatttgcaagacatccaatggagagttacagattcagtgacgataccgtatacataaagggacttttttggaaaatattggcacaactaaaagcgaagacgaaaagaaatgacaatgaacctttcgaattgtcttgcaaaagaaagtggcggagaattccattggaaaattctatgacctagtttttaacaataaa

SEQ ID NO: 82354 - DNA, 869 bp, Heterodera glycines
  Genomic contig location: Contig_ID=SeqID_17824; Location=264..1132; Strand=-
  SCN-specific regions: Sequence locations=1-73,95-120,142-255,279-869
  Gene Ontology: Mol. function=motor activity; Cellular component=non -muscle myosin; Biological process=N-linked glycosylation
atggaagaaaataaaggaaaatttaaggaaaacaatgaaaaatgggagcaaatcattgaaaaactgaaggagaagacaaagcaaatggaggagaacactgaaaaaatcaaagagaacactgagaaaatggaggagaacacagaaaaattggaagaaatcactaaaaaattattggaaaacattgagaaaatgaaggaaaatacacgagaaatgaaggaaaacgccaaaaaattgaaattggaggaaaagggtgaaagattggaggaaaatgccaagaaattggaggaagacggtgaaagattaatggaaaatgccaacaaaatagaggaaaacggtgaaagattggtggaaaatgccaacaaaatagaggaagacggcaaaagattgattgaaattaaaaaaaaagaaaaattcaaagaaaccgctgaaagattgatagaaaacaataagaaattgttggaaattcgtgaaaaattggaagaaaacggtaaaaaattgaaggaaaacaatgaaaaaatcagtaaagaaagaagtgaaaaactgaaagaaagcattgaaacgaataaaaaacgccaagaaaaatgggaagaactcaaaaagtggaaggaaattgctggcgctgagaaatggctgggctttttcctattgtacgacgctccaaaagacggtaaatgaaaattaattgggcaattaaaagtgctaattaactgattaattggttttaagactccaatttgggctgcgtttgttcggcaacccttcgaattgtctcacaaaagaacgaagtgcgcgatttccagcacaaattcaatgacgtaacaatgaaagcaagcaactgctggggattctccaatttcatttcttttgcg

SEQ ID NO: 82355 - DNA, 736 bp, Heterodera glycines
  Genomic contig location: Contig_ID=SeqID_17825; Location=291..1026; Strand=-
  SCN-specific regions: Sequence locations=1-69,91-706,728-736
atgcagctgcttctcctccgcaaaattgccctgctgagggtatgccgaggtgaccggctgctgttgctgaacattcattgctcaaatgttgtcaatttggtgcacaaatgaggttggaaaaacaggatgaagtaaaaataagtttgtccaaaagtgacaaattgggcatagactgatcggtaaaatgtaaaattggcactccaaacacctaaaactgatcagagattcattgcatagagtgatcggaaaatgcaaagagatgatcgggaaaatgtaaaattgatatttccaacacctaaaacggatcagatattaaaatgtggatgttaactgatcggaaaactgataattaatcggaaaaatgcctaattgggcattgattggaaaaatgaaaaatggacacactgaaaacgcctaaagctgatcagagagattcattcaaatttagcatagagtgatcgggaaaatgcaaaattgacactcggaactgcaaagaaaaaactgattataggttcaaagtatgatcggaaaatgaattgtcataaacaaatggattctaaacacatttaaacgttaaatctgatatcagatatattcagattgggcctagactgatcggaaaaatggcaattataaaagtgtaaacaaaaaacaacaacaaaaaaaactcataaaaactcgattttcactgattatctccataaacatatgttttttgaggaaaatgttaaataaa

SEQ ID NO: 82356 - DNA, 1520 bp, Heterodera glycines
  Genomic contig location: Contig_ID=SeqID_17825; Location=988..2507; Strand=+
  SCN-specific regions: Sequence locations=1-1004,1027-1062,1084 -1180,1210-1520
  Gene Ontology: Mol. function=regulator of G-protein signaling activity; Biological process=G-protein coupled receptor protein signaling pathway
cctcagcagggcaattttgcggaggagaagcagctgcatcccaatcacaatgtgtataggaaaatggaacgactgatcaggtgaagttcaaactgatcatcgatcaaattatttggcatggttgatcggattaatcggtgtgtatagatctgtagtggattaatcggtgtgtatagatctgatcaatgatcagtctgtgtttaattaatatgtgatcagaccctggttagggctaattcgtcaatcaatcatatgggattaatgattgatcggattgaattttgcgtatcaaatttttcgttaatctggttcattaataaatatgtgatcagatcctggttagggctaattcgtcaatcaatcatatgggattaatgattgatcggattgaattttgcgtatcaaatttttgcgttaatctggttcattaataaatatgtgatcagaccctggttagggctaattcgtcaatcaatcatatgggattaatgattgatcggattgaattttgcgtatcaaatttttgcgttaatctggttcattaataaatatgtgatcagaccctggttagggctaattcgtcaatcaatcatatgggattaatgattgatcggattgaattttgcgtatcaaatttttcgttaatctggttcattaataaatatgtgatcagatcctggttagggctaattcgtcaatcaatcatatgggattaatgattgatcggattgaattttgcgtatcaaatttttgcgttaatctggttcattaataaatatgtgatcagaccctggttagggctaattcgtcaatcaatcatatgggattaatgattgatcggattgaattttgcgtatcaaatttttcgttaatctggttcattaataaatatgtgatcagatcctggttagggctaattcgtcaatcaatcatatgggattaatgattgatcggattgaattttgcgtatcaattttttagttaatccgattaaattttcaagaaaaaatttttgaaggttttttataaggaaattctaagaaaaaaaattcaaacagtgattttttggaaaatttttacaaaatcttaataattcaccacaaattttttttaaacttttttccttgaaattttcttataaaaaaactttcttagatttttttcttaaaaatttctacgttggtaatatttttttaaaaaaacttctcgagggggggggggggtgaacgagctgctcccgctggatcagtttacaataaaatttgttcagtctgatgctgaatgttgatgatggcgtgccgatcaagacggtcaaatcgtttctttcaaagtgaatgatgcttttggcaccgattttttggcacatttaaatcaaaattttggattgccaaggattccgtcggtgttcacgggccaagacttggtcggttggctgctccaaaatgtggacattgctgaccttggcgacgcgttgcatttggcccatttgctcgcctcccatggctatgtgtttcaggtgg

SEQ ID NO: 82357 - DNA, 1516 bp, Heterodera glycines
  Genomic contig location: Contig_ID=SeqID_17826; Location=233..1748; Strand=+
  SCN-specific regions: Sequence locations=1-363,385-526,548-565,587 -972,995-1516
ctgatgaccccggaggagttgaccaaccccaacgtggacgagaagagcgtgatgacttatctgtcgcagtttccgcgtgctcgtccgctctactcggcctcgacccgcgcccccttggaacaacaagactccgaaggcacaaccttggacgactccaatcaatcggatataccggtgagtttggaatgggatggaccatttcgagtaattattcttgggcaaaaacttgttgggaaatcctatcatagcttgtcaggcattaattcttttttgctaggtcccggctatccaaccgttctcttttgacgaagaaccgcttgacaatgttggggaagagtgccagcaattgactctgtcgcaaatggacgacgacgacaacaacggagtgaccacggcactcacctgtgtgaccaaaacgaccacatcttacacaattgggcagcagaatgaggctgatgacgaggcaggcatactttaacccaatacaaacaatgaatgaatggtctaatgccacacggacagaccattctgaaaatgggaccaaattgcacccggttaagtttttcaaagtaatttcaatttttctgatttccctcacgaatgggagggggagcgttcgtgacatatgagggacggtcggagatcgtctgggtcgacttattatagcttttttcagtttccaaatgagccgtctttgcccactgacatggaaaacattccgcaacagaatcatcagctgtacaacctcatggtttgtgagtcggacttaaacgacggaattgccgagacggcggcagagccaacgactgactttgacgctgtacggatgacttatcggcacgaggagctgcaatatgagccgttggtggtggtgtcagacgaagagacggttgccctcgggacgaccgccgtacgtcctcagcccggctttcggtcgttgtgccgggaacgatccaccgaccacattgaggcggctgcaatggtggcggtggagggccacggactgcaaagctttgtgcctggtcatgcggcaaagtttgcggtagacgcttcgaacaccggtgggtcagagacgcgaggattctcagaattggaccatttgcaattcaaaagcagagttggcctgcccaaaggcgttgttcgtcggcgttgtcacttcgcatggaccggcggacaaagtgacggttgagcatgtgggcggtggctgttacgaggtgggtaataattaatcgttctattcgaaaaaaatggaattaggtatcctacacggtgcaagacgacacggaagcgttggtgtttgtcaaatacggcaaaaacaatgtggacggcagcccgtttaggtcaaattcagattggttggaccttggaatacttttttgatttttccgctttttaattccattaattttgctttttgtttttcagcgttcgtccgatgcgtttccgcaacaatcacaatgacgacgctttcttggcggaaatgcgaacagacgatgttaattattatcggatgtga

SEQ ID NO: 82358 - DNA, 1143 bp, Heterodera glycines
  Genomic contig location: Contig_ID=SeqID_17826; Location=2009..3151; Strand=-
  SCN-specific regions: Sequence locations=1-97,128-237,259-484,508 -996,1018-1025,1050-1072,1094-1143
atgaggcaatgttcaaatgccggagggatttctcttcaaaagaaaacgccgcgagaaagtgaaaacagcgaagagaagcagaaagtaaaaaaagaacaaattaaaaataataataattgaaattaaagcaaatttcgtcaaatttttatggaaattctttttttccgcaaaatgttcaaaacaaagccaagggaagtgaatggagaaaagtgagtcggattttaagcgttagcgtaaaaaagggttagtggaaaatgcgtcagtgaatcagaatttcttggaaatgagactcggtagtattatcttggatacattttcaaaattttattaaagtaaaactgaactgacaattcagaacgaagttcttatacaattttgtcttttgtattacaataccttagaaatactgtatttattactgacgcattttcgggagcccttttaagcaattgtaaaacgaattttatcagtaattaattattcgctctaaaaaataattacaaaaatgcatttttcttctcttttttgttttcttaaattctcataaataaattctgaaaatggaattaatcttttacaaaaggaaaagtcacaaggaaatgggaaagaagcaactgacaacaaacaaaaagtaactgtggaaaacaataatattatagaaattcaaaaataagcctttaaattattatattttgctgttattttcgcttttatttcaataaataaatttaagcaaagttcgccaacacttttcgctcctcaaaatgaaaattcggaaagtgaagaaagaaaggtgaggaaaaaaggaaagtgaaaaatgtttttgcatttttcaggaattggaaagaatgggccgccaagtcgcagaaattagaagcaaagtcgaaacaatcaaaagcaaaatgaacaaaatggccaatgatttcaaaaagacaatgttggagctcaaagcctttatggagcgcattttcgatgatgaaaatgagaaaagcgaaaagaaataattattttttcaatttccgttcttttttttaaatttatatttatttcaaagcaattccatacggaaaagagcactaaaaatgtggtcaatcacaaaaaaaagcatttgtgatcaaaagacatcatttgttggcaaataaa

SEQ ID NO: 82359 - DNA, 1040 bp, Heterodera glycines
  Genomic contig location: Contig_ID=SeqID_2924; Location=2315..3354; Strand=+
  SCN-specific regions: Sequence locations=1-230,252-464,487-817,839 -877,899-1040
atgctggtgaaccgtgtatatgcttttaagcaccgacaacaacgagacgacgacggggaaggtgggcaaaatgaccaaggggaggaggagaaatgggctgtcgaagaggcggaggaggaacgttatgaagatgttgatgaagatggattggttggtggcgacgacgacgcggcggtgccaccaccaaatcagcagaagcagcacaatggcaaccgatggcggtggcatcaacccactggctggctgcacaggaggccagtgcggcgcagcggtgctgccgcctctgccacaactgttggtgcgtgctgagtgtggtggcgggggacggacggtcggtgcatgcgctcgacatttcttgcgaattttgaacaaatttggattaatttagttgcataatgggctccggcggtgccgatccaataggcgctatcaggaaaaatttttttgcttattttctttacaacattaaaatttaaaaaaaaaattcccggttgaataaatgggtcccgcgatgccgcgcgatgtcacagaaaactttgcttccaaaatttatttgtgtatgttcacaggttatgacccaactgtccgcaacccattgtttgcgggtgcagaatgggcagtggacgacgaacttcgcacgctctgccaccattttcaccctaccgtttccgcatttactcgagcattggttaaaggttggtcgatgaattggttcaaacggttgcagcgaatgggggcggggtcgcaaggcaaggaggggtcgcaatttttggaaattttaacgacgcatttgaaacgtcgccgcacaaaaaaaaactttttcagaatttcaagaaaatttaaaattgttttttttttttgaaaacctaattgtaagtattaataaaaactaaatttccagaagaaaaacaaaaaactggatttatttccttggattttcttaataaaaatttacgaaacgacgttttatcctgctcccatttgtcgaccccgcccccttagaaattaatgtatgatccgtttccattcttgatgcaaaa

SEQ ID NO: 82360 - DNA, 1106 bp, Heterodera glycines
  Genomic contig location: Contig_ID=SeqID_2925; Location=125..1230; Strand=+
  SCN-specific regions: Sequence locations=1-651,675-942,965-1106
  Gene Ontology: Mol. function=receptor binding; Cellular component =mitochondrion; Biological process=fatty acid metabolism
gcgaactccaatccggcactctgtcggccacccaggttctgtacgcgtacgcgcacttcgcactgctggtcaacgaccggctgaactgtgtggccgaaatgttgcccgaggcgttcgacgaggcggcccaattggacgccaaatacgccgccggcggaaccgggaagaataaaccaccgctgttcggcttgccgttcagcgtcaaagccaacttttttgtgagcactctgatcattaagggtctgtgcaaaactgaacgaacaaatttctagattttcccgtaggtgcctaacaagcaccgccgggtcccaatgcgagtgcccctttttttcttttctgaatacgggccagacatgagaccctcgcccgaacattccatgtgtttcagttgaaaggctacgactgttgcattggcattgcccgttggttgggccacccgcggagtgtcgactgttccctggtcacccttctgcgtcagcttggcgccgtgcccttttgctacgccaacgtgccgcagacgctgttcagcttcgtctgctccaaccctgtctacggcacaacgggcaacccgcacgacccgaagcggtgtggcattttttaagaatgaatgggatacacatgccatgatgcattcatcctcccctcctaaattacctctccctctctttccagggggttcaaaaaaaacacacatacgggggctctgttttaggaaatccgttagattttcggatgttagtatgcttaattgtgccttcttttattgcactgcacagaagccctggcggttcgtcgggcggtgacgcggcacttttggctgccggtggcacggctttcgcaaccggcggtgacattggcggctcattgcgtattccggcacagttttgtggcttggcaacactgaaaccgggccaaagtgccttgtttatgatctgcacagatatgcaatgattttcccaaaatttcagaccgatttgaaatttcaaatgcccatttgggaatgccgggccatgcccgactggggttgggcactggagtttttgccaaatcagtggaagaggtgtgttacggacagcagcaggctgtttaacagatattgattgttg

SEQ ID NO: 82361 - DNA, 797 bp, Heterodera glycines
  Genomic contig location: Contig_ID=SeqID_2927; Location=860..1656; Strand=+
  SCN-specific regions: Sequence locations=1-188,240-290,317-553,577 -715,758-797
atgcccgccggggttgtgccgacgggcaccgttcgacgagaggacgacgaggcgctgatggacgacacgcaatgggccaccggtgggtggtgatgaacagtcaaaacagtcaattgccacgactaattatctaattattcgagttagcaaaattaatttatacaacaaattggcaattggctataatgttatattaatattattatttttcggtaattcataaattaattattaaatatgcctttacaatttactgaacaattattaataccattttattggctattagctaaaaatttaatttaaataattatttgcatttccctacaatattttataatcgatcgcctaattactcaattaaagacgggaatattctgctcaaatggatgcgttccgcggctgccaactccgttgggctccccgttggtgtacaggtgggcaaaacccggccgatttcacaaattttttgtaaaaaccgatttccaggtggttgcaatgcgttgggaggaggagaaatgccttgggctgatgaatgccattgaagcgatggccaaagcacagaaaaagtgaacagaatgccaagaaattggggaaaattttcaaaattgatcgacaaaaaattgtgttgtgattgaccctctgctgctgcttgccttttaaaaagcccaatttggacacttatatattcattatttgtcttcaatttctgaactttttttcttaatttaaatgattatttaaatatattatttttcaaagaatcaaatcctcttcttgtaatttaaaatatttaa

SEQ ID NO: 82362 - DNA, 1320 bp, Heterodera glycines
  Genomic contig location: Contig_ID=SeqID_17827; Location=1326..2645; Strand=-
  SCN-specific regions: Sequence locations=1-265,287-295,317-462,492 -828,851-852,881-1229,1252-1320
atgcccttttatttgtacatcgccggctcaccaatgctccattttgccattatgatcgaaagggtccgtgccacactttttgttcacaattacgaaagggccagcacaaaattcgccgttggcattttggctttagtggtaaaaagggaaaatatttgacgacatatgccaattcgttaaggcaactctgttggttgctttctgcgtttacgtttacttcagcacaatcattgacccgacctttgagaaacccatggtttgtttgttaattaactcattaattaatacatcatttatttgccattttaattgctttattaattaggtttattttacgctcactggtcgttacaatgccaccgaattattatatgcacattatttttttctccttctcgtcatttgcatttcaatcgccgattattttttgatcagaatgaatcgacgactaaagcgggcattgtaaaaaaggggggaaagaaaaggaggaattagtggggaacaccaaagcacaaattatttaattagttctaaaaagagttcatcccgaaaatctgagccaatccccaagtgctttgatcatttcccaacttttgaatattttaagtctttaaaaactaatttattccctccaaagctccaacaaagtgcaggactattcactgagcagaaactatcaaacaaatgaaaacattttgaccatgcgtatcattttcccgttggacttctcctacaccattttcttctccattttcaacatcctttcgggttatattcgaatcaaacgtgaacaatttggcattttggtgtacattcgcacgtacgaaacaatcactttggtgcgattttctgaattaattaattaaaatagtaattattacattttccattttggcttctcttcgcccatgccatcatcactttggtggtctatcactatttcttgagacgcaaaaacaaaaacagtcaaaaaatggagccagcagcggacgaacatgccgatttgtacttccgaattttgcatttgcaatggcacaaatagcgaaagcgaaatgacacagtgtttaatggggatgatttttcaagcttctgctttatgttatttataaagtaaactgtctcaattatggccaaaagtgaatttacaatttgattaaatataattaatcaattaatttaggggggggggggtcaatttggcaatactgcaaaagacggtgaattaaatttggcatttcataattcacattggtaatatctagggctgccaaaaatatgcacgaaaagtggccaaaatatgcgcataaatatgcaaataaa

SEQ ID NO: 82363 - DNA, 775 bp, Heterodera glycines
  Genomic contig location: Contig_ID=SeqID_17828; Location=360..1134; Strand=+
  SCN-specific regions: Sequence locations=1-189,211-373,395-501,525 -611,633-682,752-775
atgacgacattggaggctcgaccactatgtcaacaaccgcttcttcgtccatgggctcgcctttcagggtgagtgggagggcataaatatatatgcctcgggggcaatatgcctttttcgtcacagttaatttgttgattaaatttgaaaagcaatttccgtcattacacacacatttacagtaccacacttgtttgttgtttttgttcacgcatattctgaatacacaataatttacatgaattttttaccgtatcgagggcagggatggtcccaagatctctcggcgggggtgccgctaccgcaccccgcgcgacgatttttttgtttgttactttttacgccaatttttgttggcacgctttttttttaatttttggggacccaggaggggtcctgcgcggtgccgacaggcgccgccggaaaaaaaatgaaattcaatcattttttttaacagattttcacgaagaaatttgttgtattttgaaaaaattcagtgaaactttttggaaaatttgggttccggaggtctggatgggtaccaaataaggaaaaattgaaagttcagtacaaaatattaatttccattaaaaatttcgagtgggaggcgtcttggccccctccagctgggctatccatgctcggtggttttttcacttctatcaaaataagttttttgcagatttttatatgtattttaattaaattaatgaataattgaaattgagaaatttgataattttaaatttttgatggcaccgaaaatgagtataaa

SEQ ID NO: 82364 - DNA, 2081 bp, Heterodera glycines
  Genomic contig location: Contig_ID=SeqID_17832; Location=1..2081; Strand=-
  SCN-specific regions: Sequence locations=1-222,244-448,470-494,516 -532,556-600,623-1050,1072-1205,1229-1435,1457-1698,1720-1720,1742 -2015,2037-2081
  Gene Ontology: Mol. function=ATP binding; Cellular component=muscle myosin; Biological process=muscle contraction
gcactttacgcgcgaatgttcgcttggcttatcagacgatgcaacgcgagtttgaagcgaaggattgcagcgcgaaatgtttgtgggcgtgtggacatcgccgggttcgaaattttcgacctcaacagcttcgaacagtgtaaatcattcaccgcattcactaaatggaaatttagtctctgttatagtatatttaatttacagtatcctcacccaaaaaaatgtatttttagtttaaaattcgacggtaattgatttcgacagtatccaatacataaaaattttcgaagctatattagaattacataatcttatctttattgacagaagtatgagttccttatctgggggtgccgttgaattttaaaaataccgtaatcggacgggcggaaatctgtggtcattatactgtcgaaattcaattattgtttcgaaaacactttgcacgttttcttttagtgtggatcaattttgtcaacgaaaagctgcaacaattcttcaaccagcacatgttctgctcctgtctttctgtccccccaattgccccctccccttaaggttcgttcttgaacaagaagagtaccgtcgggaggccatccgctgggaattcattgacttcggcttggacctgcagtcgtgcattgaactgatagaaaaggtagccgataactgagtgagcacagaaccattcggctctttttgtgcagccattgggcatcatctcaatgttggacgaagaatgcattgtgccaaaggcgacggacggcactttcgtgcagaaactgtacgaccaacacctgggaaaacatccaaacttcaaaaaagcaaagccgcctaagggcaaacaggcaattaggggggggaggcataatgagacggagtccttcctcaacaggcggaggccgatttttcggtgcaacattacgccgggactgtccgatacaatgctaagtcgtggctggaaaaggtgccaaattggcaaaaaataagcttactttgaattttaaaattgtcagaacaaagacccattgaatgactctgtggtcgccgttttgaagacaaaacaaaaaatggcacttttgaatgccatttgggcagactatcaaacacaagtgaatcaattaattaattgataagtttgctaaatgataaactacaaaataaaaggaggatgtgcaagaacaacaaatgcgaggcaaagtgccgaaggggaagaaaaagggaaaggcgagcacattccaaacggtgtcgatgatgtacagagactcgctgaacaaattggtcaaggtgagttggccgaccaaagaccgaccaaagcgaaaaatccgccgaaggtgctaagccaaacgcatccgcactttatccgctgcatcattccgaacgaacagaagaagtcgacgagaattgaagccaacttggtactcaatcagctgacttgcaacggcgtgctggagggaatccgaatttgccgcaagggatttcccaacagagttgcttatgccgacttcaaacaacgctatgccattttggcaacaaaagaagcgatggaaacggacccgaagagggcgggcgaagcgatgtgcctacgtatggaaagggacgggacgctgagcagagacggcttccaatgcgggacgaacaaagtgtgccttccttgagcccctcccccttcctccgccgagggatcaatgggataaatccctccctccttcccccaccgttcatcattcctccttctcttccgaaggttttcttctgttcgggagtgcttgcttcgcttgaagaactgcgagatgaagcattgagtgcagtcatcgtccaattccaacgcgtgtgccgtttccatctcgcgcaaaaagagctgaagcgtcgacttactgagaaaattggcgtgaaaattgtgcaacggaatgtgcggagatggtgctcactgagaagctggccttggtttcgcttgttcagcagaattaaacctttgattaaagacttaaaaatggtggctccataataatttcaaataaaaatggattttaaatgttatttacagaatgaggaatacggtagtctacaggactctagag

SEQ ID NO: 82365 - DNA, 833 bp, Heterodera glycines
  Genomic contig location: Contig_ID=SeqID_17833; Location=1..833; Strand=-
  SCN-specific regions: Sequence locations=1-713,827-833
  Gene Ontology: Mol. function=structural constituent of muscle; Cellular component=striated muscle thick filament; Biological process=striated muscle contraction
gtgatctcctttttcgctgttgtgggcggaacgaacaccaaaaagaggacaaagttcgaaatgccttcgacggagaaggaatcgtcgtccttggaggaccaaatcgttcgaactaatccagtcctcgaggcattcggtaagttcgatgatgaataattaatgagtcgatcatctacaatttatgtcaatccatcgcttttcaggaaatgccaaaactgttcgcaacaacaattcatctcggtttggcaagttcattcgcatttatttcaacaacggcggaaagctcgccggaggggacattgaacattgtgaggggagacaacacccgtttattttcacaagggtttagaccttttggagaagtcgcgcgtgataaagcaacagcccaccgaacgctcttaccacatattttaccaattaatgtccggtgccattcccggccttaaaagtgagccaatgccgaccatgccacccaattctccccccccccccccccctatagcaaaactattcttggatcgtcccgtgcattcgtacaattttattgcccaggcggaagtggccattgaagggatggacgatggggaggaaatgctgaccacggacgaatccttcgacattatgatgttcagcgaattggagaagatggacctttacgcattgatagctgcgataatgcatatgggcgaaatgcgctttaagcaaaggccgagggaagagcaagcggaagaggaggacatttcgggtgggggggggaagaaagaggaggggggagaagaagcaggaggaggaagaaaaaggacatttcggatgggggggggggggaaaaaaga

SEQ ID NO: 82366 - DNA, 826 bp, Heterodera glycines
  Genomic contig location: Contig_ID=SeqID_17834; Location=32..857; Strand=-
  SCN-specific regions: Sequence locations=1-82,289-319,341-441,463-826
atgatcacaaaatttaaccaaaaattatttgatttacatcatggcaatgggaagaatctacaactatctgttcggtaccaggtaaaataaaattttaaaaattattttttattaaattttttgaagccctaaaaggctgataattatttgtaaaaaattattaaattaattaaaatgtaaatatattttttttttaatttttgattgaaaagtcataattttaatattattaaaacattcaacttaaaatatttttttcaataaagctcattttaaaagcaaatttttattgcatatcgcttttttccctacaaattaattaattttagttaaatgaaaatattcggacgggtcgacaattggcaccaaatttttcgtgccattttatcaccgtttttattacatttgttatgacaatgaatttccaattcggaattataacaaaggacgaatatatgttgttattttacggatttttatttcttgcacatgctttcaatgaccttgctcttcccgttgtaatgctttggtcagtttcgattgtcaggaaaaattccgggttatttcctaataaaaaatttcaatttttttcattttttttgtctttcgcaaggtttgctaatgtattgatttacaaaatctatcaaaaattattcagttatcatccattgctgaacagaaaagccaaggcgtcattagcgatcattaaaaaattgttgagaaattcgtccgccgtttctccactcgaagaaacggcacaaccattggacactgacggaaggccatttggcgaacgaattcagcaagaaaatcaggacaaagatgc

SEQ ID NO: 82367 - DNA, 132 bp, Heterodera glycines
  Genomic contig location: Contig_ID=SeqID_17835; Location=2022..2153; Strand=+
  SCN-specific regions: Sequence locations=1-68,90-132
atgaccgaacacaactttgagcagaatcgccggaccaattcatcaattgttcatgaaggaaatgtccaattcgacaacgaaaacaacggaactgaaagagatgaaaatgaaattagacgccttctgcttcaa

SEQ ID NO: 82368 - DNA, 120 bp, Heterodera glycines
  Genomic contig location: Contig_ID=SeqID_17836; Location=1145..1264; Strand=+
  SCN-specific regions: Sequence locations=1-120
atgtcatcactttttgttcaacagccgtcgttcagcggctcaacaccgaatttgagaagtttaagcgcagctgaagaagcaggtcaacagagtgccaaaaaggggcataaaagagaaaaa

SEQ ID NO: 82369 - DNA, 1709 bp, Heterodera glycines
  misc_feature (79)..(79): n is a, c, g, or t
  Genomic contig location: Contig_ID=SeqID_17837; Location=1..1709; Strand=+
  SCN-specific regions: Sequence locations=1-20,50-192,214-1113,1135 -1213,1240-1381,1403-1621,1643-1709
  Gene Ontology: Mol. function=acyl-CoA dehydrogenase activity; Cellular component=mitochondrial matrix; Biological process=fatty acid beta-oxidation
gaggggagtccttctttaccatttaaaaaaataatttatgtatttttttcgctgacaggccacgtgcagcgggctcgancattttgtgcaaaacgaagtgatcccttcttcgtcccatttcgactcgactggcgaggttataccacataattttcgtgccctcaaaaaaaaattggaaaatatttaaaaaagggtgttttttggattttcttaaaaaccaaaaaaaaagggggaggggactctttgattagcagttttttttttgtcataataagtcgttataattaattccattgggttttctgagccgctacgaatctgacgcccatggaccgattcctaacccgaattcgaacaaagggccgaacaaataaactattcataatttagtgttttggttcgaattcggttaaggaattctgaatggcggtaatggaggctctactgcagaattaagcatccaatcaggatggtcattgattggacgcgtaaacggcaatagagccgaaatggggttcagatcttcaggttcttgaccagccccgcaaagcccccgggaaacggtttattatgacgaaaaaatttgcaattccatagtatttgccccctttggtttttaatagcattcaaaaaatgccttaccaaaattttgactcccaacttggcacttttgccctgttcatacagttcggcactttttccaatttgatgcttttctttagttcccctggccgtgggtgcgccgtgcccatgcgcttgggttgatgaacaccggcatcccccctgaacacggcggcattgggctaccactgacggtcaaagttggcattttcgagaccatcgcttacggcgacattggccttgggtgtgttttatatgtgtggctttgacatttcgttgtgtttaattgtgttattttagtacaactttgatggtcagtgaactgtctcaacagcctctgctggtaaacattaagaaaatgaattttctgttttaatgtaatcggaattttccccgtttttcagtacgccggcactttggagcaaaaacaaaaatttctactcccaatgttgggaaatccgtttttggcagtgcgttttaacataagggataattaaatatttgtaaaattgttttttatcttaattttgttcaaatttttagtaatttcccggggggcggacacctttttcaactttggccccaaattccgtttttattattattattttttaatttccagtcttttgcggtcactgagcccgaggcgggctccgacgtgtccaatgtgtcgacgagcgccgagccgagtgaggacggcacattttatgtgctgaacggtgccaagaaatggatcaccaattgtggcgttgcgcaatggttacatttttaaatgaaatttaattgtaaaaacaaagtcaaaaaattatgaccgatttttgtcccccccccccacccttaaattttgattttttttttttgccattttttatcctaaaatctgaccaaaattttctcgtttttttatcggggatttaattccgttagtttattgataaatatttaaattgccaagtgcaaattcgtcctccctttttcggttcttcgtgttggcgcgtacggcggccgacccggcgacgccggccaaagacgcgttcaccggtttcatcgtggaaagggacacgccggggctaaccgtgggagaaaag

SEQ ID NO: 82370 - DNA, 1833 bp, Heterodera glycines
  Genomic contig location: Contig_ID=SeqID_17838; Location=54..1886; Strand=-
  SCN-specific regions: Sequence locations=1-172,199-304,326-349,445 -547,569-687,726-801,822-1280,1306-1371,1393-1708,1730-1833
atgcaaaatgattttgtggccaatcttcatcaaaatggcattgcctttttggcagattatgccgcactttggctgctggggttggacatgctgccaatgtataacaaacaacaacagcaggaaatgaagctgttcataagccaaagttgcagctgcaccatggaagcatgggtaattaattaattgattaattaattaccgatatttaatgaattaatattgaaaattaacattgttctgatttttatgtatacatactttttcctaaattccaagtaattttatttaaattttacatatttccaactttttgatatatattttcgtagtttttttttacattttttcgttttatatatataaattaagataaaaaaaaaatttttgaaaattctcaaaaaattaaaagttaaaattctacacataaataaattttttatatttgtttcatttgatcacatttatatttcagtttgttcaatcgtctgattccgttgggccattctttccgaaaatgccatccgccggttcggcatcttctccacccaaattaactgataaaatatttccaatcaatttaacaaataacggtgaacagaagcagataatcaaaatcaaaggcttaactgatgccaacatcagaagcattttggtggaacttttaagtgccaaaaaaggtaaacaatcaaaaaataattaaagaataaaaaatagaaattaatttaggtagtgagacgaaaacggaagcgagatttataattgggacggacagcgatttagaagtcactttaccaagggtacttaattaattaattaattaaatttaatgcaataaatattatttcatttagttgtcaaaatcaattcgaagtaaaggcgtaagattggcaactggtatttacgtgctaaacttggacattgtgctgaccaagcgttgctatctgctcagaatgaacggcactcagttgggcagaccaatttgtccattggaaggcaatttgccattggaggaaatcagtgggataaaggtgaaacgggtggacgagagtgggagttatcgtggtcaaataggtcggggccagggattgggtttgatcattgtgttaaaattatttaacgaataagtaaaattgtttctctatttttttgttagctttttctatggagaatatttatatgattgttcggcggtgccagaggcgccgccgggaaaatttttgaaaatttagttttggtatgtttacaaattttcacaaaaattgacattttttaggttaaactttgaaaacattaagaatttctaatatatttgatatctttcctctttaggtgcaaggacaaatgttgcttcttggagatcctcaagtgaacgaaaatgatgataaaataaaattcactcaagaagaggtagatctaatattatatccatccctaatggaataattaaaaaaaacatttaatttaggcgcccgaaatacgtttcgattggtgggctttgccgaagggaagtgcgccgttggactgtgctcgtctgtttgccaatgacgcaaaatacattagccagatggtaagacgacgcatttgtcgtgaggaagatcctactgaaaatgacttggatatgtcctgcacggctattcaaagcagaaaccgattttggcacggtgccaaggatgaccaacaaggggagcagaatgagaaggagcatgccaattacccaatggcacaaattcgaacagtgtacaaggcaagaaatgggataactgttggatttaaatattcaaatggcctgaacccattcggccattggttcgaaaaagattcaattttctatgg

SEQ ID NO: 82371 - DNA, 891 bp, Heterodera glycines
  Genomic contig location: Contig_ID=SeqID_2928; Location=413..1303; Strand=-
  SCN-specific regions: Sequence locations=1-212,234-649,688-692,714 -823,846-869
atgacgttgtttttacggcacactgggcacccatatggtattttataatatatttccgcttaaattaaatcggttaagacatttgctctttttccatgccgcctctccaaccggtttcaaattttcccacagtcttatattttgaatgcgttttcggtgaccaagggtgattttttgtattttaagcgatgaaatttttatataaagatcgtttttaattactagaaaaaataatatctctaatgtagccatcattaattaatgtgtatttttattaagaacctttggaattggactcaattcgaaaaatctaaaaaaaagtgaatttattggttggtccgaaggaatagggtttgatagcgatggagacatcgtcggtatgtttttttaattttattcaaacatatatttaaaggtttggaattatttgggggaccggcgacaattagaacgtgggggtatgccgaaggggacgttgttggagttggtttaaatcgttcgaacttccaaacgtttttcacgttaaacggaacacttataggtatgataaaccgatgaaaagtattttcaataaatttgggttttgcgattttgatataatttaaatttctatgagggaaaaatataacttaaaatcagtcttctttagtaataatattttaattttgtcttttttaaattaattttccacattatgtatatttattatttttaagaagactgtgcgtgcaaagtaacgcccgacatgacggttcctgtcgtttcattacggggtgctcagactaccgctaagatttttcgtggagcaccatatatctttgaatttgaaaatttatatatttaatcacaaagtgcgtagccatccgatcacttgaaaattttttaaataaa

SEQ ID NO: 82372 - DNA, 2133 bp, Heterodera glycines
  Genomic contig location: Contig_ID=SeqID_2928; Location=1689..3821; Strand=-
  SCN-specific regions: Sequence locations=1-397,419-541,578-871,896 -937,959-1039,1061-1121,1143-1315,1337-1687,1717-1854,1876-2133
atgaattctgaaaaatcagaaaaagctaataccattttggtggaagctgcaaaaaaagagacagagagagcctggagggatgtagcggcgttagcagaagaagttggtgattttgccaaatcttctcgggaaacgcttaatcgtgcaataaaatctagggaaaaagctccttatgctaatggggttcgggaattgtatcttaaaatgtcagattcaatttgggaaattttcaaaatcatggaccaaatcaatttggagtcagtaaaggcggaatctgcgtggcgtgagttcgaaagattgaaaacttttgaccaggcaacaaagttcgaagaactatcgcaaaattcattagtggaagcccgaagattacatttcgagtcccggagggtgcagagccaaatgttaaattatgaaaataggctccaaacaattgtttgggagcatatgggtatataagaacgaaaaaactaaaagggccacactcaaaatggatgggtgtttgataattgattcattttgtcatgaggacttaaaatttggctttaaaaaatataaatctaaattttattttaaaaatcctttcataattaatgccgaggaaaattttaaagatatcctcgcatccataatcgaagaaatttataaaaaggaacagggaaaattcaaaagtattctgaagatttctttcggctttgaatcgttttattgccctcttagatgccctagcgaaaacacagccgaggctttgttccaaaacatcttattaaaagaagaacaatattcacttttttatcctttggatgatgtcataacactagaagtaacaacaatcccagatgacaacaatagaccaagaaattgaatttattaagaaaaatgttacaaaaaattggaaatttgccggaaaaatacttaaacgatcaaataatcttgaaatttttgcaaataaactttttaaacgggtgaaaattttctacatagcggcatttagtgcccccgaaatcgaaaatttatacttttcattcttagaaattctcgaaaaaattcaaaaattacctagacttactatgcatgagtatggaaaccaggccttagctatgcaaaaattgaacattggactcaaagaaataaatatatttaaatgtcaagaagcagagaatttatcggacctttctttttcaaagataaatgaattccgaaaacaagtgcaaaattatcgatttgacacaaaaatgttgtataataaaattaggataactgctctaacacatttgtttagacccgaaaaagaaattttttttagtccttttcaaatagaaagaaatcgagaaatttattattcgttatttcggcatatctaataaaatcgcaacttcctttgcaaaaaaaaaacattttctttaccaatagaatcgcatgattttttgtaatatttgagcgttaattgcacaaaagaccaaaaagttttgcaagtttgaaggccattccctaattttatttgccgaatttggactaaattagtgtttcgtcacacattacaatccaaatagtttgagtatttaagaagataaaaatacgcataactcatctgccgtttttcaacttttcaatgggtatgggttccaaaacagaagttgcatggggagggggggggggggggttaacttcgacttattctagctcttacatttaaaaatatgtaataaaatattatttcagatgtacgcccaacaaaacgacatgcaaatttcagcacaaggtgaggatgtgttgcaactgaccgccgaagattttgccgcaatggatgaggcggagagacaatggcaggctgaacagcgacgccgacgcgagcaacagaggcgggacgcggaggaaagacggcaagtgaggggcgactggcacagtgacatgttgaggcggcaacatgtttgggagcaacaaaaagaggaacgagaaatcgacagagagcgatgggagcaaagaatggaggacgaaggaagaaaatgtgaagagagaagcgaggcaacccgaaagaaagagaaagaagaaaaagacaagaatgatgttaccgatcattactctttcaaatggggagaatggagaaaaaaggaaaaattattttttggaaaataa

SEQ ID NO: 82373 - DNA, 478 bp, Heterodera glycines
  Genomic contig location: Contig_ID=SeqID_2929; Location=1310..1787; Strand=-
  SCN-specific regions: Sequence locations=1-321,343-449
atgcaaacaatcgctgaaattaaaaatttcgagattattgaaggcggaagagtttttattgtgagagcgagaattgagaacgtagtacatgcggagtacagggtttgtattaaaaatgaaaaaaatatatcagtttttaaggcttgcgttttatgccgtaagggggcgtgttcatgtggtgttgagaaggcactgacaccttatttcaaggtgtccgtaacggatgatacaggagttttggaaaatgtggcgtttttcggtgtgcgggggaaaaaaaatggaatggtaatattttaagggaaaaaaccgtacaaatttaaatttaggaggagttgaaaggtttgtctggggccgtgtgtacaatgaaaatcggggcgagggtgaaagaattcggaggaaagaaggggatatattactctttgatcgatattgtcagtctttaaatctataaatacgcttgttaatttttattaataaa

SEQ ID NO: 82374 - DNA, 917 bp, Heterodera glycines
  Genomic contig location: Contig_ID=SeqID_2929; Location=1950..2866; Strand=-
  SCN-specific regions: Sequence locations=1-30,52-358,381-917
atgagccgagaagctgagccgggctggaaaattgagaaaatttcagtggacctttattgcagtgccctgtcagaccccgtgatcatccctgcccgccccttccaacactcgaacccagacattgttttcaacgagttcatgcacagacagcaatcatttggggaagtgaatttgttagaccagagaatttcaataattattggcacttattctttccctgttaaataaaattttttcattttttccctttcattattttttgtttattacaataattatttattcgaccttttttctttattaatttttcagttaaaatgtactcgtttcaaaaatattttgaggaggctctcgaaaaagaagattttttctggcagaaaaacagagcagaagtggaggcattgttaattgaggcttcaaattataaaattataatacacagggactacgaaagccgctattctgattatattgccacctatcaccgcaccccacttttctgtttctgcatgattgagagaaatttaagatttttttacgacacaggaaccgggacggctataggaagggttacaaccgtgctacatgttaccgttgaggcgagctatacaggagagggattcatttcgcctatgttttccttttggttttattgggagggcaggagtcaaacaacaaacgaatctttcacgagccgtctttatttgtacactgtttcgatgctaagagcaatgggcaaagcctggggcagagaactacttttgaaccctgttgaagttttaattgatatgttctaccaacgtatagataggttggaacatagaaaaaacaatttaaaaaaatattttagagatttggtcggatcgtggtcattgttctatagactcccaccctcactttttgacacttcacgccgg

SEQ ID NO: 82375 - DNA, 1858 bp, Heterodera glycines
  Genomic contig location: Contig_ID=SeqID_2929; Location=2975..4832; Strand=-
  SCN-specific regions: Sequence locations=1-191,213-665,687-1045,1067 -1145,1188-1645,1704-1776,1798-1858
gagtgtgacgtgaaggaggaattgaagaagaataaggagatgaaaaagttttttgaaagtgtgccggacaagggaccaattaatccgagggatgcttatgccgggggaagaacgatgcccttttgtttgtacgcaaaggctaccgaagaagttgagatatcaatgtttgatatcattagtttgtatccctttgttaattatggtaaaaatgtgcttgctttttttgctaatttccttcgcttaagacaccccataccccgttggagtcccgaaaattgtagtgagcaggaattttaatgtgaattggacaacacccgacgacgtaccttatgatggactgttgaaagtgaaagtaatccccccgaaaaatcttttgtaccccctcctccccgtgcacatcgatgaaatgctcctcttccctaattgttggtcttgtgcgagaagggccaagaatgaatttgtgatgacaaaagatgtgaaaaaatgtaaccatcgtcccacgcagagagcatttttggggacattcacatcaattgagttgcggaaggctttagagctaggatataggattgtgggattctatcgagcgtatcattttgaacagtttgacagtcaactgttcaaaggatatgtgcggatgtttttgaagataaaggtggaagcgtcggggtggccggcggaggtgaaaagtgaagatgaaaaaagagcattcatcgaaatgtacaaggcaaagtatgacatcggtttggattatgataagattgggtttaatcccggactaagaatgattgcaaaattggtgagaaattataaaaaatctctaaaaaatgttcgaatttaagggattaaacagtttgtggggaaaattttcgatgcgcaacaccctttcaagtacggaaattgtgggcagtatggaacgttggatggaattggggagagacaatacaattgagtttgggcgcccagtaaaaataagcgaagagatatcaagagttgtgtaccggaaaaaggaggagttcatcagggagcataaagtgtcgaatattgttttgtcattgtggaccacgagtgctgcgaggctaaagctgtacgagtacatggagcaggtctacaagaaggaggggtgtaaactgctctattgtgacacaggtgaaaaggaataaaaagaaaataaacaccaaaaatttagattctctagcttttgctcatcggaaggggcgctgtccgttggtggaggggaaatttttggggtagaacataatttttgaaacgcatttaaattgcggttttaagggagatgactcgagagtatgccgacagcgaaattttggagtttgtgtccgcgggtccgaagcagtacgccttgaaactcagaagaaagaaggatggcgtgatttggcacaaaaccaaaatcagagggatgacattggatagacgaaacgaatttaaatatgatttgttcaaagagatggtgctggattacaagaaaggggtcaaaaaagtttttcactacccggagaagatcgggccgacaaacgacttccgggttctctcaaaagatgtacaaaaagaatatacgccggtgcagaaaaaaggaattatcgacgatcattttaatgttttgccctttggatattattaagagatttaaaaattttgtgttttttgtattaatgtttataacatttaatatttaaattaatcatattcttttcctattttttagatgtcaaagaaaaacttccaagaaacttcaaaagaagtccgccgctcgaaaaataccaaaaattatttcaagaatagtcctaatttggaaaaatgtttcgaagaagtggagagtcacacaaacgaaaataaa

SEQ ID NO: 82376 - DNA, 1208 bp, Heterodera glycines
  Genomic contig location: Contig_ID=SeqID_17842; Location=373..1580; Strand=-
  SCN-specific regions: Sequence locations=1-625,654-1088,1111-1208
atggtcttgacacgcaaaaaaagcgaaaatttaaagaatatgagcaactcagggtgttgaagcaagacgaaagcggaaggaatggcgctgggcttgctcaaaaaggcggctcgacgccaaaaagtgacgaaaattaaacaaattaattttattttagaaacactgaatttttcagggctaaagcagaccgatgccgcgccaacagcagatggagagggtacatcgacccaagccgccgaaagtgcgtgtccgtccaaaaactaccaattggacaaacagctgaaggaacaggaacaagcgatcagctttcttcgactgcaggtccgcaacagagacgcaatgatcgctgagctgcgccgtcaattggaacaacaggcgccgaaggaccagccgacaagtaaatttgcagacttttagaaccattatcatccaaaatattcttagcatctacacggcgcaaaaagaatgcggctacattggagcggacctcgcggcgaaatttggcagagaaaatcgctgatgtgatcgatcgagatcgctctcgatcagtgagccgatgttcgctgcaaactctatttgtcaaacccttggaaaattggtttacaaaagtgcatttttatttgggtttttttaaaatcaaaaaataaatttaaggcccagccattgtcgccacgggatttggacgaattggaaacgtcgattgatcaatttcggacatttctcgacgatcagccacggatgcgcactttgctcgccttaaaaccaaaggtccacttggtgttgaaccattttgtgccgttcgccagacagcacaaatttttggcacttttggacgagcagggtcagggtcacaaagcctttgaaatttaagccctaaattttttttaggtgatgaagcattgcattcagtgtggaggcggttggaacagctttggaagacaatgcccgacgaagaacaaatgcgtcaattgttggagcaccactttgtctcaaattggcttctcgacacaggaaaaattgacgaaatgaagcgggtcagtttggtgcaaattgggttccaaatcaaattcccatgcttaaggaccgtgaagaacaacaggaagaaatcggaggccgggagagcgacgaagaaagcgatggagaagaacaattcgattttgaataacagttggataaaaggttttttctttgtttttccaggaaataaa

SEQ ID NO: 82377 - DNA, 2238 bp, Heterodera glycines
  Genomic contig location: Contig_ID=SeqID_17843; Location=83..2320; Strand=+
  SCN-specific regions: Sequence locations=1-197,226-406,428-911,934 -1034,1057-1083,1105-1310,1342-1545,1567-1791,1814-1899,1921 -2060,2082-2238
atgaaatgcattggggaaaaggccttgggctgtttcatctcgcctgaattggccaaagatgcgaacaaaatggccaaggtcttttcataaacttttttcaattaatttttgttttattttacttttagattgccgaaaaccgtgacaaggctttgacagactctccaaatggaccaaatgtattacctatttccctcaatttttaattattattattttaaaattcggtttaggatcgtgttgaactctttgccaatgcgaatctctcttcacgtcctgttgctgactcggcaaaaaagagagatgcgtccacgtcgcggctcaaccaaacaatcaactcaactgtggacgatccaaatgcgacaaaaagggctcggtctgctagcgggtaaatgaaaaatcgtacaattttcatttttgctctttattttttagccgtcgtcgttcggttgctgtcctccccaacaattcaatgctcaatgacaacaccgatgagggcaatccgcgtgccccgcgccggtcacattttgttggcagtggtggactttcctcagccgtttcgtactcatccaacttgaacaccacgatgacacttcaatcgcaaaatgttgctggcaaattccaattggacccaaaatttttccaaaacgactttgatgacaatacattgttagccggaaacaacagaggagaaagggaattgacaaacaccacgcaaacgctgctgttggacaaaacattcaaagtgtccactccaaaagtgggcgacaaacacaacaacaacacaaacgcggcacaatcaatggatcaggcatcttctgttgatctacaaccaattgtaatttcgttaaaaatactctgtttttatttagccctctgagaatattgggttgtctcataggtattgagtgtcaaacaaatgaaaattttccaaaatattaaaaaaaaatcaaatttttggatgtatgatctgattcagaataatgagatgaagccatctaataaaaaagaaatgagaaaaccatagcccactctttacgcattaaaatgctattactaaaattgtcaacaaatgcaataactaaccaatttttataataccaagaatttgtgacccgttccccatgagaattggttgaatgttttccgattttttcagaaaccagttgtgcgcccaaccagcactttttcgcgtcgtagtgagtcagtgtcttcaatttcttcgctggaaagtgcggaacacattgaccgaactgtgcacaacatttcctgtcttcagcttaacattgccgaggaggcgttagcccaggtaaaatttaaaaaaaaaaaatttttttttttgggattttgcaaatttgactgcgccctttcagttacttcatctgatgaacgaccagacaacacggcagtatattattgacagaaccgaactcattcttaagacggtctttcattttttcaaaaagtgggaattttattttatttttttagatggtcacgcaaatctttcacattcgaagccaacatcttgaacaattggacggagtgaaggaaggggaccaaaaagagcaggagcttagtgaatttatgcgttccatttgcaactttcttagcactgttagtgaaatgccatcaaacggatttcataacaatgccactaattcaatcccttttagctgactaacgaaatgaccattatgcaacggataagtacggacactttgcgttcattcattgattcacttctttcgttggtcagcgatcagcgtcttaaaatacttaacaaacaggtgattttttaaaattgatttggcttttttttaatgtttcaatcattttttataggtattccgttctctcaacattattgtgattcgactgtgcgaattcacaaatccgaatgtgtgttttgtggcgctgatgaaattggtcatgaaataccaggcctctgatcctggcggtcaattgtcatcgttggtccgcaaatgtctcaccaaattcactgacgcaattgttgagccgaccaggattgaaaaagtttattaaatagtttttttttgtaaacaaaagttttctttttaggttgacattctgactgtgctgcacccaatccacgagtattattcgcgtttttatgttgccgatggacaaaccaaccaaatttctgacacagtgaaggacacgtccaaattgttgtgcatttttttacagcgtttggtcatcaaccaaaaatatgcg

SEQ ID NO: 82378 - DNA, 522 bp, Heterodera glycines
  Genomic contig location: Contig_ID=SeqID_17844; Location=1245..1766; Strand=-
  SCN-specific regions: Sequence locations=1-73,97-522
atggaggacatccgttttgagaaattgaagtaagcaaatgatgttgtgttgcacttaatactgtcatattcaaataaaattttgtttttcccccatttaattccgtatttttttcagcggtacgctgtccaattgggtgttggagcgcgactttgacaaatgcattcgtcccggcgtgttgagcaaaggcggcgccgtgtcggacgttgtgcacatcgccaagcatttgggggtacgtcacttttcgccttttggcacggattgtgtggcgccgccggcggtgaatacgtcaacgatcaaatccgagctgacgacgtcactttcgcccgcgggcggcggctcttcgccgtcgatcaaagaggagggaaataatgggaaacagcagcagatgacccgttttgaatgtgcttatcttgtaatgaacagccaaccgagcacactgttcgcttgaaatcatttaattcataaataagatgcttaatattaaatatatattgtcgtgtttgtcatttagagaataaa

SEQ ID NO: 82379 - DNA, 844 bp, Heterodera glycines
  Genomic contig location: Contig_ID=SeqID_17846; Location=685..1528; Strand=+
  SCN-specific regions: Sequence locations=1-182,204-204,238-495,547 -560,582-644,667-844
atggccagaagattttatggagttcgcgtgcaattcgctttggaacgtcgttcccgtggtgactactctcatttcgcgccccaacgaacggcccaacacttacgcgagtcctgaacacaaaaacgcatgcgtagaaacagaatctagtttggtcacaataaaggaccttcgcgtgaaaaagatggtgagtgattaaaaacaaacatttatataaaatatttatattaagtaaaataagcactttatttgtttttgatttccacaaaaaatttcactgctatatatttatgctccgcttgagaaaatttccctagtcccagggttgccattcgtccttagattccagagaagtctttgactctgggcgtcgtgtcttggaaaaacttatttttaaattttctaaaatcaaataaactaaaaattctttaacttcgaataataaaaacaagttgtttgtagtcgaataaatggctttgcttttgtataaaaatgttgaaataattgtttttttacaaattttatttattttttcttttcaaaatttttcggtcaaaattagttaaaatctcatttaaaaacaaaaattactccggcggtgcctgccggcaacctcggactttttcggtaaacatcctaattatctcaaaaattctttaaaatttaaaacttttaagttatacctgtttacaagtccacattaagattccaaaaatttaacgcagcgcttgtcggcactgctggttcatttttggggcatgctttgaaatgacaatttttttcaaaatgccttttgaaaacaaactcgggagatggcacattagcctagtccatttatttgactata

SEQ ID NO: 82380 - DNA, 1581 bp, Heterodera glycines
  Genomic contig location: Contig_ID=SeqID_17848; Location=85..1665; Strand=-
  SCN-specific regions: Sequence locations=1-51,75-114,145-306,330 -408,431-507,530-564,586-1581
  Gene Ontology: Mol. function=heterotrimeric G-protein GTPase activity; Cellular component=heterotrimeric G-protein complex; Biological process=G-protein coupled receptor protein signaling pathway
atggcacttttcctcccgttcgttcagttcttccccaatgggcacgccttcgccaccggctccgacgacgccacgtgccgactgttcgacatccgcgctgaccaggagttggccatgtactcgcacgacaacatcatctgcggtgggccttttttggtcattcttttccaattaatcagtgaccgttccttaggcgttacaagtgttgccttttccaagtcgggccgtttgctgttcgtcgggtgcgacgactttaattgcaatttgtgggactcaatgcgcgttgaaaggacgggtgagtgattcattttacaattaaatataatttaccaccccccattttaggaataatttccggccacgacaaccgaatttcgtgtttgggggtgcccaacgatggaactgcgctgtgcactggctcatgggacagtctgttgaaggtatggaactgactcttctgttgtgctgttgctggtgtactgctcgaagtcgtgtgtatctcacattacattttattttgaatattttaacatttcgccttttcttcaatatttatgcctaatgtaaacaataaaatgattgtgttgagtatttacatttccaattccttctcaaattgggctttttcttggctttgtctccttttatgttcttcccttctccgtccttttgttgtcattttcgctgacatattccatcatctttttgaccattgtgaacacttctttccctatactgttttcgtctgtttattccgttcagttcgcttaccacttggctcaatctgtccgggtgggatggcaaacccgtgaatttcactgaaattttgtgggaattaaaatttatttgcatatgagtgccattcttccgaaatggtatatgtatgtaaatcaaacctttctacgtcttccggcctcagttccacgccgtaaatgtaagggacgccgcgatactttggttgaatgagttaattgttgggtttacaattgataaaagcacctgccaatagtcaatgcttgtacccgaggcaggataaagcaaatctgcgatggtgccgaaagtgtattctgtgccggtggcctcgcgaattgagtcgatgaccaacgaggccaacttttgctgatggtttgatcagttcgtttttggaatgccaaaacaacaaattctcgagttttccacctgttcccagtgatttgacggcttcacgttggaaaagccccacggggacagcaccaattggccgtaactgtgcagcgaaatgtacgccaccagccgactcagttccgggctcagcaggtccctcaccgcacgcacttcgggttcgctgaacggcgcccggcccgggtaaatgttggagcatgggcttcgggaggcgccggtctctgcaaaagtggcaaatgccaaagtcagaaatatggggccgaaaattgtgttcgatggcgtggcgaccccacctgcccagcggtagccccagttgcgattggcgtccgcaccgacgcaccatttgtgcagcgagtcgttgcgggagcgcgtcttgcgccacaggcggtccctgctcatggagaaggcgtacccgtccgg

SEQ ID NO: 82381 - DNA, 1839 bp, Heterodera glycines; identical to SEQ ID NO: 17848
  misc_feature (1755)..(1755): n is a, c, g, or t
  Genomic contig location: Contig_ID=SeqID_17848; Location=1..1839; Strand=+
  SCN-specific regions: Sequence locations=1-1080,1102-1136,1159 -1235,1258-1336,1360-1521,1552-1591,1615-1839
  Gene Ontology: Mol. function=carboxypeptidase A activity; Cellular component=extracellular space; Biological process=histone acetylation

SEQ ID NO: 82382 - DNA, 928 bp, Heterodera glycines
  Genomic contig location: Contig_ID=SeqID_17849; Location=408..1335; Strand=-
  SCN-specific regions: Sequence locations=1-37,60-660,682-861
atggtccgctcaatgcttcgtccatcgatttttgccttgctgctgctggtgtgcctgctcagcgttttgccgaaacccgggcatggtaagtgaatacagtaacagaaattttcaagtgattttagactcgatattattcggtagctctaggaggtctctgtagcctgaaaaaattcgaaaagttttattaagtttgaacaaagttatggccaaaagtacacaagcacaaccaggttttcgaatttgaaacttgacgaaattttttgaaatttgcaggctaatagaacatttatggctatcgaataatagcaagaaaataaaaaataaaatgaatttttgactaacattttttacttagaataaacaataaattttaattaaagctttcttagaaccaacaaaactacgtgatcttgtgttttctaatccatcaaaatttcaaaaaatttcgtttagtttcaaaaaagtcatggccaaaaatttttgaaaaggtttcatgtgtgtgcttctgcccataactttgttcaaacttaaaacgaaatttttgaatttttcaggctaataaagaactcttagagctatcgaatgataccaagaattaaaaatttagttgtttttgagcaaaattatgtgaagttttttgttgaaaattttcatttggtatttattttataacgctctctttgatggattttttttttataacgacaaagcacttttttttcaaattccacattaagcaactaggtgcaaatatctcgttgaatcggaattaatgataagaaaaccgcgagacagggattgcaacaatgaagagaaatgtttcgcgcagttctgttcaacgcaaaatggtaagatgaaaataattataattataataataacactaaaaataacaataataataataatagagataaataataaa

SEQ ID NO: 82383 - DNA, 1279 bp, Heterodera glycines
  Genomic contig location: Contig_ID=SeqID_17849; Location=2129..3407; Strand=-
  SCN-specific regions: Sequence locations=1-153,175-228,250-442,464 -503,526-936,959-1279
cggaaacgaagaactcgacgattcgtggggttgggatgagcaaggaggcggagaagaccaacgaagtgaccagaaggagcgcgaggagcatattgatcggaaaggatatgagaagcagactgatcattgtggaaacgaagaactcgacgattcatggggttgggatgagcaaggaggcggagaagaccaacgaagtgatcagaaggtgcgcgagaagcaaactgatcggaaaagacacgaggagcagactgatcatttcggaaacgaagaactagacgattcgtggggttgtaatgagcaagaaggcggagaagaccaacgaagtgaccagaaagagcgcgaggagcagactgagattgagcagaagcaggagaagcgctttgatcaatacgaagaggcggccgcatcggaaccgaaaaaaacgatattcgacaacttggtgggttaaaaattttcaaacttacttggtaataaaagtcgggtccatttgtaaaataatttatattcattcattcgctttaaggttgactgggcatggggagacaaataaatttgttgtgaagtgccgacgaaaaatcgaagaaatttccatggattatgaatgagtagcgcattattaattgttgtacgacttttaacctatattccacgaccaccgttctgtcttttattgtgattgattcattctaagttaatgggtaaaatttcaaattacagtatgtacgttgattaaacccctaaaggaatcttccttttttgaccggaacattttgattataataccaatcgtcatatttcattgattagaccaaccgtaattagggcttattgtccccgtaggctaatcatctttttttaaactataaatttgtataaatcgaccgccctcctttctgtaaattaccgttaaaaatgggtcattggaaaatatggcagttattaacagaatttgtttaaaaacgataatgtaatagggtacttttccgtaatgccgctcaccataaaaatgtcataattccgacaagagaaagcacttttctagggttgttttaggcgctaatcaagaatctggcgtcaaaactgcataaatctgtgcttttatatatgttatcatcatatgattttgtcgatgattttttaaatcgtataattaagggaactaaaagcatttgagagagtaatctattcctgtcgacgagtggaatagattggtactagtttcagggttctagcccaacaaattttatgctggggtggggcggaccacttttcaaataaa

SEQ ID NO: 82384 - DNA, 1605 bp, Heterodera glycines
  Genomic contig location: Contig_ID=SeqID_17850; Location=547..2151; Strand=+
  SCN-specific regions: Sequence locations=1-30,53-139,161-826,857 -895,917-984,1014-1190,1213-1339,1366-1489,1514-1605
atgggcaagactgtagagaaaattttatcgaaaatttattataatttaaaatctccggcaagtttcgctgggattcaaaaaattttaattgaggcgaaaaagattgacccgaaaattacgaccgatgacgtaaataaattcctagaaaaacagagaacatacacgattcacaagcccataaggaaaagattcccgagactgaagacaataccgagtggcttccacaccgattggcagtgtgatttatgcatttttgatcagttgaaaaagcataacgacggttacaagtatttattggtctgcatcgacgtgctgagtcgaatgatctttagtgcaccagccaagtcaaagaagagtgaggacatgatcgaagcttttgatcgggttttcgaaaagtcgaaaattatcccgatgaagatatatagtgacagcggactcgaatttcaggcgggaaaaatgaaaaattattttgagggaaaattcatcatcaaaaatgtaatgtatagccccgacctccacgccggcgttgttgaaagggcaaatcgaacaataaaagagcgcttgtacagatactttacaaaaatggacactctacgatgggtcgatgtaatagataaaataattacaaacattaacaacagtgtaaataggacactgggggtcaagccgtcttcaattacttttgaaaatgccggaaatatttgggataagttatttggaaatttggaaacagaaaaaaagaataaatttaaaattggtgatttagtccgaattacaaaagaaaagggtatatttgcaaagggttatcttccgaattttacggaagaaatttttaaaatttataaaataattaaatcagacccaatcgcttatagaattgaagatttaaatggagataacattaagggaatattttatgatgccgagttggtaagagtttcgaaaaatcaaataaataaaatataaaagaactttgacaaaagcaaaaaataaataatgaataaaataattttcttcgtagtttttggtttggcaatcggccaaataaatagcgattgttgttgcctatctaatgaagagaaacaacaattaaattctgctagaaaaaccattgaaaaatgttttcgggatacattccgattaaataacgaagcccgagattttgctgctgcttctcatagggcaattacggaggcagaaaaaattaaagttcgtcatcctgaggcaccgggtatgaaaacgtggttcggtaggttattagaaggggtgagaaaggtacagagtatttcagttaaaattaatgaagaaaaacagaaaattggtcataagatggacaagtgtttggacagaaaagatgtgttaatgtgtcgtgaattggctgacgaagcaaaggggacctttgaaattgttaaacagtatagaaaggacgtcggtactgcgtaccgtaacgcctatactcaatctgacctcgggattggggaattggccgataaagttaaggaaacaatgaaggaatatttatcccgccccggaccttccccaagaccaacatttaaagaccaatttatatctgattaatgtataaaagagaatggaaagacaata

SEQ ID NO: 82385 - DNA, 79 bp, Heterodera glycines
  Genomic contig location: Contig_ID=SeqID_17851; Location=308..386; Strand=-
  SCN-specific regions: Sequence locations=1-30,52-79
ttttttgactaactcacagaccactaagacgaaaaaaccaacttaattgtacttggagcccaaaattgaatcgccgtgt

SEQ ID NO: 82386 - DNA, 2102 bp, Heterodera glycines
  Genomic contig location: Contig_ID=SeqID_17851; Location=910..3011; Strand=-
  SCN-specific regions: Sequence locations=1-184,206-211,241-251,276 -958,1031-1058,1089-1237,1259-1312,1334-1407,1429-1770,1792-1860,1882- 2014,2053-2102
acgaggcaaatggatcataccagtgtgccattttctgctcacatcgaagtcgcaggcgtcatacattcgtatgtttgagctcctacatcaggcatggccaacatttgctcctacatcgttcacaattgatttcgaattggccgtgagcaatgcggtcacaactgtatttggagggtgtcaaatcaatttttgtttcttccattttgtgcgaaatttgcaaaagaaattgaaggaacaaaatttgtggcaggttttaataattttttttttaattagctgtttcagcgctactgcaccgattctgtgtttgccgagaacgctcgaatgatcacgtctgttgcgttcgtgcccttgtgtgacattagaatggcggtagcggcacttgatacggagttcggaaatttggcggttttccaaccgctgattgactggtgtgtgaactttttttaaaaatttaaaccccactgaaattacaggctattaatcaattacgttggacagcccaggcccaatggcacatggtcacaaccaacttttcgccctgaacaatggaacgtctacacacgcacgcttaatgccgatgcacggaccaacaaccactccgaggcggagcatcatcgtctacagggcgccttcaattgccgacacccgtcgatttttcacttcattgacgtgctacgtcgtgagcagacaaatacgcgtcattcattgccggagaggagccaccaccaaaaaagcgaaagtttttggcgacagatgaacgaattcttaatttggtgcgtctttacgtcccgatgaatgcaggcaacatcgaccatgatcacaattaccaccaaaatcccaatcaatttcacattattttggagtttctccggggaatttctcgcaactatcgaatgaacccgtgattttttgttttattgtccaaattaccttatgaacaacccgtgaatttctgttaatttttacattttttattgttaaaattattgttgaatttatttttaaaatgtttattttacatttttatgctgaaatttaaaaagttgtttttactgtgatttttcatttttctgtacttggggcccaaacgaccctggggcccaaacgaccctggggcccaaaaacgagggcccaaaaacgggggcccaaacgcgggggcccaaaaactggggcccaaacgcccccgactctaataggcactatcaagccacttaaaatcataccaagattatttaattttgctgtgaaatcaaaatgatatagagtcttgcgccaaaatggcctgcgccaaagtggccggttcccacaatatatgtacatttaagcacactagagaccggtaaaaaataatttacgggcgaatttaaaattttccgggagcgtgacctggaatcccgcggggcaaatacgggagttttcagggtcgttgataacaaatttgacatccatttcaacttatttcgagccccggacccgaattcgaacaaagtagaaaatttgaaatttccagcaggagcgggaatcccgtaaaatctcgtagaagtctcggtcccgctggtctaggggctccatctatcaactattccatacatattccgcgacaaaaacattaaaagacatttctccgtcggttaattcaaagacgaatatgaaatgataaattgtgcaaaaatgtttggaagttttccgtgtttgagtcactccgggttggctcccaaccagactccggttccttccccaaaatttattaaattatttgcaaaaataatgttcaaaaatataattgtacatagggaaagaaaagggggctggcgcccattcgacccccaccgaaagttgaaacaaaacgatgtgtgtaaattttatttacaaaaaatttgagcgaaaggaacgaaaagacgacgtggcattcatgctgatcaattggagaggctttactcagctgaatggcctcaaatcatttgcaaaaccatgggacacttggcaaagataaacttttacaaaagtgcttttattttgtctttcttgaaaataaaaataaaatttaaggcccagccactgtcgccacgggatttggacgaattggaaacgtcgattga

SEQ ID NO: 82387 - DNA, 138 bp, Heterodera glycines
  Genomic contig location: Contig_ID=SeqID_17851; Location=2041..2178; Strand=+
  SCN-specific regions: Sequence locations=1-138
atgtaaaaattaacagaaattcacgggttgttcataaggtaatttggacaataaaacaaaaaatcacgggttcattcgatagttgcgagaaattccccggagaaactccaaaataatgtgaaattgattgggattttg

SEQ ID NO: 82388 - DNA, 1721 bp, Heterodera glycines
  Genomic contig location: Contig_ID=SeqID_17852; Location=1229..2949; Strand=+
  SCN-specific regions: Sequence locations=1-146,174-658,680-733,755 -1475,1497-1651,1687-1721
atgtacgagtgcgaacgtccatttgggcgggaccagcttcgtcagatcgccaaatttgtcaaccttttctgtttccatgcgctttggaatgagctgatcggtgggtgccaaggcattcattccccgatttattaaaaaatgctgccatttttcacagattttgaaaaggatttgccttccaaactcttcaacagtgtgtaccgactgctccaaattctgttcaaccgcgactgtcgtcggccgttcaccggcgtgcccaacttttggacggttgacgagctgagccccaaggcgctcattgccgagtttgtcggcggcaccggcttcctcctccccccgctgtccgccgctgtgtcttcttctccagccacaaaacgtgcacacattttgatggacaaaatgccacacgttattccggtactgtatattcaaaaaaacaacattttcaaaacgaacagagaggacgaggcaaggaaaaggaaaagcccgacctttcatattatgccaatccatacaatatttacacaaaaacagctgcgcgaccgaattgtgcttttccgcaaattgatcagacaggacaaagaaagtgtggacacgtccaccaccattatcacggtcgaacggtctcgcctgatcgaagacggtgaacttatcggatatttttaaataaaaacacgaattctgatatggccattttggattttattttctcgtcaattacttactaattaaacatttaatttgatgcttttctcccccattaggctattcgcaattgggcaacctttctctggcagctatcaaagggactgtccgagtgaagttcatcaaccagcaagggctcgacgaagcgggcattgaccaggacggggtgttcaaggagtttttggagctgacgctgaaacgggtgttcgacccggacctgaacctgttcaaggtaacagataccagaattcgttgtcattccattcttgtgcacaatttggcctctagagcaccagtgacaagttgctttatccgtcctccacttcgaccatccacgacaaccatttggaattgttccaatttgttggccgaatgcttgccaaaggtattcggagagtttcgccttttcactaatttgcttttccaatgcaaatttagcggtttatgagggaatttgcgtggatgttcagctagcacctgttttgttggccgccgttctcggcaaacaattgcatccgttcgatgagttggccacgttcgaccccgtgctgtacaagaacctcacctttctgaagcactactccgactcggacgatgttgccgatttggagctgaccttttgtgcacaggacgaattccttgggcgggtgagagacaaatggaggagcgggggcgggccatttggccattaattagcactaattggacttggggttggacaagcgaatggtggttgcagaatgccttaaaaacgaattaaacagtgattttcttccaattaggtaacaaccgtggaactgatcagtggtgggcgtgacatcaaagttgacaacgagaacaagtgagtggagaaattgacggacgaaaaaaatgtcattttatgaaacaaaattggtatcactgatatttgtgtcttgaaaatttgatcccatgaccaatttcccttgctccagggtttcctacatccatctgatggcccaccatcgtgtcgtcaaacagatcagggaccagactaa

SEQ ID NO: 82389 - DNA, 540 bp, Heterodera glycines
  Genomic contig location: Contig_ID=SeqID_17853; Location=1..540; Strand=+
  SCN-specific regions: Sequence locations=1-540
  Gene Ontology: Mol. function=transcription factor activity; Biological process=regulation of transcription, DNA-dependent
agcactttcattgatgcacggcacaagggcaacatttcacgcttcatcaaccatagctgtgagccaaatttgtcactgcaaattgttcgtttgggtcgccaatgtccgtcgttggcgatgttcgcctccagagatatccaatcaggtggcataacccccccccccccccctcatccatttcttcttcattctcttagttatgtttgttcgagagagtggacatttttcgaacacagagagcgaaaatctcgagcaataatccactaattaatttggaataaaatcaatttgaactttctgctgattttgcagcaaaagcaaaacatcttaggccagatttgaccgggatttaattctcgacacctgctggattcaatccaaattttgcctgggttttgatcccgacattaatctcgggaccaacttgtcgggaaaccccgacatgatatggggctctagctacaaaaaatgcaaatttttaaagcattttcaattctttttcttcatcaaaaaggtgaggagctctcgtacagttacggc

SEQ ID NO: 82390 - DNA, 1632 bp, Heterodera glycines
  Genomic contig location: Contig_ID=SeqID_17855; Location=1..1632; Strand=+
  SCN-specific regions: Sequence locations=1-258,281-459,481-623,646 -677,749-757,780-797,819-1107,1152-1351,1394-1632
  Gene Ontology: Mol. function=transposase activity; Biological process= DNA transposition
aagtgaaaaaacagtgattctaagaaatttctaatgctttaacttggttattagtaaaccaaataaaaccattttggtctcattttgaagggaaaattctgaagaacatgtctatcgttttttacatgttaatatcatttttaacctttaaaatgacggtaatttagtagaatgtttgcccttgttaaaaattttttcctactgtcagatttttttgaaattttgcataggccaatattttgagccctctagcgattctttgtttattttatggaacaagtttttaactcgagatcggctcttccgtttttacaacggaaattctccaaaattttttaaattagcgtggtttatggcgttttgtctgtgcgcactttatgtcaaattgataatatgtatatgaataagaaaatttttataataatttcttctaattgagggctgatgagtatgtctgggaaattaaaaattgaaaaaccccgaccccgactcttccaaccccgacaaccccgaattttccaaccccgacgtcggggttgcaaccctattaaataggtacaaaaatcccgaaataggtagaaaaataggtaataaaaattttattaacgattttttaatgggaaaaaagcaaacaaagagggaaaattttgttctacttcttagtaaacgaataatgcaaatatttttaatattttcttagaaaatatttaaattacaaattttgtcaagaaaaaaatatataaattttggggataaattctttaaaaaatttccaattcttaggggtgtcttttttgatattattgctttttgctaatggattttctaaaaactcttaaataggtagcaaaatgccaaataggtataaataggtacctaggtaatatgtagaaaaactcccaaattaggtgagaataggcattataaaggtcatcgtagacaccccaaacaaagtggaaaatgcttttttcttgcttatctgtgcgtataagtgcgcaaaagttttaggtatttacctaaatttcccagccctgctgatgagagtagcagatttatttgcatttaaatgaataatttatttatcacttagcattgtttttcatgatcaaaaaaatttcaattaataaaaattttatgagaatttaattattgggttgatgaaaaagttctgaccctctgaaaaaacaaattatgcaaaaaatgatatttaattctaaagagattgaaaaagggaggcaggcaattgggatgaatcagcggacggttggccatcttcatgaccaaattcgtcgtcctccattttctgcaaaattccgcggcggcgtgctccttctccatgacaatgcacgcccacatgttgcgttctcaacgcaacaaaaaattgagaaacttcgatgggcggttcttcctcatccaccatacagcccagacatcagcccgtgtgactactatctgtttcgatctatggagcacttcttgagagggaaagaatttgctgatcaaaacgaggtcgaaaatgcattggatgacttttttggatcgaaaaatgatcagttttataaaaaggggattgaaatgttgcccgaacgatgggggaggatcattgatcaaaaaggtgagtacatcattgat

SEQ ID NO: 82391 - DNA, 136 bp, Heterodera glycines
  Genomic contig location: Contig_ID=SeqID_2930; Location=462..597; Strand=+
  SCN-specific regions: Sequence locations=1-136
ccccagccgttgccctcgctacgcccttgctccccgaggcaaaaattgcaaaagccaaaccaacgaatcggccttcaaattatttgctggaccgctgaaactcctcatattccctttcacgctcatagcaaaaaaa

SEQ ID NO: 82392 - DNA, 446 bp, Heterodera glycines
  Genomic contig location: Contig_ID=SeqID_2930; Location=2368..2813; Strand=+
  SCN-specific regions: Sequence locations=1-40,63-143,166-197,234 -363,385-411,433-446
gcacgttggccataatttataagggccgagggtcgataaaatttggtatatttttatgtatgaacttggaatatcgaaacaaaaatttattgtttcactgaggcaaacgaaaaaaaaggcaaaaaaaaaaatcggtttgtaaatataaaaaatgaaatattgtgtgtgaaaagagagcatcaacaaatgacggatcgaaaatttcttttataaagattttgacaaaaatgaccatggtcatgaccatagctatgagagtgggaagagaagcaaaaaaaagaatcgacatgccaattcaaagcaaaatttaaaaatttactttttaaaatgtaaattgttatcgcccaccccatattagagaaatcctgaaagaatgaaacaattcatttattgaccattttctttgtattcccaataaattcacttttatgttcgtagctgataga

SEQ ID NO: 82393 - DNA, 351 bp, Heterodera glycines
  Genomic contig location: Contig_ID=SeqID_2930; Location=1170..1520; Strand=+
  SCN-specific regions: Sequence locations=1-86,108-351
atgcactataatagccaagtaacagccggcctttttctctcaatttgtcggcaaaaaccaatactagccgctttttctctccgttcgttggcaaaaagcagccagccggcatttttctccattcttcaaactccggttgctatgtttcgactagctatattactgctgccctgccctttaattttgtgtatggaatggcaagactttatcattgacaaattcggatatcgaagagcgcaaccttggcattgttgcggaatttgtcctgacaataacatctatgacaaaggtcgttgtgttaacgaatctagctacgaaacggaaaccgatcgttatattcgcataaattaa

SEQ ID NO: 82394 - DNA, 971 bp, Heterodera glycines
  Genomic contig location: Contig_ID=SeqID_2930; Location=1750..2720; Strand=-
  SCN-specific regions: Sequence locations=1-120,157-188,211-291,314 -515,537-971
atggggtgggcgataacaatttacattttaaaaagtaaatttttaaattttgctttgaattggcatgtcgattcttttttttgcttctcttcccactctcatagctatggtcatgaccatggtcatttttgtcaaaatctttataaaagaaattttcgatccgtcatttgttgatgctctcttttcacacacaatatttcattttttatatttacaaaccgatttttttttttgccttttttttcgtttgcctcagtgaaacaataaatttttgtttcgatattccaagttcatacataaaaatataccaaattttatcgaccctcggcccttataaattatggccaacgtgcgcaagacgggaatcatttgcaccataagtattgaagaaaatgaatattcactaaggctggccaagaactgtcccttttcagggcccgtttgtcgttctgtagaaatgcttgtccaaatgatcgaaaatggaatggacgtcgcccggatcaacttcagtcaagaggaccaagaagtgagttttttcacttctttgaatttttgagggccatcttttagtaaaataataaaattgcagtatcaccgtgttaccatcaaacatgtgcgtgaagcagctgtcaaatgcgacggaggacgtgaacaatcgtatcgcgtacggcatcaaagagggcaaggagcgcgggttcatccacaacggcgactttgtggtgcttatcaccggatggaaatcgggtcagtgtctttggaatttaaacactcagtaattattgcgcttaattgaatactgattgccccgtttgttctcaggccggctctacaaacacaacccgtttgcaggaaatcaaataatagaaggacgtgtccaatgagcttttgacgattgaaaaaataatatggttatatttttgtgcctttgtttttggcatttgttgttgtattgatatttatttgcaaataaa

SEQ ID NO: 82395 - DNA, 504 bp, Heterodera glycines
  Genomic contig location: Contig_ID=SeqID_2930; Location=4042..4545; Strand=+
  SCN-specific regions: Sequence locations=1-120,142-325,349-460,484-504
atgcacaaaaatggagctttctcttcaactttccacaggttgtaccacgccttttgtgagattgactccgaatgtgaacgaaagcgttccgtgctcagctctctcccgctgatgggagttgttgcttggctggaggagcacacaatcacttttaagtcagtttggattagcaaatgttttttccaaaatgcgccgttaattattatttttgcatcgaattataaaatgcatgaccaaaattctcgcctgtcattagcaagattcatttaatttctttgtgctcctttcaggtccaaaaatgaatttgagttcccttttctggatgttttgggccgaaatctcagaatagaaaggcgaacaatgccgggagaaagagcagacaaatgtgtaacggtaagcccattcatttccttcaagtccattagcattagcatcattagtgtcataattgcatttcagaacagttcgtcctcctcctccaccgtcgccattgaacccgtctga

SEQ ID NO: 82396 - DNA, 778 bp, Heterodera glycines
  Genomic contig location: Contig_ID=SeqID_2931; Location=335..1112; Strand=-
  SCN-specific regions: Sequence locations=1-114,136-217,239-365,387-778
gcctcaagcactgatcacaacgctaagcacagaggtcagttatttatttggtggcgtcagtcagggatggcacggaattccgattcccggaaatttttgggtttcggaatgcctgccttccctggtgctggtgatacgaatggtcatgactttttgtttcactctcgctcttattatcgtcgtccattgttcaggttgcccgttacaatgcggtggcccaacatcagaccatccaacacaccatccaaagtccgctgatgcgggcacggaacgaagtgctccgtttgcttgaacaactgtccgacaaacaatacaatttcgtcgtcgatttgatcattccggtgctcttaatttacaattttagactcgtcatttaacactttttccactttttttttatttaggtcggcgaagtgctcgtccattgccttgacctttcgctgctgaagcaacgctcactgttcgagctgttccccgccattgccaagtcggacacccaccaaatcccatcggcaaatttgactttttcagattttatatggtcgcctattgtcccaacacgcgcagattggcatttggtggcaaaaatggtgccatcattgtgcacgaacttcgcgcatcgaaggcacaagtgaatatcaaaagcacatcatttgaattaggacacactccctcaattttcagacagtgcaggcgcaccgtgcgccgatcacagcgttggcattttcattggacggcaaatatttggccgcctacgcagcgcaagacgcaaaaatca

SEQ ID NO: 82397 - DNA, 3879 bp, Heterodera glycines
  Genomic contig location: Contig_ID=SeqID_2932; Location=1298..5176; Strand=-
  SCN-specific regions: Sequence locations=1-86,109-491,513-910,932 -1211,1233-1440,1462-1877,1899-2036,2070-2281,2304-2422,2451 -2682,2704-2846,2879-3321,3343-3469,3491-3879
ccggtcttctcctgctcgactatgagctctgtgccaccgagtcggaggatggtggtgccaatttcgctgccactgtgccgccgccgccaaacattgagtgtctctcaggcgccggcactgacagcgggcgggcactgctaaacacattgatcagccgacgaattgctgccgcttcttcgccgttgcaccaccacccccatcatcaggacaacggcatcgctgccgatcattgccatccccattttgatggcggcggcgcctttccctccggcctcgtcttcgctgcaagaaatgccgccgcctgtgccaacccaagggcaaccatcggcggtgtggtgcttcgctgctgtcccccacatttttggtccaacaacagtcgttgtacatggacacggccaaactgttggtctccctgttgcatgggtgggaccttgacgaggaggtggacagggcgtgcatgcataatctgaagttgtgccggccgaaactgcccatctgttttggcactatcaccaaaaagggtttgtaatttaacgggtcgaaacaccgaaaaatcaaaatttaaatgccaaaatgttcacaggaaatttgtcactttatacgccccattgttcgggcaaaattgccgcgcttgacgacttttcctacaaatatttctcgcgcagcatccattggcatgaaagtcgtgccctgaccacggtatgggatttcagcgatagttcggcatggcctgccacttacattttgttgttcattaaaggctcatctgttgtcagtcgtggccctgtccaacacacttatgacactcaaaagcaaatccaaccaattggccatcaaaaagccgcctctcaagtgagtagtgctcctcttccaggaggagtctttctacaatttatttcacccacttttcccaccaatttatcccttttttcatcaggcgaacatcgtccatcaaatccaccgactttttgccggaaaatgagtgccaactaatccgacagggctggtccaatgtcgcagcacttcactgtgtgctgctccctgaactgatcagaccgagcgatgcctacgcaacaccgcgcatcgatttgttggcaagaaagtcattttttggggataatggggacggtcggacggaccctaaatttttttaaagccatcaacagtattttaagtcctatcgagacttggatttgatcaataagtccatttttcatcgacagcaagcccaaaatctcacccctctctctttgcaggtggcaagacaattgcattgagataagagacgcagcgcaagcactgctcatccgcgaactgacgcggatgggaggcgatggtggggcctcgtgaactcgttaattcccctgaatttcactggttcaggtcgacgtcggctgatcgagcggtggtccaactttttacccaccgttttggacccgtccatctccatttttgggacccattttggcggtgcagggaccacgtcgcagttgtccacaattacatctggtgctggtgctgctcaccattcccacggcaataacactaacaacattggcactctgcaggacaaccaccaccaacaccatgtcgcttttgttgaggaaaagccgttacctgtgattttgaaaacgacgacgggtcatcagcatcatcacctccaccaccatttgtccgcaaccggctctttttttcaaatggattcgtcggcagcaaactcatccaacagtgttgcgtcgtcgaccgcgagcagtacaacaacagcaaccgccgtcacgaaactggcgccaccgcctcgtcctgctgtgccgccaattccgccgcgaacagtcagctcgggcgctctgccgtcgttgctgcccccctcgtcgatggttggcgctgaatgcggcggcggcggtgcaacaaccgagacagtggtggacaccagcggagttggcaatgacatgccgaacaactgcaggtcctcgccgaggagttcactgaccagcaacaacaaacacaatcagcatcaccagcataaacactttagtgttagccaacaacaacagcagcagcagcagttggctgcttcctcctccctggcgtcgtcatccgtcgcccagtgcaactcctcgtcactctcttcgctggacgacccgtaccaacagtgcgcctcgtccaccgcaattgcaaacaaagtctgtgatcaatttgaagaaataatggaatacaatttgataatacctaatttaattcgttgaaatcttattttaaaaaattctaagatttttttcttgaaaaaagtttgaattttttaaaaattcggcggcaagttttggggttcacccaaaaatgtgaccactccgtcactctctgttctcatcaaaattcaattgtttgcatgaataatccatctctttacagctccaagaggaccaaatgctgttgtgtggtggtgtgcaccaagtgcacaggaatcaggcgaccgccattgtcctcctgggcgccatgggtgccgagtttccgtccgatttgcagcggaacaccgacttgtgccgtgccacggcactgtcattgctcgagctgttgctggtgcccgaatcgccgctacttcccgccaattcgccgctgcgccgggcggccatcgatttgctgggccgaggctttgtgctttggcagccccatttggacctgtcaaaaaccattttgggccttctcaatttggcatccgcagccgccggtgttgacgaagaaaaaaggtcagtgcttttctataaatggtagtgcttacagttcaattgttcaaatattatagtacaacaaatatgggagcagctcgtttcctctccccaagaatttcaaacaaaattataaaattttttataataaaataattcatcataaaatttgaaaatcgccaaagttttaggtatatggggtgtggatgcactcaaaaatatttgaaggtccaatctgtccgcttttcagtgacttttgctgcttcaccacagaagcggatgcgtgcaaaacagcaaggcatgcgctgtcactgatcgctttgtcgaggtgttttcttttttgttaatgcgaaaagcttaattcattttttgattcttattaaggcctcaagcactgatcacaacgctaagcacagaggtcagttatttatttggtggcgtcagtcagggatggcacggaattccgattcccggaaatttttgggtttcggaatgcctgccatccctggtgctggtgatacgaatggtcatgactttttgtttcactctcgctcttattatcgtcgtccattgttcaggttgcccgttacaatgcggtggcccaacatcagaccatccaacacaccatccaaagtccgctgatgcgggcacggaacgaagtgctccgtttgcttgaacaactgtccgacaaacaatacaatttcgtcgtcgatttgatcattccggtgctcttaatttacaattttagactcgtcatttaacactttttccacttttttatttaggtcggcgaagtgctcgtccattgccttgacctttcgctgctgaagcaacgctcactgttcgagctgttccccgccattgccaagtcggacacccaccaaatcccatcggcaaatttgactttttcagattttatatggtcgcctattgtcccaacacgcgcagattggcatttggtggcaaaaatggtgccatcattgtgcacgaacttcgcgcatcgaaagcacaagtgaatatcaaaagcacatcatttgaattaggacacactccctcaattttcagacagtgcaggcgcaccgtgcgccgatcacagcgttggcattttcattggacggcaaatatttggccgcctacgcagcgcaagacgcaaaaatca

SEQ ID NO: 82398 - DNA, 598 bp, Heterodera glycines
  Genomic contig location: Contig_ID=SeqID_17856; Location=2..599; Strand=+
  SCN-specific regions: Sequence locations=1-63,85-421,444-569,592-598
atgggtgcttctttagatttgtgtgtctgcggtagggtcgaaacacgctttattttcttagttttttgttttctttatggaagagcaccgaacatgaggaggaccactcttccattaaaaatgtgtataacaaaaaaaattgttttcatttaattatttctcaggaattgaccgcaaaagaggcgaccgcaaatgtccgtccgcaaatgtccgtccgacaatgtcccgtccgcaaatgtccgtccgcaaatgtccgtccgcaaatgtccgtaaggcgtttgaatatgctttccatagaatgctttcacaactatttcacaatccgatggatgatttagacgatcacggagctcattaattcgacaattcaaaatttgtgcaattttttcagcaagaaggaccatttttctaattaatctagatttatattaattaattttatagaggaaatttgcaaaattattttgtaaaagatgattaatgaaaaaaaaagaaattcaactgctatttataatagttaagaatataggttaagtaaacattaacaagtataaaaacagattttcattcatttttagtcactttaatattaatataa

SEQ ID NO: 82399 - DNA, 1412 bp, Heterodera glycines
  Genomic contig location: Contig_ID=SeqID_17856; Location=1281..2692; Strand=+
  SCN-specific regions: Sequence locations=1-142,184-209,231-472,494 -841,865-884,906-1412
atgtttgacaacgaaaatggaggatccggcgaacctcaacaaataaacgaaaatattcctgctaaaacttcttataatgtccaaccctggaaacttttccgtccgaaatacatgctcacttaccgcatgtgtgaatgtaaacaatataatagaaattattatttattaattattattattattcagtatgtctttcatcattgtggaacaacacaaacaaatatattgctaacgaacgtcgatcattaatcagttttgaactttgtgaaaaatgtacaattgacaattgtcgtgctaccgaaatacttgccccattcaagccaaagaaataagcccaagatgaatttttattatttcatcaccgataattatttaaacattcgtttgaatccaaacccatctccccatctattccttcctcataaaattgttctatttactcgacgatggcaaataaaaaatgcacaaatctaagaagcaatttgaccttttttgaccttcttatttgaattcacgagttccatgagcaaaataatatttgcattagacacagggttggggttaattgcgggatgataaaagagattgcggatcaacagttcaggcactgtgttcctctattggtcgcctttgaaatttgagaaactttttagataatgtgccagctgatcaaaatgcgcagggaggaaatgcttcgggtgatggaaatggtaaataattttaaaataactcaatttcagtcttcaaaatttcagtcccctcgtttggggcaacgattgaaacgcacatggagagatctcgtcgacgtttgctgcatgatgagatggttcagcgcagtgtccagcagcattttcagcatcaacaacaacaaatcatgttccaagcacaacaacaggaacaacgccgagttgagatgcagcggcagtttgatgaagccgaacacttgcaagaagaaattcaggctgcggatgagagacaaaacgcccaacagaatgaccaagagcaggaacaagaggaggaaaatgtacagcatgctgtgcagcagcagcaatttgagagaactgtacgactccagttgcgcgagtcgcagcgcttttacggcggttcgccttcgtcagtgttagtgccaccggttcaattattttgggagactgaatgtgtaatatgcaccacttcaaggccccatttctatagcaaggagtgcgggcatatttatttgtgcagtgagtgtgctgtcactgcggtgatcaacaaggttcgacgctgcatgttatgccgcgctagtgttagtggcatttatccttttgtccgttgagtacctttatggaagtaagaaaatgttaacatttcacattttcagcttaaatttgtcttacttccataaaaaggtgttatttgaaagttggaaaata

SEQ ID NO: 82400 - DNA, 363 bp, Heterodera glycines
  Genomic contig location: Contig_ID=SeqID_17857; Location=269..631; Strand=-
  SCN-specific regions: Sequence locations=1-8,30-130,153-363
atgttgctgcgcttggctctgctgctgtggttgggcatccgtggcgccctgcacatgggcaaccgtctcacgctgaaaatgcaatgtgatgaaatgcaaaaagcaattgaggcaggcagagggagggccaaacattttcgaatttgggaggatttagatcattcacccccaccccactcggtgcccgaaatgcggcttaccggcaagccgggatatgcccgattttcgtccacccatcgcccaaaatgttaaattgaggcaaggaggaaagctttgtttttctggcatttttttaaacaccccgaaattggacagaaaaagcacgcaaaagcatgtttaagtttcgaaatcagcgaaaataaa

SEQ ID NO: 82401 - DNA, 131 bp, Heterodera glycines
  Genomic contig location: Contig_ID=SeqID_17858; Location=1298..1428; Strand=+
  SCN-specific regions: Sequence locations=1-131
cccgttcggccttgttctgctcctcttcatcccgctggcgttccgtcgtcgttgctccgcgtgccgtcacctgtacacctaagaaatgccgctgggccttcagaacaccgaccgactgcttactgatggat

SEQ ID NO: 82402 - DNA, 1327 bp, Heterodera glycines
  Genomic contig location: Contig_ID=SeqID_17859; Location=136..1462; Strand=+
  SCN-specific regions: Sequence locations=1-41,71-73,96-575,597 -702,724-789,851-996,1018-1327
atgtccaacaataaagaagaagcggtcattaacaatgcgagtaataataaattaattgtttatttaattagcactattaatttttcaaaagacctgacaaaccattggtgcaaaggtggctttttgtgggagagaagcaatggaggcaaaacagaagataccgtagccatttgcaagccaaatgagcactactgttatgtggcgaactgttcagtggcaatggctggtaagtaaaaatacttttttactttatagacttttggtgatttttggtgcatgtgctaataaaagtgccaaaataagggttcaaatcctgtaaaatcccgaaaataaatgcaatttaggtaagcatattccaaacatgctcttcttatattttttttttactcgtcgcccaataaactgctgtataacaaaataagtcgggaccggcagtgccaaaaaaggcgctgccggaaaaaattttgaaaatttcggtttttttaataagatttacaaatttttgggccaggcaatgccggaaggcagcgccaggtgaattttaaaattcagctctattttcgaacgggttttaacaacaaaaatttttgaatttccgataatttttgttattcttcgatatttggtcaaaaatattttgaaagatattaaattttcatgatttcgtcaaagaaaattgaattttttaatttcaacgaaaagaaaattttaaaaaaaaaatttgggttaatttgttaacatattatgccaaggatgatcgtttttatgggcatttttgtttaacattactttatttaataaaaatttggcaaaatgtttaaaaaattcaaattttttataaattttttttgccttttctccaacgaaaatgccattcttaggagtgtatatttaacccggccccaagtttgagttaaaatcggggtcggggtttgtcggggtcggaagcgtcggggtcgggattaacccgaaaaatggccaaaaaagttggagttcggggttggggaggggtcggggcccaacttatgactcgaaaattcttttttcacctaggttaaaacaaattgtcaaaaaaattataattttccagcaattattttctgtttctttgttggcaatgcgtcccggacattgacacaaaatcggaaatctgaacaccccagcgaaaatcagacaatttcgccctcaagaaaacaatcaactaaatttcaaaaaaaaaatttattgtaatacctatgaagtgagaactcactggagttcaaattttttacaaagtggggatgtacgacaaaaattctgatgaatttcatttttggtgcatgtacta

SEQ ID NO: 82403 - DNA, 212 bp, Heterodera glycines
  Genomic contig location: Contig_ID=SeqID_17860; Location=654..865; Strand=-
  SCN-specific regions: Sequence locations=1-212
ggagtgctgaactgtctgaagagtacgcaccattggttggcacaaaaacaccagcagctgaacaactaacagaacaaagggccgatctgtcgcaatttgaattttaatacggtagcggaaaataattgtgatatacggtagcaaattgccaaaccgaaaacgcattaaatgcagaaaaaaaatccttttgttctctttccaatggatgttaa

SEQ ID NO: 82404 - DNA, 80 bp, Heterodera glycines; identical to SEQ ID NO: 51817
  Genomic contig location: Contig_ID=SeqID_17860; Location=1148..1227; Strand=-
  SCN-specific regions: Sequence locations=69-80

SEQ ID NO: 82405 - DNA, 231 bp, Heterodera glycines
  Genomic contig location: Contig_ID=SeqID_17861; Location=1662..1892; Strand=-
  SCN-specific regions: Sequence locations=1-23,203-231
  Gene Ontology: Biological process=N-linked glycosylation
atgagggaaagaggaaaaaatgagagaaagaggaaaaaggaagaagaggaaaaaatgagggaagaggaaagagcaaaagatgagagaaagaggaaaaaggaagaagagggaaagatgagggaagagtgggaagaggaaaaaggaataagagtggaaagaggaaagagtaaaagatggggaaagaggaaagaggaggagagaaaaatgaaaaaaggaaagagtaaaagatga

SEQ ID NO: 82406 - DNA, 278 bp, Heterodera glycines
  Genomic contig location: Contig_ID=SeqID_17861; Location=343..620; Strand=-
  SCN-specific regions: Sequence locations=1-278
cgttgactgaatgtgccgtgcccacagattgtgttcatcgagtggagagggcacttcttcagagaattcaggtgccccgctgcaattccactgactatttcgacctgttaaagtgcttggatttcagtaagggttttgtcgtgcttttcctttgccgtatttcaccaccttttcagtcattctgacgaggactaatttgaccgagctgaactcgcgggcaggccgcgtctgttgcgagatggacaaagtcagtctctcatgccaattggcgtgtcgaa

SEQ ID NO: 82407 - DNA, 1885 bp, Heterodera glycines
  Genomic contig location: Contig_ID=SeqID_17862; Location=361..2245; Strand=-
  SCN-specific regions: Sequence locations=1-140,163-463,485-600,622 -1483,1508-1701,1723-1772,1794-1885
atgagtctatccagagccagcaaaggaattattggtgaggtcaaaaaatgtttagcgtgatgagacatttgcgccgcgccatttgcgccgcacagcaaaagtggacacttgcgccgctcagcaaagtcgatacttgcgccgcgccatttgcgccgcagacagttgcgccgcggatatttgcgccgctccatttgcgccgcgacatttgcgccgcccagcaaaaattgacttttgcgccgcgctgtcaaaaatattatattcataaaaattccactattatcaataacttttactaaaactataagccatcgacaaaaataactaattgaaaattcgaaaaaattactagtcaaaaagattgacattcaattttttaaccattaaaatcaaatggcgcggcgcaaaagtcggctaaccgattaattaatgcataaaccaaatatgatacaaattcactagctcaaaacttatttcacatcttcaacattcttaaaaactagggtttctccccgacccctggggggggggcaaaaaaattttggagttttgggaggccggcggttccgataggcgccgccgaaagtttttcggaattttaggaatttttaattaactttattaagaaaattgtacaaatttaaaaattttcaagagtccccaattccccgagttagtgtcggggggtcgggggataaaaagtcggaggtaggggctcggggtcggggagcaaccctattataaacccccaaaataggtgctaaaaatggaaatgagataaatattttaaaaatcaaaaatgtagtcaagtaaataaataaatcaattttgaatatgaatttttgataaaaattttccatttctaaggggtgtatttttcgtttttattgcatttttgttaataatttttttcaaaatagcagaaaacattttacaaaaaattcttcaaaatgaaaaagagcacaaaaaagcaataaatttattattattaacaggttatatcgctccaatttgattcggttttttcggtttttgaaaaaagtcggtcggttttttcggttttttgatatttcggtcggtcggtttcggtataaaaaccgaaaaaaaccgaaaccgaaaaaaaccgaaaaactcaaaaatttctcggtcggttttttcggttaaaaaccgaaaccgaaaaataccgaaaaaacccgaaaaaaaaccgaccggcccgatctctgagttttgaggacccataacttttgtcaatttccttttggattaaaaattctttcggattcatcctttacatgccgagaggaagcgattgatatctattttgttgcattttatgcgttttacggcaatggacggttcagtccagggatgggccgaggtttcgcttttcgcatttcgcctttcgcattattcgcattttttggcgtttcgcatttcgctttttggcgcgaaaagcgacttttacacccctaagaattggattaaattcccataaaatttttcaaaattttacctataaattggctaattttcagtgaaaaactgtttataagtgatcaaaatttccaatttttttccccggcggcgcctatcggcaccgccgcgcccccaaaactcctattttttcttagaaaatggcccaaaatcgcaaaatttggtaatttgctgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccccctcttcccaaaaagtttttttggaaaaagcgcgcctcaaaaaagcgttttattgatttttaaatttggaataaa

SEQ ID NO: 82408 - DNA, 77 bp, Heterodera glycines
  Genomic contig location: Contig_ID=SeqID_17865; Location=943..1019; Strand=+
  SCN-specific regions: Sequence locations=1-77
atgacgtcattgtacaaattcctcccccctctaattaattgttcaattattctaccatcttatgcagagcagtgctc

SEQ ID NO: 82409 - DNA, 915 bp, Heterodera glycines
  Genomic contig location: Contig_ID=SeqID_17867; Location=537..1451; Strand=+
  SCN-specific regions: Sequence locations=1-33,75-144,168-504,526 -648,671-740,763-915
atgtcacttctgctgaccttcatccgccctctcctccctctcccccccctcctctctctctctctctctctcccgcccactctatacccccggtaatcacttcataaattatttagaatcttttccccgcatccgtttatttgagctgcttcttcaaatggttcttcccatcctttgccgtcattttgttgtgccttcattgaagaagagctctcaacacgaatttctaaacagctgattgcgttttttaagttcccattaaattcatttaataaattaaatgaccaataaaaggcaaaaaaaaaacagtgccgagaaaagcaaagggtcgttaatcagagaaatttccttcaaaaaaaacattggaggagaaaaaggaattttttcctttcggatgactccgaattttcttttgctttttgaggatttttaaggaaccctctttttcaacgaatttgtttagaaaactcgaaaatgacaacactaatttaaaaaaatattgcatgattttgccgaaaatgataactaattaccttgaccatatgtcaaatattcgctaatagcaattatctttttttaaataaaagttgcctttatgtaaaaaagtttaaagtgacactccaataaaactttcttaatttcacagaatttatatttatgcaaatttaattttgaatattgtttatcggctacaaaagtgacagtgaaaaaatcggttcccataagtaagaaaatttacaattaaaaacctaatttaaaaaagagcaaatggttaattgaagggatggatacggtaatgaacaaaatggatactgtaatgagcataacggtaaattgacgagatggggtgattatataattgtgattattaaatggtgaagatgctcaacatatgaaatttgggacgtaacaaaa

SEQ ID NO: 82410 - DNA, 799 bp, Heterodera glycines
  Genomic contig location: Contig_ID=SeqID_17868; Location=258..1056; Strand=-
  SCN-specific regions: Sequence locations=1-799
  Gene Ontology: Mol. function=structural constituent of cytoskeleton; Cellular component=cytoskeleton; Biological process=microtubule -based process
atgcaaggagttcaagactggctgtacggggcggaagagcatttggccatggtgccgcaacagtccaagctggtcgagccactcagcgcacagctgcaacaccaccaggcgttccatgccgaactgggcgaacgcgttgagcagatgaaggagctgagcaacaagggcattcgcatccagctcagctgcgagaagaaagacgccattccgatgaagaaccgtcttgtgtcgatgaagcaccgcatggacaagctcggccaacgaagcggcgagcggctgaagtcgctgaccatggcactggacgagtcccggctgttcttcgactcgcgccgcgacctgctccactggacagaggatcagcagcgatggttgcgcgaccgcgaggcggctgagccgagcagcaccggaacgggtgagcgcatccgtgaagcgctcaccgagcatcgcacgcttgcggacgcgcttcagcgcaagacgggcgtctacgacgaggttcgccgccgtggcagtgcactggcagagcacgcgccacccagcgagaagttgcagttggacgaagcgaatgaggagatgacgcggtgctgggaggcgttatcgcgcgcggcactgcgacgccagcgcagcctggaggaggcgttgatccaaagcggcaaatttgacgaggtgcttgccgaactgctcaactggctgggcacggtgttgccaccgctggaagcggagctgaacattggcaactttcttggtaacgtcggtcggataattaaatttggtgtgaatgattcatccaacaatttcttcg

SEQ ID NO: 82411 - DNA, 309 bp, Heterodera glycines
  Genomic contig location: Contig_ID=SeqID_2933; Location=1038..1346; Strand=+
  SCN-specific regions: Sequence locations=1-21,43-163,197-309
atggctcatgatttctgttttaaaaatttttatgaaatttttatctatgccaattttatcggcttaaattttaaaaaagcattatcaaaggtgcgattttattaataataaagagttaaattcggtaaatctttttgttttaaattataagcctaaaattggcataattaaatataaaattttgaaaatttttattcattaccatttttcagaatatatcattcgagcatattaataacatgccaataaaatttggtgcatttcagagccctttctgaaaaaatatttatgcattaattttgaaaaaaa

SEQ ID NO: 82412 - DNA, 757 bp, Heterodera glycines
  Genomic contig location: Contig_ID=SeqID_2933; Location=1826..2582; Strand=+
  SCN-specific regions: Sequence locations=1-355,377-388,434-757
agttatattgactcaaagttggctcagacggagttggccagacggagttggcccgttccgcggcgccgggagtgcccgaggtactggcgcgccaactgctcggcttgccagttctgctgctacttgctgtcattgtggtgtgaaatggcgtgatttgtatgcatagagaagagtaaaaatagaaaaaaaaattttctgatttttaattctacttttcttatttgaaactaattttttactcataaatttttaattggtttttatttcaagagatatttatccatttaattaagaaaaaaacaaataattagataaatgaataaaatacattggtgtgtcataatcaaatataaaatgaataaacaaacaaaaagacaccgccacaggcattaattaaatttttgattgtttttattaatttaaatcaaaatttgggcaaatttattttgtctatttagaagagatatttttgtacttttagccaaaaaattatatagcccatgctggtggataatgcgttcaaaatacagacacgagagggacgacttacataaaacattgacacacataaacttataaaaaaatgataaaaatttgctgattggaattggccaactgatcagctgcagagacagatcacccactgatcactgatctgccccttttctctcatggatggccaacaaatggtacgaacacaaatggattagggatgaagcattattggccaagaatggacttggactcgatcttttaa

SEQ ID NO: 82413 - DNA, 278 bp, Heterodera glycines
  Genomic contig location: Contig_ID=SeqID_2933; Location=1..278; Strand=-
  SCN-specific regions: Sequence locations=1-129,151-278
attttctaagaaaaaataggagttttgggggcgcggcggtgccgataggcgccgccggggaaaaaaactggaaattttgatcatttataaacagtttttcactgaaaattagccaatttataggtaaaattttgaaaaattttgtgggaatttaatccaattcttaggggtgtaaaagtcgcatttcgcgccaaaaagcgaaatgcgaaaagcgaaatgcgaaacgccaaaaaatgcgaaaggcgaaatgcgaaaagcgaaacctaggcacatccctg

SEQ ID NO: 82414 - DNA, 1071 bp, Heterodera glycines
  Genomic contig location: Contig_ID=SeqID_2933; Location=3189..4259; Strand=-
  SCN-specific regions: Sequence locations=1-49,76-358,382-408,430 -634,674-974,999-1071
atgagatggcagggtggaaagttcgtacatctagggcatggatttttcttatcaccaggaccagtccattttaggcaaccctggatttttgtacaggaaatctcaggtttttttttccaggtcaaacatggaaccatacaggtatactaggctttattgagctttagaaattcgattaaatgtacgggttaatttaagatgaaagctatttgcatcctgagaatcaataaaatacgcccaaaaagtggcggaatcactttttatgaataatgaatgcttttcgtgttggctcggagaagcggagagtacttacacaattggtgcgtggattcgatgagggattgaaaatttggaagcgaaaagaaaaaaaaaaaaaaaaaattcggctaattgaaatataacgccacaaatcaaattcaaatacccccaaatcctagcagaattttgtgttctgtcttagcaactgatgcggctctcgatgtgtcaaatcgatctaggaggtgaaataagttgatcagaagcgattaaatcggtttttgagccagttcaaaaatcgaaatgtgaagaaaaaattcttttaaaacggtcaaactcaaacaactttgatcgaaacgggccaactgcgtctcaattgattaaatatcaaaattttttaaaaaataaaaataaaatagacaatacaacaaaatatcatttattcatttggtaattgctacaaatccctctaatggcatttctataatttgggttaatttgtttttaacaatattgatgatcattctagtcgattttaacgcgtcccaaaaacagtttttattggtcccacaaaaaaataaactaaaaatccaaaaaaaaaaaaatttatagggttatttgatgcgttgagcacaaattctagctttcaaggtcgctgatcacgataagatatccattttgaccaatttctaaccccggaccagaatccgaacaaagtcgaaatttaaattttttgaattttacttctatgtatatttaatctgcatagaatgactcattttgctgtttagtatttaaggacgctaaaacaataaa

SEQ ID NO: 82415 - DNA, 2873 bp, Heterodera glycines
  Genomic contig location: Contig_ID=SeqID_2933; Location=4602..7474; Strand=+
  SCN-specific regions: Sequence locations=1-142,164-422,461-506,537 -558,587-622,644-648,670-928,958-1322,1344-1411,1433-1488,1514 -1639,1661-1691,1770-2372,2395-2599,2621-2798,2850-2873
atggccaattcggaactgaacacaatgccatcaaatggtgatttgaagcacaataatgctgcggaaaaggtgcagcaaccgaacgacttgaagaaggtcaacgagggcggaggaggaggggcagaggctggccaagacggaacagcaccaacagcagcagaacaggcacagaaaaagccaagcccagtgagtgttttgaaacacaaaaaacagggcacaaatcttagaggttttttatgatccgatgtccattttgcccaattccgaatccctaacccgaaatcgaacaataaggtccaaaaatgaattttttttttttgaatttagactgtttgtttcggtttaaggattaagaattggacaaaatgaatgccattttcgtctggcgcgacccaaaaacctccacagaaaaatgtttcacgattttaaaatattaaaaataaaaattacaaaaaaaaaagagaattttgacaaaaaaatgagtttaccaaactaattgtaattggatttttgccaaaattgttttattttttgagatttattgtaaatgtgatgcactttttttgtatttataaaaaaaaaattacccaaaaacgatcaaatttttgctcgaaaaattgggaaatttattaataaattaatactttcctaaaattcttaaaaaattaagttggcattgctacgctcgttgttcaatgacgcggcactgttcggcaatgtcggaggcccaattcaggcgtacattttgccaagaactgacgcacattatgtaatttacggtctacgtcagttcggccccagcacgtttcgcagcgggttttcgctttggcatccaaatccaacattgttggtatcattcgaaagctcttcatgctctattagcctgcaaaattgcaaaaaatttcgtcaagtttaaaaaaagtttgagccagaaaagttggaaaattttgttttttgaactcttctgaccataacttttttgaaccttaacgacatttttcaaaattctgcaggctaatagaggacacgtagggctatcgaatgataccaacaatgttagatttggatgccaaagtaaaaagttataagcgaaaacccgctggggccgaactgacgggttccggtaatttatcttctttttttttttggaaaaatgcgggagagaatttttcctgctttgcgaaccttttttacatagttcgaaaccagacctcagaacttgaaaggggtcgaacttgatgtcaaaaacttattctcctactaaagtttacccattttttgaattactataattgcatttcatataataaagccccgaattagggggaaaaccccccggttttcgagatgggaaaggattccggctaaaaatctgtttcaacttgaatttgggtcctgttgctgaacccggttcctggaaaaatctgtacacaaaattctggcctgatcgaacacctttcataataaaatgtaaacgatttattgccgaaaaaaaatttttttttttttttttcaattttcagagtgaatatttgtgtgatcgtgatttgcgtgtccaatttttgtccggcttcactgggtccaacgcatttgtggtggtcacacaacaggacgcactgctgtggacggacgggcgctattttgtgcaggtaaaacaaaaatattttgatagatttcggaaattttggaacaaaaaaaaatttatttttattggaaatcttacaaattttttcgttttaaaatttcatatttttacaaaattttttatacggggagggggagggggtgaaaaaaatggtttataattttttgaatttccaattttccaaggcctccgctgaactgcgcgatgggtggaccctgatgaagcagtgtgtgccggactccatcgacccgattgagtggtgtgtgcagcatttggatgccggtgcacgggtcggatttgacccgaatctgatcaccatccgtaattgtttttcattttaatcatacatttattattactgcaaatttgaaaattttttatccatggacaaaaaaaatgatggcaaaattttttctaaaaactgggtttatgagttttttttttggccgtaacttttttacacttaatgaaatttttttgaaatttagtagtataaactaagaaatgcttgatttgattaacagcgaaaaaaagttatggcccaacaacaacaacacaaaaaaaaacattcaattcggacagcatgaaagaatttatgaatttaatgtgtgtttttttccgcccacagaaagtgccaacacaatgatgaacaaactgttgagcattggcctcataccagtgccgtacacacagaacattgttgatttggtatacgacgatttgattgcttttaaaacaatttttaaatacgattttgttcgcaaattgccccaaaaaaaaaaaattccatgggattttttttttgaaaattttttttttcaatttcagatttggacagatcggcccccggaaatgcctaaaaaactgatccatcttggcgagactgagtgcggtgagaagccggcgtccaaactgcgtcggctcgccctgctgatacggaaggccaactgcgactccattgtgctgtcccagctggacgaaattgcatgtaatgaatttgtaaaacatttaatggagaaaacggaaaattaaatagaaaaaattaattgcaagaaaaaaaaacagaaatttatattttacagaaattaactctcctataggtgtacacccaaaaacgtcgccgccgaaacgtcgcgggacataacgtcgccacaaaaaaaaattaaaatttttcaaaattttaagaaaattaaaaattattttagcttttttgaaaatctaagtgtta

SEQ ID NO: 82416 - DNA, 369 bp, Heterodera glycines
  Genomic contig location: Contig_ID=SeqID_2934; Location=446..814; Strand=-
  SCN-specific regions: Sequence locations=1-55,78-142,165-369
atggcgaactttctgctgtcgctgctgctgaccgcgtcgccgctgcccttggcgttgctgccgccggcattgccctcagcaggcgacgatggcactgttgaaggcgttgttgtacttgttgtcgtcgtctttgtcggcgtcgttggtgctgcttttggttttaccgatgccgtcgtgcccttggcattggcatctaccacctcgtagcagttctcgaaccgtatgccgaacgagccctgggcataatagcccggctcaatggtcaccaccacacccttgtgcaagtagttgtacttgctctgcacgcggtagccaatgtaggctaaaaaaacggcactgggtatttattagtggcacacaaaaattaaa

SEQ ID NO: 82417 - DNA, 1274 bp, Heterodera glycines
  Genomic contig location: Contig_ID=SeqID_2934; Location=1..1274; Strand=+
  SCN-specific regions: Sequence locations=1-174,198-650,673-737,760 -1000,1022-1274
  Gene Ontology: Mol. function=aminopeptidase activity
atatgcaaattttgcatagaaaaaaaagagaaaattcccattttttcatttgttttagccgtcaacctggacgggatctgtcgcgcaccgttgtgggcacatggctgtaattttgaccatggcgtcggccacggggttggccattttctgaatgtgcacgaatatccacgtgcgtttgttttaatgtgtttttgtttggggcttatttgtttgtatacacagttttaaggagtgagctataaaaaaaatttcgatttttttcgaaatgccaaaaaaactttttttcggcgccctggatgatgctgatttagagaccagggatgtgtcggcatgccagtttctggcctatttccactcggaattcccgattgccaacatttttttgagccgtttgaattacaattgccgaaatttttgagggtgtcggaatagaaaaagtgggatttttaatttttgtgtgccactaataaatacccagtgccgtttttttagcctacattggctaccgcgtgcagagcaagtacaactacttgcacaagggtgtggtggtgaccattgagccgggctattatgcccagggctcgttcggcatacggttcgagaactgctacgaggtggtagatgccaatgccaagggcacgacggcatcggtaaaaccaaaagcagcaccaacgacgccgacaaagacgacgacaacaagtacaacaacgccttcaacagtgccatcgtcgcctgctgagggcaatgccggcggcagcaacgccaagggcagcggcgacgcggtcagcagcagcgacagcagaaagttcgccatgttcgctccgctcacgtttgtgccggtgcagaaatcgttgctggtccgtgaactgctcgaccagcgcgaggtattgtggttttgagtgggaaaggtacaaatcgccatggctctttgattggttgtttggaaatgtttatttttttggcatttttacaattttgtaaattggtttatccagtcaggaatttttaaaattttttttaaccaactttgggtaagtgtaacagtgtagtttgccccccccccttctttttggaaaatttaaatttttttttgccataaaacaagttccaggggttttttttgtccattttccctccaactttccccccaaatcacacagattgattggctgaatcgctaccacaaccaatgcctggaggcggtgggtcgctacttgcaggagaaaagcatgcaggaggagtacaactttttggccgaggcgtgcacaccattc

SEQ ID NO: 82418 - DNA, 2125 bp, Heterodera glycines
  misc_feature (6)..(6): n is a, c, g, or t
  Genomic contig location: Contig_ID=SeqID_17870; Location=1133..3257; Strand=-
  SCN-specific regions: Sequence locations=1-203,335-344,366-738,761 -1031,1056-1160,1248-1303,1326-1336,1358-1566,1589-1723,1748 -1759,1798-1917,1953-2071,2093-2125
  Gene Ontology: Biological process=N-linked glycosylation
atgggnaagcaacgaaaagaaaagaatgaaaaagcttttgtgcaatgtaactgagttttcatgaaagattttcaagactagaaataatttgttttagcatgaatttgtaactgcttccgatgaaagtttaaatccgtcagagtccgaaaattccgctgaaatttttttcgatacaaatgaagaccaaattgaagaattaattgagaaagaaagccaaaattataaaatgaatgaaataaaatcagatgaaaaagaggcggaaaaatctgaggaaaaagagaaaataccaaaaaaagaagtaaaagaagaagaggaggagaaagaaattgaaggacattttgaatttaatgaagaaatggaagaaatgaatagggaaaatgagcattggattcagaaaagtcagaataaaaagtcaaaaggaaaagagaaaaatggcaaacggaagaaaaattattcgtcggaaaagcaaaaaaataatagcgaaaattcaattaaaaatgagaataattcagaaaatggaaaaaaatcgcttgaaacaaatgatacactaagaaaaggagaaaaattaagagaaaatgtcaaaaattcgccaaagaatttaatggagagaacgcgtgacatcacttgcattgtgtcactgaagaaaatgggaatttccaaactgattggtaaaataacaaagctaatgagttaaataattagcacactttcagatttaatggacgaccattttttgactattttatataaaaattattttgaagacaaatttggcgccgaatgtgtgccatttttgcacatttctctgcttggaaaggcaattgaagcgaagcgcaaatttattgaaaaaagtgcaaaaaatgaaattgcagaaaaaaacaattggaaaaaatttaatggaaaatggaaggaatttgtcggcattaaattggacaaattcgaaacgatgcaatttttgatggagaaattatattttgtgcacaatgaattggatatatatgttcttgagtaagaaaaatctaaatttgatcattaaataatatttataattaaatgatcaaaaaatatctatggaatattataattaggacgaggatttttaggagcgaaattccaatttattggcctaaatagtggcgaaaattttgaaaaatctgtactttttttcaaaataatataacttaatcaagaattttaaatataaaaaaataatttcttcttttttgaataaaaactaaaaaaaatttcggttttacggcttattctgtagtataactggaaactattaataaattaattaagaaaataaagagcaaattaaatttagtgagcaaaatgaaaggagtttaattaaaacaattgagtatttggaggcgattgaactgatgaaaattgaaaaagaaagtgccgaatttaaaacacattcttccaaacaaaccgtgtcaattccccaaaatgataaaaaagctaatgggctaattaccacccaatttgggtcattcaaaagcacagaattcaaccaaatgttggacattcttcacacgcacatattttcagttttggtagcaaaaaatgtgcaaaaaattaccgcttcaaacgaatcggatgaaacgaaatgcgcaccaaattggcaacgttattattcacacataataaacatggaacggctgaattcccttttcaaaagtgtggaaaatttggtgaaatccgtggagaacattgaaaagatggaaaaacaacagaaaatcggttaaatgtcttttaattattattttttaaaatgttttaattaaaataggtgcttttctttataatgatgaccatttttttgattaccatttaatccgaacaactcaattcactcgtgaaagtgaaattaaactatcaaatgaggtaaaaaaagaaaaagaagaaaccaaattaattattatttcaattcttatttttaattagtttatccaattcatcgctccgtttgaaataagtcaaaagaagaaagaaaaaattttaaaagtaaaaacacaaattgaaaagctaattgatgagtgggcaacaaaactcggctcaatcggtaaaaacaaatttactcacaaataatttttagactttttctgaaacaaataaa

SEQ ID NO: 82419 - DNA, 1152 bp, Heterodera glycines
  Genomic contig location: Contig_ID=SeqID_17873; Location=12..1163; Strand=-
  SCN-specific regions: Sequence locations=1-218,283-537,559-573,628 -950,972-1152
atgttgcaattttattatttttttacgattttccttttattccttccacttttttcgagtggtgacgaatgttatttccattatctaagagatacaaagcttgaaaatctgaaaagtagaccacattattcagtggttatgcctcaatgttttgccgatttgtttaggtgagatttttgccggtgtttaccggcacctgtgaacccgaaaaatgtttcttaattttataacatttgaaatttttaatcagtttttattattaaaattaacttttaaatattaccatcaaaagcatatacatattttttatccctttgccaataattagttttcgaaaactcgacgtgaaatccaatgccaagacgaacaaaaatttggaatgggttgaagccaaagatgccagggcattcaagggacaactgtatggtgttgaaacatttttggacttgattttagcacgaggccaaggccttttcgattggcgcacttcaccatcaaaagaattgattgagcgacaacaatggcacatcaaacgcctcaagaaattagctgaaaaacaggaggaggccggcaagcaaaaacaaaatcaacaccaacgacaacaaacacaacatcagcagcaacaaccggaatttggccatgacacttacagtaaaaaaataaaaaagaattcagagattaggaaaataaatctttttttatcagaaaaattttaaaaggtcttaggttaccaaccgttcctccaagcgatattatctcaaaactcttataatgaccggttttttaatcacatagatcatccaatatggcaaattggccttttcaaacggataaacaaagaatcggttgaatgtaatgaatgcaaagacactttgccattgtctgatggaagcctcaatcagctcaagcagcatctgtcggacaagcacagcgagaccgaatatgaaagtacctacaaccaaatatacaaagagttgaacgaaggtacacgggaaaatcttaagttttactgatctaaggtacctctggacattcttttatcgatcgaaggtaccggaaaattcttaattttaccgatcggcgagacctcggaagattcttaagttttacctataagttttttagcaagcaacagcatgctcaagtaataaa

SEQ ID NO: 82420 - DNA, 1036 bp, Heterodera glycines
  Genomic contig location: Contig_ID=SeqID_17874; Location=326..1361; Strand=-
  SCN-specific regions: Sequence locations=1-93,115-124,153-329,365 -380,415-454,494-578,601-643,666-794,817-825,856-1036
atgtccgccatgtttaagcaaaacaaacgcatggagcgggtgcgtttcgcacaactgccgaactggttcccaaagagcttcgggcacgagggggtcgtccaaagtgttgatgaaaatctgaaacaattttatttatttaataaaaaaatttaggtttttttttgttcatttttaataccaatcataggaatttttatgtctttaatgcgtggaaggcagcttatatgggaatagaaatccgaaactgaagcaaagttgtgcacccgacgactgtaaaattcgtcaagccaaagaagcgaagtcgacgaccaaagtttctgaaaagataaataactgtagctgttttttaaacaaaataattggtaaaagacaattcgttaaaaccattcacataacaataaattttatttgtagttttaaatcttcaaagaagataaaatcaatttaattacagaaaaatttatttttttaatactttgaataaattttttatcttttctccctttgttagaatattttcacaaaggtttcagggtcactcgatatgaaaatggaatctttttttatcgataatgataaaaaatcaattccataaaaataggtttttcaaatacaaatgcgaaaattagccccgagtatattcctaagttaaaaaatttagaatttcatccactttccttctgaattggtcaaatggatatcagattcgtgatcagcgacctcgaaaccccatataaagtagttttacaattgttattcttttgaagaataggggaacaaaccaaactattaccaagttttctaatatttttctttctacgtttgaaaatattttttaaaataaaaattttttaagttttcaggacagtaaaatccatctcataccccacccgagtgattgcttactcgttcatccaccaatcccgacttcacatggggctgaacaaccattgcgtaattccgccgaagtaatcgtttaacactttcagtgatgatgtaattgtagaaacgtcgcccgccttgccaatcgaataaa

SEQ ID NO: 82421 - DNA, 1361 bp, Heterodera glycines
  Genomic contig location: Contig_ID=SeqID_17874; Location=82..1442; Strand=+
  SCN-specific regions: Sequence locations=1-232,254-425,456-464,487 -615,638-680,703-787,827-866,901-916,952-1128,1157-1166,1188-1361
gtggcaatggtgaaatggaagcgatgttcagggttcttgccaaggtgtacccgcgaacttatttcattggcattggctttagtatgggtgccaatgtgctgaccaactgtttggcttctggacttgatccttctatttcttcgcgcattcttctcggcatttccgtttgccaaggctattgcgcttcggagtgctttgaatcgtttttttcacctttaattttcccttttagtgcttcttcccttttattcgattggcaaggcgggcgacgtttctacaattacatcatcactgaaagtgttaaacgattacttcggcggaattacgcaatggttgttcagccccatgtgaagtcgggattggtggatgaacgagtaagcaatcactcgggtggggtatgagatggattttactgtcctgaaaacttaaaaaatttttattttaaaaaatattttcaaacgtagaaagaaaaatattagaaaacttggtaatagtttggtttgttcccctattcttcaaaagaataacaattgtaaaactactttatatggggtttcgaggtcgctgatcacgaatctgatatccatttgaccaattcagaaggaaagtggatgaaattctaaattttttaacttaggaatatactcggggctaattttcgcatttgtatttgaaaaacctatttttatggaattgattttttatcattatcgataaaaaaagattccattttcatatcgagtgaccctgaaacctttgtgaaaatattctaacaaagggagaaaagataaaaaatttattcaaagtattaaaaaaataaatttttctgtaattaaattgattttatcttctttgaagatttaaaactacaaataaaatttattgttatgtgaatggttttaacgaattgtcttttaccaattattttgtttaaaaaacagctacagttatttatcttttcagaaactttggtcgtcgacttcgcttctttggcttgacgaattttacagtcgtcgggtgcacaactttgcttcagtttcggatttctattcccatataagctgccttccacgcattaaagacataaaaattcctatgattggtattaaaaatgaacaaaaaaaaacctaaatttttttattaaataaataaaattgtttcagattttcatcaacactttggacgaccccctcgtgcccgaagctctttgggaaccagttcggcagttgtgcgaaacgcacccgctccatgcgtttgttttgcttaaacatggcggacatttgggctttctcgagggcaattctctgaggcctcgctcgataacttggcttgaccgtttcatcctccaagtggctgcggca

SEQ ID NO: 82422 - DNA, 735 bp, Heterodera glycines
  Genomic contig location: Contig_ID=SeqID_17875; Location=124..858; Strand=+
  SCN-specific regions: Sequence locations=1-475,500-735
acaatggagaaaattaaaaacaatattggcgactcttacgtttggatttcggtggacgaaacaacagacaaaatgggaagagcgatggccaatttgctgattggaaaattggatggacaaaaatggcacaacccacatttgatttccgtcaaatgcttggagaaagttgatagcgcggcaattgctcggttcatcccgttcccgtttcccgtcttttttgcccggacgggatttttacgggaacgggaaaaagccgggaatcccgttcccgtttcccgtcccgtctttttgaattcccgttccccgtttcccgttcccgtcaatttttcttaaaaaacgggaataaaaatacactggtagaattgggttttcagatttaacttaggcattttgccaaacaaaatatttgtttttgagttagtcaacaacaactcaagaaacgtatgcactattcatatgcacactacatttttgcttctttttaaaaaatcaaaattaagctttaatttcttgtcaatggctccatatcatcctatttggaaaattggcctctttgaaaggagcaaggagaacgacaaaattgctgaatgtgtcgaatgtaaagcccaaaaacaacgcaaattccaattcaagctttccgatggcagtgtttcttctttgattggccatctcaaaagcgacaagcacaaaaattccgaatacaagaacaaatttgacgaaattatcaagacttaa

SEQ ID NO: 82423 - DNA, 1330 bp, Heterodera glycines
  Genomic contig location: Contig_ID=SeqID_17875; Location=973..2302; Strand=+
  SCN-specific regions: Sequence locations=1-304,327-664,686-1227,1265 -1330
atgactcgcctagacaaagctatcatcaacctaatctgttgcaacaatttgtcgtttaacttggtcaatagcccacagtttcgagtattgtgcaagccatggagtgaacagctaaaagatgaatcacattaccgcaaacttttgcctgttgcaagtgaactagtcaagggaaagattaaggaggaattacgaaaatgtgattcattttcgtgtacatcagacatttggagcgggccaaatcaaggatttataaggttagctgaattttaccattttcttttatcaaaagttaagtctgacaatcgagggagttacaaacaaatgggaacgtgtgagacatactctcgcaattaaaccctttcccggcactcacactggacgtcgcgttgcagaaattttgtccgaaattattgaccaatgggaatgtcgagacaaaattcacacttttgctactgatggaggaacaaacatgaaaaaagttggttattagttatgggttgtaaatattcgttttttgcaggcatttgaggaaaaaaaacgaaaatggtcgaattttgcctttttatcgatcaaactgtgcggcgcatttattggaccgtgctatcaaaaatagttttggcaatcgagagggagaaatatcgggacttttttgtatgaaaacgacaatttctttaaaatttttcttaataattaagcaaattgtcgtcggattgttggaagggttaagcactcgattaaagcatttacagaattgaacgaagcacaaattgaggagggacttccgcagcacaagctgcttcaggtaagctgaattccggaataaaaacaccagtttgctgtaaatttaggaaatggcagttcgatggaattcttctttgatcatgattaggcggctttctgagcaaagggctgctattgaccgaatcgcatttgaacagaggaaatttgaattgactttgcaagatggcgagtggcgactgcttaattcactggagatgctcttggcacctttggaagaagcatcactttatttttgcaaatcaccgctttcaactcaaataccattttcaagagcgttgctttcacaattaaagaatttggaccttcgggtgaatatgtgaaaaatggatatttacaagggaattactgaaattgaagaaaatgcgttcaaagcttttggctggacttgaggaaagattcggtccatttggagaaatgagaagtgtgtatatatttttaaattttcttttaaatttcttttttagattacgatgctctttcaacattcttggaccctcggtacaaatatttatttgcaaatgacgaatga

SEQ ID NO: 82424 - DNA, 2011 bp, Heterodera glycines
  Genomic contig location: Contig_ID=SeqID_17876; Location=264..2274; Strand=-
  SCN-specific regions: Sequence locations=1-826,848-1311,1349 -1376,1404-1957,1979-2011
  Gene Ontology: Mol. function=electron transporter activity; Cellular component=integral to membrane; Biological process=electron transport
atgccctatctcttccgcccctcgtccgacatcgtcaaacccatctttttcgaatacaaatcagcaaattccggcaaaacgcaccatggcctgcttttactgcctgcaaatcgcaatgggaccgctaaattcccagtcattcacgcggtttatgccggcccgagcgtccaactcgtgcgcaacagttggtacaggtaaataaaaataccgaacatttaccaacggtaattaattaattactgcggtccttttcagtgtttgtcataatttgaagtacgtcgcctttggctacgccgtgctaatggtcgatggacgcggctcggcaaatcgcggcttacaattcgagtcggccatcaaacatcgcatgggcagcgcagagattgaggaccaacaggagggcatgcgcatggcgggggaacgatttggcgatctgttggacatggaaagggtggcagtgatcggtcggtggacaaaactggcaaaatatgagacgcacagtaacccatgcctttgtcctttcaggttggagttacggtgggtacgcctctctgctgctgttggcctgtttcccgggcacctatcgatgcgcgtgtgtgggaggagcggtcagcgattggcatttgtacgacacggcgtacactgaacggtgggcaaaacagaaagggaggggaggcgaagcaaaaacccaattcatagagaaatgtcattgggtaataaaaaaacggacagcattttacaggtacatgggaatgcccgacgaaaatgccgaggcttatgagaagtcggcactttcctccttcgtcccccgtctgcccaatgagtacgttttccgtcccctctcccttttaatgtgttaattttgtattgatttgtacagagagggacggctgatgattgtgcacggaatgattgacgaaaatgtgcacttttcccactgtgccaaactgatgtcggcactgattgccgcacaaaagccataccggtgaatagagagacaacccattttgttagaaattatcatttatttacaatatcataggcttatgctttttcccaatgagcgccacggcattcgcaacggcgaatcaatcgaattctttcacgccaacattctttcattcttcgcccgcgctttttcacccccgtcgacggcacttcgacaagaaaaaactgtgccgacttccgcccccctgtgaattgtgaccaaccgacgcttttttgttcaaattgacaaaagtcctttatactattttttgccacccccccccccaaatgcttcattacaattcattgaaaatgcctctcctcgccttaaaatgaatattattatatatatatattttttaaacagtcagtcatttgtttaacacaaataattctcttcccttccttttctttcttccgtttatttgtatgaaatacaatttgagcacaccgttcaaatgatgcaaaattcagcaataaaattctattgtaaaggaaatgaaatccctaaatgaatttgtcgcgatgaaatcggcaaaatgagaatgaattaatggccacgcggcatttgcctcctctctcactccgaacaacaaaagaaataatcaaaataattccaattgagaaattggaagacacaaaaaagaaaaggggaagtgacgagaaatttgcgtattaattatgaaataattaggaaattaaatggcatgtggtgacaacttttggggcgtattgagacgagaattgatgagatcaatagctgagtgaatagtgacgccgttctgttgaagttttagtggcatttggacgatgagacaagcaaaagacggagtgaaagttgcttttggcattgcttttccctcattttgcttttggcactgcttttccttttcctcctccgatcagtttttcccattgctttttctttccctctccgtcccttcccctttttcttttctcagagttcgtttctctgctgctgctcctcctgctcgcgcatcaccgtgtccaccagcagaagcaccgc

SEQ ID NO: 82425 - DNA, 649 bp, Heterodera glycines
  Genomic contig location: Contig_ID=SeqID_17878; Location=799..1447; Strand=+
  SCN-specific regions: Sequence locations=1-160,214-271,294-356,479-649
atgttccgacaacatttcttgttgaccacaatgcttttgtgtgcacttttgtacccgattattattggagttggcccgccagcgtatttggccatttgccaatggaaggattgtgtgggtgaaaagccggcccccggtggctctcacacggtgagacacgattttattttattatttttattttaattaattgttttaaaaaaaatttaaattgtgacgaaatgatttgaatattgtttgtataatacaataaatatgagaaacattgcataattcaaatattttattcaaatgaaaaaccatggattttttgaactaaatcgattttataataattatcgtattcatattttaggattaatttaaaaaaacatattcatttatttaattttgaatttagatttaataaaatatttaaattaaatttatttgaaaatttttgctttattgaaattaagaaaaatttatatatttttaagatgatttgtttgcccgcgactcgtccggcccaatgtccagaagaagcttggaaccaactgacagaattgaacgagctggagccttgttaaatttccaaattagcatacaatggaaaaatcgcttttttaaaaatgacaaatttcggcaaattgttttatttttccgataa

SEQ ID NO: 82426 - DNA, 425 bp, Heterodera glycines
  Genomic contig location: Contig_ID=SeqID_17880; Location=302..726; Strand=+
  SCN-specific regions: Sequence locations=1-143,173-425
atgatgcaggttgtgatcaggcaaatgatcgcaatcaaaagcaacgcagcatcgccaatgtaaattgcgggatggactgtcaaaaatttatgtaatttaatccgtgatcggaaaatgcgtcgtcagtggaaaatgcgacagtgatacaaatatttttaaaatgaaaaatttctgtagcattagtattgtagtacaaaaggcgaaaagaaccttgttcgtaattggtaatacagtagtttgtaactaccttgtttaaaacaaattttcagcagtttgatttcattaaaagaagttccctctgggttttttgagtcgctgataacgaatcagccaattttggactacggcaggggtgtgatctgtcctgatttgtcagatttgtcctgatttggaggtagcgaccaaaatttgtcctgatttcttaa

SEQ ID NO: 82427 - DNA, 736 bp, Heterodera glycines
  Genomic contig location: Contig_ID=SeqID_17881; Location=704..1439; Strand=+
  SCN-specific regions: Sequence locations=1-110,132-304,326-660,683-736
atgattctgccagaattgctggatatcatgagtcattttaaagtgaaaatcaaggacagaatggacaaacaattttttggaattattactggtcaattgttgcaccgtctaacagaaaaagaagaacaaacgttgaaaaatgctttcacggtagattgagctaaaatgtttttaaatattacaaattttcagtcattctacaaaacaactttggattatgtcgccaaatggtttcgcaccgaacgttatccggatcatattcaatggctttcgcttacagatcggcaactagtccatgagaatgtcattgaattggcctcaactttttcccctgatttatccgatactttgttcgatgaagttagtcaggtcaaccacattttgaacaacatcgacgcagcagaattcatgcgactgacaacagagtaaaaatggcaaagaattttcagcgctgattttcccagtctgtacaggctcgtaagcaaattaatgtcaattcccgtctcaaatgcatttgtggagagagtgttttcgctttgttcggcgcaatggacagatgtgcgaaatttgttgaaggtcgtcgacacagtgaagtcgctggcccaaatcaaagtcaacttcaattttacatgctcggaatttcacaaaatgcttatttcgaacaaaaaattgctcaaattgatcatggacgatcaaaaataccacatttgaacattttaaacgtgttttgaataaa

SEQ ID NO: 82428 - DNA, 206 bp, Heterodera glycines
  Genomic contig location: Contig_ID=SeqID_2935; Location=1193..1398; Strand=-
  SCN-specific regions: Sequence locations=1-206
attgaatgcacaggatgaagtgcgcaacacggtgaaggcgaatgccgattgtgagatggacccggaggagataagccccgtccctgatgactacttgacgaagtgataggtttttgaatgttaatttttttttgttgtaaaagcctggctctagtgcactttatgatccaatcaattgacaatcccgagtttttttttacaataaa

SEQ ID NO: 82429 - DNA, 1165 bp, Heterodera glycines
  Genomic contig location: Contig_ID=SeqID_2936; Location=81..1245; Strand=-
  SCN-specific regions: Sequence locations=1-768,798-1042,1064-1165
atggccatcaaagatcaggaattggttcaattcctcaaggtttgctgacaccagagaatttactccattcagcttttagaaacaagagtttccttctttcgcccattgttgcaaatacaattatttgctggccaacactgccgtcaccattccgttcggttacgcgtcctatttggtctacaaaatcggaggaggtgtcaggttttttgacaattaatggatgaaaatgaatggttcaggattcagttgcaccgactcaaaaatcgcattgggactgtacggtgcgacgctgctcagcggctgttttttggtgcccacactcaaaaaacatgatatcaaggcggtaggcaacctacatgttcagcttcctcagctccaagtcaaaccctttaagctgactgccaacgctgttgtccttgccggactttccggcgctacttcagtggctttctacaccatcgacaagatttccgcttattggacgtgagtgtatttgggagttgtgccggttatatttaccaattcagcgtgcccttcactctttgggccattttctgcgctggacttacggtgaaggcgaatttcgatgcgccgcccgcgcagccgctcgatgcgccgctcgcgcagccgctcgatgcgccgcccgcgcagccgctcgaagcgccgcctgccaacgacgagctcattctacagcaaatgaccatgctgagcgacaccgtccaaaacatgaacgacaattttgaaggtaaagaatgtcgtccctaacttcttttttattttgggttaaaaatcagtttcctagcgtttttgagagtgatggccacgaatatgaaatcgaatttgcccaattccaaatccctgacccgaattcgaacaaaaaataggtgttaaatgaattcgaagcttttacccaagaaaatgcatctttgaaaaagaatttcactttttcgaattcaagtccggggttcggattgggcaagtccaagttcagattcgtaagcagcaagcaccctcgaaacccctaaaaattatttttgatcccaaaattaaaaaaaaaaaatttccagatcgaatggacagaatggaagtgcgcaacaccatttccatgtgtgcctccattttggcgatcgtgatcagcggcgcagtttttttttgcaaaaagtga

SEQ ID NO: 82430 - DNA, 369 bp, Heterodera glycines
  Genomic contig location: Contig_ID=SeqID_2936; Location=1720..2088; Strand=+
  SCN-specific regions: Sequence locations=1-42,65-93,115-369
atgtacactgagattctggagcttgtcaacttctttgcacgctttttccatcttcgcgttccccgtttgaaggttttttcaatgcccacattcgtatattttacaatccaaaaaatttacacgattttcagattggaatgttctgcgaacattttgcaaataactgttttctccgcttccacctttattggaatctcaatcagcccaaacaatgttcgttatcacacaatttccttactcatgcaacttaagatgaagaactgcgtattatacgtgtgtcgaacgaatacaccgacgaactgttcacaaatgctgcgaatgctgttggtctccagttggatgagttgcttgcctgcatccctggtactg

SEQ ID NO: 82431 - DNA, 555 bp, Heterodera glycines
  misc_feature (12)..(13): n is a, c, g, or t
  Genomic contig location: Contig_ID=SeqID_2937; Location=37..591; Strand=+
  SCN-specific regions: Sequence locations=1-555
atgtacgtgacnncaggcgaagtgttctactgtcttggtgactattcgcctccggtgcctgtctgggtcgggtcagtctgtgcggatctcaagtacaacgagacgtccaatgtcacttttccgcctccgccaattccctcgtccattttgcccactcataccatccaaccgcttattccgcgtgccattggcggtgtctctgctacggtcgactttagtgttgtaaactatcgcattcagttgtcgttagtgcatccgcgtgagcttggctacgctaccaatccggtcagttttaaccccgtttttaatcatttgcccgaattttagtcgagtgattttgtgatgttccgttacgttgtccccggcactccgaattacaccgtcgaatcttttgcatcaactcgattcggttagtatgtttttgcatttttctattaattttcgcttttaggctcgtatcgtaagcgtccggactacgaatttgtcacccatcttcaacgttcgctgttgctgatgaacatgaacatccattcgtgctcggatgagagcacttaa

SEQ ID NO: 82432 - DNA, 2393 bp, Heterodera glycines
  Genomic contig location: Contig_ID=SeqID_2937; Location=1743..4135; Strand=-
  SCN-specific regions: Sequence locations=1-236,292-365,398-476,501 -945,968-1058,1081-1354,1377-1689,1711-2028,2050-2364,2390-2393
  Gene Ontology: Mol. function=extracellular ligand-gated ion channel activity; Cellular component=integral to membrane; Biological process=cell surface receptor linked signal transduction
tttccattcggcaagccaattattcggccggcttttgggacgaattgaccgtccaatttcacttccaacggcgctatgggtggtatttgttgcaaggtgaaaattgggggggggggagacaatcacagaaaatggcaaattaataattgggaaatttccctcggcaggattttatccgacctttctgttcatgttcatcaggtcaggtggaaattcaccgctattcaaaacaagcaaattatgcaactaattgctaattaattaattgcctaattatttaacggattaattccccttgctcattgtcagttggatccctttttatttggggcccaaggcaattccggcacggacaatgatcggagtggtaaaaagggggaagagggcattctcaactcattctgacacaaattattattcgcccacagaatgccctcctggcgatgatcttccaatttggttttgtttgctctttctccccttttccattttcctccccccaggcgcaataattcgcaatttgccgcgcgttaattatgttaaggcaatcgattggtggattctttgcgggatgactttcattttcgccagcctcgtcgaactcgcggccattggatttaaagtgggcaataaaattgggagattgaaatattaattaattcgaactttaaaaaaaagatgagaaatgagggacggacgacgcttcgtatgaaaaatctgagcaaaaggggcggaaggcgcaaaacggacgcatttgtcacttgcgagaaattggactatttctcgagaatcgcctttcccggtcattttgggattaaatatgcgagggatatgtgatcactgatcagtccgattcagcaatttacacgctgttcaatgtggtctactggacttattacatgttcattgccaagtcgacgacgtgaccatacaccaacaccatcagacaacaaatggcaaattaatacacgaagaaatgaaataaatcattacatatcgaaatccgaattgtgtgcctttttatgaagtgaaaattaaaatgatacaataatattccgaaaagtaaaaacaggaaacaaaagaattgatggaataaatgcagcaacaaaaaaacaaatagaaggaataggccattggatcatttactgccgaaaagatttgtcggtttggcgggtgccgagcctttgaagagcgtcccgctgcttgccgaactgagcgtgttgctgaacccgccaaatgtcggctgtgaaggggcggacgaaccgccggcggaagagacggaagtgccgaaaagcgacggcacagcggacgctgagaatgggaaaagcggaaagataatcaaattcaaatcacgagacatttgagaattatcatcaacccaaatatgattaatggttttcattccgtaggccattttttaatattaagtttgttttgttagaaaaaactctcaaaggaggaattagtgaattaaatcaggtttttcgaaagattaaagtattataaccattcaagggcgtagccagacccttggctttgggggggggggctgaagtcaaaaattctatttttaggggtgtatttttcttttttaagtcgatttttaggggtgtatttttggttttttgaaatcccgaattatggggtctattttacaaaatttttcgccgtttttcgccaaaaaacccatgggtgggtatatacgcaaatatttgcaccgaatgaggggggggggggcaaacaaaacgccaacccgtgaaaacccaccgccagccgaagttggaatgactgctgccgcagcaccgaaaggacttggcgcggtggcagttgtggttggcataccaaaaggcgttggttttggtgtgccgaagagattggtggaggactgttgagcggagggggcgaaactgaaggcgggcgcttttgaggcactaaaaaggccaccaccaacagagggctgaccgaactgagctaaaaggggagaaatggacttcagtattgtgactggggggatgagccaagaataagttaaacaaaaggctcttaaaatacttactcatcccaaattggggctgtgccgtccccggttgttgcttcggaaaatattcgccaagttgcaaaagcgcattcgaagagggaaaggcgtcgatgcctttcagtgccgaataagcgtcgatcagtcgtcgccgctctttttgcttctcaaatgggtcaatcagtgcgaaatggccacccaatttttgtcggtgttccacaaaaatgtcgcgcagtttcttaaaaaagtaattgaaaagaataggaataaaaattaacaaaatgatatcacgtcttgtaaatctttctctaaagtttccggggttgctgatcatgaatctatcatctatctaaaccta

SEQ ID NO: 82433 - DNA, 151 bp, Heterodera glycines
  Genomic contig location: Contig_ID=SeqID_2937; Location=2722..2872; Strand=+
  SCN-specific regions: Sequence locations=1-38,61-151
atggcctacggaatgaaaaccattaatcatatttgggttgatgataattctcaaatgtctcgtgatttgaatttgattatctttccgcttttcccattctcagcgtccgctgtgccgtcgcttttcggcacttccgtctcttccgccggcg

SEQ ID NO: 82434 - DNA, 1025 bp, Heterodera glycines
  Genomic contig location: Contig_ID=SeqID_2939; Location=335..1359; Strand=+
  SCN-specific regions: Sequence locations=1-96,119-391,641-668,848 -854,928-953,975-1025
  Gene Ontology: Cellular component=ribonucleoprotein complex
atgtacgggtacaatgggatgggaggaggagcagcacaatacaacggatacggcggagggatgggcggagggatgccgcaacaatgggggacaatgggaggggcacagcagcagcaaatgccaaacggacgaggtggtaagctagcagcagccttattaagagggtaattagtgtaatgactatgcttggtattccctaggtcgctttacggagggtattaaaaacgtggcaaacagtgcgatgaatgccatcggaggaggaggaggggcagcgaacggacagcaggggggaggaacttggggaaaattggccaaaacggcaatgaacgcggctggaatgggaggggggaggacgagcaacggacaatggaacggaaacggacaacagaacgggggaaggggaggaggaaatggaagaggaaatggaggaggaagaagagaaaatggaggaagtggagggagaggaagaggaaatggaggaggaaatggggaaggaagagcaggaaatggaggaggaggaaatggaggaggaagaagagaaaatggaggaagtggagggagaggaagaggaaatggaggaggaaatggggaaggaagagcaggaaatggaggaggaggaaatgggggaggaagaggaagaaatggaggtggcagcatggatgaacaatacgacgattatggttctgattatggtgatgaaggaacggaggataattattatgatgatgctgatgaagatggaagagaagggagacaaggaagtaatagtgggagaggaaggagtaggggaaatggaagagaaaatggaaataataacggaaaaagaaagcagagagaaagagaagaaacagtttatgatgatgatgataatgaggaggatgaggaggaagagggggattataataatgatgatgatgaagatgatgaggaaggaggggagcagaggaagaatggccgacggagcagtggcacacgagcaaagagaaggaagaatgaccaaaggagcagtaaaggagaaaaagaga

SEQ ID NO: 82435 - DNA, 613 bp, Heterodera glycines
  Genomic contig location: Contig_ID=SeqID_17884; Location=559..1171; Strand=-
  SCN-specific regions: Sequence locations=1-213,235-613
tgatccgtcgaagagtcctcaaaagatcgtggcagaagccgtcaaggagatggaactttatttcaacgcactgaacaacgcgctcattaagcatttgtctctcaacatcaacctaaaggcctatgaggatttgtctgtaacattggacaatggcgaggttttgttatagggttttctataccacccacaagaatacaaaaaataaactaacgttttggaattatttaaaaaggttactatccccattcacaaagttttgaaaaatagtagttgtgtccagttggagattttactgggcatcctttccggattcgagtcccagaaccgaattcgaaaagaaagtcccatttccaaatatatttttgttttttgtcgaatttgtgttttaaaatttgctcactttttaccctccccctccccttacagacccatcggctggtcaagttcgcgcgaatttccctaaaaacacctaagggaccaattgtactcaatttcgcagacaatcctgctgcgataaagccggcacgaattgccatccaaaatatggcagaaaatgtcactccacaagtggacgggattgtcataaatgtgcaaatcccaaagatcacaagag

SEQ ID NO: 82436 - DNA, 1288 bp, Heterodera glycines
  Genomic contig location: Contig_ID=SeqID_17886; Location=29..1316; Strand=+
  SCN-specific regions: Sequence locations=1-43,65-727,757-805,847 -998,1022-1288
atgcttctgcttgtgcttctcctaattttgcttttcccttccgaatctcttcaggctgccagttttatcactttgcattgtcaagtatttacaaaaagcaattaataaaagttgcaaaaatgtgctttgccagggcaatggcttatacgtttcgggacgatggaatgaaaacggacagacggcggatttgccacttccatccgaactcacaatgcaacgattagctcgtctaattaagtgcttatttatctgttacatttgctttgaaggttcgtgtcgagaaaaaacaaagatggcaccgtttctttcatcagcaattccaatcgaatgcttttgacagttttgccaaatgcatttggacgcattgttttggctcagcataatcaaccgagtaatcattcaaactcctgctgatttgatgagtgccttttcccaattattcagctgatgggtccaccaaattcaaattaattccctacacggacggcacttacgcaattaaggtcaatttggaatgaataaagtcgaaaaacactgcccaaggtcaccaaattcaggcagcttccattggcaaatacttgagctgccgcaattacgcctatcagctgttcgccaaccgggaaaaggtggaggggcccttcgaaaggttttacttggacattgtgacgacattggcggaatttgtcaccgcaagagttccgctgaaattgcgacacttcaaggcacaaagaaaacatggataaaagagcaaaaagaaagataattcaagaaaaagggctaaatactgcgtttagaaggaaagaacaatttatttattataaaattacaaattcaaaaattaattttcttcaaagtataaacaaaaaaatgaatcgaatttctggtgccctccgattgacccctaattgtaaggaatacgtccacagcagatggacggcgtatatttgagcattgcgtccaagtcaagtcactttcgctgttttgacgcaaaatgtccaaaatctcattattaattttaaatgagataagtagagaaggagatttccgaatctgccgggccgggctgactttttcagaagcaaccggttaccgggcccggtctcccaaaaaccggtgaaaccggattttcaaattgccgggcccggaaccggtttggtaaaaatttaaattctcacatgtatttcaaccccaaaatcgacaaaaaccgtgtcaactgttaaatttcggctatatgtcacttcagtcgcaaaaaaaggcctcttcaatttataaatcataatttttcaaa

SEQ ID NO: 82437 - DNA, 1241 bp, Heterodera glycines
  Genomic contig location: Contig_ID=SeqID_17887; Location=168..1408; Strand=-
  SCN-specific regions: Sequence locations=1-198,220-552,600-1241
  Gene Ontology: Biological process=regulation of protein activity, epigenetic
atgcaaaacgaacagtacaaagtgattttccttttccttttgctctgttcggtcgaaatcgttggaaagcgtggcgggggaggaggcgcaaggttcggcattattctaaaaatgcaacactaattctttctctttttccgttcagaggaggaggtggctttggcaggtgcactatttgaccctttacatttggtctacttctttattttggttttttaggggtgggtctgcggctcgcgcgagttcggccagccgtggcggtgggctgttcggcggcagtggcaacagtcgaagtggtggtggttccggcggtagctggacggcaccgaaaccgaattatggacagactggcggaggcggattttccaacacatttagcaaaggcacacacggaggatcggcataccgaacgcccaggcaagacgggccagggcttggcatgacattagtgcaatttagtccccttttgggtcaaaaattcttttttaatttttaaaatccaattgttggtcgttttccaacgtgattcttccttggattacacccaaagcgatcattttgttttcttttgtagctcattaaattttctaaaagattattttatgcttgaatttatctatttaattatgcttccaattttaagtgtctttgtttttagtttttcccgagggagtggagtcggctcacagtcacgcggcaataccttcaaaaatatgattatcggtgccgccgccggggttattgcttacgaggcgggcaaagccatcattcgttcggttgcttcgccgatgcagtgagtcattcaccaaaactgttattttccgagtgattgttcaccattaaatgcaatatttacttgtcattctgctcattctcactgtctttcagctggggcggtcgcaattactactggggttcccagtattaccccggaggcggaatgtcttccggtcggacgatgtgccgaatgccggttgatccctcggacccgcagtttggcaacgtgtttctgccgggaggacagtcgcggcccaaagagattgtctggtcgtgcaactacaacgaggcacggacaaaccttttcttaattgaccgctaattacccctcccccctcctttagcaatgttgtggctacgaatgctgtcctagcggcggttacggcggttggaactcgcgtccgggggtcggaatggggtatgcctcttggacattgcctccactgcttttgttacttttattc

SEQ ID NO: 82438 - DNA, 1251 bp, Heterodera glycines
  Genomic contig location: Contig_ID=SeqID_17888; Location=52..1302; Strand=+
  SCN-specific regions: Sequence locations=1-415,439-507,529-538,563 -993,1031-1251
  Gene Ontology: Cellular component=signalosome complex; Biological process=photoreceptor differentiation (sensu Drosophila)
gcactttacgctcgcgtgttggaccgtcagggcaatttcacggaggcggcgcagcgttaccacgagctgtcgctgaagcccggactgattccttcggagaagcgccaagtgctgcaaaatgcgctcacctgcactttgctcgctgcgcccggtccgtatttttttgggcattgcgagactggtcaataaaatgcttcacccctcttatttattatttagttgtatgactgaattttcagtttttttcataagttcgcttttccctaagggacccaacgcaatcggttgctcaacactttgttcaaggacgaacgctgtcagcagttggtcggccattccctgctgaagaatatgtatttggaacggctcgtcaaagggcccgaggtgagaattttttaaatttcaaactttgaaaattttcaataaaatgtcttattgtttaaaattttttaagactttcaagaaaaaatttttttattttctagcaatttttggaaatcaccataaattaattttcaaaaaagaaacgctacaaactaattttcttgaaaaattaaaacaatacgttttagtttttaaattaggttgcgagtttttttgtggcatggcttgaaatacacgcccatttgaatttggcactttcagctgactgagttcgaactctctctgtgcccccatcagcgtctgctcgacgccgagggcgtctcaattttgcagcgttcggtcctcgaacacaacattttggccgcctcgcgactgtacgccaacatttcattcgacggattgggacaacttttgggcattcctgcggcaaaagtgatttagaaaaatggaaaatgaacgccaaacggccaacgaatgaaataatttaaggcggagaaagtggccactcaaatgatttccggggagaaagtccaaggggcgattgaccaattggagcggacggtttcattcgaaggtaaaatgccggaaaagtggcgaaaatggcactagcaaaacttttgattttttcattcatatattttgccttaaagttttcttgaaaatggccatttaacctaacaaattattacgcactcttttcaagtgcccgattcgtccaacggtggcgccgattcgcaaattgcttctatctgtgagttggttgcttcgatcaacgagaaattggctactcgcttctcggagtggcacaccgaacgattcaacgcgtacaaaagagcacaccaacagcccaatgatcccatgcaatag

SEQ ID NO: 82439 - DNA, 105 bp, Heterodera glycines
  Genomic contig location: Contig_ID=SeqID_17889; Location=402..506; Strand=-
  SCN-specific regions: Sequence locations=1-105
atgcggacaaattgtttggctctgagttcgctcgccattttttattctgccgttttttctgcaattggtgcgccagtcgaaccgagcacaaaagaaagggcaaag

SEQ ID NO: 82440 - DNA, 1663 bp, Heterodera glycines
  Genomic contig location: Contig_ID=SeqID_17890; Location=209..1871; Strand=-
  SCN-specific regions: Sequence locations=1-136,159-1615,1638-1663
atgcacagatcggacaccgttaaaaacattatggagaaagtccacgagcagcagggtattccgatcgcagaacaacggttgttcttccgaggagttctgctcagggcggaaatgcctattttcaagtacaacagccgagaaaatgactttgtgcttttccttgtgccgtggatttccctttcaaggtcagatagagaagaacagtttttccaagaggatgcttaatgatagattaaaaccaattgatatatctgaagagtcagggtcggcagttcagctggtagaacactggtccggaaagccagagaagccggttcaaatctaacccgtcacatagtttcccctcaagcttctatatctcgttcataaattcacagataatagttaaacggggaaaataatgatataattaaatctaatttaatattccatgctaatttttgtcataattaagaaaggaatacaaaataaaagtgaaaaatacaaacggaaaaacaattggcttgaagattgatgcgtcggataccgttcagaatgtccagtggataatcgaggccaagacgggcattccgaaccgataccaaaggctcttttatgggggacgacttctggataagcgaaaaacattgtccgactacggcatcattaatattttttacaaatggcaagaagtccgtctcgaagtggaggagccgaaagaagcgcgttcttttggtaagcaatcgaacgttagcacagggaataaactgagtggacgactaccggacatttaagtatttgattatttgaggacccccgacatttgaggacatcaaataacccatatctgtctccgattttcgtgtcacagccgattcaacagttagctttaattatagtaaatttatatttgaattagagaaaatgattcaaattaaccaatcagattaaatataaacgcaacaaacagatgaagcaaagtccgaaaatttcgggtcctcaaatgacaggttctcaaaaggcggatccccaaatgtcgtgttctcagtatttcggaatctcaaattcggggttaccctcaaatctcagatctgcaaatgtcaaatcctctatcccactgcgtagtgcataaatattggcttttaacttctttactcggcacagttcttgtcaatgttagccagtaaatcttaaaatttctttgttcatgcacaattccatgtgcacttgttcaattagtaattaagccaatgattgttaattactgtacatatttagaaattacgataattctattgggacaaaaacgtatcaaaatgagagtgaaagaatggaacaccactcattacataatgaagaaaatgcaagaaattgaggacattccgatgattgagcaaacgctgctgtttaaggagaagcggctgagggacgacgaaacgttggcacaacaccaaattctgaagggagctgttgttgtactgttgctgagccaaccaccgatcacttatggtccgaatttaatgcttatgacagagtaattagggatttcttgaataagatcttgaaaaaccaggaagttcgagtttgaatatcgagcagagtttaagtaaaagggcgcaattcggcaacgaatgaatttcaaattaaatgttttattttatgggcctttttaatatttaataaa

SEQ ID NO: 82441 - DNA, 1003 bp, Heterodera glycines
  Genomic contig location: Contig_ID=SeqID_17891; Location=1516..2518; Strand=+
  SCN-specific regions: Sequence locations=1-16,67-241,263-351,374 -920,944-1003
atgcctttgatcggcgcctcctccaccggctccttctcctcctccttctcctcctacttctccccccgcgtccgttctccgttcgtccctctccgtccccgcgcccgtcgtctgcccaacgaattgcttactgagttggccactttcgcgcactacgactttcttgagctgagtcgcgccgcaaattcgcgtctgcgcggactctaccggccgattttacagcgaaaggacgcgaaggtgggaatataaaaggaaagaaaaagcggaagatatttccaatattcattgtatggctttaatttgccatcatcactttcagttgtgcgcgttgttcttcgacgacgtccgttcgttgtccctttggtttaaaaattgggctgtccgttccgacgctttgcgaaagtttgtcaatctccgcgccaccgtggacagcaaatggtgtgaggaggcgatgcagacgaagcccgacctttgggcggtgaatcgggcgcgagtgacttcccgcggactgatcgccgacctgcgcgagttgcggaaattaaccgacgaactcatcgccaccacccataaagtgggaatacaggcgcagatgaatagcctcgaaaattcaattcgattttcgttttccgatctctgccgagggtcgtctgatgcaaagtgccgccgccgtttccgcgccgcgcgattggctccgcgtgttcggcctcggctcctcttcctccgtccgtttccattctcagaggtcacttctcatcgccaaatcgttggcggtgcccaaaacggtggtggaccggtggctgaacaaagacttgccgagtctgaaggctttggtgcgcgggttggtccaactgttgcgcgacgacttcaaagacgagtccatcacgtgccaaagtcgtaagtttcggattccgatcttttttacgttttcttgattaatgattaaatcgcttttcagagtacaccggctgtatcaacgttctcaaaacgtgcgacactcgtctga

SEQ ID NO: 82442 - DNA, 341 bp, Heterodera glycines
  Genomic contig location: Contig_ID=SeqID_17892; Location=845..1185; Strand=+
  SCN-specific regions: Sequence locations=1-103,125-341
atgtcgtgccatggtccgaaagcaaaagtgacaattgtgagctttgcaaaatacgctttacaattactcgacgaaggcaccgtaagtttttggctttgtgtaatttttgtaagaaatttttatagattgtcgcttgtgcggtgcccaactttgtgcttcatgctcccaatttttgactatcaaatcagcgcgtgagtttggtgaccatttctgataaaatgtttggcgctagttaaaaagagcgctcttttgaaaattttttcactttttttgagacttttttttttgtttattttacatataatgatgaatattaagcattaacagcacaattatggcga

SEQ ID NO: 82443 - DNA, 1032 bp, Heterodera glycines
  Genomic contig location: Contig_ID=SeqID_17893; Location=273..1304; Strand=-
  SCN-specific regions: Sequence locations=1-370,392-984,1021-1032
atgatttggaactattttgctttttttacaatctctttgaactccgtttttggctttttatcaattggtgaccaaaatcacggagccttggacaactttcagcaaaatgtgagaattttcgaattattttctactgattttgaggggttgaatcttggtaattaaaatgttctaatctctatcaagaaaatttaaaatttgcgcgtcccgctgcggtttggaactcaaaactttgcgggacgggatcccgaaagataaatcccgcaatcgcccatttaaaatttgctggatcccgcacgggattgcggcatttttaaaatttcggaaaaattttgaagtaaattaaaaaatcgtcaaaaataaaatatatcaattttgaagaaatttttggtgctggctttaaatgggctcccaactctgctttggtgttttatgttgattttttgatacaaatcctcaaaacgggttttttttatgtatacctgcacgaaaatcctttttggcggtttttagagcctaaaaaaattatcactagccgtaagtgctttctaaaagcctgaaaaactaactcctttttgtcttttaggctaatcatcttattaaaaaaagtgcccaaaaaattgcattgtcgttcgacatgggaattatgccaaccgtacgacatagcaccaagatattttacaagtcccttccgcctcgagtcgtttttcccatgctgcaagtgttagttcttctggccatttttagcggaattattgcctcttttttgttcctcgcattgtttcgagcgttgaataaaggcactcaattcaattttcgtttgtcctttctcggccgacgccgttcgccctcctcatccaacggcacgaactcgcgcgttcccatttattcctcacaatcggtggttgagtacgagacactcgtctaagtgtgagttcacatcttttattgaactttacaataatgcttaaatttcttcaaacgtttttatattagaaaattgtaatataaaataattttgatacaaataaa

SEQ ID NO: 82444 - DNA, 1646 bp, Heterodera glycines
  Genomic contig location: Contig_ID=SeqID_17894; Location=1153..2798; Strand=-
  SCN-specific regions: Sequence locations=1-271,313-1223,1245 -1311,1333-1588,1610-1646
atgattcacgaaaacgtccggcaaaatggatatgaagaccatgaaccaccaccatccaaacaaaagaagtgtgtgtttgtttaagttttctttgtgcttttaaattttttgcatattttatgaattggcagtagggccgagtaaaaaatgaattaacaagtgaatctttggtgattgattgttagcttaaatttagggagactggcccacttactgtggaagtaaaagcgaaggtcaatggccaagtatccaagcttacaatcaaagtaccttttttataaaaaattttagttttataattttcttaatttaggaaggcatttcttcagtttcggacctttatgagatcatcgtaataggtggacttgaagaaagtgaattgaccaacgaagtggcattgtttcttggtaacgcagccaaattcttatccggaaaaggtgcctcggtgttgtgcctccctggagactgtcgtatgtttaaatcattaaacgcctaatattaattctatgtttttcagttgttggcggtaaaaatctgactgcgatttcgtctgcactgttcagcaactgccgttttctccaaatgaccggcgaccatctgcagctgcttcagtcctccgcgtgcgaacgaatcgacgaattgcatttggtgtcaattttattcgaatttttgaatagctaaaattcatcttttcaggagctcaatttcactattttggacatcacttcgattgaaagtaaagcattgacaaaatggttgaccggcaaaaaggcgaaaaaaagctcaaaaaagttgctcattcgaccccgaagtcgtgaatttgccacgagttggattcgcaaattgcaatcggttagttcaaaagtttaggtctttcccctctttttttctcctctcccacttttccctctgttctctctctctcttgcttttcttcaattattgcaataattcttgtttaggatcgtctcgacaacatttaccaagtgcgcgttcaatgcgagttcagcctcgagcaattctccattagttgtggcgccaatggaaccatgaccatggaaatgcgccaagacgggcagaaggattacttattgaacaaataccccaccggagaggttttgctttgcttaaattttcctataaattggctgttaaatgatagaaaatgccgccgaatcacgcctttcagctgaatgggcctctcattaaggtgtcctttgttgcacaacagaaatcttgaggtttggactgtttttgctgaatttaaaggtgttggggcagggaaatagacacagtttgcattattttgcaaattttaattccttttttcttcagtgttgcttctgacgcggttttattcaatttctgaaaatggatgaatttcttgctccggatgatcacattattttttgtcttttccctcactttctttttggttgagtgcgttttatttctcattttgcttttgattttctccctccgttggtgcgcactttgcctttcttttttttgtaagcgcattgaaaatgtttttgatccccccaccgatctctccattttctttgcctttgcattttcaattcgtccaatttctttggttatttattttaatcaaatgagttttcattgaatattttcaaaataaa

SEQ ID NO: 82445 - DNA, 61 bp, Heterodera glycines; identical to SEQ ID NO: 61697
  Genomic contig location: Contig_ID=SeqID_17895; Location=919..979; Strand=+
  SCN-specific regions: Sequence locations=1-61

SEQ ID NO: 82446 - DNA, 282 bp, Heterodera glycines
  Genomic contig location: Contig_ID=SeqID_2942; Location=2041..2322; Strand=+
  SCN-specific regions: Sequence locations=1-282
atggcttcaaattcaattgcggcttcgattggtgtgaagttgaagcgactgaattcgatggcatttgaattgatttgggcatatttttctgctgagtattctgagacgggtaaacgggtatcattatcatttgctgattttctggcaactccaatgcgaactgattcgagttggatggcatttgttgttgtggcaaattgggcaaatttagccgcggaaaacgaattggtgccgggggttgcgccggcaattccttcccccttagcttgttgcttggtttga

SEQ ID NO: 82447 - DNA, 274 bp, Heterodera glycines
  Genomic contig location: Contig_ID=SeqID_2942; Location=2475..2748; Strand=+
  SCN-specific regions: Sequence locations=1-16,38-143,182-274
atggccaaaaatgccaaaaaagggacaaaaacagtggcggatttcattagatttaaatttcaagaatgtttaggtaaatttttataatactatagctatctaaatggaatgcttttattttaagggaatgggttagtaattagtgaggatgatgatgatgataatgatgatgatggtaatgtggctatgttagcctctttaaattaatagtggtgccagctaatttatgaatattgattactttttaagcaaaactcaacaaatgagagagaga

SEQ ID NO: 82448 - DNA, 225 bp, Heterodera glycines
  Genomic contig location: Contig_ID=SeqID_17897; Location=122..346; Strand=-
  SCN-specific regions: Sequence locations=1-225
atggtggcgagtgtgtacagctcgcagacgacggcaacaagaccaacaacaataagtacacttgccgctgcaagcgcaactttcgcggcacacgctgtgaacagcgcgtggacgtgtgcagcgagcaggaaccgtgccagaatggcggcacatgcatgccactgcagtcggcagaaagcgacggcggcgacgactttcgctgcacatgcattcccggcttcacag

SEQ ID NO: 82449 - DNA, 298 bp, Heterodera glycines
  Genomic contig location: Contig_ID=SeqID_17897; Location=1498..1795; Strand=+
  SCN-specific regions: Sequence locations=1-96,264-298
atgacgaggccgaccgcggtgaagcgtgtggcgttgctgctggcgtgctcagtaagtttggcatgcacattcccccattggcacatggctggtccctaatttttttaaaattaattttaaattataaatttagaaaaaagcgtttttaatatttgaataacatgaatttaaagtttaatcaaaaatgggcaataatataaaaaaatctgtaaaaaatttaaaattaccaattttaaaataatttttttattattttaaaaaaagtgagaatgaagaaaatattttaatatcttatata

SEQ ID NO: 82450 - DNA, 869 bp, Heterodera glycines
  Genomic contig location: Contig_ID=SeqID_17898; Location=690..1558; Strand=+
  SCN-specific regions: Sequence locations=1-202,224-296,329-515,555 -689,766-869
atgcttttcatccaccgagtcactgttcaacaggattgcagaaatcccagacggattgtttggcggaaggaccccgctgggcggacaaatgtgcgcaaaacggttcgaagcggaaagcctttacataggtaatgtactggcacaaaaatgtgtgaaaactcaccgcactgtcaccgatacgggattgagaaattgttgaaagaaattatttattttaattaaagtcagaatgattagggattgggttggtttttggcaaaaaaaactcgcatattctgattttgataaacccccggatatatataattaaatgaaatatttaataaatgtaaagatcaaaattattttggttgcaaaaatttagcggttgtggattgtgttaataactgcccgagttttccgaacttttgtgacttaattgacctcggtctgagcccgaacgatgctaactacgcaagtttttcattatcagtatattaaatgtaaattatgatatttctttaaattcacaaaccaattaattaaatataaataataaatcaaataaaaaaaaacaattcgttaggttgttacgctgcttgaacgctcccgttctgctgtgcaggactgcatttactcacacgacgccactttggaggacctgaaaacacttggcctgtgtaagtcaatgacgtatgaagcatagaaagaaatataatcataaatttataattaaaaaaattaatttatttttttcacaattaatattaatttcaatatatttatgaaagaataatttgacagaaataattaactcattttttacagttcttcgtacagagaatagtcgcattactcgtggctacaaaattggaattggaatggcttag

SEQ ID NO: 82451 - DNA, 1137 bp, Heterodera glycines
  Genomic contig location: Contig_ID=SeqID_17899; Location=297..1433; Strand=+
  SCN-specific regions: Sequence locations=1-192,215-808,850-977,1004 -1086,1129-1137
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaatttttaaaaaattttttctccatcttcctttttgatactaaagcatcagagtgctaaaattaacttgtaaataaaatttggtgcgctttagagcactttctgaaaaaatatttatgaaataaaaaaatcgatttattcaagtgtccgtttggggtactcaaacaattatggggagggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaagctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaaaaaaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagact

SEQ ID NO: 82452 - DNA, 839 bp, Heterodera glycines
  Genomic contig location: Contig_ID=SeqID_17903; Location=229..1067; Strand=-
  SCN-specific regions: Sequence locations=1-230,252-533,556-839
atgcccaaatctaaaagacgacacgacgacgacttggcgaacacttcggcaagttcgtctgagcagcaattcgcggcattctctcaccgaattgacaaccttgaaaagttgcttcaacaacttttgcaagcccatggaaaagagaaagttgctgccaattctttggatcagctaaatttacgcttagaaaagttagaaggtttggtggcaacccttgtcgcacaaacggcaacaaatccccaaattaatggatacaacaacagtactcccacagttacgccaaaaatcccatggggctgtcctccgcaatttggtccatcccaaattgcccgaatgctcaacagtgccatcgtcgactcggaactgatcaaagaaaagtcaaagcgagcagttgttgaacgcctgccggaacacctcaatgagaaggacgttgtcaaacaaattgctgaagaatgtggtctgctgggcgaaattgacctcgacaatgttcacagacatccgcggacggcacgtgaggaaaatgcaaaaccgagaattgttaaaattcccttttcctcccaaaaatcccgcaatttgttcctttataaattccgctccacacttctcaaaatgcctgtgattcctcataatttgaccgctagacgtgatatgaccataaatgaactacaaatattgtatgacctccgaaaaaaggcttttgaggcaaaccaggccgctggcgtgtataaatacatcgtcattgacctggaactcaaaaccttgtccaacccaaaaccactcaggactagggtttcgtaggggtgcgcgagcaagccgcaaaaaattataaatgaaataaa

SEQ ID NO: 82453 - DNA, 150 bp, Heterodera glycines
  Genomic contig location: Contig_ID=SeqID_17903; Location=2818..2967; Strand=+
  SCN-specific regions: Sequence locations=1-150
gtggaggcatttttggggacggactcctccgaagtggaggcacttcgggagacggactcggccgaagtggaggcacttcgggagacggactcggccgaagtggaggcacttcgggggaaagtggaggcagtgggaccggtggtactggcg

SEQ ID NO: 82454 - DNA, 815 bp, Heterodera glycines
  Genomic contig location: Contig_ID=SeqID_17903; Location=1588..2402; Strand=+
  SCN-specific regions: Sequence locations=1-514,536-562,584-815
atgattaaggggtttttgcgcgctcagcaacttgagagagaaatcgcaagtttacacgagcagaatagtatcctgatggcagaacgagtcgaggtaagtacgattgggcatgtgtctttgggcttgagttcacactgattccaagttcccaattttttacctgcttgtttgtccataaagttatacatataaagaccaaaaacagctaattttggggttccattttctatttaaaacgcaaaaagaattgtgctttgtttattgaactattctttattttttctcttttagcgaaaccgcgacattgaggaaattcggcaaactgtgggcgaaatgcgcggatttcttttggagctcgtacaacaagtaattcgtagttttcgacatgaaaaatgggatgcctacgtttcagggcttcaaaaaatagtgaaaaagttatcatgattagacatttaaaaaaaattgttgagccctcttttttgtttttaataactcaaaaagaccgtgtttgcactattacaaaatttttaaaattaatagtataaagctctttttcgacatagaaaagatttttatataattacagcgcgagaatgaattgggacagctgcgtcaagctgttcagcaagtatgtttggtgtattcacttgaaaagggtgggtctttacggttttatataattatagcgcgagcgcgagttgcaacagcgggaagaagaacttggattgttgcgtcgcttctttgtccaggtatatttagttcaaaactccttttttaccagtatgaggatagttttttgtggcaaaaacccttga

SEQ ID NO: 82455 - DNA, 327 bp, Heterodera glycines
  Genomic contig location: Contig_ID=SeqID_17903; Location=2501..2827; Strand=-
  SCN-specific regions: Sequence locations=1-327
  Gene Ontology: Mol. function=myosin I binding; Cellular component =actin cortical patch (sensu Saccharomyces); Biological process=actin cytoskeleton organization and biogenesis
atgcctccacttccgccgagtctgttcccgtcagtaccaccagtcccactgcctccactttcccccgaagtgcctccacttcggaggagtccgtccccaaaagtgcctccacttccgccgagtctattcccgtcagtgccgccagtaccaccggtcccactgcctccactttcccccgaagtgcctccacttcggccgagtacgtctcccgaagtgcctccacttcggaggagtccgtccccaaaaatgcctccacttccgccgagtctgttcccgtcagtgccgcctgttccaccggttacaatgccaccaacatttccaacatga

SEQ ID NO: 82456 - DNA, 147 bp, Heterodera glycines
  Genomic contig location: Contig_ID=SeqID_17904; Location=277..423; Strand=+
  SCN-specific regions: Sequence locations=1-147
gaatgggagcgtattgagcgtgaacgtcgccaatacgaggagacggagttggagaagcggcgcgaattggaactcgagcgggcggaggcactgagacgcgagcagcagtggttggagcagggacgggccgaacgggagcgactggag

SEQ ID NO: 82457 - DNA, 643 bp, Heterodera glycines
  Genomic contig location: Contig_ID=SeqID_17907; Location=683..1325; Strand=+
  SCN-specific regions: Sequence locations=1-23,47-223,245-457,479 -592,614-643
atgtcaaaatccaacaaaaaaacgaaaagtgtcaaattaaacttctctcaatgtgaagaaaatcaaatcaatgcctccgctgattggcaacaaattgtgagtggtgcgacgactgaccaagacaatttattaatttatggcactttagccaacatcgtccgggaaaaactgcagcattcaaaataccaaagatgacggaattactccatttaattccgattgcgagaaggatgatgcaaatttcgagatgaacgaagaggaacagttgatgagcatgttagatttggcatacaatctcgatgggaatatcatcaacgaagtgatgagcacaatcgacaaaactttgaatggcaaatgtgccgtggatgaactttcgagcacatccgatccgacatcgataaatggggaatgtgcggaaaatggcaacagcggaatgatttgcacatccgacccaactttaaagggagacagttttattctcgaagttccattttcaccgataagaagggacaaatgcgttgatgaaatggatgatggagagattgttggtgataatcaaaatgacagcggtggtgataatgaatgtgatcggagagcgattgtcagccagcagcaggtgaaagaagaagcttatgttcagtga

SEQ ID NO: 82458 - DNA, 1494 bp, Heterodera glycines
  Genomic contig location: Contig_ID=SeqID_17909; Location=41..1534; Strand=-
  SCN-specific regions: Sequence locations=1-3,46-755,781-873,899 -1344,1366-1379,1409-1494
  Gene Ontology: Mol. function=profilin binding; Cellular component =actin cytoskeleton; Biological process=endocytosis
atgccggccccgccacctccgccgcctcctcccccgcccccatccttctcaaccaattcccagccattaacaacccaaaaagcgaccggagaacgggcaatgttgctgaacgaaatccacaaagggacgcgtctcaaaaaggctgtcactaatgacagatcggcgccagcagtggagggaaaggtcgtcggtaagcactcgcagattttaaaatgtatttcgattatttgtgggcattttatcattcaggcgaagaaacaaagccttgtgcgggtcgaacggcgactgccccttcgactgtcagtcaaaaaagcgcagcgccgaagccgggcggtgccatgaatttgggcgatttgtttagggacggagtcccgagaaagccgagtgatttgaaaaaccaaaaatcgtcctctgccggccaaattgtcgcatcgaatacgctcggtaggaacaatgggcagcagaagccaaggagcagcccggtcaaaaaggcaccaccggtggcaattgcatcggaaaatgtgaagacagtcgaaaacaatcactcgccgactccgccgccccacgacgcaacggcaaacaaatcgacgagggcggcggccattgcgaatttgcaaaagtatggggaggacattaactaattgaccaaaatctaactaattaataagaggggtgttggttggacagggcaaatgcatttttatgtgaaaaggctgacgattatttctttccccttttccaatcatattatttccaattaaatttatttttattttttttgcaacaattccatttaataaaaaagagagaccaaaccaatgaacttttttttggtgtctgttttttaccttttccctggcgcaatttttagtatttgcccctctttttgttcttttttaattccactattagaaagtactcccccttcactctaatttttgatttcattttttgttccccttctcccaaccattagcactcgcacttattaactttgtttcagttttagatcggtttcaacgacagcagttcccggcgcaccaccgcctttgccggccaaattgccaaaacaaaagacgaccattgctctacagcccagcaaactccccctctcgcagcacaaccaattccaaacacttcgaccaacgaaaacgcagccaaattcggacgagaaaagaacaacgttgcggcgaacgggaagtacagaggtaggctttgtgtcagtgatcattttatgcttaaactagtacaaattggtcaaattattcaattgcccattcgattgcttaggtttatttgtacactcaaataatgccattttcaggaaatccaaaaacgcccttcagcgcctccaccgccgccgattatgcgccgtccgggcgctcctccgccgccgcccccgcctttggcacggcctccaccgccgcaaatggcacccgctgtcaaaaaggttgagcaaccgatgaacaacgtaagcatttgttgagcaataaa

SEQ ID NO: 82459 - DNA, 312 bp, Heterodera glycines
  Genomic contig location: Contig_ID=SeqID_17909; Location=3017..3328; Strand=+
  SCN-specific regions: Sequence locations=1-312
atggacggtgccgacgaacttgccaaatgttttatgaggcagcgcggaatggacgcgtcgatgatcaacgacccgatccaagtgagtggaggaggcgaaatgggcataaaacttggaccagaattgtaaaagtgccaacattgaaacactttatccacccaatttttacactttagaaggaacgattcgcgcgccttctgaagacggacattgaagaagcaatgcaccgccgaaatgagaacccggaaaagcacacagatccaatgggaattcgggaagagagaacaaatgattggctgggggctgtgaaaa

SEQ ID NO: 82460 - DNA, 7875 bp, Heterodera glycines
  Genomic contig location: Contig_ID=SeqID_327; Location=431..8305; Strand=+
  SCN-specific regions: Sequence locations=1-153,175-291,322-1367,1390 -3816,3845-3909,3941-3973,3995-4077,4100-5200,5222-5449,5471 -5665,5687-5860,5883-6024,6046-6548,6571-6783,6805-6895,6923 -7244,7267-7756,7778-7875
  Gene Ontology: Mol. function=ATP dependent helicase activity; Cellular component=polysome; Biological process=mRNA catabolism, nonsense-mediated
atggacgacaacgcattaacgagtgatgctaggtcatcaagtgttgagagccctgcggggaccatctatgaatcattcgaggcgttgagcattgatagctcaaaagtagctgcaagccctgaggggtccgctaatgttggggctgaaattgttattgaagggactgaatccaatgaaaaccctgcggggtccggatatgatgaagtgagaaacgagggtagtagcgtcacgtttaaagcgatggaagtgccccttgaccaggtcgatgcagagggttttgcgaataatggctttgatgatgaggagcctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagacaagctgattgagtcggcccctggctttcagcgtaaactcgaagttggcgactttgtggcagtgtcctcctttgagtggaatcagaagctgagatatttggctgaacatcgccaagatgccacacagtcctgcaaattttggttcaatgagaattcgcaactgttgccaaagcaggctgatgccactggcgtggctcaactcatgtatatgaacatcggacgtaagcagatcaccggggtcgtttactggataaagaggaaggtccaaagcattccctccagcttcgttcacgcaaacatcgcgtgttgtggtctagcggtttcggcacgcataaatcggcgtcatcttgatggcatcaatccggaagacctcaagctgggctcacttgtgacggtggttgttgccaacattccacaggattcacttgtatcaatgggatacattctgccgaattcttcaccgtacaaactgggaacggaaagaagagccgaaacacctgaatttttcggtgcagttgcgtgcattcgtcctcatctgttggagtggccaaatctgaatgcaaacatgacgcccaaggtttatccatgctccgcggagcttactaaacatcatgttgtggcgatggagcatgttgttggagcagctctccagattgagatggagcgagaggttgacatgatgattgaagcacgctttgaaggaagggctcggaagttcgatggtgctgattgtctgattgtctttggttcgaggtcgaagaaagaagtgaatgagttggccaaggtctgggagccggagtcccaagtgaaggtcttcaaagaattgggtgagaagcattttgctctgggagtggtcaaggatgttgaggtgctccacgcagaatacgaaaagttggaactccacgtcgtcatcttcttgaacaacatccaggaaaggaagaatgtcgacatcgcaagaaaagtggatgagttcatccagggtggcagtgttgtcatacacccggtccctgccactgcggttgaggacagactgttctgtttccgctgcaacgtcccatcaataattgctgatgaagactccccgaggggaaggataatggcagttctgctcggccgtccagccatggaaggcattcgaatggagaagcaaagcgttgacgactcaacggattcgtggatggaagaagaaggaccgctccaccctgcaattcttgctctcaactcgcggcagagagtgactgcacgcctaatgttgggaggaggtctggtgcaacaacaggcgccgccaggcaccggcaaaaccaaagtcgctgcggcgatcattaaggcaatgatggactcaaatcccgggttccggattgtggtgatggcttgtgccaacattccagttgcaaagctggtacaagaggcggaaggcacatgtgctgaaaaggatttggatggagcacgagcaattgccttattttccggttttgccagatgcaaatacacggatcaaataaaagatgttcaacggcatacgctgccgaacaaagtaaactctgaggagttcgtcaagcagttatcgcccaatgtacagaagcaagtgaaggagtaccttgctcattgtgagaagaacccgcgcttggcgcctgagagagcgattggaaaagtattcaactcatgtatggcaccgaaaatagtcttctcaacagctgccatggctgcgaatttacttcatggtgaaggaaacatcactgatgcagacgttttgctctttgatgaaagcactcaagctcagtgggcagtggtggttcacttggttgcgcggatgcccaagctcaaggcattgcttttgacgggcgatcgtcatcagctcggagtgcatcttcaagaactacctgacatcttccactcaggctatggattggaaagcgtcatcctacaagccgaggcttcggttgggacgaactacactttcctcacaaagatgtacagaagccatccatttttggcaaagctcatcagctatgcctcatatgagttgcacaatgaacaactcattccagcaagaagtgctgaagaacgctcacttattacgggctcaggctttcttatgccagttcaagaatgtcctgtgggacttatcaatgctttttcatcgttccgtgtggacccaaaaagcgactcgctcacagatgaccatcaaactgaagtggcatcattcttggtacaagcactcctggaacattttggcaacgatttttcgtcaagaatcatcgttttgtgtatgtacacgtaccaaacttcggaaattgaacgaaagctgaagcactgcggtgttcgtgcactcacagttgatgcctatcaggcacaggagtgcgatgtcatcataatagtgacaacaagatcaaaatactccgagatgggatccggaaggacggacaacatgcacttctttgaagacgatcaacgggctactgttgctctttcaagagctcgccacgctgtcttcatcattggagacttggtttcaataagtacaggacaagtgtggaagcgcttcatcgaaatggcgataacaagaacaagtgtagtccgagccgagtatgttttggcacttctgggacgaacactcgtgaggtcgtcgacatgcctatttgattcggccaaaagagaatcggtggaggatgaaggctttcttgaaagttgggcattgaagcatgggttgcgcctggaccgaacgaatgcctttggacaacaacaatcacagcagccgcgagctccctcattccaattccaaaatcgccactttccggcactacaggcgacagggccctcagaccaagccggtccatctggcagcggtggtcaacaaagaggtgcgcctactttggcaccacagtatggaagaggtcagggaagacgtggcccggacaatcaatggatgcactacggcggaaacccgaaacgacagaagggtggcagacgctgaactcatttcacatgaagtcctgcgggtctcacttctcttcctttcaccatcgctacggtatgtctaagtagttcataattcttttaacttaattaattagttaggtaatttacattttaccctttcattaaatattttattttctttcattttttctgcactcacaagtttttttttctcatgtcacccctccttaacttccggcgttcgcactgtttacgctgtgatacaatcagtagggacactttcccaccatattacggtattaatggatttccgctattttttttttctcaaaacaatttttattacactatttcccataacagaattattgtaacactggcacgccagccacgcccattgtcggggccttttaatctaagcactgcacattcattcattcattcttccattcatttgatttactgttttccactttagatactcttgcacaatcccactgctaattctcatctcacatttcctcttattatgttttctttctcaggtgggggtccacctaatcaaagcgctgcggcgtcaagcaatgcacagacagaccctgaggggctctccaatgatttgcctgagttatcagttgttgataaactgatgtttgctggaaagattctaagcacaccagcacgtttgtctgatgtggacaagctccacacggacttagttcggactgaggatggtgtcaatcgtatgacacgtcaccttaacaggaagataaatcaaaccaatagggatttgactgaacttaaggatgatactcaaactctcataactcaagtaaatactctcgcaaatggttataatgcggttcaagtgttgcaaaacccaaaccagtcaccaagagccaataaccctcctgtcttaaattgggcaactccctctccactcaggaacccgaacaatagctttggcaatgctaatacttcggtggttgaagccatcatacctctcggcaataatgaggaagattcccaggatgaagaatttgaattaaatccttcgggattccatcatgttaacatgcttttcgcagaaagcagtccctctttcacgatattctctggaacatctccattagaattcgatcgttgggcaagaaagttcacggacctgcttgactgcaatggcagaaagtgggatgattctgaaaaagtggcacgcctcaaggcatgccttgatggtgaaccaagacgcatttttgataatttacttcctgcccacaaagcaacttcttcggaagccattcaaaaaatcaaggaaaaccttgacactccacaaaataaagaactcatctatcaggcactaagcatgtgtaaacaaagggaaggagaatctgtagatgagtttagtgcacgactgattcctctaattgaggccaccacggcagaccttacaactaatgctagtgaggaggtactctgtcgagcatttttggaaaaattgaatccaaatctcaaatttctcactcgaaccctgagtgggcccgtcagaagggatttccaaatattgagaatgaatgcacgggaagcagaaatgatgcatagagagattcctaaatctattccagcacctcttttcccaatttcggaacaacaaaatccgagattcaacaacaccgagccgccgaaccacccggaaggcaactttagaacatgggctcccacaggctctaacagagagcctataagtcccagacagaggaaccggaacaattgggataacaatgcccaagcctcaagaggctcttttaacagatcaaataatcatcctcaaaatgacagaagatggaacaatcgcacttccagaaatgatagacgatggaataatcaaacccctcaaaatgaccgacgctggaatgctcggccagtttgcaactactgtgggaaggttggtcacctcgcgtttaaatgttttaaacgtcgtgacgaatttacccaaccatctaagaatttgaatttcatcagagcaattgatgaacaaaacagactgataaacgatctatcaactaaagttaatagtttaacttttagaaatgaccaatccgctgaggcggcctctcaaaatataaaaaccattcaaaaagtatctgaatctagtacagacaaaactcattcatcaatgatgaatgatactctcaaagcaccctccaaaataagtaattgggaaaccagtaaaatggttcagccaaaattttttccagtgctaatgggtctgactcttatttcctctctctcttccactttagttaaagattttaatacaattccatccggtccaatgatttgtcaaactcgcgttcaaccaatgacgtggtcccttcccaaatttccacgatgccccaggatgtcaattgacacaaccaaaccactaactaaacaaagacgcaccatctattttcccaattcactcgaattttctaccaaggcctgggcctgtcgcagaatcatcaaaagtattcggaaatatactacaatcagtggtgtttctgtagaacaacatcttgactctgaacaaacattgatgagtcatgatgaatgtttacaaatggcaaacaataagcgctgcagcttagggtatctcaaaaatgactcaggattgtggcacacagataggaaaattgaccagacaccccgtccttggttattaggctctttttcctggaagaaagtccagagtgagaattgctttgcctttgaaactgaagtatattcgcacattggtgccacttcaattataactcctgcgggaaccgctcaagcttgttcttatgacaaaggaaactgtgtcctctctgacaaaactgtcttagtatgggtccctcaaaaggacaaaatgtgtaaatacagtcccatcggagtcatggatggacataatcttggaaatgtatggctttccactttaggcgacttgggtctaaccagctcaattgttagaaatatttcagattgcggtcgaaatattactgtttctgaccaaggaccagcttttacaattaactcacaaagcccacgccataaaaggggtatttttggattagattctgaaggtgtagtcacctcctctcagttagcggcacaactttcttatttacacactaacatatctcgttcagttaacattgcttttgctcaggcatttaactccttttgtgatttaatgcttgacacacaacgttgggtacagtcatcctatctcaatgatcccacaagccttacgaggttcattcaccaaaataacttcttaattgcgaagagagttggagtttctcttctgagaacatggccatgtgtccctctcagtcagtctgactttgaatttcgtccaacccataccaattcatcctgttttgaatttcttccaataatagtcaaattaaatggaaaggaacatattgctttcttgaaccctacgtatttgacagtctctcttcattctaaaacagctccttgcgaggaccagagaaatattttaattcaaatggctgatcgcacaattgaagttgaccaagtagacggaacaatcaacaatgttcatgtccatgaaatcagggaggttgagcttgactttggtaagccaacgcgcattccaaagctctcaccacatgccttccatcatctggtcattcttaatcttaccgatctcgccacacatgcctttgcttcaaacttggtacaagtaagtcaattcacataccgagctgataaaactcattcctctgaaattaaaactacgctctctgatgaatggtcagcactagaagaatctatagttcaaaaagctgtgggaaattattccctggcatggcaaatttggatcaccatttgtcttttattgtgcatggtagatctcctgacacgccttttctttgcatacattggtatcagacttcaagatcccgtagagacattaggtcgaccaatgatcaccactatagctaatctttttggcaggaagaaacaaaatctagactgcgataacaagaaccatcctaattcgccaaccaaaaccattggtcacattacttactcacatcttcgaagcgttgctgcaacgcccataaatgaggctacaggtcagtccatttttcgagatacgctgaatggtaactcatgtaactttattgaggcataccctcaatcatcaaactccaaggagttcaaaaaaatatggtttacaaaagaaactaatttctctgcttggttgaataattatctctcaaaaccagttaatcacgaaattcctctcctacttccgcggaactcaggcgaattagcacaattcctcgatgttgcaacacactttggaaaagaaattccaaatttcaattcaaaaattgtcccattagcagaatctcgggagatgaacatcttaaatgggacaagcaacgagtctctgcttatcaggtcattttggggcatatacacatgctga

SEQ ID NO: 82461 - DNA, 527 bp, Heterodera glycines
  Genomic contig location: Contig_ID=SeqID_328; Location=2813..3339; Strand=-
  SCN-specific regions: Sequence locations=1-310,332-527
atggctacaatggttggtaatgctaatataaaatttgctgactcaaaggttgagtttttcaagttcggaggaggaccttttgaggtaattggtgcagcaagggttgctggaagcaatatcatgcacaataccaagaacattggtaactctcttattacagagcgaggcctatgaaatcgttgttgtggaatgttttgggttctaccatgaatcagcatgtgtatatgccccaaaatgacctgataagcagcgactcgttgcttgtcccatttaagatgttcatctcccgagattctgctaatgggaccaatttttgaattgaaatttggaatttcttttccaaagtgtgttgcaacatcgaggaattgtgctaattcgcctgagttccgcggaagtaggagaggaatttcgtgattaactggttttgagagataattattcaaccaagcagagaaattagtttcttttgtaaaccatatttttttgaactccttggagtttgatgattgagggtatgcctcaataaa

SEQ ID NO: 82462 - DNA, 4841 bp, Heterodera glycines
  Genomic contig location: Contig_ID=SeqID_328; Location=420..5260; Strand=+
  SCN-specific regions: Sequence locations=1-493,515-693,716-857,879 -1381,1404-1616,1638-1728,1756-2589,2611-2980,3002-3273,3296 -3315,3337-3571,3593-4202,4224-4645,4667-4841
atgcccaagcctcaagaggctcttttaacacatccaataatcgtcctcaaaatgacagaagatggaacaatcgctcttccagaaatgatagacgatggaataaccaagcccctcaaaatgaccgacgctggaatgctcggccagtttgcaactactgtggcaaggttggtcacctcgcgtttaaatgctttaaacgtcgtgacgaatttacccaaccatctaagaatttgaatttcatcagagcaattgatgaacaaaatagattgataaatgatctctcgactaaagttaatagtttaaccatcagaaatggccaaaccgctgaggcggcctctcaaaatataaacaccattcaaaaactctctaaatctagtacagacaaaaatccttcatctgtgatgaatgatactctcatagcaccctccaaaataagtaattgggaaaccagtaagatggttcaaccaaaattttttcctgtgctaatgattttgagtcttatttcatctctctcttccactttagtcaaagattttaatacaattccatctagtccaatgatttgtcaaactcgtcttcaaccaatgacatggtcccttcccaaatttccacggtgccccaggatgtcaattgacacaagcaaaccactaaccaaacaaagacgcactatctattttcctaattctcttgaattttctaccaaggcctgggcctgtcgcagaattatcaaaagtattcagaaatatactacaatcagtggtgtttctgtagaacaacatcttgactctgaacaaacattgatgagtcatgatgaatgtttacaaatggcaaacaataagcgctgcagcttagggtatctcaaaaatgactcaggattgtggcacacagataggaaaattgaccagacaccccgtccttggttattaggctctttttcctggaagaaagtccagagtgagaattgctttgcctttgaaactgaagtatattcgcacattggtgccacttcaattataactcctgcgggaaccgctcaagcttgttcatatgacaaaggaaactgtgtcctctctgacaaaactgtcttagtatgggtccctcaaaaggacaaaatgtgtaaatacagtcccatcggagtcatggatggacataatcttggaaatgtatggctttccactttaggcgacttgggtctaaccagctcaattgttagaaatatttcagattgcggtcgaaatattactgtttctgaccaaggaccagcttttacaattaattcacaaagcccacgccataaaaggggtatttttggattagattctgaaggtgtagtcacctcctctcagttagcggcacaactttcttatttacacactaacatatctcgttcagttaacattgcttttgctcaggcatttaactccttttgtgatttaatgcttgacacacaacgttgggtacagtcatcctatctcaatgatcccacaagccttacgaggttcattcaccaaaataacttcttaattgcgaagagagttggagtttctcttctgagaacatggccatgtgtccctctcagtcagtctgactttgaatttcgtccaacccataccaattcatcctgttttgaatttcttccaataatagtcaaattaaatggaaaggaacatattgctttcttaaaccctacgtatttgacagtctctcttcattctaaaacagctccttgcgaggaccagagaaatattttaattcaaatggctgatcgcacaattgaagttgaccaagtagacggaacaatcaacaatgttcatgtccatgaaatcagggaggttgagcttgactttggtaagccaacgcgcattccaaagctctcaccacatgccttccatcatctggtcattcttaatcttaccgatctcgccacacatgcctttgcttcaaacttggtacaagtaagtcaactcacatatagagctgatagaactcattcctctgaaattaaaactacgctctctgatgaatggtcagcactagaagaatctatagttcaaaaagctgtgggaaattattccctggcatggcaaattgggatcaccatttgtcttttattgtgcatggtagatctcctgacacgccttttctttgcatacattggtatcagacttcaagatcccatagagacattaggtcgaccaatgatcaccactatagctaatcttcttggcaggaagaaacaaaatctagactgcgataacaagtaccatcctaattcgccaaccaaaaccattggtcacattacttcctcacatcttcgaagcgttgctgcaacgcccataaatgaggctacaggtcagtccttttttcgagatacgctgaatggtaactcatgtaactttattgaggcataccctcaatcatcaaactccaaggagttcaaaaaaatatggtttacaaaagaaactaatttctctgcttggttgaataattatctctcaaaaccagttaatcacgaaattcctctcctacttccgcggaactcaggcgaattagcacaattcctcgatgttgcaacacactttggaaaagaaattccaaatttcaattcaaaaattggtcccattagcagaatctcgggagatgaacatcttaaatgggacaagcaacgagtcgctgcttatcaggtcattttggggcatatacacatgctgattcatggtagaacccaaaacattccacaacaacgatttcataggcctcgctctgtaataagagagttaccaatgttcttggtattgtgcatgatattgcttccagcaacccttgctgcaccaattacctcaaaaggtcctcctccgaacttgaaaaactcaacctttgagtcagcaaattttatattagcattaccaaccattgtagccataattatattgagtgctttagtgtattcaaggagtcgttcgccaatcagtgcgattatacgtgcaaaaattaatggtttagaaattagggcactagctgatacgggagcaacgataagtgtagctcctctctccttagcaaagaagataggatgcgagctttatgagtcaaaagtggaagctattagcgtctcctcacatgtaataagcatatgtgccgtgggtgaagtaataataaaacttggtgatatatctctgcggagttcaattaattttatacctgatgaccaagcaggagccatgaaaaattatgaaataatcataggatgtgatatctttgttaacctgccaccaataacatttgacttcacaaaaaaggaagtcatgataggtaaatcaaaactaaacatggaatcaaatcatagtaccctctcaaacctaaaagttcgagctctagagcaccaccgaattcctcctggtactcaaatactggtcaaagccaggatagatactatcttctcaatagacaaggacattcttgtagaaaatttggacccaagattatctgatgaacacctaagcacaccagccacagtttcaaagcctaaggacaatttattgaacattgtaatttgcaatccaaccaattttcctaaaaatataattaaaaatatgtgcattgcgactgcatgtgaattaaacaaatctgatcatcctaatcttgaaatggaatgcacctcggatgagatcaatctcctgagggagtcacaaaaaataattcacgcagatccgtcatttaaagttgatttttcaaaatcatcagtctcaggtgaaaatcttaacaaattaaaggaattgtgtgaagtattccaagatatttttagcaaaagtcaatatgacttaggctcttgcactgcaggagagcatgatatagtgaccacgtcggatactcctgtgtcgtcgaagccacaccgaacaccattcaaatatcgtgatgaactccaaaaacacattgatcaacttttggcatccggagtcatggttgagtcggacactccatgggtctcaaatatcgtcctagtgcagaagaaggacggtgggttgagaccatgtatcgattttcgtaaacttaacgaagtgactgttccggatcattatccacttcctagattggaaacgatcatggaacgaataggtaattgccgctactattctagtctggacctgtccagcggatacctccaaataagactaacggaaagggcatcccgaaaatgcggtcttattactgaaaataaaatttttcagatggtcaatctcccttttggtctaagaaatgcaaccagtgcgtttgccagatgcatggcccatgtcctcacaggtttggacgattgtgtaatcgcatatgtcgatgatattctggtatacaccagggatgataactttggtgagcatctcaatgctttgagaagtgtttttgaaagatttaggaggttcaacctaaaattaagccctaaaaaatgcacattcgctgcggcgaccatgaattttctcggatacttagtcaatgctgacggctacactcctagtctaagcaaagtggaaataattaaaaaccttccagaccctaaaacaactcgagatgtgaaacatgtagtaggaatggcttcattctttcgtaaacatgttcctaatttttctacaatcgtagaaccattgaccagactaaccaaaaaggaaaccaatttcgagtggggtacagaacaggctgcggccttcaatgaagtaaaaagaattttgagtgagaaaccaatattggtgtttcccaattatgataaaccctttcacatcttcacagatgcctctaatgttggccaaggtggcgcactcatgcagtggaatgagttggcggaagcatatgaa

SEQ ID NO: 82463 - DNA, 530 bp, Heterodera glycines
  Genomic contig location: Contig_ID=SeqID_2943; Location=1304..1833; Strand=-
  SCN-specific regions: Sequence locations=1-326,349-530
atggtcgtttcaatccatgccattgaaggtgaacaattttgtgccgttgtctgcacaaattcacacatttttgtgcttaaatgcgccaagaacggttcccaatctgtcgaattggcttttcaagtcgatttgacttttccaaatgcggtgaataatcagcagaagttggggaaggacaacgaatgcaatccgtcggtaatttttcctccctttggccttttgtcccaaataatttttgattttttcgtcagattctctcttcagatgtttcagccgaccacaaactcctcgcggtggcaacgaccacaaaacacgtccttctctttgagttgcaatcgctgggaaatgcaattggtggcacttgggaagaaacgaaatgccaaaccattcccaagacaccgaccgcagtaacaaattgccattacaaaatgtgccaaaatttcgtcctttgcagatacatttttccgcttgcggtgacactcttttggtcggcactcggtccggttctctgctgcaattccgcgtcaatg

SEQ ID NO: 82464 - DNA, 1292 bp, Heterodera glycines
  Genomic contig location: Contig_ID=SeqID_2944; Location=343..1634; Strand=-
  SCN-specific regions: Sequence locations=1-53,75-294,318-663,685-1230
atgggtcgcgtccgaaggaggtgagaaaatgggcaaaatttcctaatttttcttccatccttcatttgtcaggtcgtttggacttgcaaagagaacgtcgaaatttgctgtgggacggactgttgcccgaatccgaattattctccgccgaacagtgaggcgaagtcgggcggagggatgggcaccgttggcaaagtgttgttggggtgagtcgaccattttcgctgccttcgaaagtctccgaacggtgcgacacgccttgtttttattcagaattttagcattgtcgttgtcgctcttctcttctgctgctgctgtgctctgttaacttacacttcttgtcgctccgtcttcgacaggtcttttaaatggtcatcaacagaatgtttgttagctttgcttaaaagggtttgagccgaaattaaatctgtcaaaaaaggaaattgtttacagcactttgatatcgttgtgttactatgattattcgtacaataggaagttcgtaaaatggagtttcgtacaatgaatttttttaaatttttcaacaaaacagcatttttctcaaaaaatcaatgaattttaaaatctaaaaaacccttaaaaatattgtacgaacttccattgactcgttacgatagatgcgcatattaattgtgatttgtgttttaatccttcagttgtatgccgggaaataacaccaaccaaaactacgaccagaccaaccatcccctacaaatacgatgtgccggtgacaatgtccacaacccttcgggtggggacaacatttataattcttttttaatttttgcactctttcagcaggccaagcttatcccatgcagccttattatcctccggcatcaaataattaccctgcccagccacaagcccaagctgtttaccctccggcaccgacttatccggcacaacctcaggcccaggctgtgtatccgcccaatccgacttcgtatccccaagctcatggctattaagagagcgaacattggctgattttctgatattcatccattcctgtttcaaaggatttctaacatattgtcacttgcaaattccataaccccacttcccatccgatgatttctttgacacacagtaaatagcccaggatgtatttactaacaactaaatatgcttataaaaacgtatagttcagacactcttttgattgcatcctcggtgctgatatactgtacatttgaaaattcagagataaatttatacaaaaaaattacaaacaaactatattaattttttattacaaaaaaattaaa

SEQ ID NO: 82465 - DNA, 204 bp, Heterodera glycines
  Genomic contig location: Contig_ID=SeqID_2944; Location=48..251; Strand=-
  SCN-specific regions: Sequence locations=1-204
atggtcgtttcaatccatgccattgaaggtgaccaattttgtgccgttgtctgcacaaattcacacatttttgtgcttaaatgcgccaagaacggttcccaatctgtcgaattggcttttcaagtcgatttgttcgatttgacttttccaaatgcggtgaataatcagcagaagttggggaaggacaacgaatgcaatccgtcg

SEQ ID NO: 82466 - DNA, 1226 bp, Heterodera glycines
  Genomic contig location: Contig_ID=SeqID_2944; Location=1752..2977; Strand=-
  SCN-specific regions: Sequence locations=1-42,64-297,319-394,416 -769,791-925,947-994,1024-1144,1166-1226
  Gene Ontology: Biological process=regulation of protein activity, epigenetic
atgaaatttattcgaaagaaattcattttttcgtttttgttctgtgccatccaattgcactgtttaaatgccaaaaagtttggcggtggcggtggattccgaggtggtggagctgctcgcgctaatccagcgccagcgggtatattttacaaataattaattgttggaaaggtaaagtgccattcaggtgggcatttcggcggtggtggagctcccgttggaggaggacagcctcattttgtcggaggaggagcaggcggattccatggaccgaccgggggagggttccatccgccgcctgcaggaggcggtttccacggcccatcaatgtctgctggcagtggcccgggccggtaagtggcaaattactggatatttaagtatttttgtctgaacaacaaactttacatgtatttttagaaaagtcaggcgtttactttttcattttgcggttaaaatcgaaattttcatgtcatattgtccctattttttttgttttgattggtctgcactcttaatatgtcactgtttgttttagctttggctccggaacgggactcggttcgtcgagccgtcccgggactttcacgactgcgctggcgggtgctgcggtgggcaccgttggcggtttggttgcctttgaagcgggtcagtcgtaggatggcattaattagtcggtactaatcagaatcctattcaaaggaaaagcgattattcattccttcgaccggcccttccaacacgacggacgcaattactatttggacgaaaaatacgcaaagaaacagcacggagagattcaggtaaacggtggcgactgaactgttccgttgccagaagaatggaacggtttttacattacagataaacttttcggtaatactaccgatggtccccctcctttttggaaaaaaattttcacgtctttttagaatagaaaataaatttttcaaaaggggggggggcatcggcagtattaccaacttttcggctttggctaatgtattttaattttttgaatttagtgcaaagtgccgtgggataagctggtcaaccaatcccctgctgcgacaacaaatcaaacgacaaatggcacatcgccggaacaaacactcgcaaatgtattcacgggagcattcaccccaaaaatttaaacaatttaaagaaaaaaaaacttttcaatcatttttaagttattatgaagagttaagagttagcaaattaaa

SEQ ID NO: 82467 - DNA, 2379 bp, Heterodera glycines
  misc_feature (1250)..(1250): n is a, c, g, or t
  misc_feature (1262)..(1262): n is a, c, g, or t
  misc_feature (1265)..(1265): n is a, c, g, or t
  Genomic contig location: Contig_ID=SeqID_2947; Location=208..2586; Strand=-
  SCN-specific regions: Sequence locations=1-22,48-141,189-498,543 -694,731-779,901-908,930-1219,1244-1402,1441-1454,1511-1525,1563 -1598,1629-1842,1864-1944,1991-1992,2017-2379
atgccaaaatttggcgctaaacttaaatttaaaaatttttattttttgacaggccaaaggccagcagaattgagcagcgcgaaaggagcagctcatcagcatccaatgaacgcctggaaaatgcgcttggcgatgagtgagaaattaaaaatttaattttaaaataattttaatttttaactatttatgagtccctactgttttgcaaaaataattgtcattgtctaaaaatgttattaaattaatgggggggggggatttctcgaagcggattcgatgagactgagacacccaaaaaatccggggtttttccgagtccggtctcgaaatttgatgaggtcgagatcacccaaaaaaaaaattgggattttttctgaatttacgccgagacttcttttgaatgtcatttgattacgctcggcaccgtcgggactcgggaacactttttttttaatttaaaaacgaaaaaacatttcgccaaatattgattggttaaggaaattattttgaaattttagttttttcattaatttaaatttattcagataattttgacagttcctttctacgccccagcttcttcatcctaccgaccaatcatttggttgtttgcggccaatgcttttgtccaatttgccaactttttggcacctgttttttgggcaattgaattcacccatggaaaaaaaacggcaaaaaaaaaacttaatattaaaaaaactttaaattacccgcccttaattgggctaaaaaaaaaatttgaattccccaatttttttaaaaaaaaaaaaaaaaaaaaaaaaaaaaaaaaattttttttttttatataaaaaaaaaaaaaaattttttttttttataaaaaaaaagaatttttttttttttataaaaaattttttttttgggtggtgtttctattgatttttctcttcaatttttgtaaaaaaatacaaaggccgaaggcggggaagatttaaaagggcttttcctaagggggtgtgggccggaaaggaaaaaggggttttgccgttgaaaagctttgccattttttttatttaatgtagaaggggtataattagggaatcgagtttttagggtttttttcccatttttttcctgggcggcactatgtctgaccgcaagaaaaaacaagttttttcctgattgattttaagctactttcgattattgtgcctatttctagttttattttatgcctaaaactttttaaaaattttgaaaaaagcctattntggtgttttgcncanatctattaaaaatatgcaataaaacaaaaaatacaccattaagaatcgatccccaaaaatgccagaaaaattcactcctaaaaatcacactaaaaattttcaaaaaaatacctctttagaatcgacgataagattttcaaaaataagccttatgaaactaaaaaatttctcaaatatttattcatttccaaaatttatttatttattttcttgacaagaatttttgattttaaaaattatttaatcaatactgatttggcttaattttatttcttttttcaataaatttattttaaacgtatgtttggcagtttcatcttaaaattcatactcaaaaataaattaaattttaaattaaatttagatgttactaagaaatggcaccaacaagcatgcgaaaagaggaaaaagaaaagcaaatgtacaaagattcgaagcgataaatatcgttgtaaatgggagaacgatgcgtgcgtcccagcaacggatgaagcggattacgaaaagccaaaaaagggcgacggattattgcaaaaagtgattgccaaagtgttgtcaagcgctaaaaaaccatcaccatcagaataatagccataagaaaagtgctgttggatgaggagacccatttccgagtagaagtcctaatatgtaagcactgtcaaatattgttgattggcgaaaatttgtgtgacaaaaatttgcataaaatttaattttcatcgtaaagaatttgtttttcgttttcattaaaattatcaacagcgctttatttttagcccaaaaactcttcgttttaacgtctctattggtccccgaaaatagttcatttaaacgtcacttatttgttagtcactgaaaattcattagtttaacatcacattggtcgcaagaaggtatcacctttattttattttttttgatttttcataactaaaatatttcaagactattttgaagcgaagtaaatgtttttgcttttgatcagctaacaaatgaagagataattcgccaaagtgagagaaattacaaagaaaggaacagggaaatagtactaattgtaagcattttttttttctcagcatagttgaaagttgaccaattggcactgaataaa

SEQ ID NO: 82468 - DNA, 135 bp, Heterodera glycines
  Genomic contig location: Contig_ID=SeqID_2947; Location=2975..3109; Strand=-
  SCN-specific regions: Sequence locations=1-17,43-135
atgaatttaggtgtaagattttaaattttaaaataaaatattcaaatcattttaatgtccagattttcttgatttttgttattgaactcaaccggatcaagcctgtcctgtcaaagcagaatgtttaacaataaa

SEQ ID NO: 82469 - DNA, 959 bp, Heterodera glycines
  Genomic contig location: Contig_ID=SeqID_17910; Location=2208..3166; Strand=+
  SCN-specific regions: Sequence locations=1-141,163-365,408-442,464 -504,547-805,892-959
atgaacgaacatctggctagaaaaactttacgggtggagtaccacgcgcctgacgccaagcgcgccgttcctgatcccatgaagtttgggcggaagcgcccagcgatggttgctggtttttggaatttgccatttttagagctcaatttattttgtttgtttcgtcggagctaaagtcttattatgattatttatatttcatattgaattccaaaattactaataaattaatgggattcaatgtagcatttgtatttattttagtcaaatgtgtattttataaatagcttcatgcaatggtcaaggtctcagcgattgaagtgcgttgtcaatttcaattttgcccatgtatattaatgctactgtttaaattacaatttagtttattatttatttagataatttttgtgttttatcttaatcttcgtataaaatgaaagtatttattttaataaattcatttgaagcaataatcaaattaataaccaaccgaaattctgccagaatatattaatatttaaaatatcataattaaaattttataatggaaattattatagttttttcctcaatttcaatgaatcgcgttgtaaaaaagaatacaaatctattaattaataaaattcaattttagcaaagtgtcatacgtggacaatgcgtatagtgcgcaacaaaatttcttgccatgcctatcaactcggatgcctgtgccacagtttggcactttctcaaatccgcctgattttttatgatgctgtatttcagttaattgttctcttatttcgtttttgatagatttatttgcaaaaaatttttaaatttaaaaaataagcatatttatttttgaaatagtttttccaatttaatattatgttttataaaattaaatttgttggctatcagctccatatatttgccaatattagagagtagcttagtattattgtttaaaattatta

SEQ ID NO: 82470 - DNA, 537 bp, Heterodera glycines
  Genomic contig location: Contig_ID=SeqID_17912; Location=331..867; Strand=-
  SCN-specific regions: Sequence locations=1-537
cactaccgactgcccctgctgattgtggccggccattacctcacaaaatattggctggccaccaccattcgttcggtggtcgaatgggcgcagaaaaaccgtcgcgtgcgcgtgccgctgcaggaacagctccgctggctgatgcccatcggcttttgcgcctcgttggacatcggactgtccaattggtatgtcaacaaatctctataccttttttggacccaaaatcatcgaaaattcgattaatttaaaaacggactgacaatgagctaaaatcccaattgtgatgtcccctcactcattaatctgtggcttcccaataagcctgtccgaaaatacgcgatttggaattcaggactgaaattttactttttcttgaatttcccacccccttggatttttcaaatttttttatttccactgcctaccttcattttaaattttgcccaggtctttggagtatgtcaccatttcgctgtacacaatggccaagtcgagctccattctattcattgtcggcttctccctgatgctcag

SEQ ID NO: 82471 - DNA, 1004 bp, Heterodera glycines
  misc_feature (296)..(296): n is a, c, g, or t
  Genomic contig location: Contig_ID=SeqID_17913; Location=368..1371; Strand=-
  SCN-specific regions: Sequence locations=1-545,567-1004
atgccttcacagtcgccacaactccgcctttcgtcttgctccgcttgctcctcccatgaacgccttcattttggcgctgacgacgaggaggttttcttaatggaaaccgtggaaaatgggcacgacgacacgcggcagcagtcgtaccacacggaacggacactgctcgcctcacagggcgaagaggacgaacggaacggagacgacacactgcagcaggtgggccgaaaaggagcaatgaaaacaacgggtgaccattggaacccacggaatgttgtccctttaggaagagtccnacccccccactttatacacgccttgctataggttatggtttttcgcacttaatgaattagttttttgattctttttttagtctttgatcgcgtcacattgtgccaacgttatttatgcgggcaaacaaacagatattgatattgaccataggaccatcaaattaaggctgcaagaaatcactgcccatttggctaattggatagcaaaaatgctggtaaaaagaccttattatattgaaaaatgaaagattatcttttattattttacaaagcaatcaaataagtaggcttctaaattatatggattaacacatattttttctgcgcatatgctatgaagaaaggggctcaaaaatagcatttctacgttatttttttttttggtttggtgaaggttttttgtccatatttcggtcttagtccatatttggcattttatgtccatatttgggggatttatgtccatatttggcattttatgtccatatttggcattttatgtccatatatgggattttatgtccatatttggcattttttgtccatatctggcattttatgtccatatcaggaaatcacttggccaacaatttcacgcactcgtgcaaaatcggcaattggtgattcggatatcgcagagagtgaaaatgagtatcaatctgtagcggaaaagataaaggatgaggttgaccaattaggtgcagaaat

SEQ ID NO: 82472 - DNA, 737 bp, Heterodera glycines
  Genomic contig location: Contig_ID=SeqID_17916; Location=58..794; Strand=-
  SCN-specific regions: Sequence locations=1-368,390-737
  Gene Ontology: Mol. function=structural molecule activity; Cellular component=lamin filament; Biological process=nuclear envelope reassembly
atgaaagtgcaggagatacagacaatgagtgcgcggcagaacttggagcagaactacgccaaggaggaagtgaagcggctgcgcacgcagctgggcgacatgcgcggaaagttggccgatttggagggacgcaactctctgctggagagacaggccgaggaattggcctaccaagtggaggacgaccaaagggcgtacgaatcggcactgaacgacaaggacgcacagattcggaagctgcgcgacgaagcgcaggcactgatgttggagctgcaaatgttgctggacaccaagcagacattggacgccgaaattgccatttaccgaaaaatgctggagggggaggaggacagatcggggctttatcagctggtggagcaggtggtgaagacgcagaacatccgccgtcaggacgaagctggtcagcagttgatgtccaaaagcatttgccctttccttctattctttcagagtctcagcgcattttgcgcggcgaaaagtcctcccgacaatcgtaccaaaggtcggccaaaggcaatgtgtccattttggagacatcgcccgaggggaaatacgtggtgttggagaacacccaccgatccaaggaagagccaatcggcgaatggaaattgaagaggcgcatcgacggaaaacgcgaaattgtgtactcattccctcaagagtttgtgctgaggcccggaaaaagtgtcaaagtcagtgcgaatgccaacagatga

SEQ ID NO: 82473 - DNA, 1118 bp, Heterodera glycines
  Genomic contig location: Contig_ID=SeqID_17917; Location=1874..2991; Strand=+
  SCN-specific regions: Sequence locations=1-461,483-553,582-759,782 -812,834-1118
atggcaaatgaaattcttgaatttccactgaaatatgacaacgatatacactatttaaaagtccgacgtactgatacggtgcgcgaattaaaatttgtcatcgaggcaaaattgaaaattcccccggaagaacagagattgatgattggcagtgagtcaattctttcataaaatattttactaaatcaactccatccagactgtgtgcagccggatacccgccttttgagttcaatgaaagggctggatttggtgcgtgagacgggccctgctgctcctccctaaattggcaatgctgagtagtttgagaaagacgaatgattattggcttttgactttgtttgttgcgaataaaaattaaaaagcaaaaagttctcaaaattttcatttgtttgaacacaacattatgtcctttacataatttcgtaaaactttttattatttctctctatgctcagatggcattttaattgaaaagaaccggcgagacgttccgtttgctgtacgatgtgaagggacggtttgtcatccaccgaatccaaagtcgtgaaggccagtacaaactgtgcaaggtgaagaaacaggcggtcggtgacaagcaagtgccgtacattgtcacgcacgacgcgcgcaccattcgctacccggacccgcacatcaaggtttattgaccgtttagacttaccaagttttatatgccaccaaaataatattggcatccagtatagttttcggtaatagtgacaaatagctcatttacaaaattaaacaataaaagtaaaaacctaacacaaaatcagttatgtatgcactgaataggaaagtgccgagaattcgctctaaaatgggggccgtgtcggattccgagtccaaaaaatctccatgcatcatactcaattctgaaaagctcattttgattgttagtttttatgtgtatctgaattcttgccgctttttcacaaatactgcccagcaattgtcaaaatgtcatccaaatttgttttttttaggcggacgacaccgtagtgattgacattcacactggcaaagtgacggactacgtcaagtttgatgctggcaacatttgcatgatcactggtggacccaacattggtcgt

SEQ ID NO: 82474 - DNA, 781 bp, Heterodera glycines
  Genomic contig location: Contig_ID=SeqID_17919; Location=1809..2589; Strand=+
  SCN-specific regions: Sequence locations=1-178,200-210,233-236,277 -704,727-781
atgctcgatcaaagagctcgaagcatcaacagaaaacgcggaaattgcaaacgaattttttcggaacatcggggccaggagggaagcgttcagaaaaaaggacatgacggggaactcaatcagaaaagtcctgattcatgcggaccaattggagaggcggtactcagctgaatggccaaaaatcatttgccaaacattggggcacttggcaaaaatacaaacttttacaaaagtgcttttttatttgatatttttgaaaattaattataaatttaaggcacaacccctgtcgccacgggatttggacgaattggaaacgtcgattgatcaatttcggacattcctcaacgatcagccgcggatgcgcactttgctagccttaaaaccaaaggtccacttgctgttgaaccattttgtgccgttcgccagacaacaccaatttttggcacttttagacgagcagggtcaaaaagcattttgaaatttaagtcctggattttttaggtgatgaagcattgcattcggtgtggaggcgattggaacagctgtggaagacaatgcctgatgaagaacaaatgcggcaattgttggaacaccattttgtgtcaaattggcttctcgacacaggaaaaatcgacgaaatgaagcgggtcagtttggtgaaaattgggtttcaaataaaattcccatgcctcaggaccgtgaagaacaacaggaagaaatcggaggccgggagagcgacgaagaaagcgatggagaagaacaattcgattttgaataa

SEQ ID NO: 82475 - DNA, 1701 bp, Heterodera glycines
  Genomic contig location: Contig_ID=SeqID_17921; Location=313..2013; Strand=-
  SCN-specific regions: Sequence locations=1-396,418-464,486-1472,1501 -1606,1638-1672,1700-1701
atggagcaccacgccaacacatccatcgacgacgcactgctcgtggatgacaatgaaaagcagaaaaggctgttcagtgagttttatgggaaaatttgatccagagggaatagggaagagacggaaagaataaatattagcaaaaatcgggagtctcgaaccggaaaatcccggtagaaaaggcctagaaaatttggaaatttttcacaaaaatgtataaaatgcgtcaaagttagtcacctttttcgtgccggcactgatttattatgtcaactgatcagtaaagataaagatgctttcttcaattattacacatcattaaataagttagtctgaacaaattccatagatatgatcggaacaaccaatgaaaagactgactgttctgatcatttatcagtaaaaaatggagaaaattgtgaaagtgatagctggtcgagacaatttctatttcccattttgagaaaatttgtgtaaaaattttctatttttttcagtgctcggcctgttcatattgttttgttgggtggtcgtcataattttgtgtgcttatccccaggttagtaaaaattaaaaatttgtgggaaattatgggataaaacccaaaaaatcactcaaattttatagctttaccgtgatttgttgctacggtatgtgtgctgctgttttgcaggcttcgcagtacggtaatcaggagatttagattaatttaccattcctaaaatagagcccccggtggctctattttcaatccctctaaaaggggggggggctttattttagggggtgcgtgcattattttagtaaatatggtagaattttttttccttttggccgacgagaaaagtgccgtcaaagagcggatcaattggccaaagcgcgcgaaagggtccgagctgcctccaaatcgttcatttccgtatcaacagctgtcagcccaacagcaattatgctcaaagaggtgccgcccaaaaaaacaactttttaatcggcattttctaagccgtctaattaaggaaaatttatttttcaatcctaaaaaagttgccggatcctaaatccaattttcttaaaaaatcgctcaaattcgtaaatttagttattttttagacaaaatctgttaatcagaccagagatcgggttcaattgtcgagataaagtcgggcaaattattcattctcgggattgagaggggatttgcataagtgttgaatgaacgcagtaaaatgccgggaattgatttttcatcactaattgcggcattccatataaattcggcacaaattcccaaaaaatcgcttttttttaaactggcaaaatttgatttgcagataggactttccgagctgaggcaaggcaatgcgatggaaaggtggcatcattactaccagagaacctcaaagtccgaaccaatcggtggccaaaaaaggggcgaaacggagacaaaaatatttttattggacagatgggccagaggggaggaagaggaggaggagcaaaacaacgaaagataatgatgaatgaagccaaaagtgccattgtattaaatgaaatttgcaaaaaaaaatatcgactattacgaccgcgggtcagctgattccttggcttaacattcagagcactgggcagaaatcatacacggtcaacgtccacaaggaccatccgtctcctctgttttaattagacagtcggattccccga

SEQ ID NO: 82476 - DNA, 2371 bp, Heterodera glycines
  Genomic contig location: Contig_ID=SeqID_17922; Location=496..2866; Strand=+
  SCN-specific regions: Sequence locations=1-223,245-584,606-610,632 -666,688-1037,1059-1150,1201-1534,1556-1830,1873-1875,1900-2371
gcatttctccgtgccaccaccagcacttcggcctgctacacaattaaatttaatgttcacgagtcaacgctaattgtgccatttgaattggtgaacggacagacccaagaaaagttgacactgaagaaagaacggaaaaatgatttttataataattattggtggctgttgaagcgatgcccaattagtgaaaaagtggcggcggatcaatgggaaaacgacgaaaattccgccaattttaacattgtccaatttgcgcttaacagcattgacaaaaatcatcactgcattgggtaggtgagcagaggaacacagcttttgcttttgttaatttgagattaccaattttaatttgttgcatttaattaggtcattatgtccaccagcggcgggtcaaatcaaaggaaagggtcgtctgaaaatgagtgccgggcccagtggcaagagaaagaaaaagtgaatgcaattatttgagaaatgatcgatcatttttaatttaatggacaaaaagctaatttaatgctgtattttctctcaaattattcctcatatattattttatttattggttttccttctctcttaaaacatttattttattgtttcgaacaaatcagaaaaattcttcaaaaaacaaatgaaagtgagagagcatttctgatgagagaaaataaattagcatcaaataaatttcaattggtgagattgatcatttctcaaataaaattaattcacttctgcgcagtcattaaaataatcactcattccgctgattttttattgaataattttttcaagcaaatataccaaaaacattgttgaaaccaccttttacttggttaagaattttaaaatttagcctattaaatttattttgaaaatgttattaggtatatttttcaaaaatttccgatttccgacgttttgggggtcggaatttcgatttgcgctttccgaaaaaaattttttgagcctcggaattccgaaaatttttggggcctctgaatgtcatcagttattgcggccattagcggtgggtcagagcaacaaaaaagtcctctatctctgcggaagagaattaattgaaaaatgatcgattgctttgaattgattattggctctgatgatgctttttttcttctttttgcagtttttttaaaatttaatattattttttctaattatttttaatgattttttcccacatttgttggttctttcataatttcgaatacatttaaatttatttgctttttctcatctttttatgcttcttctctatattttttgaggttttctgcatttgatatgtaggtttatgaaaaaatgactatgaattatgtgcatatttaaatattgtatgctttttatttaatttaggtattttatttattgctcgtttagtctcgcttctattggaaagcaaaatgggaagacgtcgacgtcgtttaaggaaaatgtaagcgaatttgtggactaagttagatcgggaattatttgtcgaaaatttcagttggatttgtacggatgtttggatggacatgttcccgttttttgaccgtccccaactcggcctcaaattggcacttctttcgcctcgttttgatgttttagtggacaaatatttcgatggcaaaagcgaattgccaatttggagaccaatcgaaattcgtaaggacagtgtcgcaaaagtgccaaagttgcgtgtgcttattgatgccaattctgttgaatttccattgcccgaccattcgctgcacaacaaaattcgctttgaggacctttatattgggtaatccttaattgtttttgacgaaaatttaaaaacaaaattagttaattctaaataattaattaattatttaaaattaaaacaattaaattaaaaaagaatcaaaagcaatttattttccaccatttttagtttcattgatcactccgtcatcacttttctccgttccaatcaacaaatttgggacaaaggcaccaatttggatttgtggatgcctacatcataccacatttatgtcaagcggtgttggaaagttttggtcaatgaaatttggcccatttttgcgccgaacattcacaacttttccaatgctaattggttgttgtacgaattgcgtcgcctcatctcaccaacaatcctcaccgatctaagcccgctgaattcaatactttctgggaatctgttgcccgattcaattgctgacgatggaccaaatgcaactgctgaccaagtgttgtccaaatggttgcacactccgcgcactgatggccaactgaaccgattgttttgtggcaattatcctatactgatgatggatatcaacaaatggatcatcaatttcaaagaggtcaaaaaagg

SEQ ID NO: 82477 - DNA, 2824 bp, Heterodera glycines
  misc_feature (2481)..(2481): n is a, c, g, or t
  misc_feature (2483)..(2483): n is a, c, g, or t
  misc_feature (2508)..(2508): n is a, c, g, or t
  Genomic contig location: Contig_ID=SeqID_2949; Location=1414..4237; Strand=-
  SCN-specific regions: Sequence locations=1-265,289-416,439-585,607 -635,708-753,775-805,827-1138,1166-1226,1302-1516,1551-1862,1885 -2201,2244-2324,2346-2427,2449-2526,2604-2617,2682-2824
atgagtgcgttcgtcaatgggttgcacaaaatttcgtctgtcaaatggtcgacctatggccttgcctggggccttatcaccttcaatggcgcaggcatttgtctcttcatgcattacatcgcccagaagacgtacatgggatcgccccacttcaaaaaggcgatggtgcgttaaccgaatttgggaaaagaagtcggattcgtccactcggaaaaagttaattcccgaaaaaaacgttttcgtgtttgctgattgatcgttgaagaaacatccaagggaatttattttaacaaatcagagctctcaaattggccaaaaattttaagaggcaaatttagttataataaattgggaattttgcattttttaattaggtatatggttgctttttgtttgtgccatcatttaaattttccaaaatattatatatttattttacactgtttttttttcgtttttagctcattttcgatggacatgacgaggccaaaagtttgttgggtgaaccggtgaaagttgggaagctgaacatgttggacaagaagaggaattacatgcgcaaaacggaagcgggggtgcgtgaaatttaaatcattttaacaatgttgttattaaaaaatgtaaaaaatgttttcctcccaggccgggaatcgaacccgggtctcgcacgtgacaggcgcggatactaaccactatactacctgggaaattgggaaatgggaagaaacgaattttttatcctcaattcatagcatttttcttttaaatttatgccattcaaagttttcccagcggccccatctattttaccatatttttgaaaatttgacctcaacctggcaaaaatttgtcattttttagccagaaaagtttttcttggcgacgaaaatttaaaaatttcgcgagaaaaagatttttggaattttggcccaaagaaccaaaaataaagtcttcgcattcctacctccgaatttttttctggctacgggcctgggtcgccggaccgggtcggtttatttaaatggatttagtcaaactcatcccccatctaaaaattcgaaatattgctggaatatctaaatttcatgggaatttttgaagtcatttattacttcaatataataaaaacaacgtttactttttaaataaatctctttaaaaaatttgacagtggaatttgacaatttaattcaaattgttgttgtttaaaaaaatcaaaaaatatttgcctcccaggccgggaatcgaacccgggtctcgcacgtgacaggcgcggatactaaccactatactacctgggacatgttgtattggacgaaaaaattatccaaatttcaataaaaatattatgaaaaaccaaccatttattaaaatttctttttcctatttactttttaatattttcaatgtttagcttcacattccggtctgtggaacccattcatctggctttgtggacgtattttctgagagagaaccggacgaggtgagcatttgagaaatggttgctcgggagccccccacccttcccccaattaaaaattttattgcttttaatccgttttcaattttttttcgggacccttaattagcgtgttttggaaaatgcttgaagaaaattcctttcacttatttgtaaggatgtgggtgaactgcttgagttaaataaataagaaatgatcgaccgagaaaattgttcatcgtttgcatcgcccaaaatcggtttgatcggctactcatttctgatcgctaatcgggggtcattaaaaggggaatgatggattggcatagcggaatttattttgggtaatcaaatcatgtgattgatcaggttacatttcctcgatttccgctttttcaatcgccttttttcttacccttttaaaatgtcgccaaagactggaaagttcgcccactcaagaccctattgacaccgctaattactataatatttttttcgagagggttaaaaatcaggggaaaaaagctccgtaaaatgacggccaaaagcaaaacaattaggccggatcatcccatattttcattctgatttgaacgcctttaagtcctcgttcaccatgcagcgtatggtgttggaattggacgacggcgagcgctttttgatgtacgaccgggcggcggaggaaaagcggcggaaagaggcggaggaaaaagtgccgaaaaagagaccacgcggacgatgagaaaaacaaaacaattcattattatttattttaattgtagaaaagtgcttccaatgggagaaagcagagaaaagtgtggcggaagtaatgacaaatattttttggagcgtttttctttgaaattttggcccaaaattttaagtttaaatgcagtaaatccaaaattataactctttcaactcatttgcatcattttgctatgccattcttcaaaatttgaattggaaatgccctttttggaggtcctccgcatatgccagcgggttttgtccgccancnatttttcctcgggattggatttttngactcttgctcgtcatcattttttgtttattttttttttgttttgcttttcctttctctcccatcgtcccttctctttttgttgtccttccttttaacgatgttttgtggaaagagacggaaaacagacacaaaaagaaagaaacaaaaaaaatgagagagagagagaaagaatttatttgaaaattgtgcaatttcttacctacatagaaatggatagaaaaattttttttagaaggaaatgacccccccccccccccaaaaaaaaagcagggaaaatgaaaccttattttactccccattttaggcacaataaa

SEQ ID NO: 82478 - DNA, 2201 bp, Heterodera glycines
  Genomic contig location: Contig_ID=SeqID_2950; Location=287..2487; Strand=-
  SCN-specific regions: Sequence locations=1-190,212-264,294-756,778 -813,836-1224,1254-1397,1419-1791,1864-1864,1932-2058,2096-2201
atggacggctccaagacggaggggatgacggcgcaagaattgcgcatgattgactacgagagggacattgaacggctggaaatccaatgctcaaagcagcacgaacaactgatcattctgaggtgttgtggtggttcatggattgatggaaaatgccaaaaataagaacaatcgtcgaaaatggaatcactcccaggaaatttagggccagaattttcaaatagaatttaccggaagaacctaaaacataaacaaactataaattttcataatttaaaaacttaaatttttcaaattgcagcgaacgtgccaagcacgtggaactgttggaggaacaaaaggtcgacctgcaaacgcagacggacattttgcggagacaaaatgcgcaactcattgtgagtgttcacgctcattgtcaaaaaagcctaagttgttcatcatcgcgtccctttccttttcagcgtgaccatgaggagctgaagtgtttgtttggcggcggttccatctcacgcaacggtttggaggagttggtgcgcagtgccggccaattgcgcgaaaagtcggtgctttttggttgaggcttataggggcacaccattggggagcagcagttcgtcacctcccccctcccgtcgtttcacaattttttagttttctagtttttccgagtaaataagaatttttttcgcttttataattttcaaagaaattttaaaaaaacatttttttctttcctagaaataaccttccaactgtaaaaaataagaaaacaacatttccgatttaagaatgcaccccaccatggagagaaaagcaaaaatcctaaacgaaaaaattagaggtaacattttatccggattcaattctgcggtcatttcctccaacttcctcttaacaattctaagtcatcgtgaaaaattccaggaacaaagagctggagaccaaactgaaactgttggactcgcagcagcaaccacgcgacgcgccaaccgtcggcgagtcgcgacgaattgcgcaactgttcaagcgcaaatacgacgcggagcttggcgaactgcgcaacaaattgcaaaaatatgtgagaaaaaatatgcaaaaaactgtttgtgtgttttgtgaattttccccggctttaggaggagcccaccgggtcagacacaactcgcattttgcgcttcgccaccgccaatccgttggacgaagcgcgggatgagctggtcatccgcgaggtggctgctgctgctgcgtctgcttcaactggcgcttctgctccgaatccgttgaaacgacgcaaattggtcagtggttttatacttgaacaggttttagtattttttagtgtgtgcgtatttcattgggttgagactcatggaatattttcgtttgcaatttagaaaattttttatgctttatttggctttgacgcgccatttgaaaatttgtttttcccattttaacaatgtgtctcgttttttcaggacaattccgttggtgatgaattagcggcagatgaaacgccggtgggagacgaattcggagaggagacggaggactcggacgatggccatgttcacaatttacgtgttcaaattcgtgcgctcaaagatcggctggatcagacggaaaatggttgggtatttagcggaaaattggggccaaatctcttctcaatatattaaggtttttgtccaccaaaaagttagttcaaacgaattgtaaatgtaaattgtgaaaagaatcttataaaaaaaaagatgagttgtaagggaaataaaagacccttgatatgtgtcccaggtagtatagtggttagtatccgcgcctgtcacgtgcgagacccgggttcgattcccggcctgggaggaaatatttttttaaaatttttctttcaatttctttttgttaaataaacaagttttatttaattttttcagttaatgcggagctgctgcgcgaatttcgtgagacggttgcattgattagcggttacgacgtgcgcattggcgaggagggctttttcgaggcggagagtgtgcattccaagaactgtgtcttccttttccaagtgcttaaaacaaatttcaaaaatttttgtttgtaaaaccaattcctcacagaaacatggccaacaaccgccgacggtcgatctgttggacaacgaatgtgctcaacgttggaaagacttgattgcgaattatttg

SEQ ID NO: 82479 - DNA, 572 bp, Heterodera glycines
  Genomic contig location: Contig_ID=SeqID_2952; Location=749..1320; Strand=-
  SCN-specific regions: Sequence locations=1-572
atggaccgttccgcggagtgcccagcagcgacctggcagcgaatcccctgctgtaatgtgagatcggcatctaccgggcggtagtgcactgttcagctatcagagcatccagacgctcgaccaatatctatacatatagttaggtgatactgtcggtgggttttaatctttaatatttcaaaaaataaaaatcaatttttctttttttcagtcaggcacaaaacaaggcgtcaaagctgaacatcaacgtgaacgcactcaacaccctatgtgcaggcactgaactccaccatgcaacggggctgagctgctgctgacgtcgccgggccggccgatgacggagggatcgtcaggatagaatatgatcatctgcgagtgtgtgcgttgtcagcgtttccataactgtcataatgccccatattgtaattgtcaatacccccgatcatttgaattgttgtcggtgtgcccataaactgccataatgccccatattgtaattgcccccccccccgatcattttttgtatgtatttgtataaaattttaaactgatcacctcacagcaacaataaa

SEQ ID NO: 82480 - DNA, 668 bp, Heterodera glycines
  misc_feature (653)..(653): n is a, c, g, or t
  Genomic contig location: Contig_ID=SeqID_17923; Location=363..1030; Strand=+
  SCN-specific regions: Sequence locations=1-36,63-90,139-290,323 -486,545-615,649-668
atgcactttttcaaccaattcatcattgtcattggcattattaaattttaaaaaagcttaaatgaatgcctcagcgaacaacacggtatcattaatataattaaattattttaaataatttttaatttagttttatttggccttcaaagatgtccatccaagctggtcactaattggatgtggattgatttacggactcatcgctacagttgggattattttgaattcttctgtcattcttgtgactttgttaacaaagtatgtgcttaatgaaaggcgtgggaataaaatgatttaaattttttgaaaaactttaattaggtcattccgtggcaccgttaattaccttttggcactttgttccctttttgaattgcttcatcaaagtggccattttctgtttgtgtacaccgcattttctggacagaatttcattgagaatcgtctggcagcaaaaattcttttcatttccacgattggactcggtaatatatgtttaaaaaattaaccataataattcaaaaattatattaaaatataaattcaggtgcaatcactccaacaatgtttttcactggcattgaccgactaatcggaattgctttttcggaaatgtaaaaaaaatttttactaatttaatttttattactaantttagtcacgataaa

SEQ ID NO: 82481 - DNA, 224 bp, Heterodera glycines
  misc_feature (55)..(55): n is a, c, g, or t
  Genomic contig location: Contig_ID=SeqID_17924; Location=23..246; Strand=+
  SCN-specific regions: Sequence locations=1-55,91-117,141-224
atgggggtctgggtgagaaaagagaagggaattggtgagggataagaaattttgnataaaaataaattaaattatttattttcatttatagcatatatgcatatcataagtggtatagtggctaaaccttcttactttcattatttgtccgtcggttcaattccctgatggaacagaaaatttttttatattttctttaccattattttaattgaatttaatta

SEQ ID NO: 82482 - DNA, 970 bp, Heterodera glycines
  Genomic contig location: Contig_ID=SeqID_17924; Location=510..1479; Strand=-
  SCN-specific regions: Sequence locations=1-312,334-543,567-970
atgggtccgtttgacactgcgccaatgttcataggaattgcggccattaaagcgcagaaaaaagcattgaccggagaagcaattggaattagcagaaagtaagtaattgctgagattaaatagccgccgatattcacagtgataatgcaaaaaagggcacgaaaagtgcgacgattaaacgaatcagcggacggcaagcctatattttttattttaattaccatttattaggttgaatcgcaggatcaaaaaacaccagtaaaaaagcacaaaaatttcgataaaaataccggcggtgtatcatatttaatatgttttacctgatgcttttatacgtattgtaatgccaagaaagatataaatggcaaaagtcattatagtaaacaagttacttattgtaacaaacagaggaatgatctgaaaaatataacacagttaaaatatccgacaaaaaagttgccataattttttcctaagcaaccaatttaaacaattcttggtattgttcgatagatttgagtgtcctctattaacaaaaacgccaaaattaaaaaaaaaattatattgaatcttttttgaaacctggtctttggttgtttacaaaaaattatgaaaatttttgttaaaaatgccaaaggatttatgaaatctatcagaactagagttgagcgggaccgggaaatttgacaaaaaccgggaccgggacttaccgggaccagaaaagtcgggaccgggaccaagtttttcgaccgggaccgggaccgcgaaaaaacccgggaccgggaccaaccgggacttttcccaagtgaaaattttttttgaaaaaaattgaaaatttaagtgcacattgttacgaaaattgccaatattcaaaaatgtacccataaaattttgtatttacgttttttgttatcagggggggttcttggaattttctgagtcccaaaattctgtattttttttaaataaa

SEQ ID NO: 82483 - DNA, 900 bp, Heterodera glycines
  Genomic contig location: Contig_ID=SeqID_17925; Location=72..971; Strand=-
  SCN-specific regions: Sequence locations=1-316,403-668,838-879
atggacaagcatttgatcaccgactttgagcaatcaaatcgtctgctgttcaacagcttttcctccacgcctctcccaatgataattcagcgaaaccaaagaactcaatcaacgcaaagtttgactaccgcaaaccaaaaactgcctttggttactgtagcgactgcgaaaattcccgcaaatgtttcttttcaatacccaatttgatcaacgaagattgaacattggcagcgtcatccactttgagtgtaccgtagaaaggtgtgaggaaagaattggaaaaacgccgtcggcgataacgccatgcccacgggtgaaaaacaaaagcaaattgaaagaaataaattaaaaataattaccaaaaaaaaaaaaaatcatttttgtttaattttatgtttaaaacgtaaagcattaaattttttaactttccaacaattcattgttgttctttgtagacaaattgtgatcggaaacggaccatcgctgagaaacagcagcaaccggtgatcacaacacaagcggaacagcatcacaatgttgatgatgccgttgatgaagatggcgcgaaagtgacgggcgaggacgaggagttggagctggtcacccaattgttacgggcacaacaacgggaggaggagggagaggaggaagcccaatttggcggagtggaaggagaaacggacgaaaacgaagcagtgacagaagcggcacagaagaagcagcagaagcaaaatgggacggaaatggcggacgaaaaaggaaaaggaaaagcaaacggaggaaaagcaaagggggaagcggggaggaacagaacggcacaggaggaagaagaagaagcaaaggcaatcagtggaggtgccaacaatagaaaagcataacaaaattaacttagaaaataaa

SEQ ID NO: 82484 - DNA, 386 bp, Heterodera glycines
  Genomic contig location: Contig_ID=SeqID_17927; Location=313..698; Strand=+
  SCN-specific regions: Sequence locations=1-7,29-43,65-231,253-335,358- 386
atgaatctaaagttttacaataaacatacgcacatttttggagaaatggttgttagagaaaaaatgtggaaatctgctttcggtgaaaaagcatcgcctggatagtatgtttttgatgaagagggggacgaggcggatgatttaacgtaagattagtgcaaagaaatttcattcataattaattataaatttagcctcggagtttcggattttttgcgccttgaatgtgtgctggattttaaaaacaagaacatttcttttacaaagaatgttgtaacgtattttgttgactttgagattgacgaccaaccggacgatgagaacgccgcttaatgttttgaatttttaaaattctatgttttttttttactttattggttacctaa

SEQ ID NO: 82485 - DNA, 1290 bp, Heterodera glycines
  Genomic contig location: Contig_ID=SeqID_17927; Location=823..2112; Strand=+
  SCN-specific regions: Sequence locations=1-419,445-532,563-736,773 -890,912-965,987-1215,1243-1290
  Gene Ontology: Mol. function=peptidyl-prolyl cis-trans isomerase activity; Cellular component=endoplasmic reticulum
atgaccgttgaaaaatcggtgtcaaaggctgagagacggcgctgcttttttgacattcacatcgatggtgagcctgttggacgtattgtgatggaactgtttgacgagcttgttccccgcacgaccgagtttgcattcaatggacatttttgcgtattttatttgaaaacaggaattttgtgatgctctgtactggccaggccggcattggcaaagtgacgggcaaaccgttgcacttcaaaggctcaatgtttcatcgggtcatcaaaaactttatgatccaaggcggcgacttcagcgccgcaaacggcacaggaggttcacattttttacaaagttattgtttttggtcggaaaatggaagtccaaatttgatagttttgaggaaaaaagggtctgtccgcaattgcattggcattcaaaagaagggttttttggtgtgttaaaatattttgtgacgcccttcatctttgtactatgattattcatgacgattatagggttgggcctacgaaccagaaaattcgtccagtattttttgttttgtctttgtgctgaaactctccctggttttctgaccttatttgttttggactccgtcaatgtcccccaaattgaatgaccatgtaaattccaatttttatgatttaggcgagtccatctacggcggtgtgtttgatgatgaggcatttgtggccaagcatgaccagccatttatgctgagtatggccaaccgtggcaaggacaccaacggctcacagttcttcatcaccacaaaaccggcgccgcatttggacggaatccatgttgtgttcggcaaggtacaacttttagtttttttcgcttcagtttttttcatgtcgttctaccgcgaaaatgtcgtgcagttacaaaagttttttaatttaaattgggttttggctggttttcgggcagtttttcgtggtttcaattcgttttcgtccatccaccacaataccaaaagtttgcccttcatttttcgaatttagttatttttagagggttttccgaattatttcttcaatttttaaattatttcaaaatccaaattttgtttcagctgatctcgggccaagaagtggtcaccaaaattgaaaatctcaaagtgaacgcgaagagtcgcccgttggccgacgttgtcatcgccaacagcggccaattggtgaagaagcgcagtgcgtcagcccatgacacggaagaggagggggaggaggagaacgaagacaggttttttgggggaggggacgtcaattacacattcagatgaca

SEQ ID NO: 82486 - DNA, 62 bp, Heterodera glycines
  Genomic contig location: Contig_ID=SeqID_17929; Location=1180..1241; Strand=-
  SCN-specific regions: Sequence locations=1-11,34-62
tttattgttcgtcaataaacatttatttattgattgtcttccttaaaccctcggaccgaaca

SEQ ID NO: 82487 - DNA, 1261 bp, Heterodera glycines
  Genomic contig location: Contig_ID=SeqID_17930; Location=1477..2737; Strand=+
  SCN-specific regions: Sequence locations=1-364,386-683,705-835,860 -1165,1188-1213,1235-1261
atggcacgggaagccgaaaacgaaatgagaaggcaacatcacaaaccattggcacatatttatagttagggcttatattaggggttatttttgaaaattttagcgtcgattcttaggggtctaatttttgttgggcataatgcccaaaagacgctaggtttttcaaatttttggacttttaggctctaaaaataaaaacttggaaaataggccctaataactcgaaaagtaagccctatttatagttattgagagcaaagtttggccaagtgttggtggacaagcaatttccacttttagaaaaatggtggacgacgaatggacgagtgagtgaatgaatggaatggtcgcggatggcataagcaaatgggggtggaaaggggggtaaataatttggtgccaatggtcttccgaccgacccgccgccagtggttgcccgggcaacccaacccatcggcacaatcggcagaaattggcacagttatttgagacaaggttgggggagggttagggacaagcgaaaaatagccacaaaaaattgagggggaagtgaaaagtgtaagaagcggacggtaatttaacggaaaaacaaaaacaaaactttttgaaaagacgcaaaattttaattacgaaatgagagaagggcaaataattttttttaggggacacttaaatttctttgctgaattttatttaaaagatttgttaaaaggatatatttataccaaaaaaatgtaaatttttgacacggttcaatttttaaaatttttaacagtttgaatttatcaatgtttataggtcttttttgaaacaatatccaactctttaatttctgttttaataaaaataattttattttgattactctaagaaagataaaattgttttcgattcaattaaaaatttgaagaaagtgtcaatgttgtgacagccttgagattaaaagtttttctttcaccaataaatttccgttcgcgagggattacatcgacatttgtgacgacattgaaggattatcaacagtcagtcacaatgttttgccacaattttgttcattttataccaaataaaatgccattgggataattaattctctcgtcaatttttttttttgcccagtttttttttttcaaattttatcctcgtaatatattgaattttgtcaaaaagcaagttttataaagaaataattttaacataaaatccttaatcagaaatgcaattagaattcataaaaatttaaattgacaaaaattttaaa

SEQ ID NO: 82488 - DNA, 765 bp, Heterodera glycines
  Genomic contig location: Contig_ID=SeqID_17931; Location=13..777; Strand=-
  SCN-specific regions: Sequence locations=1-225,261-402,446-642,664-765
atgatgagtaaaaagaaggtattcggcaacatcaaggcatatttggccggcagaatatcggaaataatgtggaatggacattccacaacggcttgttcgggcgatgtaaaggaagcgaacaaagtagcttgtgtttatttttatcgttttttctgttcttgtttcagttggcctacctttccgtgaaaaaatatggcttcagcgatgatttggggcgcattagcgtaaaaaatattttaattttttgaaaaaattttaatgattcagattgacgatgagttagacccgggtccagaattaaaaaatcgaattgattcggcggcgcaaaaaataatttctagctgtgaacttgaagtgtccattttactcagtaagaaggaaatcaatgtaaattgtaagttcaaaagttaataataattacccctatttacaggaaaaatggaaaaaattagtagaggaattattcgagagagaatttttggatggagaatacgttgaaaagtattttaacgagccgctaaaagaagggaaaggcgttcagagttgctgatctttttaaaagtttttataatattttatctgcgatttttgggattgatcaatttatttactgtttataatttctctgctattgccttgtttcttttatttaagaaaggaaaattttttttgataatggtattgaaatttataattaaaatcgaaaatttccagaaattctggaataactttttttcttgttgaggatagaaatccccaaataaa

SEQ ID NO: 82489 - DNA, 340 bp, Heterodera glycines
  Genomic contig location: Contig_ID=SeqID_17932; Location=92..431; Strand=+
  SCN-specific regions: Sequence locations=1-268,298-340
taatgatcgatggggtgaaaaaaggaggaaatgggagttttcctcaagtgtgatgcgaatgaatgtgccgataggggaatttgatcggccttaaatatgagcaaaaatgagtgggccgataatgaattgcatgtgaatggaagaaaaaatgcgtaaatgagtgacaggtgagacgagtgaacaaacaaatcctacaaaactttactagggaaaatggggtgatagcgtaaatgggccacaaaatttagttactaaaatagatattctcattaatatttcaatttttaaatatttattccatactttcaaacattctgggattgcccaaacaacagtagca

SEQ ID NO: 82490 - DNA, 1188 bp, Heterodera glycines
  misc_feature (1169)..(1169): n is a, c, g, or t
  misc_feature (1182)..(1183): n is a, c, g, or t
  Genomic contig location: Contig_ID=SeqID_17933; Location=1..1188; Strand=-
  SCN-specific regions: Sequence locations=1-103,125-125,147-358,380 -719,741-1188
atgacgagacttttcatcctcccggcaattttcgtggccgccactttctccctgtggctgctcatttgcaatgcgcctgaatggggcgacgaaagtcaaatggtcggagccattcaccaaaagaaggaggagcagaacggcagaagtgagcataaaacaacaaaaaaatgtgacgggccaatgggcgaatgattggcaaaagcctaaaaaggggcgactttccctcccttggccatgctttggtcagtgtgctgagtttgtaaccgtaccgcgtgattaattatatctggcaattattgaaagtcgagactctcggccaatcttttggtcatttgtcccttttctgatactttcagctttgttctgaaaggcttctttccctgtcagatgctccgttttcctccgtgcccattgaattgccgacgcaatttgagaatttcaccacaatggccgaacagttcaaagcgtacaaaactaggcacacttcctacatcacaacactgttcatctgtgcctatctctacaaacagacattcgctattcccggctcattttttctggtttttgctaaaaccaaatttttgtgaccgttggcgacgagtgaattcactggcaaatgaactaaaaaataaccattcattcaatgcttccgtactttttatttatttagaaaatgacattcacaaatccgagacggactcacaaattcccgcacttttttgacaataaattggcatttcccttctaatttctctccattctcagaatatcgccgccggcgctgtgttcggcctttggctgggctttcttttgtgctgtgtgctcaccactctcggctcaactttgtgctatttgttctcggaatttttcagtcgcgaatacgtcctttactattttggcgagaaaattacttatttgcagagaaaggtgaatgattgggttattttgaatcatttgtaagattgtttagaaaattaggggttttttggttcttaaaagccgtgattcaccaaaggaactgatttattaataaggacagaccaacatcggctaatgagcttggcttccccaggacatgtctttccaaaatcctcaaattaattggtgccaaattggtttgggtgttcactctcaaatgcatttgctttttctgttttttgttcgtccgnttttgaccgaccnntgcag

SEQ ID NO: 82491 - DNA, 1274 bp, Heterodera glycines
  Genomic contig location: Contig_ID=SeqID_17935; Location=503..1776; Strand=-
  SCN-specific regions: Sequence locations=1-66,90-443,465-902,924 -953,975-1045,1096-1274
atgcccgtcaaacggctaaggaggtttacacattttgttgacgattggagtccttcttctgtcgcatttttaaacaaaaaaggaaaagaggattttgaatgtttcggttttttttgactaccctatgtttgatcggcaatcatgaaaatgggggtaccatattctaatttattaatcttgggattttaatcaatttttgatcaaataactaagaaatttttaattcaagaatagagaacaaattgtaaatattttcggttatacatatctcaattccctcttgcagacaggccaaaattgctcgggttttagcattttgtatagttttgttgaaaatcaaatacttgacaaaaaaccatcgtagagaaggtttaattagctattactttaaatctaaaagtatgtaatacataaattgcgccattagaagacactttcagttcttaattttaataaactaaaatgcgtattgatattcttagggtcgccttatattgattttgttttgcaaaaaacgcatttctgtgttgaaatttttcgcttatgttctgaatttttggctgaaaattatgtcactatttcggactagtactacgagttgccattaacacaaaaaatcgctgttaatttttgaattttttttcttggaaattttctgtttctataaagaaaatttcggcggcgaacttttggtggtgtaacccattaattttgcaatattcatttaaaaaaacattttctttttttacagaattttgcgaccattgcgcatatttggtggttggtcaacgggacgtgttccgagtggagttgactgctttggccgaccatttgtggcatcagtgcacaatgaaatcaaatgccaacccaacaaaagcaatgggcgaaatgagcagcagcaatgtgcaccaactgttgatgtttgcggacagtggagaagtgtgttttgcatgttaatttattggttataaatgttttacaaataattagtgatcggaaaatgggagattttccgggaaagtgaagttttttaccggtttttctcaaattttaaaaatttacattaaattttttgattatcttttctttagagcccttcaatcgggtcggttgtgtgcgttcaggcgccaattggaacggatgttgacgaagacgacgacggcggcacggatgagaatcggcaacaaagacgagatttattgattgctgccgaatgcttatttggcaccaaaatgggaagaaaaagcgctttcttggccaccctggccaggtga

SEQ ID NO: 82492 - DNA, 129 bp, Heterodera glycines
  Genomic contig location: Contig_ID=SeqID_17936; Location=434..562; Strand=-
  SCN-specific regions: Sequence locations=1-66,91-129
atgagtaatagtgatattaaaaagacaattgacatttggattggagaagcagaaaagtcagaactccagcaaagggaaatttggttttttataggagctgaagaaaaatttgtatttgaggaaattttg

SEQ ID NO: 82493 - DNA, 1277 bp, Heterodera glycines
  Genomic contig location: Contig_ID=SeqID_2953; Location=43..1319; Strand=-
  SCN-specific regions: Sequence locations=1-492,514-525,547-656,679 -728,750-915,940-1051,1080-1215,1239-1277
atggcggagcgtccggagcgcgacgaggtggtgtacaccaacagcgcacgcgacttccacgagctgctcatgcgtccggagcaggaggtggtcagcttcacccacctcaacgaccagctggaccgctgtgtggtgcgcaagcgggagccgttcgcacgggcgccggagcacaacaacttggccgtcgcatgttttgtgacgtcccatgcccggctgtacctgtacgactggttggaggaggtccgacgggtgggcggccgatccctgtactgcgacacggacagtgtgctgtacgtgaagcagcgtggcgctgaaggtgtgcgcgagggcaacgcgttgggtgacatgaagcgggagctgcccggccgtcgcatcatcgacttcttcgccgccggcccaaagaactatgggttccaacacgtggacgcgtgcacgggcggcgacctgagggcggagcgcaaggtgcgctcctttgagctcaactatgcggcggaccagcagctgcagtatgagcgcatgcggcagctggtcatcaaccactttggcgtcgggtaaataatatgacaccactcccctgttgggtcgagggggggggcactgaggcactctgaacacacaaacacacacacacacattttttgatgattttcaggcagcaccatcaacaacaacaacaaaggggtcccgcggctgatgctgctgacggaagcgatggccaggaggagcgcaccatctctgtgccatgccagcggtttgtgcgcaaccgccaggcggacatcttcacgcgtcgctccacccgcgtgtaccggcccgtgtacacaaaggggcgcgtgcttcggcggggtgcagcagagtgtgttggtgagtcacaaaagaaaacagaataaccaaaagggagaatagcaactagattaccacacacacacacacacacacacagcaacaacaatttcaatttttcagatgaagtgccgccgcaatccatacgcactcgcccatttggatggagctgttgtgccggtgacgtgggatcacccgacagctcagtgatgaacgaggaggaagaggaggaagagcccatgcaaatggctcccgatgaagctgaccagggggaggaagaccgatggggggagcatgtttggccggaagaaattgctgatgataataaaaaaccagggcctgaacggaagcgtgcaagggtggaacagtgcgtggccccgccgccgccctccccaccacagacgccgcttcgcgagccgcatgcggagccggagccg

SEQ ID NO: 82494 - DNA, 3369 bp, Heterodera glycines
  Genomic contig location: Contig_ID=SeqID_2956; Location=833..4201; Strand=-
  SCN-specific regions: Sequence locations=1-14,53-409,431-493,531 -642,669-1086,1108-1218,1241-1932,1955-2038,2060-2213,2254-2274,2296 -2322,2344-2377,2399-2407,2429-2784,2809-3160,3182-3369
atgcaaatggcaccgggacaggaggaggaggaggacgccgagggaccaatccgcgccgtcgcagtgccaatggagacgctccggcaagtttaaataaaaatccgcaattttaacaaataataattgccctccctttttaaaggagaggaacaatgggaggaaacgggcacgtgaagacagcacgagcaatggcggcagcagcaaccaaagtggcacagccacttcaagtgtgcggcacccgctgtacggaaacaacggcggaggcggcatcggtgccgcgctcgatttggacatgcttttggcgccaatgccacagcagttcgtcagcgacacatcggcaagtttttttttgagttttcaaggcgggattttcggggtcactgatcacaaatgtgatcaaaatctgagcttaataatttcttttgttgcttttacagcgcggtgcaacaagcgctgctggtgccggtgttgcccaagtgtcagcagcgaacagtgcaactgcttcttcttctgctgcttcttcgggtgttgtgccgacgcggtttttggacagcaatgtgagttaattcatgcactggtgggggggggatggtttcggcggatttccgatggcttttgcctcggaaaattttcacattttccaataataatttttttaattttaaattccaggttggcttcgcaaggccgagtgatggcgtcggtggtggtgttggcggcgacggtggacaattagccatggcacacatgcagtttggggtgagtaatgttggacatttgaaaatgcccattcataaattgcttttgctccgcttaagctgtcagcaggcggtggaagtggtgtcgtcggtgatcaacagcagaatttgcagccagtgagctgcatgcgtggcgtgccggcggcggtggcgaccacgatttggactggttcgtccaatgtaagtttttggagatgttttggtcatattttttgttttgcttaccgagataatggttaacagagattttggttaatagaaattttatttttgatttaaggccggcacttttgtcaacagcgggtgtgctgctgctgcagctttcggtggtggtggcatttttgggagcacgacgctgcgtagcgggagtgccagtgctgctgaaggatttggcggactttcggtagtgggggaagtgagagggggggggggaggtcgagatggttgtgtttagtgattaaattttaattttctgtgtattttttaggccctccctccccacattcgtgaagcgattgagcgcgtccactcgaggcaaatgcagcgcatggttactgcacagcccgactttaccgacattctcccaccatgtgctgacaacgggatgtcaaataccgcttggctccttttggattggcaacccgacatgctaattgggtatgttctcaaattctgatcacttttggtaatattgtttatacattggccccgttttgttttaaggcgtgttgttgggcttgtcgtgttgtgtggtccgttcaccacgatgggtggtctgaacggcttcgacgtgcgcctcatcttcgaccaacacaacacccaacaggaaatggccgtccactgttgggaggattgcatgccacgccttgccaacaacattcagtgcgaccagatcgtcgaattcagtcgtcttaaagttcgggagcaggggaagaacgccaagggattcttcccgttcactctcctctacaacaacgagtctcgtcaccgcgtgctctcggcatccggccacattggtgagttgcattttcgcattttttcgaacgtttttttgtaactgtgttcatttttccctcacattctcaggcgcaaatttggccagcagcagtacaccaatcattgttgaggcggtggaacagcaacagccgggcatgaacactctcagcaacgtggtgcgtcacaacagcagcagcagcggtgccaataatcagcacatccacggacaaaacagtgagtgaaaagcaattgtcagttcaacaaaatatgaactgatcagatggatttaattaataatttaatttccttaaatcgttattacaggcaccggcgttgtgacggcagatgatggacaaagtgagggcgagcccgatgagacggcggcggcagcgaccaatttgaccaatgccggagcgcgagatgcggatgttgaggaaggcacgagcgaaacggttagcggaaattaaacaaagaaacgaaacgaaacgaaatgcaatgatcggaaaatctcttttgttttacacactcacgcacatacacacgctcgcatttatgacaacaataaacattttgtcttttctctctctctgagtaaatattgttacactgatttgttagtttcttttttgtgttgtgatgaatttcccgtcacattttttgttttattcatttatgcgggcgtgttgtgggcggtcatgccgttgtaacaaaaaagtgttaacaatactatttttaagaaaaaaaacaacaaattgtgtccttcttataggcatggctgtccacaacacgtccacccccgtgtacaccggttgggcgtccgtgtcgtcgccgccgtcttcgttctcgctgcgtttctccggctgctgtgccgcccagccgtcgatcgtcaccaccaccgcagcgtgcctgctctatcactgctcagcgcagcctgcacagcattgtgcaacgcatgaacgtcgttgatgcgcaagtctcgcgcgatgagcgcaacacgcgtgttcgtcagcgagcccgccgtcagcaactacagcagaaccaccagcagcagcagctgagtcgtcttcgtcggcacgtgccgtcttcatcttcgtcatctcccacccacccgttgttgcgtcgtggagtcccgaacgagttgcgcagtgccagtgccgttgaagcggcagatgtgatcacaattgacgacacggagccgctcggcgttgagccgcaacaacaactccaacgtggcgatgcccggtatttccaagacgaattgctgacgctggaagatgaagttggagcggcgcacatcatcatgattggaaatgagccactctcggtggcagaccgagagtggctcatatctaccggctttcaaatgcggcacctcccatcgtcagtgaaaggcagcgtggaggtggacaacgacggcaacaacaacatcagctgttgtatttgttacaactggctcgtctcagacgtggacaccgtggttcgtctcgcctgccaacatttcttgcatcggaagtgcttcgcccaggaagcgactcaacgcagtatttgtcctctctgccgacggcacttcattacgggggaagcaacacaacagaatgagggtgccggaaactga

SEQ ID NO: 82495 - DNA, 1118 bp, Heterodera glycines
  Genomic contig location: Contig_ID=SeqID_17938; Location=17..1134; Strand=-
  SCN-specific regions: Sequence locations=1-102,124-196,230-253,306 -372,414-419,441-458,499-499,558-575,600-616,638-674,714-727,749 -781,807-889,911-952,974-986,1008-1118
gtcaattgtcaaactaccaaagatttatttttgctgaatcattcccaacaatggtgaagcatatccgtggtcgtccattgggagtaaaattagtataagttattaattacataaataaaacgacggttttagcaagtgcgtattggctttggtgatgccgaccccctttgggactcagagaatgaaaagtacaaagtgctgtgccgaagcattcatgtttccaaggcagctctgtacattggttacatgcggttgttggtctccttagtgtccagtctcttttttgcgtaccaatacatgatggtgggtgtttgaccgatgcttgaacattaattcacttttgttcgtctaggccgtcactggccaattgtcctccgaccattggattaaccaagtgactgctcgctttatgtgtaagttttatcagtatttcttttctttccatcggtccatttaagcacaggcaatgatgtccatctgtttgcaagtgattgtcgtcgtacttatggtccacggtgtgaaggctgagaagaagtccttgttgcttccttttattgtgtatgctgcgatcgcagttttggctggttcgatcaaggttagctgtgtccttttccctatatgcaaattactcttttgaggttatgagtgatttggtgtatttggacacgagcgtctacaaaaacaatgaggcggagagtcgagccgccaaagtgtaagtttacttctatttgatttcttttaccaaattcttcctaagattaggcccacattttacaggcaatttctcactaatctgttgcgcactgtgctccaggcctggtgtctgtctgttgtttggcgttgctatggttacctgaccgaaaaaaaggtggcacgtcagattcgtgaacaactcaactcaactgcgaccgcattcaattacccggagaatttgatggggcacccgtcgatgccgcagcagcctcctccttacgttagtttgcatcatataaatgcttgttatttaattcttaaaggcggctgttgtcactgctccgatcgcaattgggccgtccaatgacaagccgcagacttcagcgacgaacacatccgcaagtgcttctcatattcagcagtag

SEQ ID NO: 82496 - DNA, 302 bp, Heterodera glycines
  Genomic contig location: Contig_ID=SeqID_17938; Location=1285..1586; Strand=-
  SCN-specific regions: Sequence locations=1-91,115-302
aaagagctgcctaggacttgcgttataacatgataaaagtttgaaattcccacaacttttttctgagatgtcaaattgcttagcattcgcttagaaaaagattctccttttcaaaaactttttttagataccaaatttgttcagtttaattgggaatgaagcgagttatggcagatcaaaataaaaaatacaaaaaaggcattttccagtgtaaattttgaaatagcgcgcaaaaatttacgccaaatgcgctatttggcgttatgagcaattttgtctgacactggcgcgtacccatagtg

SEQ ID NO: 82497 - DNA, 420 bp, Heterodera glycines
  Genomic contig location: Contig_ID=SeqID_17941; Location=977..1396; Strand=-
  SCN-specific regions: Sequence locations=1-164,207-280,302-420
atgggacccgttcgtaccaggaggggttttttccggttcttggtactgagtcatttttttcagagtttttccatggaaatttgtggtttatatgttaaattgtcgactcagtaccaagaaaagaaaaaaaattccgtcacatccatgcctggttcgtacatgtcttaattagaaaaattaaataaaaattttttagatttaaatttgctaaatttgatcgtcacaattcgggtagcattcgcccacttcaggctccgataaatgtgcatgaattcgcgccttttttggaaaaccgtttgccgaactcttttcaattgcggctaattgctttcggactgcatcgatagaaattctctaaaaaaaacgctagctttttcaaaaatctaagtttttcgcaattcaaaagaaaatacaaataaa

SEQ ID NO: 82498 - DNA, 826 bp, Heterodera glycines
  Genomic contig location: Contig_ID=SeqID_17942; Location=1760..2585; Strand=-
  SCN-specific regions: Sequence locations=1-152,198-355,381-386,411 -659,682-688,710-749,783-826
atggatgaagaaatgggaaccaacccaaatgatcaacaaaaaagagaaataatcaaatttgaagcaattaaagaaaagcttaaggaaaagtgaaaatttcaacgaaaaaatcaaacaaaaattgagacaaaattggaaaattattaggcgcgtaaaaaaatatataaatggaaaaaagaattaaatttatataaaaagagttattatgatgagaaaaagaatgaattcattgaaagaattgatgaattcaaaaatttatatggccaaggcaaacagaaagaatttgtaatggaattgggcatttctgaaagaacatttcaccgccaaaatacaacaaaagtaagcgatttttaagttataaaatacttatattataaaagtgagagaataaaaataaaaatttttatttagcatgcaataaatatagcaatgaagacaaatttaaaaagttgaagcattatttcgaaattaaagaagaaaacccgaaaattagcgatgaaaaaattgctaagaaattggaaattggaattacaactctgaaaactttgaaaaagacagctgctttaattatggaaaaatgattttttttttttttgtggattctttcggtcgatttattattgtaattcctaaaattatctgctttttttcttttctgttagaaaccaaaggttttttctcattttgagtatttttaaacatcttttaaaaagcataattttaaacaaaagtagggctgccaaagtatgaaatttattttatttttttttttaatattatttctatgcaaaaattaaaatactatttggctatgatgataaataaa

SEQ ID NO: 82499 - DNA, 445 bp, Heterodera glycines
  Genomic contig location: Contig_ID=SeqID_17942; Location=2654..3098; Strand=-
  SCN-specific regions: Sequence locations=1-93,115-334,380-445
atgaatgtatttattatatttttcttcgcttataaaattgaaaccgccaagattcgaacaaattttgacgaaatattcggcaacggatgggacaaaaatgaaagtgaacaaaaagtaataaaaattgaacaaatcgaacaatcggaatttattcattcttttgttcgaaatggcgcagaaaatggaacacactcaaatgaaatgatcaaagaaaaagagaattaattcaaaaatatgaaacaattaaagaaaagttaagagaaaaaggtaaatatgaacgaaaaaatcaaacaaaaattgagacaaaaattggaaaattattaggcgcaaatcgtaaaaaaatatataaatggaaaaaagaattaaatttatataaaaagagttatttatctggcaaaattcgaccaaattttgacgaaatattcggcaacgaatggacaataaa

SEQ ID NO: 82500 - DNA, 1014 bp, Heterodera glycines
  Genomic contig location: Contig_ID=SeqID_17943; Location=245..1258; Strand=+
  SCN-specific regions: Sequence locations=1-31,64-815,837-1014
atgccgaccggaaagacgctgcgggagattagggaaagggaagagaagaaacatgaaatattgagccgctacgtcgacttggaggtgatctgggaacacgaaataaatgagaagctgaaaaaggacacagcaatgagggagtttttcgacaactggaaggaccattcgccaataaaaatcagagacgcgtttcacggaggacggacaggaccaatgaagctactccacacagcaaagccaggccaaaaaatcagctacaaggacttcacaagcctctacccgtttaccaactttacgaccgactatcccctcggccaccctaaaatcgtcagtatcccaccaaatgagcagacggttaactggcgttctccatccgacaacccctacaaaggtctgctcaaagtcttgcttctacctccaaacaacaacattaacgtcaccgttatgcccataaaatttgatcaacgcctcctcttccctctctgtgagaagtgcgccaaatacatcaccgcaaaatatcccaatggcctcaaagacaacgactactcctgcccacactacaacccaaatgaccgggccttcgtgtccacttgcacccatcttgagttaaacgcagcattggaggccggctacacagtccgcaaagtcttccacgtcctccaatacgaccaatggagcgacaatgtattcaagtcttacgtgagtgaaatgatggccctgaagatccacgcaaccggcttcccgtcatggtgtgagagcgaagaggagaagagtgaatacattgaggagtgctggatgaaatttggaattcatctggagaaggagaagatgaaagctgaaccggggaagcggtacatcgccaagctctgcctcaactcactttggggccgcttctccatgaggaatctactttcgaaggcggtaatcaacaatgacccttgtgttctccgccaatacaccgacgacaagaaaattgatattatggacattgagctgatggatgaggacaacgac

SEQ ID NO: 82501 - DNA, 729 bp, Heterodera glycines
  Genomic contig location: Contig_ID=SeqID_17945; Location=2107..2835; Strand=+
  SCN-specific regions: Sequence locations=1-294,316-324,346-399,424-729
atggcattggaaaatgggaggacgatgaacggaactcagcaaaacaataaaacagcgattcgaccgtcggagtttgaggatgacacggagaacagagactttgaaaatttgtccatgtcagtgtcggaggcatcgtcagaagtgggaagtgtgtccatccaagacggagcaatgcaaaaccaaaatgaacggccaatgcttgaaaatggaatcacgaaaaggaacgtcagactgaaaagtggtgagatagaatatgaaaaaatttacgtacaggttaggtgaaaaaatttacgtacaggttaggcaagaaacctggattttctgggtaatattttagagtttgttcattcaagtggcaaatgttgaccaatattttatttcaatttatcaaaaagtgattgaattaaattaattaaatattccaatatttttcagatttaagaatttcgcccgcaagttccggaagttgggagagggcaattcgtcccgtagtgaacaaacatcacaatgccaatgctgcgtccgttggacggcgacctgcggcgaatacccaacgatcttcggtgtgttggtattgtggtgtgaaaggacatgccgcggcccattgtcaaaaaaagcgcagaaaaggccaatgagaattgcgagcacagacccaaaggaatgaatgtgcgagacaaatcggaattccagtgattgattatcgaatgtatttcacccatttttcactaa

SEQ ID NO: 82502 - DNA, 285 bp, Heterodera glycines
  Genomic contig location: Contig_ID=SeqID_17947; Location=683..967; Strand=+
  SCN-specific regions: Sequence locations=1-285
atggctctcccagccgtcgaggtcagtcagtcaattccccagtcatcactcccactactggccctccccctaagccgaccgatgggacggagcctttccgcgggggctacggcccagtccaacaatccgtcggtggacggaggagatcgatctccggggttggaattaagcaggccgtatcccgaaacccggcacggcttaactgtattttatgtcgattgcccattgaaacatatttttcaagaagatgttcaaagaactttaatataaaaccacaagaagaga

SEQ ID NO: 82503 - DNA, 1193 bp, Heterodera glycines
  Genomic contig location: Contig_ID=SeqID_17948; Location=101..1293; Strand=-
  SCN-specific regions: Sequence locations=1-257,279-828,850-1004,1026 -1193
atgtctgggccaatacaaaaagggatcatcaatgcactcaaagctctggacaatgccaaaagcgccacctcactccttctacaccccgacccggacctgtcaaactgggaaaatgccatcaacttggaggctcaatttgatcgcgtcgtcaaggaaattcgctcgatggaaatgcagatggacagtctacgagattcatccaatgcttggatcgaacttctcggtcgtctgatcggagacgacaaagacaacggcgaaaaagaatacgtcaaattcgacaagaatgaaaaaatcgccgaccgatacgacgcagcaacaaccaaacttcgggatttgcgagatctcgaagcaacgctcagtgccgcagccaaactgcacagaggcagagccgacagagaagcaaaggcggatcaattggccaatccgcagcaacaagcgcccatgctaccagcgatggcagcaccaatgacagtgccaacattcacagcaccgctctaccaattccaaccaattcaactggataaattttttggccaaaagcaaaaatggcccgaattctacgaatccttcaaatcggcaatcggcagccaatcaatcagcaaagcgcagaagctgaacttgctccgcaatctgctgggcggagaagcgcgagaactcatagcgggcttccggttggaagacgcaaactacgagacggtccttcagccgttaaaggacacgtacggagctccggaggaacacatcagaagtcttcacttcgaactggccaatctcaagccgtgccgaagcctccgtgagaccaaagactttctgcttcaacttgagcggtttacaagggagctgaacaatgccggagaggacatcgagggaccgcaggtgttcctcatgctggagaagaagctgactccaccattcctacgaagcatcctcacaaagaaaggagaggatccggcaaactggacgacaaccaaattccgggatgtgctaaccgaagcagtccggaaagaagtccaagaagtgatgggagaatatggccatcactacgtccaaccaaaagcagaagtcgtctcagcagcacctgtacaagcaccgagaacaccaaaccaaaggtcacgaaggcctaaccaaccaatggcactgcgtgatatgacatttatcgcctcatcactggacgagggtcacaaacatcaagg

SEQ ID NO: 82504 - DNA, 1135 bp, Heterodera glycines
  Genomic contig location: Contig_ID=SeqID_17948; Location=2006..3140; Strand=+
  SCN-specific regions: Sequence locations=1-13,35-273,295-353,378 -604,626-906,928-1035,1057-1077,1122-1135
atgccatcaccggggaattatcacaaatggaattgggcaccgggatgggacagaaatttcagaaatggggcaaatggaaagatcacaaaaatcaatgatagggaccgggaggaacagaatggaggataccagggggtccacaaaacgaagaccaacaaccggggatcaaagaatgatcacgaatgggggttatcacagttaaaggcaaatggaaggtaggggagagaaacggcaaaaatgcctaatgaattttggttgtgaaattgggggcatttttggccgcttaaataacaataaagttaaataaaaagtggcaaatgtgagcagaacaaaaatgggccgaaaattgggcacgaaatgaaaaacgggggacaaaatgaacagatgaacaaaatgggcggaaaacgggaaatttgggggttcatcgttctttggagtcgattcgccaaattggggacgggggcagaaaagttgcggtttgatgaattggtaattaatttgtgcgcggagtgggggaggaacacagaaaaacaattaacaatttgaaggaaaaaagggacagagggatggaacgccgaaaacacgtcgcgcggcggggggagttggtaaagggggcgccttccctcttaattcgccgatcattgattggcgatcggaattgaaattccgacagtcccaaatttaaacaaatttttttatttgtttaattcttctgaatttatccgagaaattggatggacttgtatatattgattggcacaatgtggatagcctttgggtagaggggtaattccggctagagaaacggaaggtatgtatatgtaaaagagtcaggtactaaaataggtgctaaaaaagtgcaaaataggcgctaaaaacgccaataaatattggaaaaatccagtgtatttatgcacaataattacaaaagtgaatcatttctgatcaatttcgcccgcacaattgcaacttctcatgaaaacaaataaattttggagacgaattttgggaaattttttcatagggaatattttatgaaaatttgttaaattttttgggagaaaatgaccttaacaggtttataatatctcattttaacattttaaaaattatttattggtattctaaggttcaa

SEQ ID NO: 82505 - DNA, 486 bp, Heterodera glycines
  Genomic contig location: Contig_ID=SeqID_17949; Location=1026..1511; Strand=-
  SCN-specific regions: Sequence locations=1-220,242-398,464-486
atgccaccatcaacatctgctggaactgatgatttggacaataatgcggcggcggcatcaattgcgttgcccgaatttttggccgacctcaaggcggaacggattactgtaaacatggaaaattgtcgtactgagttggccccaatcaacgtgttgtggctgagttcaatggtccgtccgtctttttggccaaatttcagcaattcgtttcgaaagaaaattttaaatttcccattttttcagcttctcgcgctggcttctgtgccgttctgtctcagcgtgttggcacttctgatcacggcaaaatgctggtcaactgacggggatggagccggtggcatatcgttgcgggcatatttgcccggatgggttcaggcaaaaaacaattcgctaaattcataaaaattttctaaaagaatttaaaaattccaaaaaaaaaaaaaattttaaaaattcaaaaattggttcgcctgccaagaaaataaa

SEQ ID NO: 82506 - DNA, 178 bp, Heterodera glycines
  Genomic contig location: Contig_ID=SeqID_17951; Location=243..420; Strand=-
  SCN-specific regions: Sequence locations=1-178
tttgaagaaaggagctcaaaaaacgcatttctgcattaaaaattttcgattctgatgtcactatcggtcactagaaatcactattttggcgacttcgtcactaaaatagttaaaaatcactattttggcgttttgtcactattttttcactatttcgacattttttggaaaattcctt

SEQ ID NO: 82507 - DNA, 3605 bp, Heterodera glycines
  Genomic contig location: Contig_ID=SeqID_17952; Location=417..4021; Strand=+
  SCN-specific regions: Sequence locations=1-103,128-337,404-725,747 -757,781-870,896-977,1011-1144,1175-1293,1330-1583,1606-1787,1839 -2300,2325-2330,2352-2377,2469-2722,2745-2770,2805-3010,3050 -3213,3241-3605
gcaatggcgatgatgaagacgatgacgttatctttttggctgaaatgaatttgcgaaaggaatgcgacggcggtggcaatgcccaacggcgggaggacgacaatgttgagcagcagcagcaggagacggcggcatgcagcaacaacgtggcgcaacagcccgctaatgatggtaacattagggggtgcttttttgacaattttttggttgctgcatcatatatatgaaaaaaagggggggggggagtcgacccgccaacccttcctcgcttgggaaaatttgtttttactaaaaaaaaaatttcaacaaaaatcatagagttttttttgtaagaaatccaaaacaaaaattttttgtttgaattacttttcaaaaatgttccaataaatatttttggcactttgagtcggaaaatgcatataaatgataatataccattgaatagagcaggttcgatatgttcccttgttagaaatttgaaaaattgtaaatattttgttcctttttttcttttaaattaaaagtactatactagtatactgtaattatctgactgatcggcaacgatagtcactatttcggctgtgggtagggggtactgacaaactttttttttttgctttaaccactgcgccttcaccattttttcgctctgtttttaaacaagaatttcggtgaagagaagaggggaagatttatttttgcaaataaatgattttttttaatttacattttccccctattttcaggcaccgacggggatgatgaaattgtatttttgggcaaacagaaggatgaacgtcacaatggtcggcggcggcggcaatcgttgacacggctcattacggaattttaccgcccacggcagcagaggatgaggacgatgatgatgatggccaaaccaattttgtgtgcaaccggcaataatgccgtcgatgtaacatgatggattgtttaaatgcattaacttttgaagtaaataccgcatgaattaaaaattttttaacttaggaattaatgttttttatgcattatgaaaatgaatttttatatattaatctgtttttccattttgagcaattgctgtaccatcaagcgaacaatttcctcgagggaaaaaagcatcaatcgaatactattagacaaaaataatatttaaaatataatataatatgttaatagtgctagggggtgtcttgaaatttccaggccaattgaaaaaaacttatgatgaaattatgattgtcggcacgtatttgaattagcctagttggaaagcactgaatttaataaatttacaaaaatacaaaaaatcaaattgatgggaaatatttaatgaaactctgctcttgcttctcacagcagtttttttatttaactattttttagcctgcggttcccgcgcctgatcctgctcggccatttgttttccagctgcaacggggcaatgagctgtgcggcgtggcttttgccagcttgctctggcaacgcaccaaggcatcgtcaacaccgctgacgagcgcggttcgccctttcgttgcccgtaagcaaaaattatgaaaatccattaaaataaaacaatcattgagttttatattgttttttattcacttacgcattttccactggcaatttaggtcataataaatagagctatggaatatgtcgattctgtgcacaaaattgtgattatttgttttaaaaatacaaatttggcgatttttgccaaacaactaactcattcattgtcagcatgtatttgaattagcttagttgaaaggcactgaattttctaaatttacaaaaatacgaaaatcaattttgatagtgaaatatttaacaaaactgctcttgcttcgcacatcaaggtcctattttgaaagcattttttagccccctgctcatgcgcctgtggaccctgctaggccattcgtttgccaccttcaacggggcaatcagcggtgcggggccaattttggcaccgaacatgcgcttcaaacgcacgaaggcattgtgcacaccgcggacgagcgcggttccctgtttcgttgcccgtaagaaaaatttaaaggcaccggataatgcgtcagtggaaaattcttcttttgaatttgtcacattcaatttaaaagaaaactatagaattttgaaaatccattaaaatttaacaatcactaattggattattttaaatgtgttcctgtgtcaatttaggttaaaatttaaaaaaaattgatttaccaacgcattttttcagtgacaatgttttctttcggtcatcaaatttaatactatacatatgaaaaaatgaaataaaattatgttgaaaaattaattcatttttattttcatgattacagtatgctttaattggtacttttttaaaattaatttttttatcaaataaaaaaaaatatattaaataaatgtataaagaaatattatatgttatgaaaaatattaaaaaacagctttttagcaaattaagcgtgcctggctgtctctttggcacaaacagcgaaaggaattgtgatcgtcatgtgcgaacagtgcatggcggctacttcccgccggtgatttgtctgccgggagaggcgctgtgcatgtcggcggtgcaaggtaggattttgaaagtttttgaaaatttcaaaagcaaattttgggttttgatctttttcaaaatttccgttgttttcgtttcgtcctatcgccactttttgagtttctttttgtgtttcgttgttgtccgtcaaaaacttttcgtttcggatttaaaattttctttttgttttcttccaatgaaatttggacgaatatattcacactctaagaataacttttttgataaaaaaagataattgatctcattgaaatattgtagtctagtagtgcaaactgcagattgataatgtggtgttcattatgagttcggtcctatatccccgcactttttatttatttagaaaatttttgataaaaggacaaaaaattctgaaatataaatacatggaataaaaatgaatttttaattctttaaaattttttaattggttagaaggccaactttttgttcggggcacatttgtaatggaggcacaagtgtcgcgccgcaccaaaaacgttgaccggcttacactgctgagcaactttgaccaggaagcgacagtaagtaaatagcaaattttatcccaagtgctaaataaaatttataagaaaatcccaaaaaattcttttttataagttggtgaaaacttgttttacatcgatttttgaaaaattttagacggcaatccaaaatgcttgcgtcgcggccatcgggttctccgagcccgggagccggagaactcgtttttcgaccataataaggtcgttatgcgaacacgaccgggcgagggctgcaaaatgggctcctgtggatttgccgcctttgccgcatttttgtcgctggcgagggtcgtgccgctcccggagaaggccatgagcggggccatcgacggcgtcagtttgagggtgcgggcagttgtgcacatcggtctcccaagctggccggggtgttgtcagctggctttcaccaagcgatcctgccagccgtcaacagcagggat

SEQ ID NO: 82508 - DNA, 617 bp, Heterodera glycines
  Genomic contig location: Contig_ID=SeqID_17952; Location=2438..3054; Strand=-
  SCN-specific regions: Sequence locations=1-170,262-287,309-314,339-617
aaaactttcaaaatcctaccttgcaccgccgacatgcacagcgcctctcccggcagacaaatcaccggcgggaagtagccgccatgcactgttcgcacatgacgatcacaattcctttcgctgtttgtgccaaagagacagccaggcacgcttaatttgctaaaaagctgttttttaatatttttcataacatataatatttctttatacatttatttaatatatttttttttatttgataaaaaaattaattttaaaaaagtaccaattaaagcatactgtaatcatgaaaataaaaatgaattaatttttcaacataattttatttcattttttcatatgtatagtattaaatttgatgaccgaaagaaaacattgtcactgaaaaaatgcgttggtaaatcaattttttttaaattttaacctaaattgacacaggaacacatttaaaataatccaattagtgattgttaaattttaatggattttcaaaattctatagttttcttttaaattgaatgtgacaaattcaaaagaagaattttccactgacgcattatccggtgcctttaaatttttcttacgggcaacgaaacagggaaccgcgctcgtccgcg

SEQ ID NO: 82509 - DNA, 881 bp, Heterodera glycines
  misc_feature (29)..(29): n is a, c, g, or t
  Genomic contig location: Contig_ID=SeqID_2957; Location=803..1683; Strand=-
  SCN-specific regions: Sequence locations=1-215,238-649,672-769,820-881
atgcgacgcgaattcggcaagcgatggcncaacgaagacatcgaaacggggcacgtcgttcggtattatgtgaagtgagtgaaaaataggcaaaatgccaaaaaaagtgatcatccaaaatgccattttttatccaattataaggacattcttgagaaaacgaatttcaattcgaaagtttttcctaatgatgccgttgaattcaaggacaaatctatttatattattaatttatttgttgcgccaaatcatcttttttatcatttatttttagaattatttatcatatcataaatattatcatacttcgaatttagttggcataacttttgaattctcataacttttcttttttttatcgaattttagaccacgattttttattttctaacaattttttaaattctaaagaaaaattcaaaaagggttgggttttctcccattttaggtattttgatgtgaatggtgacggtgtggtgcaattggacgagtttctccgagtcttccgcagggatttggccgcgatgacttcgtcccgaaaaaagtcggcggatacgggcctaaatgcatctcgaactgatcgcaatcactccggcaccggtcagaacacatcgggcacattgggtcgagtgcgggacccgggcttggcctggatcttggactttgacaacgatggcattgtgacagcggaagaattggattcggcggaccgaatgattcgaaaagtgccgaaagtgttgcccaaatttgacaaaaaggacgaactttgaataatatttatgttatcttatttataacatttattgttattattattaaggcccgatttgtatggatttccttattatttttttgcacatttattccgaactaaaaataaa

SEQ ID NO: 82510 - DNA, 1270 bp, Heterodera glycines
  Genomic contig location: Contig_ID=SeqID_2958; Location=622..1891; Strand=-
  SCN-specific regions: Sequence locations=1-397,429-923,945-1219,1241 -1270
atggcgtacaatcagcaggcgacgagttctggtgccatttgcatcaacaacacagccagcactttttgctgctgctacggcgatggctgcaactcggcactgtcccccgccgtcggtgggacaatgacgtcactgttccgctacagtatcccattggcactgttgttgatgatcggaagagtactgtactgatcaatggaaaaccttgaggacttttttcatatacttctgatatgtgttattttttcttcatcgttttaatgtatccatcgtactccaatcagtcaggggaagtcattcattggtgtggtgaaaagctgagtgaaaagccggcgacttcgcctccgcggcaatttgaaaccgcgatcgcgttctgcaaactttgattatttttctcaacaaattcctttaaaaattccatttcccccagtttatcggcaccgcggatcaccattccctctagaattttcaaacttaacccaataacaaattcgacccatttaaatgattcgatgagcaaaaattatgcgattttttatataattttatcacttaaatttccgtttcttaaattttagctgataatttgtttaattttgatctttcggtaaataaatgaattaaaaaaatgccaatttttatttgcttttcccatcacttccaattgaggaaattccgatgcccaaatcgattctttccttcacttccgctccaaggtcaatgccctctcaatgcctccaattcctcacattcgttctgctcacattatttgcttcacacaaagaaaagcagaaaactccgcccaaacaaaacgaacaaatttcagattttgtttttttcatcgcaaaataaatcaataatccgaacatcgattaagaattttaaattaaaattcagtcgacaaaatgcttttccgttatttggctcttttttatctcacatttaaaggtgagcaatttgtttatgattttgaaaaaaccagaaaaacccgcaatgaacgccgctcatcagcggctattagcccggggcgagcgaacggcacttcgttttcgagaatttttttttgtatttttaagcttttgcctttgctaattccgacccaattctgccgctgggcgacggagacgaaatgaccaacagacggaggccggaggatgccattccggtgatcgaagtgcgcggcgaggggaagccgatgagcgcggcacaaatccgcgaattggaagaagcggccaatgggggaccattggacataaaagtgggcaattaa

SEQ ID NO: 82511 - DNA, 557 bp, Heterodera glycines
  Genomic contig location: Contig_ID=SeqID_2959; Location=467..1023; Strand=+
  SCN-specific regions: Sequence locations=1-47,69-435,467-557
cgcggccgtgcgcggtggtcgtgctggcgttgggaattggaattcggaatggggagggaaagggaaaagtgccacatattcccgaaggatgggtccacggggtgatcaagcccgggattgccttcccacactcgctggtcacacaataagtggctttattctcgggacgactgagctccgttcgcttgaaaaggcaaacgttaaatacaagtgaaaagtgaaatgtcatcgatcaattatcgctgggagggcagtacaattagtaaaaagggaaattaaatgcaaaaagaaataaatgtgaaaataatgaaatcctagagcttcggcagttaaacgagtaaaaacccgacaatttcgattctctcttacacctccaaccttaccaaagaccgtccccggtctcttaccaggatttcacttcacaattgccaaagcaaaaaaattatttcaaaaaaataataattttgctaattttcatgcccttttcccaattttgaatcaaaattttatgcttcgtgccactcactcccaaccttacattggatcgtccctgatcc

SEQ ID NO: 82512 - DNA, 848 bp, Heterodera glycines
  Genomic contig location: Contig_ID=SeqID_2960; Location=44..891; Strand=+
  SCN-specific regions: Sequence locations=1-602,624-700,723-794,816-848
aaattgagaaattcttttcgaaaacaacgaatgattcggaaaaaggcggctttttggaagaaagctcggcgattggtaaaattttggcggccaaagtttcggtatatggacgtaagttgaatgccatgctggacggcggatcccaaatttctccaatttcggccaaattcttctcacaaatcatggataaagtaagccaaaagaacgtcatcgcccgctctgaaagccgcattatcgatataagcggaacggaagtgaagtgttacggtgttgtttgtcttcccattcggcgtgaagcattagagacgaagatcaatttattcgtcgcgcaatcagcttttggctacgatttgcttttcggcacgaatgccttaaaacaattaggcttcaaaatgatcgacgaggttagcaaccaaatcgtagacttctcacccgcttcaatgctcgagaattctccaatgatcgttttcaaaacatttgttattgatggccaaaacttggacaaaacaccgggaaattttggagggaagagaaaggacgcgtcggagcctaaaaatggcactgggaccaagaaatgtaataaaggacggcgacaagaaaagcagtcagagacagagaagtcatcagttcgaaatgccggtgaaagaaggcccctattgaccaaaacattcgtgccccaactaaaaaccaaggaaattccgatcaaaaattctgaaaattttggagaaagtgcggcaaacaaacagcgattgaattcggttcaaatgaaagtgggcgtgccaaacgaaagcgaagaagagtatttggagaaggaaaaattatggtcaaattcagttagggacaactga

SEQ ID NO: 82513 - DNA, 520 bp, Heterodera glycines
  Genomic contig location: Contig_ID=SeqID_2961; Location=494..1013; Strand=+
  SCN-specific regions: Sequence locations=1-93,117-520
atgggaaaaggaaaaaaacgggaacggattccctcgtttgcacatgggaatctcattcccggtgggctagaaaagaaagaatcaaagcggactcttaacaaatcaccatttgtacactctgttcatgtatttggaatgtccgtttttttcgaacgccaatttaattatcactttcaattggttgatttggtaagtaattaaaaaattaagccgataaaagacaataaaagttataaattttagctctgctgttcgaaaagtgattaaacagtctcaaattgctctcaaattttcgatattttttgaacctgtgccagataacccgaggctggcattgataaatttatttatgtttgtgacgaaaatatgacaaatttttcctgaaaatttcagtaacaaaccaatcccaactaattaattaatatttgtcaatttcgtttcacaatctgttgcttgccacaatctgtcaatgatttcgtcttcaatgagttcctttctttcttatgagattattgaatta

SEQ ID NO: 82514 - DNA, 975 bp, Heterodera glycines
  Genomic contig location: Contig_ID=SeqID_2961; Location=1585..2559; Strand=+
  SCN-specific regions: Sequence locations=1-12,34-68,91-425,447 -528,553-606,631-897,924-975
atgaccgtccctctggttgggaacggtgctaaaaatggccaacattttggcacaaaaaaagcgccatcgcaaagactccgctccattttctcatgggtctcaaagttcaatcaaaatggtcacattatgaagctctaccaaaagttgaagaacacccccgggggatggggccaactcatccgcaaaatgtacgctgaaatgctttcggcaaagaaactcggagctggcaacagcaaaccgttacgcgagaactgtcataaagccctccaactgattggagagggacgagcagttcaacgcgtcgatgttcagaagataaaaccgttccacgacttttggacccttttgaaaaattcggcactttcgctggtgacactttttaagggcactttaaaaacgaaaaatggaagagaaagtgaccgtaaaatgaagagagaaaacattttacgagcattgaaaacattttccacagaggacaactcatttttcttgcgaatggtccgaaaaaatggaaaaacgaacgaaagtaagcaaaataaatactttatttatcagggattttaaaaaatgaactacttggtagagtgattgttaaatgtttttcaaatttaagcacacaaagaccaaaaacgacgacggcaaaaacgattggcccctttgattatttttggcataatcatcggaggactgttggtgatcgcgtttttaagtgaatgggtaaaagctggtttttaaattcgaaaagacataaaattctgcctttttttcgagttgtgctattgcataaagattttaattttggttcaattagcgacaaattttgaagttaattcctaattgctttttttcattgtgttggacaacacagggaaagactaaccgtttgtttttacgttcattcttattttaatttattttctattaatcctttcgttcgaaaaggtcgtaaaccgataaatgcggactttttgataa

SEQ ID NO: 82515 - DNA, 508 bp, Heterodera glycines
  Genomic contig location: Contig_ID=SeqID_2961; Location=2750..3257; Strand=-
  SCN-specific regions: Sequence locations=1-213,235-508
atggcatcgcctccggctattctaccgtttgggtgtgcacctgtcgcacagtctttggtgaatttttagatttgctttcaaaaatcgttgccaacctttttgagccctttttggctgctccaccgcctccgcccattctgcgctcccccgctggctttatgccggcagcggcggtccccgcatatgccccatctgcggcattccctggtcttttttagctattttaatgctaattcttggctttttccaatgtttaggcattatgccagccgctgcttttcccggcctgacagccgccgccgctgtgcccgcttttgcaccggcagccgcttttcctggccttatgcccacttattcgcctgctgttgccctcccggcggctcagctgctgcgaatgccaccggcaatgtgcggctttccgcgtaaagccgcggctaaagcgcgcgccatggcacgaatcggaacacgaaaagggcgcgcggaaatgtcggcaaaagggagaaattga

SEQ ID NO: 82516 - DNA, 690 bp, Heterodera glycines
  Genomic contig location: Contig_ID=SeqID_2961; Location=3122..3811; Strand=+
  SCN-specific regions: Sequence locations=1-142,164-312,355-543,587 -633,655-690
atgggcggaggcggtggagcagccaaaaagggctcaaaaaggttggcaacgatttttgaaagcaaatctaaaaattcaccaaagactgtgcgacaggtgcacacccaaacggtagaatagccggaggcgatgccattatggcgggcggtgggggcggaggcggcaagggaggcggacccgcaggtgcagaagcgaagtaacggccgggtgggaggcaatcatactgtacaacataaatacggtagggataaacggtaggcaattaaaatgcgcaattaataccatgaattgcgacctgacagcactgaacccgagcaacagaaatgggctgaattggggaaaatatgcacaagtttttaaaacaaaattattctaattgatttgaattggggtacaaaagcacggaaacgtcagggaatctcccgaagaatcgacctttgatttgctgacacaaatttaattcactattttcaatcccaattggagaggggttagtcgagattaatttgcattggcaagaacagttatataccctaattaagcaatttaaattaaaaatctatttaataaattattattattaattcagattttatggcaaaaggctgggaaagtcgcgaaaaagctgctagcaaaatattaataaaaagttgttaaaaacaaagattttttttactctaatttttgtga

SEQ ID NO: 82517 - DNA, 90 bp, Heterodera glycines
  Genomic contig location: Contig_ID=SeqID_2961; Location=4148..4237; Strand=+
  SCN-specific regions: Sequence locations=1-90
atgtgtgtgtacacatttgcatttgcattgtcaacaaagttttggggacttggccaactcggccaattccctccgtccgtccgtcgatcg

SEQ ID NO: 82518 - DNA, 528 bp, Heterodera glycines
  Genomic contig location: Contig_ID=SeqID_2962; Location=367..894; Strand=-
  SCN-specific regions: Sequence locations=1-342,364-413,454-528
atgcttcccattgctaattgcattcttctgctaatccttctccttttcccgctgcgcttcacggcagcgggtggtcatccggaatatttgtccgctctgaagaacatctcgctcttgactacaaacgacacgcaagaagaagcggaaatggcgaagaacaggtgaattggtcgaaaatttaaatttgattcgagacgttgggagtacggcatttttccatcggatattttttttaatttcaaaatgaaagaaatttaaggactttcgacattccctttgactacttccccagagacatttttccgccgttgcaaaacatttcatttggcggacgaacaccggaaacagcagcagatgaacaaattgggagcagtgctgctacacacaaaatggatgctttggaaaatccgtagaattatttttaatttactttaaaataataataataattaagaatgcgtttaaaaatcggcattttaatgatcgagatgattctttctttatgtgactttttcctttcaaaataaa

SEQ ID NO: 82519 - DNA, 321 bp, Heterodera glycines
  Genomic contig location: Contig_ID=SeqID_17954; Location=305..625; Strand=-
  SCN-specific regions: Sequence locations=1-321
agtttgcaaaatgtccaattgacatatcttctctaagaacttttattaatggacaacagcagcaacattggcacaccgtcgcgtgacaaaagctcaaaggtccgactacggcacattcttggccgaattttcagcagcggaggagtggccaacaacaccaccaactccgatgatggcacaacgcaacagcaacagtccactgaaaagggatggcaccagcagagcatcaacgaaatttcggcacccagcgacgtggtccatcgaatccatgttggctatgatggccaaaagttcaccggattgccaccctcgtggcttgag

SEQ ID NO: 82520 - DNA, 246 bp, Heterodera glycines
  Genomic contig location: Contig_ID=SeqID_17954; Location=878..1123; Strand=-
  SCN-specific regions: Sequence locations=1-101,125-246
ggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactaaaattcgagacttggacatttcgtgggctggacattttgtgggtcagc

SEQ ID NO: 82521 - DNA, 81 bp, Heterodera glycines
  Genomic contig location: Contig_ID=SeqID_17954; Location=1544..1624; Strand=+
  SCN-specific regions: Sequence locations=1-3,25-33,56-81
caatttattgacgtgtttatgaattcgttcgccatttagcccccctccccatctctgttccgtaacaaattaattgaaatg

SEQ ID NO: 82522 - DNA, 1413 bp, Heterodera glycines
  Genomic contig location: Contig_ID=SeqID_17957; Location=697..2109; Strand=+
  SCN-specific regions: Sequence locations=1-348,373-432,455-525,547 -1172,1194-1413
atgagcgaatttgttgattggattttgggatttaaacaatttgaaacggttgcttttgctcattatgctggaaggttcgactcgcattttgtgttaaaagagctgactgaaagaggggtcgaaaccgagttgatgatggcagacctgaagatttatcaaatgaaagcgcgtggtatgtattttcgggatttctggctgctcagccaaaacaagttggcagatcttccaaagactttgggtttgaaaaccttagcaaagttgtacttccctcataagtacaacaaaaatgtgaactttggaaaaaaattgacacacctaccaccccttgaagattattgtccggacaatatgaaggaggaggaatgtgctaaattggtaaaatggcacaatgaaaattatagaatggaatttgagctaggttagagaaaatctgttttccttttaaaattgaattttaggagagcagctcaaggtttattgcgaaaatgacgtcgaaattttgatggaggcaattttgaaattccggcaattgtttttggagattactgatgggatggatgtgttgaaggacagtgtaacaattgcgggggttgtgatgagaatttttcgaacaaaatttttgagagaaaatcatctcccaattattccggaaggcggttatgagagagccgagaatcagagcaaaattgccgtgaagtattttgaatggttggctcaaagcaaaagagtgagacttagacacgcatgcaatgggggtgaagtggaaataggggattaaaagtggattgtatcatcggagctgagaaaaaaatcattcaggtaggcagaatttccttccctattttattttttgctaaagggatgtgcgtttcatggatgtccaaaatgttttttgccctggaccataggacccaatgggcgttgtatggaagtaaatttccgacgaactgagacacgaatggagtttttgagggaaaaatgtattaaactcctcggtgggggaagtttgcgtgtgttcttttctaatgtttggagcattcgggccattcgtgggtctacgacgggcgcgtcgccctcgttttttttagggatagggggacgtttctccgcttcgcggcctcaggacgggcgcttcgcgcccgttgtttaattttgtggggaacatttggccgcttcgcggcctccggacgggcgcttcgcggcctcaggacgggcgcgtcgcgcccgttttttaattttgttgagaacattcggccgcttcgcggcctcaggacgggcgcttcgcgcccgttttttcttagtcggccgcttcgcgcccgttttttagcttgttatgccgttcgcggcctcagtcaggcgcttcgcgcccgtttttcaaaatttgttgaccttacagggattataagaggtgca

SEQ ID NO: 82523 - DNA, 619 bp, Heterodera glycines
  Genomic contig location: Contig_ID=SeqID_17958; Location=73..691; Strand=+
  SCN-specific regions: Sequence locations=1-34,57-98,129-153,175 -274,296-619
atgttcccctgtaaactctggaatgtagttgatcgagttgctgaagggttgggaagaaccaataactcagttgaggtgaatgattggcaattgcagagatgccatttgtatttatttctaagtttttgtttatttggaggagctaaatcatagaaatttaaaaaattcacatttcaaaacattcatattttgtgcattttttatcagtgcggtacttttgaaatttttaatggcatctctgttctattgcaagtgtggtttaggcttggcattgcatctggaatgttcatctgaaaggaaaccagcgcttgagctcattcattcgaaaaatgattgaagaggataatatgtgggcggacagaattgctgattttcaggcagctccagcggatggcataaggggtccatatgagcgacggaaggcaaaatacataaggcaagacaacaacctgcaagctttagtcgctgattttgatcaacgtgatccgcttgaatacctacgcgcatgtgcctaccacttacacttttaaattaagaaagatcattcaaacatacattcaatttgaactaagaaatttaagaaagttaatccatgtatttgtgcgataatatgcgataa

SEQ ID NO: 82524 - DNA, 1709 bp, Heterodera glycines
  Genomic contig location: Contig_ID=SeqID_17959; Location=294..2002; Strand=-
  SCN-specific regions: Sequence locations=1-526,555-876,899-1238,1338 -1709
atgtcctccaaaactaaaacaacaaaagaattgatcgactttgctgcggagcagctcgagtgcaataaacgggacctcggaaccgtattattgagtgccacggagcgaagaagtctgaagaaacggatcaccgaggcattgaatcgcgggtcttccctttggtatcgattggatgaaggatacatcgaaaatttaaacggcttgaatttgacggtgactccggacaggccctttcttgggttaagaccccgagtctcccatcgccaatttgcctttcaaattttaagaatcaaacggacgcagggaagtgcccttggaccaatgttgttagccggtgaattcttttatcctctgggcggagttttttttgatcattaccgggacgaattcgatgattttggcgacttttttgcgggatttatgaaagagaaggaagaaaaggcgggtaatggaattgagagtgcgggcgagcgcggtgcaaatgatagcagtgggctgataaatagaaatgtaagcggaacgggtaaaagaattgaaattctgagccaaaatttgggtttgattataacggaaaaggacgggggtttaaaattaaattatgaaagcaaattgggttcacaaaatgaggaaggaaaggctgtgattaaggttaaaggtcgcggcacaataaagggaagcatttttcttttggtattgtacctgtgggggtcgatgctaatgagtagagggccaacaatactcaaaacagtgaaagggcatgccaattagagttggaagcaaattcatcaacttcgacggcacattccacaccggcgggtcagcaaataatatgtttgaacactcaaaattcgggttcagaaaagagctttggaggtacagtaattggtgtggaaactgtggcaccaaaggagaatggtacggtagatcagagagtgggtttggttaaaattcgaggtgaaaatgattcaggatcagcaaaggcagtaaaaaggtcacacactgatttgcagccaaaggcaaaggcacaaacgggtttgcctcaaaatgggtttcgatttgatgcccttaaatgggcccagatgcatcaactcatacccccgcccactgtcttgtaccccaatccacagatattgcgtactgcggtggcggtgccctttaaccagcagagttgttcgagcagttcacttaatggtgtacaattgatgccaaccaatggagaaatgatcgtaactccatgccaacagcagcagccgcaacatcaaagccaaccacaacaccaaaatcatcagcaacagccacaacaccaaattcaacagcaacaccaccaaatgcatcagaatcaacgccaaagggcaattgaaggggaaagccgattcacaccgcggcgttttggcccgaatcgctctcatccttatggaggccgaacaactgcttcgcttccattcattagggaacaacaggaaacacaactccctatcaattggccatggaatccccttccccgaattcaaattccagtcgaagttcgtcgtgtcctcttgcaccgattagcacaggagcgggatcatgcctttggtcttgctggagtcatgcgccaatggaatccaccaatggcccttttgttgctgtcaatggaagctttctacagtactcttttggcatttgtagtgaacgaaggcgagccggggccatcacttccccaactttaa

SEQ ID NO: 82525 - DNA, 1004 bp, Heterodera glycines
  misc_feature (835)..(835): n is a, c, g, or t
  Genomic contig location: Contig_ID=SeqID_17961; Location=841..1844; Strand=+
  SCN-specific regions: Sequence locations=1-89,111-580,602-1004
atgctttgctccgtccgtcgactgtttctccctcttctgtttctgctcgtacttttcttccaaaaggcaatcgcccgacgacgaaaatgtccaggtgggggagaaaaatacgaattaacaataagggtaattaatgaattattgttattaattaggggataatccatcattgattaagggacactttctgaggacaaaattgtgcgggaaatgtttcgaaattacaccaaaaaactgccggacagtgaacacaaagacgagagtgttcatgtcgagattgaaatgcatgttcaggtggtcatttggctgagatggcatctgccaaaccattgagacaaattggcaccgattggggaattaatgaaaagcataaaaagggaatttaaaaaggtgccatccctccaaaaaaattactattgctttatgaacaggacatgggttcgctgaacgaaatctcggccgacttcgaaattgacattttgttcacccaactttggcacgacccgtcgctgtccttcgtcaatttgagttccgaatgtgtgcgcaacatcacaatggagtcacgttttttgaagggtatttgttccaaaatacattaaaattaattttgtcggaatttcaatttgcagacatttggacaccgaacacggtcagtacgaggcaaaatttacagaaaaaattgaaaggaaattaattggctatcacagtgcattatcaacgcaaaacggacatcagtgcacgcatctccggcggacaacataatgttcattctgtacgagaacggcactgtttggacaaaccatcgattgtcagtgaaagcgccgtggcgcattgngtgggccaaaaggacacaaaattaatgggaaaatcaaaaaagataatgggaaaaaatgaaaatgctaagtatttctaatccatactttaatcaggatttaattcagaaaaaatgccaaaaaatggccatggggatttgaatcatccatccatcaggaaaaaacagaata

SEQ ID NO: 82526 - DNA, 898 bp, Heterodera glycines
  Genomic contig location: Contig_ID=SeqID_17964; Location=1438..2335; Strand=-
  SCN-specific regions: Sequence locations=1-287,309-349,371-694,725-898
atgaaaaatgaatttaagcatcaagaaaagaatggagccaaaattatgacgaaatttgtaagaaaattggagtaagcaatggaacaattgacaattggaaaagaaaatttgttattaacagtaaaataattgaatgatcatttattggggaataaaaaaagaaaatccaaaaatgagtgacaaagaaatcgcgaaaaacattgaaaactgatcgattgtgccttttcaaatggaagcaacaattgcggaacccgtcagctgggccccagcggtttttgggctataacttttttctttgacatctaaatcaaaaattgttggtatcatttgaaagctgtaaatgtcctctattagccttcaaattttgaaaaattatgtaaaggttcaaaaaaattatggccagaacaactcaaaaaaccagattttccaacttttatggccataaatttgttcaaaatggacgaaattgtttggaattttgcaggctaatagagcatctgaagggctttcgaatgataccaattatgtttgatttggatgtcaatgaaaacagttatagtccaaaaacatgctggggcccaaacgtgctggggcccaactgacgtagaccgaacaattgtgggagaaataatgtatgattgaaaaaaaaacgaattgaattggcgagaatgaaaactccgaaatatgtgcttgcttttaatattttatttaatatcaaaaatttgctttatttgttaataagtatttctaattatctaattacagtatatttgaaaaaatgctgtaataattaaggtgaaatgttatgccaatgttttattattcttttttgcattgttttaaatgtcaaactcagcagcaaagacaaatttaatgccaaggaaaacaaaataataaa

SEQ ID NO: 82527 - DNA, 705 bp, Heterodera glycines
  Genomic contig location: Contig_ID=SeqID_17965; Location=451..1155; Strand=-
  SCN-specific regions: Sequence locations=1-9,32-606,648-705
atgaagtgattttctttggtttattttttaagctaacaatgtaagaaacctttttactcaaaggaatactcctacataaattatggtttttgaatgcgttttcttgatagtttcagcgagaattctggcaataaaattcgaattcataattgagaaaagaatgtttgcgttgagtagtttatttctaaattagccgatcctttctaacgaaatcattttttctcacatttttctttctgagaaaaacagtcctattacaaaatttatttcggagccgttatttgaaccttaaacaacatgaatctcttcattaaattaataaaagcgaacaaatttcgttcattagcatgcttttacaagaaaaacgatattcaggcgacaacgaataataagaaatactttttatcaggatcagacggccaacaataaaaaaattattttaaacttttcagcattccgcaacaacacgttggctgtagcccgtcatggttttcggaaaaacaaagaatagttaaaaaagtcattgcagaatttcggttataatttctcaatcccagacaggacgaaacacttttagaagagaacttgttgaaaagtagggtttgcattaaataattctttttattaaaatattttatgtttaataactagcagaaaatttaagaaatttatcatttaaacttctgttctgaagaaagaaataaa

SEQ ID NO: 82528 - DNA, 685 bp, Heterodera glycines
  Genomic contig location: Contig_ID=SeqID_2963; Location=1064..1748; Strand=+
  SCN-specific regions: Sequence locations=1-302,325-685
atggcgttcccattaggcggcccagccacatgcattgcaaaggcgaaagcaagtctgggctttattccatatcatggtcgcaaagctgaccgatatgggtgccatggtcgcgaagcagaccggcactgtgtcatggtcgcaaagcagaccgacactgatggctatggtcgcaaagcagaccagcctagccatggtcgtcctttaagggactggccattgaaccacaatcctcaaaaggcagtccacatttatttgatgaactcagatttcctacgttacttctcaccagtccactggtcttgacaaagtgcgggaccagcttcgcaccggctgttggccagcaacgataaggaattcatggcgccaccattgagcggcccagccacatgcatctctaggcgagagcaagtctgggcttgctttccatatcatggtcgcaaagcagaccgatatgggtgccatggtcgcgaagcagaccggcactgtgtcatggtcgcaaagcagaccgacacggttggctatggtcgcaacgcagaccagcctcgccatggtcgcaaagcagaccggcgtgtacactaatatcatggtcgctaagcagaccgatatttgccatggtcgcgaagcagaccggcatgtgcacaatcttatcatggtcgcaaagcagaccgataagattttgatacaa

SEQ ID NO: 82529 - DNA, 565 bp, Heterodera glycines
  Genomic contig location: Contig_ID=SeqID_2963; Location=5163..5727; Strand=-
  SCN-specific regions: Sequence locations=1-565
atggcacaacagcaagcgataacgaagaagcgtaaagctatgcaagacggtattttcaaggccgaattaaacaactttctcatgaatgtttgaagaaaagcactttcttcttcagttgaccccaactttccctcctcctcctccgtcccgccaccaaccaacgaatgctcaattctcgccaatccgtcgctttctgtcgcccatttgtcgtcctcggtcggacgaacgacggaccgaacgcgtaaattgggggaggaacaaaaccgactttcttcgaaatgggcgacctaagttttcctccccaattttccctattttccaatttaattttcaatatttaagcacataattccgaggcttcgaccagcaccaattttctgctcggactttctcttcgcaccaaaacagcaccaaatactacgcctacgcgtccgccgtggacaaagcgctcaagtcgttcgagtcgaccaccgaatgagccgatctgatcgcagctttgggaaaactaggcaaagtttgttggcgcttttttgggctgagattaccgattttctaattaaataaa

SEQ ID NO: 82530 - DNA, 935 bp, Heterodera glycines
  Genomic contig location: Contig_ID=SeqID_2964; Location=1224..2158; Strand=+
  SCN-specific regions: Sequence locations=1-150,206-222,464-473,495 -708,731-763,806-822,844-935
atgattagaagaggtacaacagagattagaagaggtgaaacagtgattagaagaggtgcaacaatgattagaagaggtacaacagagattggaagaggtacaaagattgtaggaatggtacaataatagtttaaaagggtaaaatcatggtttaaaaattaaataaataagtaaatggttttataaaaaaatataattaaaaattgaatgtgttaataatttttaataattataaaataaattccttctttaatttaaaaataaataagaaattaattttatattaaaacatttattcatcaaaaaataatttaatataaattaaacaaacaatattaaattaattaaaataaataaataattaattttaaaacaaaacatttatttataaaaaaaatttaattcaaataagaaaatttaatttattttaataaaataaaaaatattttcaattaattaaaatatgtaaaaacagcaaaaaatacaaagaaaataatttacaccgtccggactcgaacttcgccccccccccccaaaaaaagatgcctcagaatccccaatcacacagggattctgaggtcttaacgatgtcaaaagtaaaatctgatcacgtattcgtgatcagcggcccaaataacgactaaagacatgtttttggaagatttttgacgaaaaatttttttcactcaaaaaccatgtgcacccccctttggtcccgaatcccaaaatcggttttatttttgtaacaattcgtaagaaagtgataaaaatgtaaaataagatttatattttaaagaaaaaaattgcggatttttgtagtattttaattttcaaaaatttcttttcagaagggggttatgaatttttttctgaaaaatcgaaaattttcagaaattctggaataactttttttctttttaagatagaaatcccaa

SEQ ID NO: 82531 - DNA, 64 bp, Heterodera glycines; identical to SEQ ID NO: 59455
  Genomic contig location: Contig_ID=SeqID_2964; Location=671..734; Strand=-
  SCN-specific regions: Sequence locations=1-64

SEQ ID NO: 82532 - DNA, 604 bp, Heterodera glycines
  Genomic contig location: Contig_ID=SeqID_17966; Location=1194..1797; Strand=-
  SCN-specific regions: Sequence locations=1-129,151-335,357-571,593-604
atgaagcactatccactcggattgttgggcagcgtacaatcaggtgttagttcaattgttcgggtatatgattaattgtgcagatcgctgctggaggccaattcaacctcttgcgtgttaatcatcggctgaactttgtggatccccaaacaggagcgcatacccaaaacattgagcgtctgtggcgttccgcaaaacgtcgaaacaaggagcagagtggcacgcatcggcagatgctggaaagttacttctgcgagtttttatggcgtcattccgtcaaacgaagagatgtgatgcattcgaagaccatttgcaaaacatcgttgcttatatgccaccaaattaatatgatttctttcgatgataataatttttaggagaaaaaatgaaaaaaaaaattgaatttagataattgttcgaatccggcgaaatgggtcgaaatggacatcatattcgggttctacgaccccgaaaacccatagaaacgactttttattaatttcaaatcaatttaacaaagagaaaaattttgttgacacaaaacccgaaagtacccgtaattataacaggaaacttaaaggagaataaatttggagaaaataaa

SEQ ID NO: 82533 - DNA, 2293 bp, Heterodera glycines
  Genomic contig location: Contig_ID=SeqID_17968; Location=807..3099; Strand=+
  SCN-specific regions: Sequence locations=1-412,437-554,583-590,612 -911,933-1084,1106-1948,1971-2293
atggtcatagtcacgaactggagctgcagcatgtcgcatcacgtagttttggatgataaaatttttgtactaatcgaacttgtgtgtaagatgggtctaaaaaaagagataataacagcaatagttagggcttcttttttttaggcaaatgcctaaaatttttgcgcactttatacgcacaattaagacgaaaaacgagttttccggttggtttggcgtgtctacgatggcttttataatgcctatttttgcctatttcggggtttttgtgcttaatgcctatttttgtgcctatttcgccctttttggcgcctttttcaggattttcggaaaaatccttaacaaaaatgtagtaaaaaaaatacaccccctaagaatcgacccgaaaaaatttcgaaaatatacccataagaatttaaaaattttctcaaaaattgatcgccaaaattcgatatttttttccttgaaagttttggtttaaatttgtccttactcaaaaaaaaacttctaaaaaagaagccctagcaatagtaaatctcacaaatcagaatcacttaaataaaaaaattattatttaatattggctaaatatatttcttctattttaaattcaaaaatcatcaaatatattgggcgagaatgagggtcccgttctctcgcttttgcttgaatgtacagttttgttcggaaacgaataatgcgggatttccgcaggggatccccttaccgcgatttcttaattccattttccgcttctgcatacgtttttaatttattccagcttcttttcttgaaaagcagtcaatgaatttgcgcaagaagcctaaggtttaaggatgttctttttatttaaatagcttacaatttgttatccaatttttaggtcgaaccaatagaagatgagattcctgagaatgagcagcaaataaacatctctacccgttcacataactcttcttataacgcaagttacatctttttaactttacgatttaatatttacagtctgatcgtgtcaatgaaaatgatttggttaaatcgctgtctcaatgtcttctggcaaagtatgagttgcttaaacgcacttcatttaaaaaagaattcagcgtttctaaacgagggtttgttcgtgatgccgacattggagaaatgttctcagaccgaagagaacgcgagttgcgagcgaatgttctgaagaagagtgagaaattgctgatggatgttcttggataccgagtcagaggaggaatttctgaccgttttttattcttttttagttagatcgagatgaggaagggaagcgtttttacctctcgacaaatttatgtaaaggcattgcaatggctatggtgagtgattcttttataatcatgtggtgacgccagtttttccattttaaaaaaatggaaattataaaattgtaaatcagaaaaagcactcaaaatattttgaaaatatatgatactaatttaaaaaaaaagaaacatttgaaaattgttttgcacgctcttttattacatttttaaattttgaggtcaaggcacaaaacaaaagtaccctattccgaattcctgacccaaaatccgaccaaaataaattctcttaattttagttgtgactttttgtttgggacatgttttcgactaattaagtagctcaaaaatatttaggagatatctgacgacacacaccgaggacttaacgaatttgcagatgaagatgcgtttgaggaagaatcaactgtaaattcagccggggaggagaactaatgaaacatttaatttacctaaatatttcagcaaactgaacaatttacaaattgtcttcttgaaatggcgttaatgttcattttcatgtcgaagcgacacatttcaaataaaactgaaacagaaaaaggagtggaccaaatgctcctaaagagtttcttggttaggtctttattttttaaaggatttctgctgacagtaatgggctattttttgattttaggatgatttattcgatgcttttgaacggagacctctgtcaagtaaacagttcggcgaattgtttggtcccgctaaatcagccgaatttattgctcacgttagcgctctaaaatttacatgttaattcgataatgaccaattaagggttggttgcgttgcgacattcaaagagacactgtaaccggaagtgaacaagttttgtatcactgggggcctcgatcagaaacggtcgtcagcaaaaaagtgaataacgattatatttacaattagacttgaaaaagatatttgcaaatccatttccccta

SEQ ID NO: 82534 - DNA, 1596 bp, Heterodera glycines
  misc_feature (1485)..(1485): n is a, c, g, or t
  Genomic contig location: Contig_ID=SeqID_17968; Location=1..1596; Strand=-
  SCN-specific regions: Sequence locations=1-179,201-208,237-354,379 -935,964-978,1005-1059,1081-1492,1525-1596
  Gene Ontology: Mol. function=RAB small monomeric GTPase activity; Cellular component=Golgi apparatus; Biological process=signal transduction
gaaaagaagctggaataaattaaaaacgtatgcagaagcggaaaatggaattaagaaatcgcggtaaggggatcccctgcggaaatcccgcattattcgtttccgaacaaaactgtacattcaagcaaaagcgagagaacgggaccctcattctcgcccaatatatttgatgatttttgaatttaaaatagaagaaatatatttagccaatattaaataataatttttttatttaagtgattctgatttgtgagatttactattgctagggcttcttttttagaagtttttttttgagtaaggacaaatttaaaccaaaactttcaaggaaaaaaatatcgaattttggcgatcaatttttgagaaaatttttaaattcttatgggtatattttcgaaattttttcgggtcgattcttagggggtgtattttttttactacatttttgttaaggatttttccgaaaatcctgaaaaaggcgccaaaaagggcgaaataggcacaaaaataggcattaagcacaaaaaccccgaaataggcaaaaataggcattataaaagccatcgtagacacgccaaaccaaccggaaaactcgtttttcgtcttaattgtgcgtataaagtgcgcaaaaattttaggcatttgcctaaaaaaaagaagccctaactattgctgttattatctctttttttagacccatcttacacacaagttcgattagtacaaaaattttatcatccaaaactacgtgatgcgacatgctgcagctccagttcgtgactatgaccatttgttcaaggtgtacaatggcattgtttctcggaatcccttaattttaatagttgctcataattggcgatagtggagtgggcaaaagcagtttgctccttcgcttttcggacaacactttctccagtgagtttataacctttttctttattaaattgataattttaatttttagccagttacatcacaacaattggtgtggatttcaaaatacggacgattaccgtgatgggcaaaaagattaaacttcaggtggagtatcgacatttgttttgtgggcggggaggggggctaaatgggtacatatattggctctattgccgttacacggtcataaaaaatttaacaatcacaaaataacacgactctgcactttgagtccatcgacatttatgagtccaatggcaccttatgagtcaaatcaattttttataagcccaatcttttccaattaattaaatcaaattttaagcacattatttttatttaaaactatcaccaatctaaatcacaaaaaataaatacaactaatctcaattatagttgtcgaatttctccgagaatccttttaagccctggcgctgctgaacatttttaaaaatatcactaaaaaaatttttggcccgatgagcaaaaaatttaaaaaatccataagcggcccatcccatccctcgtttataacaattaagttagctntaactttagatttgggacacagccggtcaagagcgattccgaacaatcacttccacttattaccggggcactcatggtgttatcgttgtgttcgacgtgaccagcattgag

SEQ ID NO: 82535 - DNA, 248 bp, Heterodera glycines
  Genomic contig location: Contig_ID=SeqID_17968; Location=3447..3694; Strand=+
  SCN-specific regions: Sequence locations=1-13,36-221,243-248
atgggttcgtctgcattaaaacaaaaaacaaatgggtctcaaccactccggaactctgtcttttggctgttcctggcattttgtatggttttagaggtttgttgtttttgggcggtagttccgcagaatttccattgctttcgttgccggggttcaaattccgatggcattaactggcaaaggtaaagattattggtcccgaaaaattttttttaaataagttttgagaaaattattttcaggggtaa

SEQ ID NO: 82536 - DNA, 1242 bp, Heterodera glycines
  Genomic contig location: Contig_ID=SeqID_17969; Location=1..1242; Strand=+
  SCN-specific regions: Sequence locations=1-390,415-474,581-627,700 -700,742-790,821-833,856-863,1002-1070,1212-1242
  Gene Ontology: Mol. function=formaldehyde dehydrogenase (glutathione) activity; Cellular component=cytoplasm; Biological process=alcohol metabolism
tgtcgatcggtgggggagggagtgcgaagtgtgcacgttgcattcccttcatcccctgcttcacgccgcagtgtcgcctatgctactcctgcaagaaccccaaaaccaatctgtgccaaaaaatacggtttgagtcatttcattggcagcggagtttgaccgtttgttttccgtcagtgccacccaagggaaaggactgatgccggacggaaccagccgtttcacgtgccgtggccaacaaatcgcccactttatgggctgcagcactttcagcgaattcaccgtctgtgccgagatttcccttgccaaggcattcatttgtccccctcccccccccccccctaatttgccacccttttccatgttgacaaatcggctctccttgacaaagtgtgtctgctcggctgcggcgtctccaccggttacggcgccgtgttgaacaattgtcgggttgagcctggcagcaccgtcgccgtgtgggggttgggcaccgtcggattggccgtagtaatgggcgccaaaaaggcgggcgcctctaaaattgtcggcattgacttggaaaccgccaaattcgagaaaggtgttgcggtcgtctgcttggttttgtccaacagcgtcattcatttcaagcgaagcatttcggagccacagaatttgtgaatcccaaagaagtgccagcggaacagactttgcaggcatttctgatggacaaattcgacggaggtttcgactacactttcggtgggcactttcttttccattttccaatttacctctccgtcactttgcagaatgttgtggaaatgtacaaacaatggtggacattcccttggtttttgtttctttcatttttctgacttttagcgccaagccctcgaggcagcccacaaagggtggggtgtttcgtgtgttatcggagttgcgggggccggggaagagatcaaaacgcggcccttccaattggtgacgggtcgaacatggaagggcagctcattcggaggttttgtatcagtgatacgtgaaatcacttatgaaaaagtttttgtaatttttattgaataggtttcttaagggtggaaaagtcgcgaccaaattccatcgctcgtcaaggaacatttggacgggaaattggaccttgacaagtttatcacgcacaaattcgccttttccgacattaacaaagcattcgaatgcatgacaaagggcgaaaggtaatcagaaatgaccaaaaaggaaaaggcg

SEQ ID NO: 82537 - DNA, 297 bp, Heterodera glycines
  misc_feature (3)..(3): n is a, c, g, or t
  misc_feature (38)..(38): n is a, c, g, or t
  Genomic contig location: Contig_ID=SeqID_17969; Location=1688..1984; Strand=-
  SCN-specific regions: Sequence locations=1-297
atntcgccatcaatggttttgcgtggcaccgagtacanttttcacatgcgagtcgatctgccaaatcaaatcgatcgaaaacgcgtaaatcgatcaaatttttccatttgttaattttggagaaacaccgccctcttgcagggagccatcgtcagaaacagcacaacggacggagtttggcaaagcgaagagagacaattgggccgttttccgttcactttgggcgccacttcggacctcaaaattgctgctgttgcgcaagggtttaaggcattcatttcactcccattccattga

SEQ ID NO: 82538 - DNA, 1875 bp, Heterodera glycines
  Genomic contig location: Contig_ID=SeqID_17970; Location=1308..3182; Strand=+
  SCN-specific regions: Sequence locations=1-20,122-209,231-514,553 -752,776-870,892-1276,1308-1650,1673-1875
atggtttcggaatattccgccagcaccaaaagtgacggaagcggtggtgcaacagcggcagcaacagaaaaccaaaatggaacggcacaacgccaacaacaacagcagcagcaacagcagcgtcgccaatcagtaaccacgctgaactgctcggcaaacggcggaggaagtgccaatggcggcaacaataaaatgccaaacggagggcggcaagtgtgccaaaatgggacaatgccaaagttgacggacaacaaccacaatggcatcatcaagaataatggcaacagaaactcacacagcagttgcggcacaacaatttcggcactttccggactgcaagataccggggcgtcgaagctgtacagcattaatcagcagcaggagatgaacatcggcagcaccgtggcgacgatgaagcataacggggagaagcagccaaacggcaatacaattcgtgtcggcagaggaccaccaaatgcagcaacaattgagacaagcggaggaaaagtaagcgaaattaaaattaattatagaaacaaaaaattttttaatgttactgggcaattcctcaaatttaaagcaaattctcattttttttgtaaactaataaatttctaagcaatgaacaatttcaaagaatttacacaaaattgtgtaaaattttttgtttcaacttcgtagtgaactgtttctgtaattaggtggttcagggagcagtaaaaatacaaacactaaactgcccaatttagtccaataattatatttaaaattatttgatcagtgaaaaatagaataacaaaacggggatcataaccaatacaccttcatgaggatttaatttttattctatttacatttttcaaaccacaattcctaaagaggggaatgaattatttgtcattggatggcaaactttgttcctgggggggggggggattatgatcgaaattttattttacaagaatacccttaggtttgaccaagattcaaagacaggaggcggtaattggtccaaaaagtgaggttgagaccaaaaccaagaaatttctcgactcgagaatctcgagcagccctaataataatgtccaatctttacccgcgccgaaacgatttgaaatgattatgtattgtgaatgaaataatagggccaatcctgggaatatttgccaacatttttcaggctactactttttattttatttgtccgttcttcatgtattttttgaattctaccaatattctaatttttttatgcggcaactattgccaaatttggtttatttttttaaatttaaaattttttaaatcactcaaaaactgcaattttttaacaaaaaaaagaaccattgtcatgacaactccgctttatgcagaagctatcgaagaagcgaaggaacagcaaaagctcacacaattacctactttttaagtttgtatttttttttaatttggcgttttgttagcactcttttaaaaataagttgccattatgctacgtggaggaaaagacaaaacgtagaaaagcgagaatgaacaattagctgtttggtctggctgatgctcgcatataaatttagctcccgactctacaatttgggagtaaacccacggaattattttttttttgaccgtgattgttattaatgttaatggaatgcaatttttaaaatttttgataacaaacaaatatgtacattttttagtttaaaaattgctaatccgcttaacatttttctattctatgttccgttccgataacttgtgataactgattaaatgatatatttgtttttggccctttccttttctaaatcgccttaatcctatgcttaatgtttgctctcatgtttaaaatcaattcattcaaaaaaaaca

SEQ ID NO: 82539 - DNA, 1471 bp, Heterodera glycines
  Genomic contig location: Contig_ID=SeqID_17971; Location=126..1596; Strand=+
  SCN-specific regions: Sequence locations=1-1331,1361-1471
tggaaagtctttcgtcagcggaaaatgcctttggctacgaatttcgcgtttggacagtttcgctggtgaacggtaagcaaatttaggcaatttaacgcgagtttggcattccgtcttatttgtaggtctgcgctcggccgtcccttctgcggtttctgagccgatccgacttcactccgattggccaatttctgctgatcagattcatactgcggcaagcagacggcccccggaaagaccatcggcccctgaatatcttggtaaatcagggattagtagggattgtcgactcatttctttgagtttcgacaacatcaccttaccttacgcatttttcagaatacaacggtggcaccagtctgaccctctgttggttgccggccaaaagtgttcttcctgtccaggggtacgaagtcgaattccgtgacattatgcaggacgccacgcattggtaccgtatgactgatcagttggtgcgcgcgtgcaaaaccaccgtcggctatttgctcaacggacatcaataccaattccgaatcatcacaaaaaacgcggccggcctttctgagccgagcgatccgtcgccactgatcacaatcgacgtggaggacagcggcgtccggtcggctgagcaacaaatgtcgacattggacagacaaattggggtgccattggcagacgaaatggtcagagagtcgccgccactcccggacagagacggtgagtgccggaaggcatttccaagtgatttgcatatggacaattcccgatcagattcaccgccaccgatctatcgccaaaccgagtccagcctccagtggagagacccgacactgaaggaagtgattgactacctgaagagtcctgaccagacactggtgctggacgcttccggctatcttcagcatttgaccttcaataacgatttgatcaaggaggagacgcggaattacggtaggtcgggatacagtggtcttttccaaactcgggttacggtagagtgggacccgtctcttcctcagaatgcccttttctgactcattcttcaccatttgaggtggcattgaatgtctcgtttctctgctgcacttcccaaaccccgaaatccttcgcaatgtttgtggctgcctcaaaaatttggcttttgggcgtgccaacgacgtgaacaaacggctgatcaacacaaagggcggcgtcaaagcactgacccaactgctcagacaaacgaatgtgcctttgacggtgcaggaggaagcgactgggggtcggttttggcattttgcttttcctctgccactgtttttgggaacgaacttttaagggaatgtaaaatgaaaataattatatcattattataaattatgtgattgccttttgttaaattgcagcactttggaacatttcttcggctgacgaactgaaggaatcggtgctgaaccaagctgccgaaactgtggtcacgcacattgtgtga

SEQ ID NO: 82540 - DNA, 674 bp, Heterodera glycines
  Genomic contig location: Contig_ID=SeqID_17973; Location=545..1218; Strand=-
  SCN-specific regions: Sequence locations=1-146,168-341,366-376,401-674
atgccaattttccgttccttctgctcctcctccgccattctcttaactgttctcgatgtttttctgttcactgcacaattcgccaattcgtcggcaccggcggacgattcattcgtttggcccatggaacaagtacagtaaacatctttcttttttgtctaccgtaacaaattgccgcccccctccttttacagtatgcttatgacccgatcagtgacacaatgctccgatcattgctcggatatgacgccaaaagtaagcagaacattcgcccatttcgaatttttctcgcggcacagccaccaaaagaaattgtaagaaaaggaaaaggaaaaatggggaaaaaattaaaattaattaattaagcgaatggaaaatgagaaaggaggagaagaaggagcgaaagaaagaattgtaatggcgaagagaaaaaatgccgaattggtcaaccacattttgaagaactttgcctcactgaaccgactcggagacgcggggaaaaagtgaaaaggcgacggaaaagcggaggaggaaagaacgaaagaaaagaaaagtgatcagaaagaggaaaaggaaagtgatcagacagaaagaggtgatcagccgaagcaccggtggcacatgccaagccagccattatgaaattatttttgaaattgtatttaatgaataaa

SEQ ID NO: 82541 - DNA, 821 bp, Heterodera glycines
  Genomic contig location: Contig_ID=SeqID_2965; Location=4787..5607; Strand=+
  SCN-specific regions: Sequence locations=1-763,785-821
atgcgcattgtggggaagtcagtcctgatacctagcattgttcaaactcgggccaattgcaactcgtacaaaagacaattcgtacaaaaagcaactcgtagaatagtcaaccccgtacaaagtcaaaaggtacagttttattagtccaatcgactttcatgaaatccaaaggtatttatttatgtttccaatcaattgataatacttggggtttttatacaataatattgttcatcttcgaacaaatcgtatctttttgatgacattcgaaagcatataaagtctatcgaaactaaactatataaaatctcagcgtttaggcaatatccaaaaaggatgtgtttgattaaataattgttgattattttcgtttgtaacttttttttaaatgtttgcattctcttatttatcgtattaaataccttgttcagactttgtgctttcgaatgataccaaaaattagggttggttcaaacatgaacaaagttactgtattaaaaccagaggtattattatttgattggactcatattatctttggactcataaaagtcgattcgactcataaagtgcaatatgtagagcccaatgtactgtaataaattttacaaaaataagcctaagcctaggctcaagcaggctagtttaagcatatgtacgagttgtctttgtacaagttgtcatgacatcggcttcaatatcagcgccggactaagccgggtgcctaccccggcgaatggcaccgtctcggggtttcagacctaacttttaaaaacaactatttgtcccatttatgcagccgtcgccgagcccggctaaca

SEQ ID NO: 82542 - DNA, 59 bp, Heterodera glycines
  Genomic contig location: Contig_ID=SeqID_2965; Location=4654..4712; Strand=+
  SCN-specific regions: Sequence locations=1-59
gcgcccaggccgcgtgtcgtccagtgtgccagtgccaagaaccgtcactgaattgccaa

SEQ ID NO: 82543 - DNA, 576 bp, Heterodera glycines
  Genomic contig location: Contig_ID=SeqID_2966; Location=702..1277; Strand=+
  SCN-specific regions: Sequence locations=1-22,50-177,244-311,336 -354,377-576
atgataactcctgtgagtaggctttttaaaatataatttaaattattttcataatggtttttcttggtattttctcattttttaattttcaggaacaacaccaaaagcggctcgaatttataaaaaggaaaaaaatgaatagcgtcggctgttacggctttgaggtgtgttgtaaattttttgttttttattttaatttgattttgtgggttgtgatcttgtttctgttttaattgttgctttggatcagttcccctcaatgcagaggttttcttctaattttcaaaattttcctttttggatggaaattcaatataaatttattaattaaaattgcaaaaattgattatttgagtttaaaaaatttccctgccggcgcctatcggcaccgccggagctaaaaaaattcctttgatttttaaattgactcaaaaatcccgagaatattagaactgacagaatttttcgaatttataaaaaatggcccagctctgatcggcgccactgacgatgcaacagtgaaaaattcaatttacggagagaaaaacaactttttttttaatttttggaaagtga

SEQ ID NO: 82544 - DNA, 548 bp, Heterodera glycines
  Genomic contig location: Contig_ID=SeqID_2967; Location=646..1193; Strand=+
  SCN-specific regions: Sequence locations=1-92,114-160,183-276,334 -433,470-548
atgacaagcggtcttttttgcacttatttgttagaaaggtttgtgctttttcatggcctaaaaacttatataagattttattcaaagatttcaaaaaaaaattttaaaaaattgatgatcaagtgtcaagagttttgcccaactgtttttcgatcagtctaaaaatcttgaattaaccaaatttaatttaaggattggaaatgcaacaaatgtcccaaggcttttgaaacggctatagggcttcacaatcataaaagagtacacaggtagattagcattaaatcaaatttaaataattataaatttttaattttaaacaaaaaaataatttatctcgaatagtagcgcaaaactttcaccagtccgccggccatcgactcccaccattgacttaacggggggaacacctgaaccagaaaaggtaagtcatgcgtataaaaagataaaaaaatttttaaattaaaaaaaacactcaaaatgttttctgaggaattttttcgaacacactcttttttgcggtggcttttcagaattagtgctatttgtta

SEQ ID NO: 82545 - DNA, 1276 bp, Heterodera glycines
  Genomic contig location: Contig_ID=SeqID_17980; Location=952..2227; Strand=-
  SCN-specific regions: Sequence locations=1-57,81-110,134-222,250 -267,303-965,987-1276
atggacccgtcgaagcggaagtacgatgtattccggccatgatctcgcgcagagggatttttccaaagaagggaggtgttggataagggaacaacccattattgattatgttttccctttctctccctctctcattgtctctcgccccgccccttgaccagctccataaatatgtctccctttcccccactcagggcattctcccattcattccaccatttcattattttattttattattatttatttcctgctgtcctcctcctcatttatttgtttaataaattatttatttatttattggacaacatttgttttggttaaaaaccaaacatttttattgttgtagcaaatacacaacaatttggcgcagtcacaaacaaaggacctgctctacatcttcgggtgagaaaaggcatcaaattttgttttaaggaccaaaagccgagacggcaaaacaactcatcaaaaagccgggattggctctgagttttgttaaagccgagtcggccatttttcaaaaagcagtaaaagaaactgttagcgtctaaagccgagtcggctcatcaaaattcgtcaaaagccgggtcggctcagcaaaaattcgacaaaagccgggttggctcgtcaattttgtcaaaaaaaaacaggcaaaagaactgcttattcttctaaagccgggtcggctcgacaaaattcaacaaaagccgggtcggctcgacaagttcttcaaaagccggttggctaaacaaatttgatggaccccaatcagcttaaactgattttggaggctgttttgaaggcatcggcgggacaagtcaacaattctgcggcattggcgacatcaatcgatgcgcgcctttcgacatttgagtatgaccctgagttagggcatacatacgacgtttggctcaagcgctatgggcagaccatcgcccaggacggacacgcactcagcgaccagtccaaagtgcagctattgattggcaaattgggcgaagcggagtacaagcggtacatcgacagcatcgcacctaagtcgcaaaacgacttcaactgggacgagacgactgcaaaattgaaacatttgttcggagaaacccgatcattgtttctccgccgtttcgactgcttccaaattcgtcaagacgcgcatcaggacgtacaaagtttgatcgcattgatcaactcgtcctgcgaaaatgccgatctttcgctgagcaaagaggagctcaaatgcatgatactgatcattgcaacgaattcacagatctga

SEQ ID NO: 82546 - DNA, 1014 bp, Heterodera glycines
  Genomic contig location: Contig_ID=SeqID_17981; Location=13..1026; Strand=+
  SCN-specific regions: Sequence locations=1-11,142-151,192-201,226 -253,275-811,833-839,861-874,901-1014
atgcaaatgccaagagagaaagaaagaaatgccaatgccaagagagaaagaaagaaatgccaatgccaagagagaaagaaagaaatgccaatgccaagagagaaagaaagaaatgccaatgccaagagagaaagaaagaaatgccaatgccaagagagaaagaaagaaatgccaagagagaaagaaagaaatgccaatgccaagagagaaagaaagaaatgcccatgccaagggatcgaaaagaggggccgattttcaaaagaccattttgactctatcaaaaccctgaaaatagcaacaaaagttaagcaataggcgcaaaaaaatccaaaaaaaatcatcgaaagatcaaaccaagcgaaatacatcaatttccagttttaatttgattcatttaggtgcattatttattttcactgctcgacttggaaagggcatatgtcaccgaaaggggccgtcttgtcggagtcgtggcactgagagacgtaagtcggcattttaataggctttttgatgataaatccttcgctattttttgtttagcttcgcatggcaattcaaagtgcacaaaatggcatttcccttcggcataatttgtacgattccgctgattcgtcatcgactggcactgaaaatagcttagacgaattcctttccattgatgtggaaaaagggatggcacagaaaaacgacgaaatgccacaaatgacactgaccgaatgtgacgaaaagcgaacggcacaaaaattggcaaatcaaacggaccgaaacttcggcgcaaatgcttttactgtccaaaattcagtgccgcttcaaataatcgaggcggaaaataaattgcaccaacgaaacagaagccaatcgacgcgaaaccgatggaaggaaggggaagaaagcgaagcggcacgagcaatggcatatttaagacgcaaatcagtggcattggaggatttgaaagcgttggaggaaacgccacttccaacgacggcagcggagaaagaaagggaaaaataa

SEQ ID NO: 82547 - DNA, 330 bp, Heterodera glycines
  Genomic contig location: Contig_ID=SeqID_17982; Location=974..1303; Strand=-
  SCN-specific regions: Sequence locations=1-330
ttggtacgcaattggaagccctggagcagtgtctgttaagaattcgtttgttcgcgcgacgtttcacctgcagtgttcatttgtcgcgtatttggttcgatcttgacgagatcgaagagcgacaagttcgagaattgttggatcagcacttgtgtgcgcatggcatcaacgtgtacatttacaaattgcggaggtctgaggggaaatcggcggctgcggagaaaatggagaattgaggagtaaaaacgatcacaaataaataaacccacgaactaacgtaataatgcatgagaattaactcaaacttttgttctgatgacctcacttctc

SEQ ID NO: 82548 - DNA, 1160 bp, Heterodera glycines
  Genomic contig location: Contig_ID=SeqID_17983; Location=336..1495; Strand=+
  SCN-specific regions: Sequence locations=1-33,76-654,676-1160
  Gene Ontology: Mol. function=protein domain specific binding; Cellular component=nucleus; Biological process=protein targeting
atgggtgaacaacgggatgaactcgtccaacgtgccaagctggcggagcaagccgaacgctacgacgacatggcaagggcgatgaagaaggtggggggggggggggggaaagaggtcgctggcacgcctaaccaaaatgtaattttttgtttttttcagctggtcgaaatggacgccaagttggacgaagaagagcgcaatttgttgtccattgcatacagaaaggcggtcggtgctcgtcggacttcacgacgtatcattacctcaacacaacagaggccgacactgacgaagaaacagaagcaaattgccaacgagttgaagaagaaggtggagcacgacatggaacagaagggccgcgaggcgttggtcggtggcattggcaaattgcgcactttggcaatctttcaaaaaatgaaatctccgtcattttgaacagttaaaaggatggtcaaagtgttcaattagttcgtgtggcattttctccgttcaccttaaaattgtttttgctgtttcaggacttgctggacaaaatcctcatcccgaaggttgacgagcccgtggcaaaagtgacctacttgcgaatgaaagccgacctccaccgctatatggctgagatcaaagaggccgaaaatgacggtaaaaagcgatcaaaccaaaacggtttttggatttgtaaggtcatctcccactttttcagatccccagaaggcaaagcagtcgtacgaggacgcgtggaatattgcgcagcagaaaatacggccatcgcatccgattcgccttggagtggcgctcaattttgccgttttcctccacgaattcatgaaaatgccagaagagggtcgcaaattggctcaaaaggtggtggacgcagccgaacaaatcgcattttaaccaccaatgtatttacatatcccaattttttgcaggctcatgacgacggaaatgctgatctgctggcggacacgagcggcggcgattcgtacttggagtccatcggaatcctcgagaagctggacgagaacatgcggatttgggcatcaacgcaagaacgggacggatcatcagaacgaggaaacttctaggatatgccgtcccttgtcacacatgtacaaatattgtaaagtaggcatttgtatcccatgtctgtatatattgta

SEQ ID NO: 82549 - DNA, 118 bp, Heterodera glycines
  Genomic contig location: Contig_ID=SeqID_17983; Location=2273..2390; Strand=+
  SCN-specific regions: Sequence locations=1-118
cttgtaatcagaataatctacagaaaacttttgtctcacattgtgccaaagccagtgtgtatggttctgcgacaaatattcctacggttttggtgataccgtaggaattggcgtcaat

SEQ ID NO: 82550 - DNA, 893 bp, Heterodera glycines
  Genomic contig location: Contig_ID=SeqID_17984; Location=831..1723; Strand=-
  SCN-specific regions: Sequence locations=1-29,57-268,290-893
atgtcgtcttcatcagcgaataattgtgatgaagcaaataatcaacaaaatttacataacgtgccaattgcaacaccatctgtcgctcaagtcactgaagctgaacaatgtcttatcaaggtttttaagtaaaaagattaatttatggagacaattaagattatcaattccgacaactattgtttgttttatgcaatgcaagcaacaatggtccgcgcagtaggcggtttgaaccgacaaaggtttcatgattatcttcgaggagtgggaggaaggctcaaaaaagaaacattcgaaatgatgaacgctcttaatgtttcatttggacaacaaaattacgatgctgagttttacgtgccaaggatcattgattggtggaatggcacaaatttcatggggatatggaaattcaaagcattcatctttgggtcaactggacactacaagccccttttcaaatatgggccggaggattacgttgtaccaattatactttactttgatgctaatcatttcaatggtgtacaacgaagcggcaacttgtttggcaaaccttattgtctaagttgtgaaaaaacatatgatcgtccaaagcagcattccaaaagctgcaaagctcgctgcataaaatggtttcaaaaaaggttcaaaatatattcccagtttttcattagctcacaaatgggtcccaccttttcgtgcaaacccattgatggatttcgtcaaaaatgcagtggatgcaacaaaatgttttataacaatgactgctaccaacatcacctcgcttcagattaaggcctaaatagtcattctcgagaatcttggtctcgactcgagaaagatctcggggttttttttggctctcggtctcgagtatcattacaaggaataaa

SEQ ID NO: 82551 - DNA, 745 bp, Heterodera glycines
  misc_feature (57)..(57): n is a, c, g, or t
  Genomic contig location: Contig_ID=SeqID_17984; Location=2232..2976; Strand=-
  SCN-specific regions: Sequence locations=1-381,403-407,429-745
atgcggtatgagtgcaaatcggtaaatttactttttaaaattctataagaattatanatgcttttatcaggcgtcacaaaaaaaagtacgtgatattctgcgacttgaacggaaaatgggtgaagaactacagactagaacaaccggaccttgatgcattgcatattgctgacaccaacgaaaatgaggagccaaatcccgaggatgccgaacttcaacaagaatttgtcttggatgaagaagaggttgatgaagacccatctgttccatgctgttcagcttcacttcaacgtcagaataccgctgttcgaagaaacgataacaaaacaggatcttcaactactgctctttcctcacctatgtaatgtttattattaaaccaaaaatttattttttattttagtcctgattatgtttttccatcgcagctttcatcagattctgacgaaaattaattcgtatgtcttagaattttgctctaatttatttatgcaaaaatattatcacgcattttgtttaaggaatctgtagtgactgcattgtttgtgtatgtgtttgggccgtggtaaagtggaactccacttcagctgttcttcgcattactctcattataacatttgttttaaaatgaatgtgttcggaccgtggtaagtggaactccacttcagcggttcgacacatatttggataagaatatattttgcaaaaaacaaccattttcattctaatttttaaatgtaataaa

SEQ ID NO: 82552 - DNA, 636 bp, Heterodera glycines
  Genomic contig location: Contig_ID=SeqID_17985; Location=115..750; Strand=-
  SCN-specific regions: Sequence locations=1-106,196-205,227-277,299 -312,339-636
atggaacggctgaaaacgaacaacaatggcaatggccaacaacaaccattcaaattggccaagggatcggcagagattggcaaggcgacaacaacggcatcggcacagaaaaagaagaagctgaagaaaacgaagcaacaggaagagcagaaaacaacagcagaggatgaacaggggaagaaggaggaggagcaggtacagtaatattttgtatttgttgcctaaatgaatgtgtacggtattcagtttttctgcaatttttttttacaaattttgaaataatggaaaggtctgaaatttttggtctggcttaacgtattttgtttttaaattcttttcggccaactatttggattttttttgttcaaataattgttcgcccaaaaattcgagtcggaaagatcaaaaccacttattttcggggttaatgcatctcctatttacctccttaatttgccaatttccttctgctggcgggcgatcgggtggcaaaggcaattaaaagcgcggatttttccttcatttcccgcttaacaaaaagttttgttcaatgggacaaattgactccacttcagtttattttttgcttcattttccaaattttttgtataaatgcgccaaattcgttcaaataaa

SEQ ID NO: 82553 - DNA, 510 bp, Heterodera glycines
  Genomic contig location: Contig_ID=SeqID_17985; Location=1086..1595; Strand=-
  SCN-specific regions: Sequence locations=1-74,106-510
atggctttaaaattaatagtgacatttccaattaaggcaacgatcttagacaatgtcagtggcccgggacaatttgaggttgaagaggaggatgaagtggatggcaatgacgaggagatgaagcagtacaacaaggaggatgaggggaagtcgacagtggctgaaagcagcgaatttgttgaacctgtgccaacggcagcagcggaaaaaagcgaagtgccaaaatcgtcagagaagcggcgggcacgcggcaaatccggcaaagggggccgccggcgggcattgcatgaccgtcggggggaaaagccgcgcgagacatacatccaactgatcggcatggccattgaggcacaagagtcgaagcgtgccacactgaccgaaattgtgggtgattttctgatgagccaactgatgggacttgaatcgatcgatgactttttgtggcttagtggtgaaaaattgggaagccgtgggtttaaatcccactgggtggcttccatttttatctaa

SEQ ID NO: 82554 - DNA, 725 bp, Heterodera glycines
  Genomic contig location: Contig_ID=SeqID_17988; Location=81..805; Strand=-
  SCN-specific regions: Sequence locations=1-329,352-410,441-614,636-725
  Gene Ontology: Mol. function=choline transporter activity; Cellular component=membrane; Biological process=choline transport
atggttgattggcttggcattatcgcaatcattttcttctatgtgttgatcttaattgtcggcatttgggctggtcgtaagacggattccaccaagacgggcgttggtgaccaaaccgaagaggtgggttagcggattatcattttaacacaaaattggttggcccacttttggccagcagatttaggggatttttacagtattcatagtatttattgaattagaacccccttgaaataaagccacccttttgagggggggggggatttaaaaataaagcccccaggggttctatttcagtaaatagcgtatgtaataattaaacatagttgttttttaagtttaatttggctaacaataagcaaatagttaattaaatcccgttacggtattgcaatacagtaatatgctttttaaatgaaataatatataaataaattggctcatttaatatatgtttagacttttttctttgaaattttcaggtgatgttagctggccgtaacattggcacgctggtcggcattttcacaatgactggtgggtgagggaggcaattaaaattattgtttggtacagttttataataatcaaaaacggaattagcaccctaccatagtgtaacatttcctttataaacctctgtcgagctaccgtaatcacaagccacaatttttgattttttttttgccctcgtcacacaaattgaatttagagcaaataaa

SEQ ID NO: 82555 - DNA, 317 bp, Heterodera glycines
  Genomic contig location: Contig_ID=SeqID_17992; Location=414..730; Strand=-
  SCN-specific regions: Sequence locations=1-94,139-208,250-317
atgccaaggtgtgcttcatatttttgttttgaatattcgttgaatggaatttcttggagtccattcataaatgcaagtaagtttgtcgtcgaccttatttaaaattaataaaataagtcatttaataaataataataagttctattaagtaaaaaatagatttggataatcctactaatgatcaatcccaatttttaaatattgcatcattatttaatataataaacaaattatattaagtaaaaaatagatttggataatcctactaatgatcaatcccaatttttaaatattgcatcattatttaatataataaa

SEQ ID NO: 82556 - DNA, 545 bp, Heterodera glycines
  Genomic contig location: Contig_ID=SeqID_17993; Location=2..546; Strand=-
  SCN-specific regions: Sequence locations=1-113,153-216,273-317,346 -389,415-524
atggtggcgattcttcgggcgaaaaatatgagccaatggaacatatatggtcatgtgccaccaaatggcaatgggaaaagcccggcgtgtcaatcaaatgggacattaccgatgtaaaaaattaattggccaaattaaaatcaaaatttgaatttcaaagttaattcagacactcaccgaagcggcggtggacacggattgtccatcatggaaaagtaaattattaaatgtattttaatgcattagttaattgtttttaaaaattaaattaagaccggatgaacaattgttgttacgtgcagatgagtaagggattgataaaaatatgaatttttataaaattatctcaaaataattagcgaaaaatttaatcattttttgggtaagtttcaattaaattaaccaaaaataaattttcatcaattttggtataaacctttaaatataatctttcaattacagatgctacaacaagcaaataggacaaaagagctgcgacaacaaattttgtgaaatgtatggagtaaattaatttttttaataaa

SEQ ID NO: 82557 - DNA, 319 bp, Heterodera glycines
  Genomic contig location: Contig_ID=SeqID_2968; Location=152..470; Strand=+
  SCN-specific regions: Sequence locations=1-157,262-319
atggcaacaaccttgcaacaaaagtacagttgtgctcggtgagtattcggatgattgaccaaaatgcatagaccagcaatgggccaccaaagggagcagacgccttggacgagtaagtagccaattgttttaagagcacgcacaatcacttaagcggaataattaattttaaatttaaaataaattacaaaaaaaaaatataccaaaaaattagcatttttttttctatatacaatttttgttaaaattaatttttaaattgttatttgcaaagttgtaaaagacatatctatcattttttaggaatactaaatagtaa

SEQ ID NO: 82558 - DNA, 1464 bp, Heterodera glycines
  Genomic contig location: Contig_ID=SeqID_2968; Location=590..2053; Strand=-
  SCN-specific regions: Sequence locations=1-31,54-199,222-234,259 -313,345-575,597-629,651-874,899-1017,1041-1098,1126-1146,1169-1464
atggatgatgaaggcaaagaaatttgtgaagtgctgtccaaaattgatgcttattcacaacaaattttaaacatgcatcaaaaaaattatgaaaaacaaattatcaatgaccaaatgagtaaactcacgcaattaattgagcaacattttgccaatacaaagcaaaaaattgggaatgatttggcacctgaaaagagagaaagcatagaacaatttgttgaacaattggaaaatgatggtgaaaaaatggaacagcaacaacaaaatgatgctgttatgaaaaaattggacgaacaattaaagaaaaatttgcaaaaaatcaaaaaattaaataaaaaattattgaaaaacaatgggaagggtccaactgagaaagaaattcctgaatattacgaggtataaagtaaactccaaggagaaccactaagggaaacgcgtagatcattcattaaggcattcttccattataaaatgtcataggttcgagtcccattggccgagtctccttttatatccaaaccatgtacggtaaaaaaaaaaggtaaaaatcgttgacgtaacaaaatgccacaatctttaaatataaaatgaagtgcctttttaaaaatgatgagaaagtacgcaagatgagaggaaaagtggaaaagaaacgaagagatagtgcaaagcattctctctgtagctgttcgcaattttttacgccaaccattttttgccgttttttttttaaattttttaccgtccatgtaacttggcaaggtgcgttttgcagttaatgaaccttcaaatcaagccaatcccagccaaacatccaaactaaaacaaaaacttattcagcctccaactttctggaaacaggattttctgccagaataagccccaaaagccacagtttttcattcaattttgagagtgccaaactcccaaaataaaaaatgaatcgctaattatcggaataattgaatgtattaaaattacagttgtcctaccaatgtttattaatttatgaaaaaatggctgtacatttatttccattgcaaacattggataccaccgccggagacattcctcaggttggagcagtatctgcagcacaaccatctgctgctgctgttgttgctgatggcaacaatcgccgacggcgacgaaagcgtggggttcactgctgcggtggctgttgcaactgttgtgggctggagtttggcgcaatgttccgcgcatttttcaaatttatgggcgaaatgttaagcgtgccgtggaaaggtttatatttgagttgaaattgccgaaatttaccgcaaaattttacccctaggcataaagatttttagcattattttgatcattcatttttttgccgttgagaattaatttttttttaaaggaaatacagtaacattattttccctgttctttattaaaattaagcatagaatatttgatttatacgaaactataaataaa

SEQ ID NO: 82559 - DNA, 1522 bp, Heterodera glycines
  Genomic contig location: Contig_ID=SeqID_2968; Location=2683..4204; Strand=-
  SCN-specific regions: Sequence locations=1-287,310-910,940-1034,1089 -1160,1206-1218,1249-1344,1395-1442,1465-1522
atgggaggacgatttggggaaggaatcccgggcccaggattggtggtgaaattccccaaaaagcctcgatgttattagaataatttattctctccggataaaatggtgattgaaatattccatgacgaacgactgatcgaataggcttaacgactcgactgactgacgactgactaactgatcgctgggggaaggaaaagtgtgaagcgaacggaaaaggggcggggatgaacggaataaatgagatgagaaaatgtgataataaagagtggaaattacgactgctgagggaaaataaaaattgttttttaggatggccaatcccttacagctcaccccttccataggatcgtcctcgatcctcgaagtttgtcgatgatgctggcgccagtccgagaacggtttcgcccttcggttcccaatccaaccacctgctcaccagctgctcaatttatgaacagacttggcctgaggggcttgaggaaatcaaccagagttcattccgtcccagagtggagcgaagaaacggtgcaaaagacgaagtgcggagttggaagagctgtacagggttggttgcccaaaattttgaggggtagattaaagaaagatcagccgaaaattccagtacaaaaaaaggaaattgagaagaaacaattgagaaggaacaaaagaaaaggaaaagagaaatgaggaaatcaaacagaatgatacaagaaatgtctaatttggttgactttgacaaaagttatagcaagttttttgttgaaaatttccatttgatgtataaactcccttattgatggtttttatataacgatctcagcaccaatgggtcgacgaccggcccagttccactgttttgcaaaagaaattgaatttcaaaaagttagattattttattacccaaaagaaaattaaattttactttattaaaaatttcgtaaaatcttcatatttttttttcattttacatgaaaatatataaaatcattcatatattgatgtaaattgattgattgttgcttacgtatatcttataaagatttattatattttacatattaaatattaaaataataattttttttcacttcatttcatctatcaaacatagggcaatggccctttttaatatggcattattctgaattggtgaatttttatttcagatttatttggaaaaattaatgtttaacaagaaaaaagtttaagcctctgaaatttttcattttatttattttttattttgattggagaatgcattttttcaattttagaatgaaattttttgcttttattccttcctttaaacatgttattttattgaatttctatttgggtaagttttttaattttattaaaaaatttgttttgtttttttttacttttaaattcagtaatttttgtaaatgccaacggatcaaaacaaaatcaatgtgcacaaattgagactcttgaaaacttcaataccaaatttgtgcaccaattgtatgacgagatttgtgaagcagaggttatttag

SEQ ID NO: 82560 - DNA, 594 bp, Heterodera glycines
  Genomic contig location: Contig_ID=SeqID_2968; Location=5734..6327; Strand=+
  SCN-specific regions: Sequence locations=1-19,41-120,218-319,341 -351,373-381,446-468,507-534,561-594
atgtgcaccggcaatgacaaagaacttttaaccagaagcccagagaaaattttcgattttgttgagcgctcaattacattaagccttgatgttgattcattgttaggcataggattaaggtaaaaaaaaatcaataaaaatttttgtttaaaataaattccaaaacaaaaaagaataattcttttattaaaataaaaaaatctttttttttatatatcttctcgaaggatcccaaattaagcaaagtttaaaaaacgacaagtgttttctactaaagcccagaacaatcaaatatcaaattttcagacctcgtaacaaaattggaattcaaaaattttacagtatttaattttttagaagtcttttgcatgagcttgcagcaaattaatgatattatatataattaaattaaatatccttatatgactaaattttataatattttctagcccaatttaaacagaaaccaattaatttattttatttaaaattaaataattttttttcatttacagacgtcatccattagaggcatttaaagaacagaaaagcaaaattgaagtgtatttgagcatgaatcggctgttcttttgg

SEQ ID NO: 82561 - DNA, 1454 bp, Heterodera glycines
  Genomic contig location: Contig_ID=SeqID_2969; Location=514..1967; Strand=+
  SCN-specific regions: Sequence locations=1-607,629-666,695-918,984 -1274,1303-1454
atgccaacaatgctgctcgatcggcacgattatatccataaatggcttatctgggtcacagagtatgccgaaggttggttggccaagctgatttcgttggccattcgaattggcacactgaacatggacaacgccagggaaccgtttgcctatattatttgccgtcattttgatcgtgtaaaggggaacagtgattttgatgagaattatacggtagaagacgatggtttgatgatggcagtacataaacgaaatgaaattgatgaaatggcgacaaaaagtgagcaaactcagcaacaatatttggacaaaatcgttgcacaaagtttggcgttgcgaaacattttgatgattttagcggaagaagcgaacaatgactttaccttcgaaagttctctcaaaggtgaaaaaaggagcactttttcgttatgccatcccctccccccccccaataaaaacgtcatgatcccgaaaagggaaagctcaaagaaagccatttttggttttttcgaatcgacaaaatcatatataagacaagcgcctaaaactaagcccagaaaagtgctttccctcgtcggaataatgacaattttactgggggggggggcataagggaaaagtaccaaaaaagtaattttggaattctgcctgaggcaaattgaaggcattattattttttcttttcttaattgtatccaacaaacttgatatcattcgaatccgtgggcagctttattattgagctaccgaggcaaaactgcgctttcttttatttgacagttccaataggggccgtcgtggaaacttgaaaatttgagtggaatatttattcacccaagaattggcatttttcgacaaaaccctaaaaaatctaatttttcaaaaattactgataattaaggggtaataaataaatggtataaaattttaattatttattttttcataattataaatttaaaagaacataaaataataatttaggaacaagtagttcctcaacttcttatttaactacaattatctccaaaacattgcatccgttattgatcaaaaatgtgcatagcaaccatcaacaattggtccaccatttggccacgctcattttgttttttcatcgaatttttgaaatggtcgctgtgccacaaatttggttgctcaacaaattcagcgtgggcaccgagttgaagcagttgaagcgcatttatgaaacaacgattaaggccttgcataacattgaaaatgagtgggacaaagaacagaaagcaattagtgatgatgatcatgaagatgacaccgccatttcggctaataaccgttaattagttgattggcgagaaacaaatggacgaagccgacctcaagcattgccctataaaatgcattggattttttgattgataagaatctgataattaattaggttgtcataatttgtattattttttgcacga

SEQ ID NO: 82562 - DNA, 1021 bp, Heterodera glycines
  Genomic contig location: Contig_ID=SeqID_2969; Location=2341..3361; Strand=+
  SCN-specific regions: Sequence locations=1-187,209-236,269-422,468 -509,551-562,594-599,877-1021
atggcccaaaattaccaaattcctcaggcggcatatgggcaacactggaggtatctgtcatttaagccataatataattgattcttttctttttttttttgcaaaaaatgtatttccatgaaaaatgtttcacgattttttttcgttttacgcgactcggtctcacttatacattgtccccaatagattttctttcctctcctcctatgacaaatgttttacacctatttgacgccaaataaattttctaaaatattattatttaaatgtttttgagtattttacgttgttcagccaaattaattaaacaatcgtaaaaatatttattaatgaatgatattaacatttttgcacatgagggcctaaccgtggttgtccgattgataacaattgcaaaactcaattattttacttttcctatgatttttatcaattttaattataaatatgttaaaatttattaaaatgatacttaaatacacattctcctaaaagttatgtagtatttcaaataaagaataattaaaatttacttaatattaaataaaatcattggctattactgtgaattttttaaattttgtggtttcaatggcgcctataaattaaaacaaagatagttattaatgtgataaaaacaatgaaactgatagtgataaaaacaagataaaaataaaaataatgataattgatagtgataaaaacaatgaaattgatattgacaaaaacaagataaaaaaaataatgataattaatagtgataaaaacaaagtgatagtgataaaacaatgataatcattaatgtgataaaaataatgaaattgatagtgataaaaacaagataaaagcaatggtaattgatattgataaaaacaaaacttggcattagattgttataataatttacagattacacaaaaatatcatcgaggctcagataagatatggacaaaaaattaggaattaaggttttgtggaatttagttatcatatctttttatatatttaagtaaaaaattta

SEQ ID NO: 82563 - DNA, 390 bp, Heterodera glycines
  Genomic contig location: Contig_ID=SeqID_17994; Location=137..526; Strand=+
  SCN-specific regions: Sequence locations=1-390
gcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcataattaaaaccgaaaataattttcgtatatttttcacaatttatttcaaaagacaaaaaaaaa

SEQ ID NO: 82564 - DNA, 342 bp, Heterodera glycines
  misc_feature (263)..(263): n is a, c, g, or t
  Genomic contig location: Contig_ID=SeqID_17994; Location=1338..1679; Strand=+
  SCN-specific regions: Sequence locations=1-342
gcttaaaagcattgtacagcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtnaaatgtggtacaaaattttggaactgtcccgccctcacgcggggcttaaaagcattgtacagcataattaaaagctaaa

SEQ ID NO: 82565 - DNA, 420 bp, Heterodera glycines
  Genomic contig location: Contig_ID=SeqID_17995; Location=383..802; Strand=+
  SCN-specific regions: Sequence locations=1-200,253-273,300-363,385-420
atgacactgacttttttcagttttttgtgcccccgttcccaacaatttctcgccaaacagtaccccggtttggtgttacgacgacgacgcccaagacaaggaggcggagcaggacagaaacgggtggtggtggggagcacggtggcgccggcgacgacggcggtcaaattgacgacgccaatcgcagcggaacatcgattggagggcgaagaggaagaagaggaggaaaatggggacgacggaggaggaggaatagcgacaaaattgactacagccgacgacgacaacgacgacgaggaggtggaggaggacattttcagcgaaattgtcatcgacgagttctcgttgctgctgtttcggtcgatggacgactacaatgtatggggcagggggaaaatgtactatataaatgagagatga

SEQ ID NO: 82566 - DNA, 1167 bp, Heterodera glycines
  Genomic contig location: Contig_ID=SeqID_17997; Location=85..1251; Strand=+
  SCN-specific regions: Sequence locations=1-74,121-139,162-169,248 -333,355-361,474-483,521-575,607-816,853-872,894-1026,1099-1167
atgtatgagcatattatacaaattgttttatcattttatgaagctgcacaagttttagcatctggaacaagaagtaaaaaattatcattatatcaaattaaaactttaattaaatttataccttgatggaactcgcgcatttatttttactgtacaatttatctttttcattttaatttaaatactaatcttaaataatatatctactattcgtttttataaataaatctaaataaaataataaattgcggctgagtcgttttataaaaacgatcaaatgaaaatttgattaacatgacattgaatattaatgaattaaactatgaatgatcattattaatcaaagaaatgaaattgaaacaaataataaatttattaagataattaaacgaatattatcaaatagattaaacttaactaataatacttttattaatttcccagaaaaaataattatttaagaataaaatattcgacggatataataaaaataaataaaattagaaacacaaataaaaattacttttacctacttctgtgtatgagatattaaattaaacttataacataccttcttaaaatgaaaattaaaatataaaattaaaacagattttcggcatcaaatttgtccaatttgacagaaatctactgaatattaaaaaagacacaaagcgattgcgaaagaattgtgtcattcgggatttcgcggaagaagtacagaaaaataagaaaaatgtaaaaaaaataaagtggtagaactatataactatcaatagtttattaatgtttaatgtaagccggctttctgtaactcgcaaaaatttaaaattaatctacatttaaataaataaactcgcaaaattaatggttataataaagtgcaactcaaataactgatatttgattaaaagacaaattttgaatttataaaagtatttaaatgctatacatatttagccaattcatattctgggcgactcgtaacaatttataacgtaaataaagaagaggaagaatcatagattcaaaataatacaatacaattttaaataatactactttgatatttttaattataaaatttttgtttaaattaaacatgctttggtataataagtatgatatgaattaacatgcttttaaatcggaattagtgataaacaacta

SEQ ID NO: 82567 - DNA, 732 bp, Heterodera glycines
  Genomic contig location: Contig_ID=SeqID_17998; Location=477..1208; Strand=-
  SCN-specific regions: Sequence locations=1-695,721-732
atgtcggacaacccgaaagaagctgagcgaaaaatggaaaaagcgatgtgctaattaaatctcaatttaatttctaatcattttgttttttctattttcagctcatctctgccgactgttggctggcgtgttcgatttggtgcaccccgctcagcttgaccttaaattgcactgatcagccgccgatttgactgtcgagtggatttacatttcaaaacgagcaaatggacattggaccaaattgaaactctaagcaaaattggaaagaatggcgtcaagggaatgaaaattatcaattacaatgaaaaacttttacaatccctcaaaaatcgttgccgaacaaaatcatggcattcaattactttttgatcacgtaaaaattgaattaaatttgtaagggtttcctgaccatatctaattttcagctacttcgaccacaatgtgatcactttccttcgccgtttttcttgctatttttttcctttttaggcattttccagttcttcttcgtctcttgctttccagtttgataattcattttcatttaatggcattataaaattactagatttatttatttttggttttttttaatcatggcttgacaaaagtcatgactatttttttgtcaatcgaaactttgttgctttttaatttctatttcttgttgatacaccgcattattcgatcaactttgtgccagtaaatactgattttattacgataaataaa

SEQ ID NO: 82568 - DNA, 770 bp, Heterodera glycines
  Genomic contig location: Contig_ID=SeqID_17998; Location=1324..2093; Strand=+
  SCN-specific regions: Sequence locations=1-104,126-131,154-190,213 -309,362-516,607-770
atgtgttgtagtaaaaataacggtgtcctctcgaaggacccacagacaaagaaccccagcctattgctattggcggatccttccactactgcgcagtgcgttgccaattttttgggtccaaaaaatcaattaacataggaattaattgatttgatataaaattattcaatgcgcaaataaattatggatcaattaaaaaaataaatattttagggaaaacaatttgaggcaaaactccctctctcttgaaataaattgaaatttaaggacaaaacctaatgtagcgaaaaataatggaaaaataaggacaaaaaaatatatataaattttaagagaaaaaataaatctaattaaaaaatttggtagaaattacattgcttaaatatttcaattaagaatgtgaaaaaaatgaaatatttgcaaaaattgtttttgttatttttttctttttggccgcatatttttgattttaataaataatcaaactttttaaaaattgtattcaaatattacgattttaattttttttattattatttaagttcgtttaaattattttttttattttaatttgaattatttaaattatgtttagaaattcaattttcttaaaatattttcaatcttggagtcttccttccacctctgccgatgcatcttcgcggtattgtcaaaaccaacactaatttcttttttagtacactcaaaagcaaagttttaattttaaacttaatctttcatgttgtaattattaacttgaatttttatta

SEQ ID NO: 82569 - DNA, 279 bp, Heterodera glycines
  Genomic contig location: Contig_ID=SeqID_17999; Location=543..821; Strand=-
  SCN-specific regions: Sequence locations=1-15,54-69,91-93,123-138,184- 242,269-279
atgaagaaaaatgagaaaataaattataaaaaaagaattcataaaataataatccttttaatctctttttatgcatttgtttttaattgtacgtatttaattattttttttcattaattttaggcttcttgtcttgagattttttgaatattttttatattccattattttttaatttaaaatgttgggaaaagatgaaatgattgcgtcgctttaattgcttggattattatattacgaaagttagctttttctttaattttattttgttataataaa

SEQ ID NO: 82570 - DNA, 955 bp, Heterodera glycines
  Genomic contig location: Contig_ID=SeqID_18000; Location=4..958; Strand=+
  SCN-specific regions: Sequence locations=1-30,54-133,169-506,539-955
atgtcaggggttagtgtgcacccactgctctattaataaaaaattaaacatattgaacattaaaggcataatgaataccccttaattctccgctgactgtaaaaaatggctgcatattggagcaatgttcttgaaaaatattttgtatttaaaaaaaatttaaatatacccaatgccgttgagtctgcattcgtagtatttaattgtagggaaatatacccaatgccgttgcatctgcattcgtagtatttaattgtagggaaatatacccaatgccgttgaatctgcattcgtagtatttaattgtagggaaatatacccaatgccgttgcatctgcattcgtagtatttaattgtagggaaatatacccaatgccgttgcatctgcattcgtagtatttaattgtagggaaatatacccaatgccgttgaatctgcattcggagtattgtagggaattattgttcggcagaagtcggtcgacacattgagaaggaacaaatttcaataaatttatttaattaattttattaaaattctactcaaaaccattggttgaaaaaattaaaaacgcaacaattcgtctcttctcaaacatgtttttatggtaattaatataaaatttttggtctttcaggtgtacgtccttcaattttttatttttgcgaatttagccttggggcatatttttataacctttgatggaaacgcggaatcgtttttttgtattaaactttagtctggtatttattatgtgacacaacaaacatattattttttgtttttatacgcgtcaaacgtccttgagacattgcatgttccttaaaaattgttcatcaaattatttactaagttatcctaatgcaaaggtatgagaattaatactataacaaatatgataattattttgattagaataattatggaatttatattaaaacacaattgaaacgta

SEQ ID NO: 82571 - DNA, 519 bp, Heterodera glycines
  Genomic contig location: Contig_ID=SeqID_18001; Location=1163..1681; Strand=-
  SCN-specific regions: Sequence locations=1-238,269-306,360-519
atgtgcatgaaattcgaatatttgtaatttgtaattaattatagataattttttgtcttccttccttttcgtgtataattttttattgtaagtttttctacgctttaatatacccctcctcactccgcctcacaattttctattcttcttttcttaatttaaaactaaaatcagaggtgaaaagtcaaaatattacaccccgtataacatcattttacctttgtgtggtcaaactgacaaaaatttaaaaatatttatcataattaaacaactttatatcttcagaaattattcatggaggagcacaataaaaaatttaaatatatttgtatcgaaataattcataaaaatttaattatctgatgctaaaaccaaacacaaaataatgggttaaataattgtagaattaaatacatttaaactattcttttaaaattactttatgaattaaacaatttttataatagcgctaaactcggtgacaaaaaaaaatacactggatttataaaaaaaaataaa

SEQ ID NO: 82572 - DNA, 1337 bp, Heterodera glycines
  Genomic contig location: Contig_ID=SeqID_18003; Location=388..1724; Strand=+
  SCN-specific regions: Sequence locations=1-1161,1183-1337
atgccaaaaatcaaaaagaataagagttctaaaaaatccatctcggcggccccgtcacgacaaatgccactggcacaaaattatgaagacctcacatcatcgcgcgaatccgccactgtcgacaaacattcgccattaactccaacaacgaatgtcgtcgttgaccgaattttttcggatgatcctgaaatggcagatgaggatgggaagcgagtttctcgctctgaaaacgggcaacacattaaaaaaatgtctgtgaactcggccttagggccatccgtcatgattgaaaataaaagtggtggcgataatgagccaaattatgaagagagtgaggtgagaattgaggtcttggacaaaacaactaagacggccttagggtcaccagtcatgcatagcagagctaatttagctataaacaatataacaatagagaatattgaggacattaatagctttttcacaacctttgaaaattattttgctcgaacatatcagattttgggaactttgacagaccctctgttatgggctatgttacagcccaaatctctgagtgaatcagagaatagaaaatctgaaactatttcaacggatgacaaatttattgttattcaaacagggataaattggaccttggcatcacgattaactgaagtgagttcttggcctcattttttgctgatgaaaaagaaatcacaatcagatgaatattttcgattgggtgaaatcatagatataaaagaatttgtggaaaatgagtcaaattctcctaaggcttttagcaaatttgcgacagatctcaccttgcttccagaggatggttgtgggtcaattgctagaattctaaaatgcgaaagaactggtaaaataaatgccgtcgatatctgctttgatgagttagtgcaacggttctattcacaccaatttggttcagatgtcgatgtttcagaaattgttgctgatgcttatgtagaggttattaccttaggttttcgaattcaaggctttgaaaacagtctgtctactttaactggtctaaataccttaagcgatgaaccaatccaaatagtatctcaacccaatattggaaccagcatcgatttagtaatcaagattgtcagacaaattgatccagtagaggaggattaccgtcaatggtgtgagtttctcgtaaaacaacggtctacttccaaccatgatcaagactaccatcaccgaaggtagaattatattgagaacaaaagtaccctcgggtcaccagtcatgtgattttttccctaattattaaaaatttgcagcatttaaaaacttattttaaattctttcttattaaa

SEQ ID NO: 82573 - DNA, 2117 bp, Heterodera glycines
  Genomic contig location: Contig_ID=SeqID_18004; Location=174..2290; Strand=-
  SCN-specific regions: Sequence locations=1-5,57-274,296-372,394 -562,584-921,943-1067,1155-1256,1278-1590,1620-1708,1783-1855,1880 -1893,1915-1954,1985-1993,2017-2075,2097-2117
atggaatttaattattctttcacttattcatttattttttttctattaatatattttgttgtcaacagatgcaattctgaagagttgctcaaaatttgcataaaatatgaacagaatcattcaacggacgacacgcaacggaaaattacggttaatttgagtgcaatttacctgaacatgaatttgatgagcaaagatgttcaacaaaatgtgcaaattggggacaaattggacattccaatgccaacaaatgttcgtgaatttgacgaattcaaatttgttttttgcatttttgtgaaaccattggacaatgagtaccagtcgggtggatttgacgaggacccatcggacgatcagccgtttgaaggtggatttggcattttgggtaatttgacataagaacatccgtttccggtcggagctcgccccgagagaagaattaaatcattatcatttattcgactataagatataatacatgatcaggtatcagctcttgagaatttatatttaaatccgattttggacataggcgcaaatgtccgaggcgcatgtccggggctcaaatgtctggggcgcaaatgtctgggcaaggctcggtttagactcccggaagaattgaattcaatcacatgcacctaaattttttgacgatattcttcccggggcgttttccaaaaatagcatttcttaatcaaaatgccttagctaatcggtggatatgtcaaaactttcacaattcaagaccagtattaccaacttcaaatggacgacattcgatcaatggtccgatctgtcggtttcgttttgtatgagcccaattttgcaaagcgttacacatttaacttgggccaaattgacccgcgcggactcttttggaagcgacgaatttttctcgacacaaaaaacggcggcccgggcaatttttatggctttttatatgccaccgtgaacaaaaatcaaagaaatttgccaatgttggatgaaaaaattttgctgggacacgcgccactcactgcggcaaaaaatcatagaaatgaattgactacgaacagagaacaatcggcaaaattaaatttaatggtaaattatattgaaaaaaaaattaaaaatattcccaaattttttttaaatttttattttttttttaaattgttggtaaataataatgtattaatttgttttagcgctcaaatcatttacacggagaagcatcaacttcgcaacaacacgtaaaattatttataatttgaacctttttaatgttaaattcagttaaatgagtacaatttatcaattgaaattgatgatgtacaacgcttttttaaacacaaaattttgaatcttcaattgaaaatttattattttgatgaggtaaagattcttcagcgaaataaaattgaataattaaatttagggaaataaaataaatgatgatttaattattgaaaattcaatcaacgacaaaaagcaaaaaagtgatcgtaataatgatgacgaagaagatgaatgcccaatttgttttgagtcattaaatggcgaaaaacagacaatcaaatttcatgaagattacaacgaaaactcaaaggcatatttttatttaataaaacaatttatatggaaagcttatggaattcggtcaaattagcgtgtaaatagcttttggagaaaatgccaaaaatgattttcttagcctatcttcaaaatgtaatttttaaattttcttttcaagaatttattaatatatgtttcattaaaaaaagaattaaaaatgaattaattgtatacattaaaactattccagcacatttttcacaagcattgtatcataaattggtgagaattaattgaatggtttttaaattttaattttaaataaggatcgctgctcaaggaaaaggtttttgccctttgtgtaaaagggaaatagaaagcataaaggtataaaaattgctttttattttttattaaatcattaaaaatactttcaaagtttttagttttcaattttacttccaatattcaacagtaggaaagaccaattgaatttgtttatttttcttaacccaatcgcccatttatttaaaattgccaatggaaagactgaagaaaataaa

SEQ ID NO: 82574 - DNA, 142 bp, Heterodera glycines
  Genomic contig location: Contig_ID=SeqID_18005; Location=1615..1756; Strand=-
  SCN-specific regions: Sequence locations=1-142
taaaaacaaatgagtctaatttaggatttttagggtcttcggggtcgctgaatacgaatataccctttatattaccccttgcctaaccttaggcccatctgaataataaaaaactcaaattcgagacttggacattttgtgg

SEQ ID NO: 82575 - DNA, 1140 bp, Heterodera glycines
  Genomic contig location: Contig_ID=SeqID_18007; Location=889..2028; Strand=+
  SCN-specific regions: Sequence locations=1-70,92-134,348-354,376 -483,1087-1140
  Gene Ontology: Biological process=N-linked glycosylation
atgccaaaaaagaaggaaagtgaaaaggaaattaaaaggaggcaagcgatccggtggtcaagtagttagtgtgccttcctttggtgctggcttcccatgggttagagtcccatttcttctgattattttaaagcaaatattatattgaaattattctaatttttgttttttttaatttattttttttattaattaactttatggtattttaaattaatgataatgattttttgaattaataaaataataaatatttttaattaatagaataataaagtctaaattaaatattaaaattaatcgaataaaaattaaaaataaacaaatattaataaaaatttaaataatttataaatctcaaaatgagttaattttaggattagacgaatccgggtatttgggcaaaactgggtccggatatttccgggtccagcaaagccgggtccgggtccaagtttttaaaccgggtacgggaggaacagaaagtggaagaggaacagaaagtggaagagaaagtggaagaggaacaaaagtggaagaggaaaagaaagtggaagaggaacaaaagtggaagaggaaaagaaagtagaagaggacagaacgtggaagagaaacagaacgtggaagagaaagtggaagaggaacagaaagtggaagagaagaagaggaacagaaagtggaagagaaacagaaagtggaagagaaacagaaagtggaagaggaacagaaagcggaagagaagaagaggaacagaaagtggaagagaaacagaaagtggaagagaaacagaaagtggaagagaaagtggaagaggaacagaaagtggaagagaaagtggaagaggaacagaacgtggaagagaaacagaaagtggaagagaaacagaaagtggaagagaaagtggaagaggaacgaaagtggaagaggaaaagaaagtggaagaggacagaacgtggaagaggaacagaaagcggaagagaagaagaggaacagaaagtggaagagaaacagaaagtggaagagaaacagaaagtggaagagaaagtggaagaggaacagaaagtggaagagaaagtggaagaggaacagaacgtggaaaagaaacagaaagtggaagagaaacagaaagtggaagagaaa

SEQ ID NO: 82576 - DNA, 1842 bp, Heterodera glycines
  Genomic contig location: Contig_ID=SeqID_2971; Location=668..2509; Strand=+
  SCN-specific regions: Sequence locations=1-252,274-369,426-1038,1112 -1315,1337-1347,1370-1373,1395-1395,1441-1538,1560-1563,1622 -1685,1707-1725,1768-1842
atggcgatcaattattatattttctttacgatttgtctattttttacgaaatttgcaatgactattaatggtaataaattttgttgaatatttttttacaaaattatttttcaaaattaggagggccaagttcgacaaataaccaaaagccaagaacgatcaatcgaattgcacatccaagaaacattgaaggacaattagctgctggtgatcatattccgcacacaaatcagccaacaaacaatgccacgaatggccaccaaaatgatcaaaatgccaattcagaaaattcagatttgttggacaacagtgcaacagaacagcattcaagtgttcatgaggggaataacggtataagaaagtttactgttttatttttttaatataattaagcaaataaattattgtatttttaaaattattttctgagtttggaatagttggggatttccgatatcctgatctttaaaaaaaaacccaagcctggatttttttttggacacagctccaggtatcaggggctatttttgacaacctggatttcctggaattttgtcagggaaaatgctggtccaggtccaggcttttttgggaattccaataacgtgatctttcaaaaaaaacaacacaggaaggagcctggtaaatgttagcctgatcctgatacactaatccagggacatcataattttgcggccatgacatttttcatcagatgccagatgcaaaaatgatggttaaccctaatttataactaattatcatcattatttttaatttttcctccattttataacgaaatttcgtcttttttttgtagctggtcgtccaaccgaaaatttgatcatcgaaaatgaacatcgagctcatttctttgatcaaggcaaaagcattgataccacgtcgccgtcgggatattcaaatgcaaatgcaacaaaattggacgaaacaaatgatcatcagcaattggtgagcgaaggtgggaacgacgacgacgacgacgagcgcaaaatgaatgacatggaagaaggttttttgtaaatttaaaaaataaataaataaaacaattttaattagataaaaatataattatggttatttaatattttatgaatcaaaaatcgccaatgttttcgaaaattttttagtgcttaaaaatagggttaagccccgaccctcggggagaaaaatgtcggggaacggggaggaaattccccgaaagaatttgtcggggatggctggagaaattccccgaaacatgtcggggcttaaccctacttaaaaactcccaaagtataacgaaaatattagtccattactaattaaaaatatttctagagttaaaagaaaaattcactgtatttaaaatagtgatttaaagctaaaattcatttgttaattttttaatttcaattttttaatgtatgttaaaaaaattttgttttctgattttaatttcgttttcgttaaaaataaatatttcgtttcgttttgtgatcagattgatcggagatacatacgaacatagtctctcgattagaaaatacgaacaaaatgaataagaaataaaataaaattatttttggagataaattattatttattaaaattcatttattaagaagacagcaataatgatccggtggtctcagaatgttgtccaatttgcttgcagccattcacagaagcatcaaacaaaaaagtgcttaacaaatgtggtgtaagaaaatttgtttatttttttaaaattttatttaatcttttttagcatcaatttgatgtgaattgcatcgatcaatggcaaacaatttgaattaattaaatggattaattaatattaaa

SEQ ID NO: 82577 - DNA, 625 bp, Heterodera glycines
  Genomic contig location: Contig_ID=SeqID_2972; Location=1171..1795; Strand=+
  SCN-specific regions: Sequence locations=1-1,46-625
atgtttttaaaatttgtgttttttcctttcttctcaatttcattggcaattgctcaacaaattctgccgatgacaaatgatgaaattgaaatgatcaaaaatataatgggctcaattgaacagaatttgattatggtggaagcgaattgttgcgcaattgatcatgaaaattttgatcaattcaaaaaggcggtcccgaaaatgttcgagaaaatcaaccaaaaaataatgattgaaaacgaaacgccaaaatttgcggattttcaagaatttttcgcggaaatttatgcatttttggacaaagtgcacatcgagatggaaatttttgtcaaaaatttgtccccatattgtgaacaaaatgagcaaaaagcgttgacacgctttgaaatggccatgcaaatggaaaaggaatttttgatggacaatttggtaataattgaagagccaaatgcgaaaatcaaacggtaaattgaagaattaattaaatggaaaattaataatttaagattttttgaaaaatttgactcctcattgtttgcaaaattaaccttaacaattgttgatatgctaacaatggattcattgctaaaggatgagagaaaccggcactttagtaaattgtttg

SEQ ID NO: 82578 - DNA, 245 bp, Heterodera glycines
  Genomic contig location: Contig_ID=SeqID_2973; Location=188..432; Strand=+
  SCN-specific regions: Sequence locations=1-60,82-172,237-245
aaatgctgtctcagttgcggttgtgttgtgatgtcaccgtggatgctttttgtggcaatcattggcactccaattggcattgtttgcgaaggtgccaatgctgtgcgacgctgcgctaacccaacgccaaaagagatgccgtcaaaaattgcatcgaaaactagcggcacatcaaaaacaacatcaaaaacggcgtcaaaaacaaactcaaaaaatggagagaaaaagaaaaataattaagccaa

SEQ ID NO: 82579 - DNA, 993 bp, Heterodera glycines
  Genomic contig location: Contig_ID=SeqID_2973; Location=689..1681; Strand=-
  SCN-specific regions: Sequence locations=1-213,235-574,619-766,789 -872,894-956
atggtgaacggatttttaaaatggtgtttatacatcaattatcacaaagtaatttggtctatctgtggcctaatggttagtgtgtttggttctttcggagagggggtaaaaagttcgatcccgacaccatgtgattggattttgaaatgaattatttaatcagaaataaaatgctcagcacaaatacatatcagtggcataatggatagtgtgttgggcttttttcggcacaacctgggttcagttccgcgcggagttagcagattaaatttaaggacaaatggtcgaaaagggacaaaaggtcaacctgggataaatgatccaaaacggacaaatggtcgacaaagggacaataggtcaaccatggggacaaatggccgtttgagtaccagaaaggccgtttcagtgccaggactctggtactgaaacgtgtcagaaaatctgggactgaaatgtccggtactgaaccgtacagggaatcgtggtcttacactactaatgtttaggactattgaatgatagcaaatcgtattaattaccgtactgtacttgataccgtaaatttaattttgtgaacttactttaaaatatatatttttaaggatgaaagagtaaaaagtataataattttcatatacctttaattaacactggtaggtgaaatttgtttggcagcgaataatttaatcaaaaatgagggtaattattaatatcaggctgcctggtaaagaattgaaacggctaaattgcaataatatatagcaaattagttttgaaaattttatgagactgaaagtgcaattagaattatttaataattgtcgcaattttttgggaatcatgcaacggtttgaaattgtaaattatctaatcaaaaatgaatataattattaatatcaggctgtctggtcgagaattgaaacggctaaacaatagtgttttagaacttttttaggaaaattttttataccatatattaattataaaattaaa

SEQ ID NO: 82580 - DNA, 3725 bp, Heterodera glycines
  Genomic contig location: Contig_ID=SeqID_2974; Location=1069..4793; Strand=+
  SCN-specific regions: Sequence locations=1-140,162-1063,1086 -1620,1642-2203,2225-2912,2935-3725
atgtacgattttagtccatacattcgtgagaactcggagtttttcacgaaattagctgccacaaaatcggacaaaaagaaaaacgatttgctcaagggtgcttcagcagagcaaattctgggattagtggaaatctgcgcaaatatattaaaatttaatttccgtctaaacagacgacagagacggcgactggctttgtacgctgactactatcgagcaattgcacgttcacgcagtgagcgtacagcacgacatagactacaacagggcagcggaattgctttaggcgctattttggcgcctattctcagcgttctggccgaacagctgctacaaaaggttgttgcgaaatgaagcacactaaaaagatgatgttggttccagagagcgaatatttagcgttaataaatctgttgaaaggaggtgtaggcgacggagcagactcccttcaaaatgaaaaagcgttgctcgacgcacggattcaaaggaaccttaatgatcacaagatggatgctgatgttaaaatgaagcgacactcatggttgtacaaacagaggcatcagattaaagatatgatcgataataaaccacaaaaagtcattgtggaaaacgcgtctggttcaacgccgcctaatattgcaccgtatatgggcatacagaaggcggcaacaccgaataagcatctgctagatgaagttgaagatggcagaaaaacaagtcctcttaaaaaacggcggcgatcaatgaaaacacataaccgtgtcgtcgccacaaacacttccaacggagcgagctattgtgaagaaactgatgcttatacgtctgcgccagagaccgatttgctgctaagcaaaaaaagagagcaaaaatttctgaagcttaaaacagacccggtgcattacgataaattgcagagcataatagaacgaaaccccgccaaatacggagtcgataaagcgtcaggggaaattctaacaaacttcaaaaagccggttgttaagtcaaattacattgattctttgatgtatttgacagggcagagggcagacgcgcctaaaggccacagattttttgtccaaaaaattggcaatgatccagaaattatgacattttttcatgcccaacagggagagggtggtaataagcggcgaaagcgcaaaaggatagtccttgttaaggccaatgctataaaaacaattggactcaaccgcattgggcaaactaaattttttaaaccgctcctatgggcaaagctgtagaacaaaaattattagaacaggtctattatgatcttaggtcgccggcaagctacgccggaattcaaaaagtgttggcggaagcgcagagacgaaatcccagcatcacccttcgtgatgttcatcaatttctgcataaacagcgtacctacacgttgtttaaaccgcgaaaaaaccgcttccgcaggctaaaaactgtgcctagtggactacacacggactggcaatgcgacttgtgcatcatggatgcgctaaaagagcataatgacggatttcgttacatcctagtgtgtattgatgtgttgagccgtaaaatatttactgcagaggctgagtctaaaaaaagtgagcacatgattgcggcatttgagaagattttcaaaaaggccggtgtgctgcccaacaagctttacagcgatgcagggcttgagtttcaggcaaagaaaatgactgactattggaaacaaaaggatatcatcaaacacgtgatgtacagtccacatttgcacgcaggagtcgttgaacgcgcaaaccgtacattgaaggagcggctttacaaatattttagcgaaaagaacacaaagcggtggatcgatgtgttggacagcattgtgcgtaacctgaacagctccgcgaatcgaacaaccggactaaagccagtggacgtcaacttcaaaaatgccgatgctctacggaatcgactatataagcaaggtgaattgagctcaaaaacaccaaattttaaagcgggagacatagtacgaataagcaaagaaaagggtgacttttccaaaggttattttccgaattttacggacgaactgtttaagatttctaaagtgaatccgacagatccaccttcctacaggatccgtgaccaagacggagaagacattaaagggattttttacgagcaagaactggtaaaaactgttgcagaaacaacgcatagagcagaagtgttgaagactcggcgtagaaagggcgtgaaagaacactttgtgaggtggattggctactcagacaaacacaatcgttggattcgagacgaggatcttgtcaagaattagaacaatggatgaattttaccttgtacttccttccaacacaccaggcacagataatacgacatcaaattttacggttaggcttccacacacgttggagttggactcaaattggactgtcgctctagcatctataatctacccatattcatttccttcagtaggaattgatgaagatgacatcattagcattaaacttgttaatccaagctacagatttttggatgacaaaaaatttttgcacattgaactaaagattccaagcatgcaattttcaagtgtggaacatttgcggctgactctaaataacctaattactgaagcgtatcagcaacaaatttcttcgtaccttgacgacgatgccaaaaggacgaaacgacaagaaaatgtcactgatctttttttccatgaaaatccggtggattattgggaaaagattggcgaactccgtgcaaaatatgaacagctagaaaaggaactgacagaagaggagagtgaacttagcgccaacaccacggatgccgagaggagaaaagtgttagaaagcgagcttccacttaaacggcttcgtacacggaggaaaaaggaggaattggaagagctggaacgtgctgctgaacgacgtgatcaagaaagtcctgaagctgagcaaaaaaagattggcgaattcttccaccaccatcccgaagattataatagaaagctgaacgaggcaagactgatattcacacaccatctctcaggattacaagcggtgatgcgcaagtacatcgatgaaaaagacgcaaacaaaattcggcagcttgagtcggaggttgaaaagttgcgtctgaagatcaaacgcctacagcgtaatttaaccatcttcgaaaatgctacgctccagcgtgaccaccaaaaatctttgtcgcaatatgaggagctcagccaccagcagaacagtgcgtatgtcaaagaattttttcaaaaacacccaacaaattactggcaaataattcacaacaattatagaggtcttacagaacattttcagaagattgaagaactgcgagcaaaggcggtaggattaaaggataatgcctctttccagcaacaaattgaacgcgcaaaacaactgattgaatacagaagaaagaggtttgctgcgctagaattcgaggcaaaaaagcttgatgaatcgtcaatacggatggtggtgatcatgatcaagcagatgagggtccccaagcaacaacaactccgggagaagcattaagagataaactgctgcaaaaaccaaagcaatctgatcatgatgctgatgataaaccagatgagggtacacaaacgacaacaaaaacgcatggggatgcattaaaggaagagatattgcaaaaacaaaagcatgctgataatgatgaca

SEQ ID NO: 82581 - DNA, 594 bp, Heterodera glycines
  Genomic contig location: Contig_ID=SeqID_2974; Location=4973..5566; Strand=+
  SCN-specific regions: Sequence locations=1-299,321-594
atgacgcatggtcaaacgctaattgcccgacttaaacagagcgaggagcagaaaaaagaatgggtagcagtgccccaagatgatgatgatgatgacaggccagcgctaaaacatggagatatgctgtggaaactgttacggtcaacgacaccgcataaccagaagcaaacggcgggcgatgtcatccaccgccaatttgcagatgctgaacatactcgtggacaggtaatgatggaactgttgaaaaacatcttagaagaaaaatctgacgctgctgatgcgcaccgtcaacaacagcaaaattatcctcgtcagaaatctgcacaagttcttcggacaaaaagcagaggtgaagcgttgaaggaactgatcaaaaaaacgcaaaatgagcagctgccacaatcttctgctaaaacgcgaggagaaattttaaagttgatgttggaaaatatgaagttttcccgggaggaggaagtaagctttgaaaaacttgtcgctaagcagaaaaccgagcaaaccgctgccgaatttgtgttcaacgatcttgcacaacggttcgtcatgaaaaccggtgcgggcgtcctgcatgtggat

SEQ ID NO: 82582 - DNA, 1003 bp, Heterodera glycines
  Genomic contig location: Contig_ID=SeqID_18008; Location=688..1690; Strand=+
  SCN-specific regions: Sequence locations=1-41,63-202,231-250,284 -677,700-1003
atgcattttcattataaacttttggttttttttttttggaattttctgacatttttcattttcaagctaaatttgaattccaagaaaaatgccaaaaaataaacgggttccatcggcgaaaaggaattgaaatccgacagaaattttcctcaaaattgttgagaagataagggaattttcaattaaaacatcaagaaaaattgaacatacttttaaaatgttaatttttagtgtgcatttcagaaaattgtttttaaatttttaatttattaattttattaatcaaaaaacgcttccttttttcattaaaaaattgcttaaacagaaatattcatttttaaatttagacattcaagaaatttgtaattatgggagagatggcacggtggaaaaagtcagcatatggacggcatttatacaaaaaattaagccgaagccaatgccatacgaccaaatacatcttgaaaaagtcatcggccgtttattttcaatttacatccaggatgtacaaaatccgatgcttgtaaaacatcccaacaggatgaagcagttactggtgaaggacccgtgtgatgaagccaaactaaaagtgaagcaaattgaaggggtaggggaagacgacgaaaatgatcagtgatcaaagaccaacaatcagtgatcaacgtcgaacaatttttattttgaaattgcaaatttttatgcaaaattcaccacaatcattatttttttactccgtttcttcatatttgttgcgtagcgtaaattgattgcctaattgaaaattaattgtcattcatcacaggcatttttgacaacttttttccccaaaattaagacctaaattttaaaacaatgcttaaaattttttaaaaactaaaaagcatgataaagaatttaaggcttcaagatccaacttttcatgcttaattattgctgaaattgggattttctacttaatgattagtagggttgctactgctgctaaaaatggataaatatagaa

SEQ ID NO: 82583 - DNA, 775 bp, Heterodera glycines
  Genomic contig location: Contig_ID=SeqID_18009; Location=123..897; Strand=-
  SCN-specific regions: Sequence locations=1-57,89-110,148-269,332 -395,445-446,470-775
atggcgttcatcacctatgtgctggtgtctggttttgtcttcggagttcagaaaaggtatatatatataggtatgtatatatatatatttttttttgcaattcggtttcgtttaaatttgttaattttgaaaataaaaaaaaaatttctggtcaattggcgaaatcgcggggatacacccatcactttttgccacaaagatctgtacattgaacatttttaaatcaaatgttgcgattttcattgaaatcggtgctcaagcgattgcgcaaatttttcattataaaaaattaaaagaaaattacggttttttcaaaaaaaaaaaaaaaattcggacatgaaacgataaagggggacaaacgtagtgcacccaggcgttatatcgatagacatgggaaaaattttttttttaaacttaaacaaaaattgataaaatttaaaaaaacgatatattttcatcttcaaacatgtttcatttcatggcgacatatagtaaattattttagattccctaaatttataaagcatatctaaccaattaccacaaccaaaagtttttttttcaaaaaaaattttctctttttttttgcaggttcagccccgaaaagcttggcatgctgaccacaaatgcgttgttctatttgttcctggagaatggcattgtgttcgtgatgaaatacgcgttgaacatttcgcagagtttgaacatttggcacgcattgtcctacagttcctacaaattcaccgggtctgattttttggcatttttaaaataa

SEQ ID NO: 82584 - DNA, 839 bp, Heterodera glycines
  Genomic contig location: Contig_ID=SeqID_18010; Location=260..1098; Strand=-
  SCN-specific regions: Sequence locations=1-80,103-402,426-839
atgttttgtgaaattagggggcagcagcaactgacgccgtttgcaactatgcaaagaaaggatgggaaatggaatattgaaaaacagaagaaaggatgtggaagggtggaggggatggggccaaattttggggccggatattgggccttatactactcccatttgggattttgtccccagagaattacattaattaatccatcttttcttcttaatgagtgcgtccgtcccgcgaattctttattgactatgaaagtgactatttaaaattgcgaattttgccaattaaaaaaggattaggataaaaggaaaaagccctataaacaaaggatgcaaaaggatcaaatgcccaattttggtcagttgcaactcatacaaagttcaaaagcataatatgtacacaattttattatttcttttcataaattatctttgttaaaagttagaaaaaaatttttttcagttttttttcagaaaaaatcatacagtggactcgcttcatcgcgcaagtttccactttgtatcggcgccgtcttcgttattttgctgcggattaagtgctggacgaaaacattgatcagagcaacccgaaaaatgatgaaacccaaaaattttcaaaagttaaactcaaaaaagcgaaattgtccaaacattcaaaaccaaattaggaaaaacattttaaaaaccgggacaaaaaaaaagaattcatttgggtcgactaaactttccgcgacccatcaatggtaatgaaaccaagcgtttcgatcaattactcttcacgctgatcagaccatcaaaaaataataattttccgatggtcatttgggaattaaaataaa

SEQ ID NO: 82585 - DNA, 168 bp, Heterodera glycines
  Genomic contig location: Contig_ID=SeqID_18010; Location=1..168; Strand=-
  SCN-specific regions: Sequence locations=1-168
agcttaaaaagaatgaaaaaagcttatttaggtagaaaattttttactttgaaccatcacaaagtaaatttttatgcaaaaaattcgtggaaacgttgtaaacaaaaaataaaatgactagtattaagctgcttttagaagttatgcatgttaaggacataccgaaag

SEQ ID NO: 82586 - DNA, 1220 bp, Heterodera glycines
  Genomic contig location: Contig_ID=SeqID_18011; Location=1..1220; Strand=-
  SCN-specific regions: Sequence locations=1-26,51-297,324-628,650 -684,707-906,928-1085,1107-1187,1209-1220
  Gene Ontology: Biological process=deoxyribonucleoside monophosphate biosynthesis
ttacaaaaattgaaatttgttccagaccacggctcgttggggttccaggaaaagtcactgattttggctgtgtgcccgccatggatgaacaacagttctttaaaaggatccattttagtccgttttgcctccactcacccggtggtccgtcctccgcgtcctctggcgactgttcgtcgccaattttgctcaggtcccaaatgtgcagacggcgatcggtgcccgagctggccaatgttagttctcgcgcctcccatccgtccatttcggcacctcaatctcttcgtccgatttgaattcgtccgcatcttccggctcctcccaaagtctgtcaaaataaaatgcagaaacatttcacaaattgtgggccaccttttctcggccaaacggtcgacggccggtgatttgggcactccgacgccgccaagtgccccaatagggcggccgataattgtcgtgaaaatgataatactttggctttaaaagtccaattttatgccataggctttgaattttgaattctcggcattagtttttggcgccaaattggagttaatattcgttcgcgcgaaccgtgccataaatccccaatttggtgcagatcgcgatcggctttatcaaatttgaatttcggcatttgatttaaacgcaaagccaaaatacgcggtattttgggtattttgattttaaattttttgttaaaaaacattctaaaattgcaatcgtcgtacatagatttttggcttttcagcaattttgcactacaatgggtagcgagggcaaaattttgactggaaatattaatggggaaacagaaagcaaagaagtgaattcggatgaaatgaattatttgcggcaagtgggtgagattttgagtcgcggaacggtgcgcactgacagaaccggcacaggaacaatttccatttttggcatgcaaacgcgctatagcctccggggaggtcaatcgaaaaaaatgaaattgtttaaaaaatggcggggttaagggaccattccattgctcaccaccaaaaaagtgttctggaagggcattgttgaggaggtacaacaacacacacttaagaaattaataaagttttcattttttagctgctttggtttattcgcgcagaaacgaatgccaaaacgctttcttcgagaggagtcaaaatttggggtaccaaaattatttttaaatctatttttgtattacctacatttat

SEQ ID NO: 82587 - DNA, 134 bp, Heterodera glycines
  Genomic contig location: Contig_ID=SeqID_18011; Location=1746..1879; Strand=+
  SCN-specific regions: Sequence locations=1-134
ttacaacacttttttatcaacaatgagacaacattttaggccacttaaaacacgcgaaaaaagatcatggtcggcggaggcattctattacatcggcaatattggcaaactcaggctggtgaacatgctgatct

SEQ ID NO: 82588 - DNA, 433 bp, Heterodera glycines
  Genomic contig location: Contig_ID=SeqID_18014; Location=90..522; Strand=-
  SCN-specific regions: Sequence locations=1-93,118-433
atggatgagggacaattttggagttgtgccttgggcgaatgggttaagtaagtttttttttcattttttaaatattcgattaattaatttggcattttattttattttatttcatttaaaatgtttaacatggcgaagaattggttatttttgagagttttttattgcttttttgcaaaaaaaaaaactgcctcaaaaattgggcgcttttctatacaaataataaatttggcattttaaaattcacatttgcagggattgtgtttgtggcacatctgctgctgatccgtggccaatcctcgacccaagccaatggccaattgtgccgagtcttcagcttcgctatgccgaactttgtgacggcgtggcgctgaacctcgtcctgtgctatatgtatgcttttcccagcgatcaatgaatgctttttattaaa

SEQ ID NO: 82589 - DNA, 370 bp, Heterodera glycines
  Genomic contig location: Contig_ID=SeqID_18014; Location=1052..1421; Strand=+
  SCN-specific regions: Sequence locations=1-336,358-370
atggggggatgggacaagtcagtctcgtccgataaaaaagtatgggacaactcagtcccgtacaacaaaaagttactttttgctggattcgtaagtagagaaattgtaagtcgtggcacatacatgtaggagtttaatccatattaagtttgggattgcaaagcagtacccgcaaatcccgaaatttggagatttgtaagttggggacccggcattgagggatttgggacaaaacgacatttgtggatccgactctgacttttagcgactcgttccactttcaaaaattctattagaaagttttttaaaaaaatttaaagtatttcaggtcctgtgctattcttgtctgataaaaaagtccttggattag

SEQ ID NO: 82590 - DNA, 426 bp, Heterodera glycines
  Genomic contig location: Contig_ID=SeqID_18014; Location=1685..2110; Strand=+
  SCN-specific regions: Sequence locations=1-45,67-74,268-426
atgaaagtattcttaatgatttctttatttgtgtttttgatcatcattttaattaatattaattatgttggatcagaaaagaaaaaaatggaacaaaaaacatttgacgaaatatttggagaaaaatgggaagaaaaaagaaacgaaggacagaaaaaaagagaaataattggaaaatttaataaaataaaagagaaaattaagcaaaaaggaagaaaatattcagcaaaagaacggagtaaaattgaaggaaaaatagcaaaaaaattgggcacaaatcgcaaaaatattcaaaaatggatcaaagaattaaaattaaataaattcaaatcaataaatgaccaacgaaaatttgaaattgttcaaaaattcattgaaatgtcaaatgaatacaaacaaaaaggaacatattcgaaaaaagaatag

SEQ ID NO: 82591 - DNA, 394 bp, Heterodera glycines
  Genomic contig location: Contig_ID=SeqID_18015; Location=989..1382; Strand=-
  SCN-specific regions: Sequence locations=1-144,166-288,311-394
atgtcagcaaaatcagttgggaatggagaagtgaagtgaaattacgagaaatgtgcacccgttagatgagtacaaaagctcaaaacttggagagaatttacattattttcataacaatctagaaaaatgggcaaaatcatattcggtttttgaaaactttttcgatggcgtttatcggtgcaccacggacccgggtatggtaattccaaaactatattagaatatgagctaaattgaatacatacataaaagtagagtgccacgggaccgggatctggtagcggacaactgagtacaattgagtaccaaggtcccggttttgaccgggaccgggactagtctcggttttttttttgcttgtcaacaaaaaacttgttatgtaaaactcaataaa

SEQ ID NO: 82592 - DNA, 530 bp, Heterodera glycines
  Genomic contig location: Contig_ID=SeqID_18016; Location=995..1524; Strand=+
  SCN-specific regions: Sequence locations=1-222,246-438,505-530
atgcattttcaaattgtctcatttttggttttttgcattttccataattttccatcgttcgcgcggtattgtgggggaaaagcaatcagttcgtttaaaaagaagctgaagtatgaaccggatcaagaaggagcgccgcttgaagttaaaagggagagccgaaacagttttgtgggaggaaacggaaaagtgaaagcgaaaataaacaacaaaaaaaaagagaaataattaaaaataattaattactaattgcatgtccacaggtgtatattggctatgtgaagaaaagcccaacttacgaaggatgcgtagcgataaaaatattcaacccaaatttttacgctatttatgagaattcgaaagattttatgcaaaagattcaaagcattcttccgcctgacgagcgaaagcatttaatcacaatggttgacgcgtaagaaatttatttaaaacaattttaatattattatttaaaattatttttggatttttatattaaaaattcaatagcggaaaattaaagaaacaga

SEQ ID NO: 82593 - DNA, 1039 bp, Heterodera glycines
  Genomic contig location: Contig_ID=SeqID_18017; Location=348..1386; Strand=-
  SCN-specific regions: Sequence locations=1-388,412-484,509-607,633 -1013,1036-1039
atgtctattccaaaaactactcaaaaacccaaatttattaatattcgacggttcaccccgtcgaatgtgtctcttttaaatacggttatttcatctagaattagcaccttatctcagggtcatttcagtgtaaatgaaaaatataacgcctttaataaaacactgctagaaaccttaaacgagtgtattccgataaaaagacttaccaaaaaagagttagcccctaaatatccaacgcatttattggcatccattaaagaaaaggccaaactatataagctgtgtaaaatcgacccaacaaaaagggcactttatgatagcattagtttacacataaaaatacaaacaaaaaaatttcattctcaacttgaacaaaaggctatttcaaagggaaaaaattcaatttttaaatatatacaaaaatatgatgttaatccctttgaaatatcgaatttggtttctgaaaacaaatgctatcataatgaccaagaaaaatgtgaattatttgccaatttatttgtaaattcgtttaacaattctgaagttgatccaggctttctaagcttggacaacacttttgttaatcaaagctttatatcagatatagaatttaacatcattgagacccaaaaacttttaagaaaacttccgaataaaaatggaacttctccggataatattagctataaaacattgaaaaattgccatccttcattagcaactgttattactgaccttttcaggatttcattagactctggttctcttccagatatctggaaggaatcaattgtttttcctcttttcaaaaaaggggacaaatttaatcctgaaaattataggcctatttctctaacctgctcactttgcagggttatggaaagaattcttagccaaaatatttacaactttctcctaaaaaacaataaaatttcggaataccaatttggttttgttagaaataggtctacaacaagtcaattaataacagttgtggaagattggtatgatgcaattattaatggaaaaaatgcggact

SEQ ID NO: 82594 - DNA, 1195 bp, Heterodera glycines
  Genomic contig location: Contig_ID=SeqID_18018; Location=1..1195; Strand=-
  SCN-specific regions: Sequence locations=1-192,216-988,1010-1195
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcggttttctgaaaaaaagagttaagcctaaactttttggcctgtttaaaaaggaattaaaaattgttaaaaattttattcatctccctttttgatagaaaaagcc

SEQ ID NO: 82595 - DNA, 1128 bp, Heterodera glycines
  Genomic contig location: Contig_ID=SeqID_18021; Location=58..1185; Strand=-
  SCN-specific regions: Sequence locations=1-598,623-1056,1078-1128
atgtcgggatttttgcgtacaaaaatcgcaatagagctaaaggctcttgagaaggcgaaaacggcaacagaattgtatgctgagccggaccaaactctgacctcattggaaaatgcaattctcctggaaagcgcggcagagagaataaagtcagaggtggaggcagtgaatgccaaaatcgagcaaatttggataaccgcaagcaaatggcatgacgtcatacaaaaaatggacaaggacgaaagaaaaagtgagcagacagcgtatgaacaatttcaaacaacggagaaactgaacacaaaaatggaagcagccaacacaaagctaacagagcttaaggacctggagatgaaggtggaagcaggagcaaagctgcaacgctccaaagcggacagagacgcgcgagtggagcaaagagaacatgcaaaagcaatgtcgaagtcgaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggtctacgcttggaagagaaaaattacgaaattgccatgaagctgttaaaggacacctatggagacaaaggcgaatatgtaaggaggttgcacacggagttgtcgaacctcaagagatgcttttcggtggaagacacaaagcatttttgcatggaattggaacgcctggcaagagaattggaagcagcggaagaagacattgaagggccgccaatttatttaatgcttgagaagaagctatacaagcctttcctgcgtgaaattctggaagagaaagcaaaaaatccagacttttgggacacgtcatccctccgaaaggctttaggaagtgcattgagcaaagagctagcaatcaaagaagtcatgagggagtatggcttcgaaggcaaagaggcaaatccagagcatggattcaaacgacaattaaggcggaacagattcggaggctcagtcaat

SEQ ID NO: 82596 - DNA, 380 bp, Heterodera glycines
  Genomic contig location: Contig_ID=SeqID_18023; Location=359..738; Strand=-
  SCN-specific regions: Sequence locations=1-90,112-380
atggccgtgacattggaccgttttgtggatatggcggaccccggcattcgcgaagttttcccgggaatcgtcgggcacataaaactgcgcgagaacagtgagaacataaaagtcatcctcggcacttccatttgtgaatttcagacgaaacactgctcaacaaagtgttggcacctttcgaatgttcgggtggacagattttccgcgtttacacccgcgaaacaatgccacggcgataccagtgggaaatggcacaatcaaaagatgatcgttgctttttatccgactttcgttcagctacgcccgtagtggacgcattggcgaattggtcatcgactcggcagtgggcaccaaactgttcaaaacggccgagaagatga

SEQ ID NO: 82597 - DNA, 528 bp, Heterodera glycines
  Genomic contig location: Contig_ID=SeqID_2975; Location=874..1401; Strand=+
  SCN-specific regions: Sequence locations=1-87,125-175,219-422,446-528
atgcccaattcattcacaaatatcgacattaatcctgtagaattgagtcaaaggtgtgacatttggtgattttttggtcaaaatcagttaattaattgataaaattttcaaaaaaaaaaaatttcagacggcgcctatctgcatagacggacccctattctttttcattgtttggattttatttaaatttaattcttttttccatttatatattttttcgcgatttgtgcctaataattttgcaattttcatctcaattttgttttaattttttctttgtaattttcctttttctctcaacttttctttaattgcttcaaattttctaattgtttctctttttttgttgatcatttggttccgttcctttttctccacccatttgctcaactgctgagctttcattatggtcattttgttccatttttatcatttgttcttctctgtcatttttgtcccattcgttaccaaatatttcgtcaaaatttgattggattttgccggtttcaattttatatgcaaagaaaa

SEQ ID NO: 82598 - DNA, 617 bp, Heterodera glycines
  Genomic contig location: Contig_ID=SeqID_2975; Location=1786..2402; Strand=-
  SCN-specific regions: Sequence locations=1-146,179-181,203-396,419 -426,448-460,486-534,569-617
aatgtgttgcgaaagaaaaagctatctctgctccttatttgattggtcgggctgtccaattgtctgaatgccgtaaattgtatcgaggtgaccgaatttgctttcgtgggatcgcatctcaatcagtaattgttcaaataatttcctttaaataataattaattttaatgatttaaatgggaaaaataaataaaagtttaactcatccatttttgttttttaattgaattgaaattgctcatttttgttagggcgatagtggcagcgcagtattggccagcaatgggacagactatgtccaaattgccgtttcttcttatgtagaatgtatatcgtcagctcctggtgaatgaaataatggccggaaattttttagcaatattttaatcacttttttaaattaaagataagaaaaaatgcgagaaatttctttctttaattattttaactgaaaactacgaaattttttaaaaatccaattttggcaaaaaatactcaaagccaaatatgcaaaaacaactaaaaatacatccctttttaaataataaaaaaatatatttttttaaaacagaagcctcctacgccatttactctcgaatcgacgctaaatggcttga

SEQ ID NO: 82599 - DNA, 1240 bp, Heterodera glycines
  Genomic contig location: Contig_ID=SeqID_2975; Location=2471..3710; Strand=+
  SCN-specific regions: Sequence locations=1-65,101-209,231-423,459 -504,527-692,714-781,803-1032,1054-1065,1088-1240
atgcggcgaaataaattaaccaaaaaggtgagttaattttttaaagtgcgtcaaattaagcgaatttctcaacaacaaaaaatattaaattatcaaaaactttgcattgcattttgtgaaaatttcagctaaaaaaaacaatcatcattaagttcatttcgtatgctatgacgttagtcaaaaaaaccagcaaattaaagtattttttgaaataacttttctcaaaagaaactaaatttttaattattgaaattaggattgctccccgtccccgagctccccggtccccgaccccgatccccgacatttctgggccaattccccgctacgacccccgacatgtcgctccccgaggtccccagcccccgactttttgcccccccccccgactccccgacactaattcggggaatcagggaccccgagcattgttaaaatttaaaaagttaattcaacaaagaagaggggaaaggttgaaaatttatgaaattttgaacaattttcttaatattaattattaaaaattccgaaaaacttttcagcgccgcctatcggcaccgccggttcaaaaaatgtcccaaaattgcaaaaattggtatttttaggaaaaatctgttaacaaatttcaaattttcaaaaaaaattttcctcgcggctcctaacaccaccgccctcatcacccctttgttccccaaaagtttttctgaaaaagagcgccgcaaaaaatggtggtcaaattcgatgttgagacgggttcgcaaaaatttcagtttaaccccactcctttctacatatttttaaaccagggcttccatcgaaatttttcaaaatataaacaccaagtccaaaataagattttagtgtcaaaaatatgaacatttagcaacatttttccaatcagttatttttctaatttattcgatcaaattttatatttttagtctcctattatcaattttgataattttggggaggaaaaagcaaaattgtaaatttcagtaattcgggatcaaaagatcaaaaaaattttgcggtagaccttaaaatttcttgaaaaattgtgacattatgccataaaatttcaaaactataagtatatttaagaaatcagaataattttagtcgctaccccccccccccccccaaaatcagaatattcttataaataagaacaaatggaaaccccatgtttaaaggccaacttggactcactcatactggcgctaacgaaatcagatga

SEQ ID NO: 82600 - DNA, 812 bp, Heterodera glycines
  Genomic contig location: Contig_ID=SeqID_2976; Location=225..1036; Strand=-
  SCN-specific regions: Sequence locations=1-146,189-658,680-812
atggacatcaaccttatgccgtggactgtgtattataagataaaaggtggcggccattgctctggctcactcatttcatcggaattcgttttgcttgctgcacattgtgttaatgaagttaaagatggagccaaaattattttaggtaaatttaaaaaaaaaagttttcttcaaattttaatttaattcgaggaggctttaatttttatttttcaaatccgtggtaagtcgaaacaattattataagcagagggccatggatttaaatggactaagaaattccaaaatatggaagaaatattgacaaaaagtgctaattacagcaataatactcctaataatctaaaagactgtgttctcttaatttaattctgtttaggctatcagggcttaaaaaaacttaaacttgaatagatttttggcatagaagcaaatgtcggggttttctgaataaaatacagtatccaattccatgaaatacagtatgagttgattgtttttaagggttcaatagttctgaacgcattaggactggaaagccgtacaatggaattcagttgcatttgcacaaaaacccatcaaatgtgttcatccatccaggctttgtcaagaaagaaaatttgaacacaacgggatggaacgatttggcattgataaaggcattaatcaaaaacaataataaatttaatacagggttttgccattcgaactttatcaccccttaatgcaaggaaattttcagcacggcagtgccgataggcagcgtggagaaaaaaaattggggttttgaatgtgttttttcaaaaaataaa

SEQ ID NO: 82601 - DNA, 2391 bp, Heterodera glycines
  Genomic contig location: Contig_ID=SeqID_2976; Location=1363..3753; Strand=-
  SCN-specific regions: Sequence locations=1-201,224-312,334-350,430 -495,517-888,910-1101,1193-1425,1448-2166,2188-2226,2285-2391
atgtttttggctaattttattttctgcatttttttgtttgttttttccgaactttttgccggattaaatggaaagtaagcaatacaatttgtctaattatattctcaaaaaatggatgataaaataaattcctaaacaagtaagttaaacactaatctgatattatttttctaaaatctgacattctaatttggaattctaaaaatttgaaattaaaatttttgtggctcaaaattctaatttcaaatactatggggtcaatgatacaactcaattgacataataaaaatttttgttcaagttccgaatattcagggttaataatttgatgaaatgatccttcattttccaaaaaattttttgattaattaaataatttataaatatttataataaatagaaaaatttctttaacattaatttttaaaacattaagcactcttacgttgcaagtgtctaaagccaatccgtggccaatccaagtgttttaccgtagtaagaaatgctcaaggtaatttggtcatatgcttaattgcttaatttaattggttaattaattaagcttttggctctgctacaaccgcacaatgaccgacaaaggctttccgtggaaactgaaaaaagggtttcgtttcgatcaattgttcaacgtcagcagtgagccatcgatcagtgatcagtgtgggccaaatgccaggaaaattcacttttcaattgccaacgaaactctgaccatcggaaatgaattgatcaccaagtcagtctgtttgggttattagtatatatagtacgcaaatttacatcaaagaagtgccgactttagaaaataaaaagtcggttttttcattttttaacgtaattttggccaaaaattcaaatttttaggagacacattttattatgaaaatatcgttttgaggggttaacctatcaaaagcatcggaaccatttcccattgggattgaactgttcggcgtttaaaaggcaccgaagatgtcgtaaatggtctaattttcattgaaaatggtaaatttcatggaaaacaattcccgcgggtgtccttactcccgccgtcttcgggcctacatttctgtttttggcatttttttaaaatttttttaacaaaatacagtaaaacaaaaaatatatcctttaaaatattttaattaaatgaaataaataatcttatattgtagcaatgcaaagccaaacgacacaaacattgaattgaaatttgactcattttgtggcaatgttgtccttttaaacaatggtaattattaataacaatcacttgcattgaatttattttccaaataccgtgtttactaaattagaacccccctgaaataaagccagcctttcgaatggagttgaaaaatagagcccccgggggctctaattcaggaaatacagtcgataatggtaatcattaaatggatatattccagtgtatacgtttaatcagtgattttcctcagtttcataggcaataactttgtttttacttggtcaatgcgtaattcttgatatcaaatgaaattatgtctatagtagaacataaaagctaactcgcccgatgggactcgaacccacggcctttcctcaccatggaatgcttgaaaacgactgagctaagggtgatccctttagattattaggtgatccctttgattattctttaatatactctcaaaaaactgaattaaggaaagttcgctgattagatgtgtaaaccaaagtagagccaattaaactaatgacgtattaagatggacaggaacagttgaatgattttggcaaggaattttttgcccactccaattttggcccatttttggctgattatgcgggactttggctgttaccgctggatattgtgtcaaaattgggcggcgtcatgtcggatttaatttcggtggtgccggatgagtgtaaattcgaatggagactaattgatccaccaaaacaatgcatgccatttgattttgaggcagcccaaaagcgtcgcagcgcaagacgaatcaatccgctcgtaagaaaaaaaatgttggggatgtttaatgattgaaaccaatttgccaatttttcttgattagctttaaaatccgagggattaaattttacgcgtcaaatgattcattttagggttcaaagaattttttcattcatttaaaattataaaaaagccttgaataattcgaaaaaagatttttttttgtatgtcaaaaaattagataaatgcaaaattttatagaaaaatatttttggcattttgattttactcccatcagctggaaaaagctccaattttcaagaacatggatgctcgtagttttctaaagaggcatagtccatttccagaatttattttgcataaatgacaataaa

SEQ ID NO: 82602 - DNA, 508 bp, Heterodera glycines
  Genomic contig location: Contig_ID=SeqID_2976; Location=3868..4375; Strand=+
  SCN-specific regions: Sequence locations=1-66,88-90,112-157,223 -325,383-508
atgattcaccataatgcaacgataaatgatagaatgatgataattcattgggaaaatggtaaaatatttatgttaatcatttttaatggttttgtgaaaaagagcataaattatagttttggttagatttattaatgaaaatataaaaatgtgcaagaaaaataaattaaaaattgaacaattattgaataattatttgtttttagataatactattataatcagtgattggactcgtatttgaatggaaaagtacgtacttgaaaatcatgcgggaaaatttgaaatttgcttacctttaagattgattgtacttgaaaatagcaatttaaaaatttaaaatttttttgaaattttgtaccaataattttaatttttttttgtcacttttgattatatgtattctgatcattttgcatttgttcacttgatccactacgattttcttcactttaattttgtccaatccattgccatatatttcgtcaaaatttgtgaaacccaaata

SEQ ID NO: 82603 - DNA, 825 bp, Heterodera glycines
  Genomic contig location: Contig_ID=SeqID_2977; Location=224..1048; Strand=+
  SCN-specific regions: Sequence locations=1-270,294-420,449-489,511 -580,603-646,690-825
atgtacaaaatggattttgctccattcaaattacttctccttttatgccagaatgccgagaggccccggtggcccggtgagcccgggcgcgccaggcagccctgccacacccttgggacctggcattccaggcagacctggatttcctgaaaaaattggaatctgtagtttaacgaccaattaatttcgaaataattttagtttcatctatggtagcaatcggaaatcgatgcctattcttgagtatataaatatgtacgaattttttcgtattttcataattttcaaaaaacaattacctgtaactccttgctatccagccattcctggcggtcctgcgaggcccttctgtctggaaaattccatgttcgaacttttgtccatttattcctagaatgcctgataaacgatcataccttcttaaattcaaaaaatattaaatttttttcttgaaaattcaaaataccatgcccaatggtacctaaattgcttaaatttttaaaaaatcatctcagcgcctgtcttatgcaaattcattgcattaattttgttcgcttcttaatattaatcttaattttattatttgtattttcttttaacaaaactttgccaacagtaaaattgtacaatcaatttttcactatgatttaaaaatattcttaaaaagtatcagttaatatgtatgtaagaattattatttattgtgaaatgttgttaatatttttattaggatgtgtgtaatagggctgttcgaatctccgatttctgtcatttcgtctcgactaaccgagacttttttacacccttaaagattgagttttttaa

SEQ ID NO: 82604 - DNA, 1375 bp, Heterodera glycines
  Genomic contig location: Contig_ID=SeqID_2977; Location=334..1708; Strand=-
  SCN-specific regions: Sequence locations=1-152,175-263,313-438,503 -628,669-796,840-883,906-975,997-1037,1066-1192,1216-1375
atgctacaacaaaccgctaattacccggctgctaccggtactggtaacgctcaactcaacgaaggatacaacggtaggggggtcagttctgtgtggccgcttcggtctcgccagttccgacttagtacttaaaggccgattccgtcttaaatatattggaccaaaaaatatacttctttttttccatgtgtcctactggaaataaaagtcggtacaccccaaaacgtcgccgccgaaacttcgccgggacagaaaatcgcagcaaaaaaaaaaaatttccaaaaaacttttaagaaaaattttatttttttacaggaacttcaagcaattatcaaatcaaagcgtgcgacccaaaactgaacagaacaaaagaaaattcaaaattcttatttttcccttaagacgaaaatagttttttacaaagcaaatgtaaatttgaaaagaaaaggtggaattttctttaaaaaatttgttaaattttaatttcttaatttgttaaattgatcaaatgggaaaaaataaataaaaaccgtaatttcacatcaatttgatcgaatcgagtttcataaaaccaaaaaacgaagcagaagtcacagataatgaatgctaaggccatataataatggacaaaatatattaatttaaatacctttattttatttaaaaaactcaatctttaagggtgtaaaaaagtctcggttagtcgagacgaaatgacagaaatcggagattcgaacagccctattacacacatcctaataaaaatattaacaacatttcacaataaataataattcttacatacatattaactgatactttttaagaatatttttaaatcatagtgaaaaattgattgtacaattttactgttggcaaagttttgttaaaagaaaatacaaataataaaattaagattaatattaagaagcgaacaaaattaatgcaatgaatttgcataagacaggcgctgagatgattttttaaaaatttaagcaatttaggtaccattgggcatggtattttgaattttcaagaaaaaaatttaatattttttgaatttaagaaggtatgatcgtttatcaggcattctaggaataaatggacaaaagttcgaacatggaattttccagacagaagggcctcgcaggaccgccaggaatggctggatagcaaggagttacaggtaattgttttttgaaaattatgaaaatacgaaaaaattcgtacatatttatatactcaagaataggcatcgatttccgattgctaccatagatgaaactaaaattatttcgaaattaattggtcgttaaactacagattccaattttttcaggaaatccaggtctgcctggaatgccaggtcccaagg

SEQ ID NO: 82605 - DNA, 485 bp, Heterodera glycines
  Genomic contig location: Contig_ID=SeqID_18027; Location=8..492; Strand=-
  SCN-specific regions: Sequence locations=1-16,38-119,142-485
atgacccttcacacaattcattccttctgctgcaccacattgctcatgatactgaaaaaagattggaaatttcgagcttcatctgtagggcgaggatttagatttactccccaaatatttaaataaatatttgagaaaaaatgcccaaatatttatattacatgttactaaagaccttttttttttgctatttggactaaaaaaaacttttccagattattttaaaatttcagcgccggatatcaaaaatttgcccaaaaatgattaaattatgccattttgagggtttaaaattcaattataaggttgagaaatgggagaattcggccctcctccctggctacgggcggggtccgtacaatccttcagtgggcaatccgtcagtggtcaatccgttagtggacaatccgtcagtgaaggacaatccgtcagtaatggacaatccgtcagtgtacaattcgtcagcaaatttttttgaacaatga

SEQ ID NO: 82606 - DNA, 544 bp, Heterodera glycines
  Genomic contig location: Contig_ID=SeqID_18028; Location=1251..1794; Strand=-
  SCN-specific regions: Sequence locations=1-211,243-544
aggtggtgtttacgtgccattccccggcggtgaacaatcgacgtgttcagaccgccaaaatcagtccgtcttcaccaactgttttgggaaccggaggacgggaaaattttgaattgagagtattatttaaaaaattatcgcaaaaaacggttaatttgctagcagttttgcataaaaatgaccattttcatgacagttagttgaaaacctgaatttatttttaaaaaaaatttttttttattgctctttttaggccgttctgcgacagcccttcagcacatggttgacgtgcgcaagaagctggagttggaggtcaaaattgaccctgccatttttgtcgtttgctccggcggtgcctttgacccaacaaaaacgacattaatcgccgaacttggtcaattgaaactgaacacttaggacgagccgtccacaaaagcatacgaacatgtcagggaattgtttagggcatcattcaatttaagaaaatgataatatttgcagataaccgatcagagattgcgttcattggtggccaaggcatacg

SEQ ID NO: 82607 - DNA, 383 bp, Heterodera glycines
  Genomic contig location: Contig_ID=SeqID_18029; Location=558..940; Strand=-
  SCN-specific regions: Sequence locations=1-104,126-225,247-383
tagaaaaagaatatttttggggttaacgtacatttgaaaaaatgaatgaaaatgttattggacgggaatcaattttcctcggccaaataatttgcataaagtgcaaaaataaatgggaaaaaatatttacataacggggatttgaacctaggacagaaaaaaggtgcggcagaggcgtaacccactacgccaccggccactgtggaagggtgtaaataattatttcttttatttaatcattaaaaactttggcattttttatctcggcacaggggtccatttggcagaaattgaaagcatttttcttaagaacccaggggtgctctatctacccaaaaaatctcattccgagatcccacggacacttggccacctccctttgt

SEQ ID NO: 82608 - DNA, 388 bp, Heterodera glycines; identical to SEQ ID NO: 51536
  Genomic contig location: Contig_ID=SeqID_18030; Location=338..725; Strand=-
  SCN-specific regions: Sequence locations=1-20,42-275,297-388

SEQ ID NO: 82609 - DNA, 1092 bp, Heterodera glycines
  Genomic contig location: Contig_ID=SeqID_18031; Location=148..1239; Strand=-
  SCN-specific regions: Sequence locations=1-554,576-878,901-1092
atgaccttaaattcactgcctgaactaaaagggaacttcggggcagatggcgtccgatcgtttttccggcattttgatgtcgcaaccgaagaatggcctgaagcgaagcgtttaagcgcacttcgatcaaaatgtttggggcgtgcggaacgtgcgttcaatgttgcggttgcaaataacccattccgttatgacagcgtaaagagagcgatgataaatctgctggaggagacagatgctaggcaaatgtcggcatttgacgagctgatgtctggtgcatatcgccgaaataatgagagaatcgacgatttggcggaccgtatttcttcgctggtcagaaaagcctaccctgggttactcgagcatctttacgacgattattcaattcggcacttcataagggctctccaaaacccggagttagcattaactctcgagttagcccgtcgtccttcaatgatttttgatgaatttgttgcattagcggcgagagctgaatcaactcaaaaggcatcgaagctcgcaatgcaaaagtcaaacaatttctcaaggttcaacagccaatttcaagtgcctcagtacagcccacggccaatgcagcagcattttcgccaagaaaattttccacaagccaatgaccagcaacaaaaccgcccaacttgttataattgcggaaaattcggacattttgccaggcaatgttcggagccccaacgaaaccaaggcactcagaataacaacagctcaacatcaaatttcgttcgacaaaattttattgttgaacaacaggaaagaccaccacaaccgagtcaaaatctttttgttggtggcatttcgatgagtcctgctgaggtggaaaaattgtttgggaaggatgggaccgaaaatgagacgacgaaaaatttgaataaggtttcgatcgggagaataatggccctaaatgtatcggtttgtggtttgacggcaaaggctatgttggacggaggggcccaaatttcgttggtttcttttgcattctttgcaaaattgttggccgaaaaaagaattgataccgatcttcgcccaactcgtcacatcacttcgggtgattga

SEQ ID NO: 82610 - DNA, 952 bp, Heterodera glycines
  Genomic contig location: Contig_ID=SeqID_18032; Location=122..1073; Strand=-
  SCN-specific regions: Sequence locations=1-119,196-210,238-410,502 -762,810-926,948-952
atgacagctttgatggttgacgcaaaaatgcactttgatcatagagttggctggtcacttgtgtccatgcgatcaatgggagcagtccggacaaaatgtgatcccttttttgattggttgaaaaagtattttaatagaaatttattaattttattttattgttattcttatttagtttatttaatatttatttcaaatttttatgtgtccaagcaatttttataaaaagaaatgattaaaacttcggttaaagaattagtccagattaattatttgtcgataatgatcagtcaaatgaatcaagtgatcggaatatgattttatttaaaaaaatgatggtgggaactaccgtagcgaaaaaaggatgaacaaatggaatttgccttctttgccgacggcattatgtgctgaaaaaattgaataaattatttttttattagatatttttttattgaaattaatttattttaaatcattataattttggtatatatatatatagtagagttgctcggtaccggtaccggtaccgaccggtaattaccggtttttttggtaccggtaccggttttttcagaaatcaaagtatcggtaccggtaccggtaccgaccggtaattaccggtttttttggtaccggtaccggtaccggtttttcagaaatcaaagtatcggtaccggtttgtctagtaccggtaccgccggtaaaaatttgcactggtaagaatgggggtctgggtgagaaaagagtaggaaattggtgaagaaggagaaattttttgagaaaaaaaaaattaaattatttattttcgtttaaagcgtttgttcatatgcagtggtcaagtggctaaaccttctgattttattatttctcgcttgggttcaattccccactgggatagaatattcttcatattttctttaccattattttaattgaaattttaattaaa

SEQ ID NO: 82611 - DNA, 1146 bp, Heterodera glycines
  misc_feature (1091)..(1091): n is a, c, g, or t
  Genomic contig location: Contig_ID=SeqID_18032; Location=1227..2372; Strand=+
  SCN-specific regions: Sequence locations=1-117,155-190,235-609,631 -1058,1101-1146
atgaaaaatccttgttgcaaggcattgaggatatatgaagaacaatttatggttttttgtgtgatgtgtccatatgtaaaatcagatgatgtaaatcaaaaaacgaattaaaacaccataaatatatatttatatatataaatacatttattatgtacaaaatttgttgtatttcataaaacagtatcagattttaatgaattaaatttttctttttctttttttaaattttaagactgcccagtcaatttctttcacatcaagcggatttgaacccagaacccatttttaatgcaccgctaaatgaaaaattcacaatagaagtcgatcctgctctatccaatctatatatagcttatatgcaatttcacggagcaggacaaaacgtcgtcggacgaatttttgggccataacttttttttctttctccaccaaattaaacattcatgctattattcgaaagcatttgaaaaacgctattaaactagtaaatttccaaaaaaaatgtattcatgcacaaagaaatcagggcaaaaaaagttcgaaatactgggttttcgagttccttctggccataacttgtttgaaacttaacgaaaatttttgcaattttacaaattaataataaaaaccacagagctatcgaacaacaccaacaattcttaatttgattgacagtgaacaaagttatggttcaaaaagtcttccgacgacgtttcggccggcgacgttttggggtgcaccggcaatttcatacatacatacagttgatatgttcccttgtaagcaccggaggtccggccgtcccgatatgatttacaaatcgctgaatattaattttttggctgttaaatttcaaaaaaaaattgcttagtttaaaaaggttgtgcaccgaaaaggaggctttttcgacacttttgaccttttgtatgagatttattgcacgaaagggagtgtggagttggaaaaaaagttcgaaaaactagggtgaaaagaacgtggtgatcaaatggaatttcccgggatataacctccaaaaggtacatttcgtcaaaatgtttttttataaaaaaaaaaaaaaaatcaaattnttaattttacaggcagataaagaaatttatgtagataattaactttttattaaaa

SEQ ID NO: 82612 - DNA, 902 bp, Heterodera glycines
  Genomic contig location: Contig_ID=SeqID_18032; Location=2400..3301; Strand=-
  SCN-specific regions: Sequence locations=1-200,222-491,516-666,688 -822,856-902
atgtcattaccaacaaaagcaacaacaccaataagaaatgttcagccaaaaacagaggccgaaggacaaagcggggcgatgacttggaatgtggcgattgtgacgattgtggcgattgcgatttttgttgctgttgctgtatcggcggtagcagtaccaacaatgacaacgactgttgctgctgtaacgcaaagtgttgctttgttttgtggctaataattgcattggcatgcgttggcggcatcgctttatgtgccatcaaaatgcatcaaattactgctaatgaaccgaatgcacaccatagtattggtcatttcattggtggtacggtgggcgctggcatctttctggtgatttctgttattgctatggtgatcagctgttgtgtaattcgggatagctgaagtgatttaaacgcgctaatggcaaaacgtgcaacaagaaaaaaaaaagttgaaaaatgtaacataaaatgtaaaaaaagaaaaaaatgctttttatttttccaaattaaatacctattttagcttgaaagattagtttttgaaaaaatcacagttttgccatgacaaagattaggcatatggtacggtatttgcatttttgtagattaatggcaatcaaagaaaacagaaccttaattcacaatactgaaaaaaaaaatcaaaaatagcagatttcacagaaattttttaatttcaagtgagtgtggagtcctgcgattcataatataccgtattctgtgagtgtgggtgctttcttgctgaaattttgaagctaactcatttcgataaacattaaccaattttaaggagtttaatcaatttaattttattttattttatgtttataaaacttctaatttcgtattaagaaaattatttttgtttgagtccaataaa

SEQ ID NO: 82613 - DNA, 562 bp, Heterodera glycines
  Genomic contig location: Contig_ID=SeqID_18036; Location=2159..2720; Strand=-
  SCN-specific regions: Sequence locations=1-91,114-121,145-232,349 -384,411-562
atggtaaaattggcataccaatgccactttttgtttctacgttttcactaattaacctattttttggttttgtttttcgcttcttaattaaccttgtttctttctctctcttcccacttccgtttgtttcttttgttcatttgcgcttttccaatggatttgtgaggtcataaatgttcagaagagggccaagcaaaaggcgaagttggcgggcgaagaagcaaatggttttgaggaggaagaaaagtgccaaaaggaagaagcaaaaaaggaggaaaaagccgaggggagacggagtgaattcggtggaggaagaagaagcggaagagagtgggaaaagggggacgaaagccatggcaaaggccgaagaatggagggacaacaagcagtagcagaagcagcagcagcagaggaagaacaaacggaatggaagaaaaacggacggaagaagcaccgggggaagacgaaggaagcagaaacgtatgccaaatggacggattgattactgaaaaattaattaggtattaattaattgcttaaagttgagtaattttaaaataaa

SEQ ID NO: 82614 - DNA, 593 bp, Heterodera glycines
  Genomic contig location: Contig_ID=SeqID_18036; Location=1065..1657; Strand=+
  SCN-specific regions: Sequence locations=1-593
attgtaataattcccatttttgacaatgctaaaattgggtgaacttttgtttcaattaaaatgcctttgtttcattcattctttttgattttgctctttttaaatttatttttccaatttattttcttaaaagcattgaaagtgccgcgtttcttagtaaaaaaaatattaaacgaaacgatgcaaaacgaagcgcagacaatcactgaaaaggtgggccaaacatggcgaaatggaaaaaacgggaaaatggggggggggggcggtaataacaatttaatgtaattatcattaattagtccaacaatgccaaagtgccgtttcagccgccgcccctcggcgcctccgccccttccctcggtggcagcgctttgtcctcccttttcgcctcccctctgatcactttggcccctccgatcacttcctccgcttcgtttctcctctttttgctgacgatcaccttccttctgctgatcagtgcttttggccttttgcttttcaaatggcacatgcgcaacggaaagagcgaaaacggagggagcaaagaaaaagcgtggaacggcagaacgccaatcatttcgcagcctttgcga

SEQ ID NO: 82615 - DNA, 796 bp, Heterodera glycines
  misc_feature (644)..(644): n is a, c, g, or t
  Genomic contig location: Contig_ID=SeqID_18036; Location=2899..3694; Strand=+
  SCN-specific regions: Sequence locations=1-185,207-330,352-378,428 -600,632-796
atgagaattaagcaaaagaaagattgcagagatgtgttttttgatggtttgtaatgcgtaaaaaatatgtaattaatttttcttttctgccattccatcgttttttttcattttgccttcaatatgccattctgtgaatttaaatgccattcttttgctgcccttctgtgatttctatgattacatttttctaactttgttcatttcgacacttaccaatgtcaaattcggcactagggctaatatttatagttttttttctgagctctccgtttgttaagctacttttcgagttattagtaactattttctagttttttattttgagtaccaattaacaaaaatgcaataaaacgaaaaatcacccctaagaatcgaccccaaaaatttatgaaaaataaacatgaaaaactctctctaaaattcatctctaataagatttttttgattttctaaattattgaataaatttagtcattttacaaccctaaatttgaggcttttaagtgcctattttggcggtttttagagctaaaacttggagctcttttattaacatccaaagggttaagtgtactctattagcctgcgatgccatccgtctcttttttaaattaaataatttgcagaaaacttcgttgtgncatatggaagcgccgatgcttcaaatcaacaacataaatccggcgttgaagcaattaaatatcatccaaaaacacaacattatgaaattaaggataaatttcgaaagaatacaagagcatacttatttttgaatgacattgtcgtaattaaa

SEQ ID NO: 82616 - DNA, 1522 bp, Heterodera glycines
  Genomic contig location: Contig_ID=SeqID_2978; Location=203..1724; Strand=+
  SCN-specific regions: Sequence locations=1-50,83-103,132-370,399 -448,582-612,692-717,747-790,821-829,852-892,975-1027,1049-1078,1116 -1117,1166-1169,1225-1358,1381-1427,1461-1522
atgatatggtaatatatgaaaattttgatccaatttaaaataatataggcatattaataaataaaaattaataatattaaaagcttcttattttaagaacacgaaataataaacaaaaatataataaaattgcatcaagaaagtgcaaataagttttctaggctacctaagacccaataagaaacaagaaagatgtgacgttgcacgtgaaaggcgagtgcttaaaaacaaaaatgtaaaaaatagaaatgataaaactaatgtattgtattttattttaaagtaagatatcttcatatgtaaaaaaaaatttaaattaagcgttttaatattcgtttcggttgaaacattccttatttggggaatttaaatatatatatatatatatatatatatattttattttattttcggattgaaaattcaatacaatttaatttgcaaaatcaaaaattaataaacaatataaataccaaacatttaatataaacattttaaaaataatattcagagaaaaaattttcaggaattattaaaaaaatggattaatttttttacttttataattaattaaaattattgatgataaattggtgaatgactgctttttacataaaaaataaagtttattgaataaatttaaaagttattttattatcttaattataatttaaatcttatttaatttattgaatgaaacccataagaatttatctgtaaatatttaattaattgaaatttaaaaaggacctagtgcaattattggacctgagaatcacatactaaaatgtaaaattttaaattcataaaaaatatttttgatcgaaaaaggctgagttgaaaaagaaaaacatgtatatgtagaaaacataaaacagaattttatatgatcataaatatttaatatgaagaataatataaaataaaaataattaacaatttattaaaaaaagtaataattttaaaaaatattaggaaacaccacccgtatatttcaatggatattcgtcaaattttttgtctcgaaaaatttacaaaataataaatggaaaaaccaacaagtaggcaagtgaaagtgattaaatttaaaagaaattaaaaattactataaataacacatgaaaaataactcccaaaacaaattaaacttaattttattttgcaattgaaattaaatgaaaaaaataattaaaaaaataattaaaaatttaataaaaaaataaagatgaaaatctattcaatcattaaaataatattttcagtagtaataaggccagattcggagtatcaaactgttgcagaacagttgcaattttttcaaggctcttaatagaatagctctacaacggcagagggcaagtaaacacttaaaaaatatattgctaaaatttacgcaattctaattgcttctgggaatttgaaatactaaaaatttgaacaaatgcaaaaatgaattgaaaaattattactaatataaacaatgtcttgagttaaggattaattatattgaaaaatcagctaa

SEQ ID NO: 82617 - DNA, 1193 bp, Heterodera glycines
  Genomic contig location: Contig_ID=SeqID_2979; Location=874..2066; Strand=+
  SCN-specific regions: Sequence locations=1-527,564-754,788-1193
atggcattagttagattttctgtcggcaaaacgaaccgtgggcgtcagctgatcacgcatggaggctacgaataccttttcgaagtgaaagttttcaaaaaaacaaaaaagcagttttctaaggctgactcccgcacggaagatggttggagttactggaaatgtcctcgccgtccaccatactgccctgggagggcaaccgtgcagtcaaatttgtttgttgctgatgacggctcaaattacagattaggtcgtgttactgcacaacacaaccacgaaccggtctttggttcattaactgtgggtcaaattttagtggaaaatagggggaaaaattatataggttagagaagccaatgaacgacttcgtgatgaagcacgatctgattttcctacaacaagtcgaaatgttgtgaggcaggtcagagcggatattccagtcgatgttcgggttggcgttgctccatctgcttcaaacatgcaatggaactacaattacaccaaacgaaagcattttgaacaagtcgatttaataaataaataaaataataataataattaaaggaaggcgatattgggcttgatgcaatgcccccaacgaatttattggttccaaatgcactccaaaatcgtgtcatttacaaccaaaatcttcaggggaaaaaaatgctcattttttgttcacagtttggtctcgatgcactcagaaattacggagaaagcgttgcaattgacggcacttttgaagtacgtaagataaaatcaaaatggaaaaatgtttttcagagttgcccgaggggatttggacaactttacacaatgtcggttatcattgagcactgtgctgtcccttgcgcctacgggcttcttcctaacaaaaattcccccacctaccgcattttttttgattccatctgcgcttctgttgggattgggtggtaccctgccagaattatgactgattttgaagccggggcaatcaatgcagccaaaattgtttatccaaatgcaatcgtcagtggctgcctcttccacttgggaaaggctttttttcgaaaaattcaaagtcttcctcatttgttggaccgctacaacaacaatgaggatgtccgaaaagcactgcgttgcgttcaagctcttgcctttgttccattgaattatgtgtacaattactttgccatcgccatgtcggt

SEQ ID NO: 82618 - DNA, 1745 bp, Heterodera glycines
  Genomic contig location: Contig_ID=SeqID_2980; Location=395..2139; Strand=+
  SCN-specific regions: Sequence locations=1-16,40-212,234-396,421 -535,557-838,868-940,962-1133,1155-1232,1255-1631,1654-1745
ctgctgagcattcacttagaaaaagattctccttttcaaaaatttttttcagatatcaaatttgttcggtttggttgggaattaagcgagttatggctgatcaaattaaaaaatacaaaaaaggcatgtaaattaaaaattagcgcgcaaaaattcacgacaattacgctctttggcgttatgaacaattttgtctgacactgggcttgaccaaaacacattctttaaaacaattttgtcaaattttttggtaatactgccttttactggtcccattaaaaaaagagaataaaaaggcttttttttacgattattcgttcttttagggggttatcaggccgctgatcacgaatatgatatccatttcgaccaattcctaaacccgaattcgaacataaaatcgaaaattcaaattttcaaaatttggatttatgtttcaaaaagggtttaaatgcacggaagcaaaccgaaagccataattagcaataaaaaatacatataagcatttttaagacgaaaaattcgaaattctttaatttgtgaactttctattttttgttcgaattcgagtccgggcttaggaattagtcgaaatgaatgacatgttcttgattagcgaccccgataacccccgagtagaacgaataatcgtaaaaaaccgcgtttttattctcttttttttattttcaaaaattataatgtcaaaaaacatagttatttccttgggttttcggggtcactgataacgaaattcggcatccatttgacaattcgaaatcccgaaggtgaatttgaacaaaaagtcgaaagccaaatttcgaattctcatttttctctgaaatggtttaaaagaaattttacttaagtatttattgttgcctttcagtttgtttccgtgtttttaaacaaagtttgaaccaaaaatgcgagttcgaaaatgtaaatcttttggttttttaatgaattcgtgttcggagtccggaatagtcaacatggatgctggattcgtaatcagtgacccccgaaaacgcaaagaaatgaattgagcagcgggggaacaaactccaatattacttctgcgcttatgtcttatggaggtcggaattgaacggatggaaagcgatgagaatttggaaaatttaccaaaacaggattggacgataacaccagaaccaattgtcattcgtggagttgggcacctaaccatgtgagaagagtaatttaagacaattaggattaataggacttgttttttcttcgaaggtttggccttaactcgcatttttcaacggaatttcctagcgctctgacaggaaaattggcaccggaagagtttgacgacacattgcgacgtgtgaattacgttcttcagaggaatgtgagcagaaacttgcgctggttgatctgcggattgcttttttgctgctgcagcttcggcatttcgttatggccggtggtctgtctgaacagaagggtaagtggtgaaaaaaaagtttatttcaatttttgtaaaaaccaaaattcaagactatttccgctctcgagaaaactctggaccatgagaaccaacaattgtacgacaagctcggcttgcattggtagcgcacctttaacttttcaatttgtttgctacaaatggcgatttcaggaagttggccaggctgcccgttgagccgtccaatcgcctgacagaatatgtccttttgcttgaaacgctgccaagaattcccctttccatgccggat

SEQ ID NO: 82619 - DNA, 1135 bp, Heterodera glycines
  Genomic contig location: Contig_ID=SeqID_2980; Location=1074..2208; Strand=-
  SCN-specific regions: Sequence locations=1-161,184-560,583-660,682 -853,875-947,977-1135
atgggaacatttggaataaaacggacagaaagagccatcgcagtcaaatctaaacagtttcacgtgctaatccggcatggaaaggggaattcttggcagcgtttcaagcaaaaggacatattctgtcaggcgattggacggctcaacgggcagcctggccaacttcctgaaatcgccatttgtagcaaacaaattgaaaagttaaaggtgcgctaccaatgcaagccgagcttgtcgtacaattgttggttctcatggtccagagttttctcgagagcggaaatagtcttgaattttggtttttacaaaaattgaaataaacttttttttcaccacttacccttctgttcagacagaccaccggccataacgaaatgccgaagctgcagcagcaaaaaagcaatccgcagatcaaccagcgcaagtttctgctcacattcctctgaagaacgtaattcacacgtcgcaatgtgtcgtcaaactcttccggtgccaattttcctgtcagagcgctaggaaattccgttgaaaaatgcgagttaaggccaaaccttcgaagaaaaaacaagtcctattaatcctaattgtcttaaattactcttctcacatggttaggtgcccaactccacgaatgacaattggttctggtgttatcgtccaatcctgttttggtaaattttccaaattctcatcgctttccatccgttcaattccgacctccataagacataagcgcagaagtaatattggagtttgttcccccgctgctcaattcatttctttgcgttttcgggggtcactgattacgaatccagcatccatgttgactattccggactccgaacacgaattcattaaaaaaccaaaagatttacattttcgaactcgcatttttggttcaaactttgtttaaaaacacggaaacaaactgaaaggcaacaataaatacttaagtaaaatttcttttaaaccatttcagagaaaaatgagaattcgaaatttggctttcgactttttgttcaaattcaccttcgggatttcgaattgtcaaatggatgccgaatttcgttatcagtgaccccgaaaacccaaggaaataactatgttttttgacattataatttttgaaaataaa

SEQ ID NO: 82620 - DNA, 725 bp, Heterodera glycines
  Genomic contig location: Contig_ID=SeqID_2982; Location=638..1362; Strand=+
  SCN-specific regions: Sequence locations=1-13,35-137,159-360,384 -475,530-559,583-594,616-689,711-725
atggaatttaataattattttaacaaaagtaagtcaacagtattctaaagaagtgtaacaatccgttcttgtgccgcatcttgtattccgaataaaaagatccgttaaatcacagttttttgttcacggattaacataattatatttttaagtgcaaaatatttaaatttatctttgactctataatattattttctattgtcatagtataacaaacatatcattgctattatttgtttacttacaacaaaacaaatattaattttttttcataagttctggcggtaagcacaattcattctcgtcctatttaaggtcgttgattatgttgaaaatctcattgtttttttcttgttttggaaatttttttaaattttattattctagtattttgattaaaatgttattgcttttttattttaaatgttcaaatttcgtattctctcgacgtaagcaaaaatttgaaataatccggttaaaaaattctttttattatttttatcattaatttgattttattaaaaaaaatgttcgtttattatcattactaaatgtcgatatttaattgataataataaatttgattttgatattcaaaatggaaacataaaaatatttttaggtactcttccgttggcgattagttaactttaacgtatttcgtgtcattatattcttttgattgcatatttttctttattttccccattctgtattcattttca

SEQ ID NO: 82621 - DNA, 780 bp, Heterodera glycines
  Genomic contig location: Contig_ID=SeqID_18037; Location=501..1280; Strand=+
  SCN-specific regions: Sequence locations=1-413,437-452,475-549,572 -610,633-780
atgagatggcaagcgaatgctgcacgtatgcttatggcgattcctcttcgagagcctaaaaccgttgatgttcctgacgagtaagtgaattgattgataatttagtaatttcatggacccgaaattcacaaatttttttgttttgtaggcctaagtcttcacctactgacccactttcaccatacgacccgtcccatccgcgtcctacacaaccggactatcccgacatgcgtgattatgatccgcgttcatttaaacctcctgagccggacgatgacccgcttcgactgcatccgatactgcccgctgcgccgtatgcaccaccggcacggcctcgaccttcacagcctaatgcgcccactcgaccgccacctacttaccccgacattggcagaccgtattttgatcctcttccgcaccagccgacgaacccgtacagcgactggccctatggacctgcagcaccgactggatccggcggatatatgggcggttatgatggtggagtgtatgaacctcgtcctgaccagcctgggaactcgaattatgacccatatggaagaggaggatcggacgacggcaaccacggacacgatggtccaggatcttctggtggcggtggcggcggattttttggtccttatctttaagaagttcggatggaagtctatttgcttgttgatatgcaattgtttccattgtataatatgtaatgtggttaacgggtattcattcatttaacacatacattggcatatgtcaaccatactatttgtttca

SEQ ID NO: 82622 - DNA, 1062 bp, Heterodera glycines
  Genomic contig location: Contig_ID=SeqID_18037; Location=1521..2582; Strand=+
  SCN-specific regions: Sequence locations=1-1062
atggaagagtttgaggaaatggtcgctgttcttcagcttgatggcgtccttgactttgacgcggtgcgaagagcagtcagttctggtgcaatccgagtgcgcgaatgtgacgcggaaacgcccatggttcaggtgtctgaattttgactccttcgatagacattccgaaccgagttcgaacaaaataaaagttttctgatactgagttaatgaaattttgtttgaatttttgtctggagctcgcaatttgtcgagccgatgccagattcatgctcagaaattccgagaaatgtgttttcttaacttataaaattaaaaaaagtaaaaatgactatttattgaatatgaaaaaaaaatcgaaaaaccggaattgattattagtcttttatcttaagattggatctcatttgtattctggacaatggtcacaaacgttaggcactgatatgcttttatgtccttcttcaatgtcggattaccatcaccatgaaggtattaaatttcttttaaaccgaggtcgaattttttttcaatctcattgtcagctcccataaacagtattaaatattagagtgttggtttggtttttcatggttgtttaaccgaaacgaaatcgaaaaccaaggggtaggccaaaaatctaaggccgaggagtccaaagccaccctaactaaaagccggtagacccggttaataatcaaccgtgaataacccgtgttgatgtagcctatcttttttattacatattcatgaatttagttttgaaaaaacaaaatcatacgcactttcaaatacacattttgactacgtcgaaagataaacaaaaaaaaaaaattttccggaaaaaaattctgttcatgaacaacataaaaaatctgttcttcccattgggcattctgtgcgttttacgttttaatttcaggccatcagaggttggaattggtcgctgtgtcagacactcgtctctgtgcgcaaaaagttcttttagcaactgacgaaagtccgactaatggcaatggcactcggaatgaacaaagcacttcaaatagttcaaaggcataa

SEQ ID NO: 82623 - DNA, 948 bp, Heterodera glycines
  Genomic contig location: Contig_ID=SeqID_18039; Location=1143..2090; Strand=-
  SCN-specific regions: Sequence locations=1-162,191-208,234-254,277 -603,644-948
atgtggacctcgaagaatgtgcaggaatttaaagacaacatcaaaaaggagggcaccgagggagttctgaaaattggtcatggcgaaactgtcacagtgagtgaactttgaatcttgaaacggtcctttccattatgagccaaacaattttactagtggtaatttatttgtttgtttgtttatctgtttggcctttcaaaagggacgaagaatattgtataaaataaacaaaagatgctaattgaaattcgcattttttcattatttttaggttcgtgtcccgacgcacccagagggcaattctttagtctgggagtacgtttccaattgatatgagtcattcattagtcctctctttgcagttttgcaaccgattactatgacctcggttttggcgtttatttcgaatggacaattgcggagacgaaccaagtgacagtgcaagtggaagagagtgaggacgaattggaggacgacgaagcggcggggggcgagggacgcaccggcggacagacggcgggcgacgatgtggaagcggacgcggcgaagcgacagaaagacgcgaacaaaccgcgcgtagacgaaatcattccggtccggccccattgccattgcttttggtgttttaatattttcattttcagaccttccgaagggactgtcacgaggaggtaattctgtgcgttcaagtgacaaaaagtgaacaaatgtgttttttaggtgttttccggatctcatgtttatcccggacagggcatttaccttctcaaatttgacaattcgtattctctgtggcggtcaaaaacgtaatgctttttaccctttgagtgtccataaaataataacttacgtttaccttaaggttatattacagagttttctacagcaagtgatatcatccagacttattgttgaaatttacacagtgaagggaaatgattgaataaa

SEQ ID NO: 82624 - DNA, 102 bp, Heterodera glycines
  misc_feature (75)..(75): n is a, c, g, or t
  Genomic contig location: Contig_ID=SeqID_18040; Location=1170..1271; Strand=+
  SCN-specific regions: Sequence locations=1-102
atgggattgtgcgagaaaagaaagaagctcaaaacgatcggcagatgtctttcatttatttgggcagtgattggngagaaaaacgatatcaacaaaagaaaa

SEQ ID NO: 82625 - DNA, 730 bp, Heterodera glycines
  Genomic contig location: Contig_ID=SeqID_18041; Location=699..1428; Strand=-
  SCN-specific regions: Sequence locations=1-223,245-366,388-730
atgtctgaagccgacccgaattttgtcaaaagtgaggcgatcagcaacggatgaagcatttgtgccatgagttccaacaatgcgttgactgaaatgatgcggcgtgagaagaaaaaattgttgggaaacgtcgatgtccacgggagcagattgttcaatattcgttgagcccgctatcgacttcgatagcgccttcaggcaaattctttaatcaattcatccgttttaatttaataaaaaaattcagttccagcgtgggaggacgaaatctttcgggcgccccacttcccaatcccattttggaacatgcactctcaggccacgtctgccctcgctcgtacaaacaacggactggaagcaactcatcttcattttatggtctttaattttttaaaagcaaattgaaaagaaacatttagaaaggcctctgtcaccaccccgccctcttggacttcatttgtggggttaatgaaagcatcgacagacaggtggacgctgcccgatctgctcgccatttcattcacaagcgacacaaacgatacatcctccaggatgctgtcattatgcgaattttggcggacgcgtcgtacaacaacaacggtgacatccatgatcttatgacggcgctcggtttacaaattgagggatatgcaggaaaattgaaggatttcgagaattttgatgattcaattgtccacgtcgtaaagaattttattgaatgtttaataaa

SEQ ID NO: 82626 - DNA, 1588 bp, Heterodera glycines
  Genomic contig location: Contig_ID=SeqID_18042; Location=396..1983; Strand=+
  SCN-specific regions: Sequence locations=1-130,158-204,226-451,486 -536,567-585,615-794,820-1261,1284-1322,1356-1386,1441-1557
gttgttcaagggattttggtcaaacttcatcaacccgagaccactccactagctccgatcaccaatgaagaagtggacaacaatcagcagacagacaatggcaaaaatgccgtagaaagcggtggcaatgcttcatcttcttcttcacctgcttcaacagtgccactgataattttggcactgattttggctgtgctggtgttggtcagcattttttggatattgatcaagcgggcaaaggctggccaagagaagcagaccgatcatgccaacggcaaaggtgggtcggggcaattagcacaactcgcgaggcaaactaattaattaattgatggggacgctaaaatggcataaatttgggtccgaatagcacgcattttttttttataaaggaaattcaaaaatccatggaaattttttttctgtttttttggcgtgagggagccttcgcaattttttttaaattttattaaatcttttaaaaacgatctgatagatttccatggatacaactggaaaattcaagaaacccaaagaaaaattaaaaatttttttatgttttttttgccatgaggaagccttcgcaaattttcaaaatttattaaatttttgaagatttcacaacataaaaggggtatttgtgaactgtcaaaggcgcgcaaacaggaaaaatttaatccatttatccgaatttttcccagaaatcaggtgaacaatttcctaattttgcgcgattcaaatattctatcattcaaaaggagaaaaattgtttaagatttgcgcctagaaaattgaaattttttaattttaaattttttagccgtccatttgccgtcgccggccggcgattcgaccactccaatgttggacatgcgtggaaatgccgagcggacaaccgccccggacactgtcggcatggcaccggaaaatggcaccgcgggaaggaactgattttcattcattggcattttgttcattctttggcatatgtccttctctccctgacaatatgctgaccatttttttttgtttaatacatacattttttgaggcttccttttttgtcatgccataattttttggcaattaaatttcaaatttttcttttggaaaaatcagattttttgatttttcatttggcttactgtctctcttttttcttttcattctcaatttgggttcttcttttgctatttaattttttaaatcaaatttcgggattttggtctcgactttttgttctaattttgcctgttttacaactgaaaccctccgacttttttagcattcattatcactattattacattaatttacactcctaaatatttaaaaattaatatttcaattattttgccacgcgccacccttacgttgtgaccagtcaaaattaattaattctgaaaattattttgatttattttaaatgattttttttatctatctttgtatcaatttatgggcagttgatatcactaatatttaggtgaaaatataatttttccagtcaaaatgccaaatttggcgcccaccaactgcccatccaactgaaactccattaatttgatttttattttattatttttaa

SEQ ID NO: 82627 - DNA, 1655 bp, Heterodera glycines
  Genomic contig location: Contig_ID=SeqID_18043; Location=572..2226; Strand=+
  SCN-specific regions: Sequence locations=1-557,580-762,784-1351,1381 -1478,1500-1604,1627-1655
atgccacctcaggacgaagcagggccgtcatcatctgctgcatcggccgaagaagcgatggagacaccaccaccaactccagcaccagtgccaacgccggagatggacgaggaaaaatttggaacagtatggtgctcttctctggccccaaattgaccaaatgaatgcattgatcaacagaccgattaagtggtaaaaagggtgaattttttttttaaattgtctgaaggtttatcggaggtgatgtgagctttgtgtgagcactgatcggtcattgcggatcagcagtgacttcgtttccatcgcctatctgcaattgtcatcttgatcagatgctcactgaaggatggcaatgtcaaacccggacaatcccgcagacaacgcaacagtcagaacaattcgcaaacgcagtggaaaacggagagaaagcaacagccgcagttcggtccagcacgatgggaattgtcaaggcaccgctcatgaagacaattgaatttgatcggattattccagcaccgtttcacgtgttgcaggggttgggaaacgcacttgttcgtgaacttgagcagcaaactgatgccacaattgccgttcaacaatttctgcgacagataggggctcggagggaacaatttcgtaaaaaggacatgacgggaaataccataagaaaagtcctcaaacgtgcatcggaaatggaacatctctttgaatcgacatggccaaagacaatttgccaagctcttatgcacttaggccaaatccaaaatttcacaaaagtacaaattttgagcaaataactcccaaatttataaatttaggctcaaccactttcgccaaatgacttggacgcatttgaacaccaaattgaggagttccgtggttttctggcccaagaacaacggatgcgcgacttcctatctcagaaaccgaaggcccacttatttctcaatcatttcgtcccatttgctcggcaacactcttttctcggcttgctggacgagcagggtgggcagcaaaaattaattgacgcaaattttcataaaaattaggggatgaggcgctgcattcggtttggcgaagactggagcaatggtggaaatgcatgccggacgcggaccaaattctacaacaattggagcaccattttgtcagcaattggctcctcgacaccggcagaattgctgagatgaagcaggcgagttttgagtggcgtgggaggggttaattttcccagaaatcatttgaattaaacattttagaggctggaagaccaaaaagaaaacgacaattttttggagcattcggatggtgaaaatgaagatgacgctgtcattgatgttattgggtgatcaaattttgttttgttttttaaatttacttaaaaaaatcttagaataatatgacttaattattttttctttattcgttgagaaaaacgtgaaatattgcttaattaaatatataactccggtgggattgaacctgggactccctttttggtggcaaactcacagaccagtaagacaaaaaatcaattagtttttgaactgggggctcaaaattgactcggtgtgtatagcatttggtcatgtaacatttttctcattaagattagtgattttttgtcatatagcatttttctcagtccaatttga

SEQ ID NO: 82628 - DNA, 462 bp, Heterodera glycines
  Genomic contig location: Contig_ID=SeqID_18044; Location=73..534; Strand=-
  SCN-specific regions: Sequence locations=1-163,237-294,321-358,381 -404,426-433,455-462
atgccaaatcaaattttttcgccggggtttttgaccattttggagctgggcgaaatgagcttggaccaagaattgcaacgtggtaaaacaaaaaaatcaaagaatcaactgatcacaatggtaaaagatatcgtgagcactttggatgttttgcacaaaggttattaactaattagtttattaattaattgtcaataatagagttaacgattctaaattaaaattatttaattaatgtgaataatatgaaaaactgttcaaagacaaaaaaaaatattgtaattacttgaacagaataattaattattttaaatttaatacatgttcgatcctttccttactgattttatcgaaataattttaatttgttttttaagttgcaatgcatttggacttcaagccgttaaatttgctgttatttaaaaaactcagtcttttttcttccacagatgtttcaataaa

SEQ ID NO: 82629 - DNA, 250 bp, Heterodera glycines
  Genomic contig location: Contig_ID=SeqID_18046; Location=1731..1980; Strand=+
  SCN-specific regions: Sequence locations=1-250
  Gene Ontology: Mol. function=transporter activity; Cellular component= integral to membrane; Biological process=embryogenesis and morphogenesis
gcggtcaaaagcagcgaattgccatcgctcgcgcattggtgagacaaccgaaagtccttttgctggacgaggcgacttccgcgttggatgcgcgcaacgaacagctgataagggagtcgttgtccgcttgtgcgaagggtcgcaccgttctgatgatcgctcatcgcctttccaccgtaagacgtgccgaccgtattttggtgatggaacatggccaaattgtgcaggtccgaaataggaaacggttgtt

SEQ ID NO: 82630 - DNA, 383 bp, Heterodera glycines
  misc_feature (162)..(162): n is a, c, g, or t
  Genomic contig location: Contig_ID=SeqID_18047; Location=196..578; Strand=-
  SCN-specific regions: Sequence locations=1-62,84-170,192-383
atgccgggcagcaagtaccagcaactgttgctgttcatcgatgaattggggcgtgtcatccgtaaatttttttttttttttttgggaatttgaacgttttacatgcttttttcgacaaaaaaagaccccaatattaatttcccttaaaaaaaaattaagttnccattatgcaattttttataaattttttagtgatcagcgaccccgaaaaccaacggaattcggctttagtgcactttatgagtccaatcgagttttatgagtccaatctgacttttatgagtcccatcgagttttatgagtcccaatcaaatatttatgagtcctataaaaatttatgagtccaatcatttttttatgagtcccaatgattttttaataaa

SEQ ID NO: 82631 - DNA, 2297 bp, Heterodera glycines
  misc_feature (2153)..(2153): n is a, c, g, or t
  misc_feature (2203)..(2203): n is a, c, g, or t
  misc_feature (2208)..(2209): n is a, c, g, or t
  misc_feature (2219)..(2219): n is a, c, g, or t
  misc_feature (2244)..(2244): n is a, c, g, or t
  Genomic contig location: Contig_ID=SeqID_18048; Location=1..2297; Strand=-
  SCN-specific regions: Sequence locations=1-34,58-181,212-355,378 -380,422-620,648-921,945-1521,1560-1613,1635-1750,1775-2048,2070 -2131,2153-2297
tttcgaactccgaacccgagttcgaacaaaaagtcaaaaactcaattttcaactaaattcaattttttttttttgcacaaagagattcaattcgaattcggagctaggaatgggtcaaaacagatgccgaattcgtgattggcgaccccgaaaacctaaggaaaagtgttttatccgactctataaaaattatatatgttttttaaattttgggggacaaaccatataagagcccccctcccctttacagtgcaccacaccaatcagaaattgcagcaatcggcaacctcagcggcggaaggtggtggcaaattttccgattttgaggatggaagtgacaatgaattgttcatttccaccaccaccatcaacaacaatgatggtgataatgataatgatgaggaggaagaggagggaaaggaagcgattccatggcacgggggcggcaaatatgccaaatgttttgagcaaattgtcagagatggcacattggtggccaaagtccggtgcctcatctgtgccaaagaattgagcaccaaaagccgaacaagcataagatattttaatgcaaaaaaaaaaactagggcctcaatttttccaactctaaaaaatttgggccgattttaatttttttttttttttttaaacgggatatcttaatgcaaaaaattaaaggcctcaatgtactcgctttttgttaattcaaaaaaaaaatggggggcgggagcgagcgatgggcagaggaagggggctttatttagggggggaggggggttgccgaggtaccttattgaatttttttttttcaaattttacagtctaaaaaagcgtccgggtgacgatttttggatacacggagtttttacatcccccgccaggatggtgtggaaaacttagttcgaaatggcatttttatacaaaaaataatggaaaattttttaaagagcacagcaaattgcaccagttggttgccgaatcaggcatttttgaccattcgcaagagggcatttttgacggaatgatgccggaggcggttggcactgcgttagtggaagaacggacgccaattgttatcccatttcgacgccgggttacgaccacggaaatgatgccatcaacatcagcacaacagaaaatggtcctatcgaaattttgaaggcataataattggaaaaaatgaaaaaaaaaccagcatggggagggtggaaaaatgtgtccgaaaaaaccaaaaaaaaaaattgagaaacttttgtttaattacccctctgatatttgaaacaaatttagaaaagacgtccttggatcataatagtagctcacaaatttgaatgaatcgcctagccaaataccagggatgatattccaaggccacaaaatactttgggaaatcgaaattcagaggcagaggcccaaaaatttttcggaagtcggaattccgaggcccagtagtatttccgattccgacaccaaaaatttcgaaattccgtgccatctttgccatacactgtctggcataaaagcaatttaaatgaatttttaaattttataatatttaaattgtccattttaaagcgtagtcaatcggtggaggacgacattttgaatgatgaagagctgcagcagcagcaaaacttggcacattttgattggaacaaacagaaaattgaactgcaaattttggaggccgaactcattcagaaacagttgtccaatttccagcggtgcactgagcttggcataccagctcgtgtaaatttaaaaaaaaattaaataacgacatgaaagcctaactctctcttggcacagccttcgtttattggaatttcctaaaaaaagatttaagaaaatgaggaatttttttgaaaatttattgtccctcgtcacctcaatattgaaatacccgaaaaaaattaagaaaatgggaacaaagtttagaaaatttaatatctctaatacgctaaaaattaaaggtggcaaattttaaaaatttaatgtccttcgtcacctcgttattgaaaggtcccttggtcaaaattttgcacaccttttttcacataaaaatgaaaaattttggaaatttgttgaaattttttttttttggaaattctcatttgcacaggtccattttcacttttaaaatgaaaattttgaanatgttgaatttttttggaaattctccaactccatttgcacaggtccatcnttccnnggttggcatntgtgccaagtgggctcacaatcagncgaccggatggaaccgccgctttgccaccttttcaaatgcgcacgcgcttcag

SEQ ID NO: 82632 - DNA, 408 bp, Heterodera glycines
  Genomic contig location: Contig_ID=SeqID_18049; Location=1092..1499; Strand=+
  SCN-specific regions: Sequence locations=1-299,328-378
atggttgggcatgagaatgacaataatcagcaaccaaatggtagtgatcaggcgctgaatcggccatcgccggctgatcgccgccacccaaccgcccaatcgtcccaaaaagatggcgcaaatgggggcggcggaaggcaatcgcgcgcagttggcgctaaagcagatggtgccggcagcagttcatcaacatcgtcctcaacttcggcagtcgttgagcggggttcgctttttgccgaaatggccaatttgtggattttgagggcaaagattgaaaaaatgcctgtggaaattaatgcttacctgggaatttttggaaattttgagtgaatttttttttaatgctaaattttctaaaactgccctttccaatacaattctaaatgtttccaacattttttgttaata

SEQ ID NO: 82633 - DNA, 114 bp, Heterodera glycines
  Genomic contig location: Contig_ID=SeqID_18049; Location=1562..1675; Strand=+
  SCN-specific regions: Sequence locations=1-114
aagacggccaaatttctcagcattttggagcagttcacactgtgcacaatgtcccgcatttttggccgttttgtcggcacttatcccatcgcatttctgatcttctcactgatc

SEQ ID NO: 82634 - DNA, 1034 bp, Heterodera glycines
  misc_feature (13)..(13): n is a, c, g, or t
  Genomic contig location: Contig_ID=SeqID_329; Location=54..1087; Strand=+
  SCN-specific regions: Sequence locations=1-44,231-238,260-366,389 -405,427-487,509-582,604-715,757-991,1013-1034
atggagaaacgtnggaagaggagaaaaaggatgaaaatagcattggggaaggaggagagacggaagagaaagagagaaaaaggaaaaattcgacggaagaaggagggggagaaagaggaggaaaaggatgaaaatagcattggggaaggaggagagacggaagagagagagtgaaaaaggaaaaattcgaagcaagaaggagggggagaaagaggaggaagagagaatgaagcagaaaagagggaggaacagcagcaaatcgacactttttgattttgccggtgctaattgctaatggatgtcgtaaatccccgtcaaaatcctgaaaactacacaattttcgaaagaaaaatgcattcattcgattacacataggcaaaaaatttatgttgtggcgtgggttttgcaggagcacagcttgttccccaaatcccattaacgatttaaaaaaatcattaaatttctcagggaatttccggcaaatttcaaacaatttattacaaatagagattcttagaccccctaagaatcggtcggggccgttttcgcgtgagtagctgttcaggactggaattggtcggatttgtgcaaaacatccatgtttcgaatccgaacccgcattcggacaaatttcttaactttttaatttttttatttcttgcggctaatatcttctacagtaatttgtcagtttggtcggatgtgcgtcaaacggaaaaaatatttaaaattttataaaaatataacaaaaaataacaaatttcagaacaaactaaggtcgcatttcatagtttcgggaaacaccagtgagaaaattgataatgttttcgggattcacattggcattggcataattgtgatcattttgggggaggtgaatgttattgatgtcgttatagaatgcgccgtttttgcaaattttttctcctccaccggcagaagaaacgggacaaagcatcacaaatgggccgtcttcttctgacaattagtgacggacaaaacaacaaaaacagtgatcagcagcagaagaagaa

SEQ ID NO: 82635 - DNA, 961 bp, Heterodera glycines
  Genomic contig location: Contig_ID=SeqID_330; Location=4483..5443; Strand=+
  SCN-specific regions: Sequence locations=1-210,239-239,278-288,337 -349,384-672,694-884,906-961
  Gene Ontology: Cellular component=cytoplasm; Biological process=rRNA processing
atggcgcagaaactttgcgcaacacaaccgccgtcagtggaggaagtggggacaagcgagagtgggagcgagtcggcctcggactccagctattcgttttcttccagtggtgagtttgagtgcggggcggggaagggcacaatttcaatttgtatccattaataaaactgaattttcagattcagatgagagcgaacaacccgccgggcatggaggaggacgttctcagacgccgcgcgagaagaaacaaccgctgaagaagaaggcgccgggcccgagcagtcgcaatcctggtcgacgcgtgaagaaaccgtcaacgaagaagtcgcctgctccccgccatgcaaacacctccaccaagaagcgcggacgtcctgccaagaaagcggaacaagccaaaccatcggacagcggaacagccgccgatagtggccgcgacgacagcggacgtgagttgaatgggggtggggaatggcacaatttcaattgtataatcctaatgaaattgaattttcagattccgaagagagtgcctcggggacgaagaagaaaccaactcgcaagagcgctgctgctggacatcccacgaaacagaaggcgtcgcgcggaggacgtgcgggcaacaagaaggcgcaggaagaacgctctgaatcgtcaactgaatcgggctctgatcgcgaggaggatgaagaatgaatgagccagccggagaagaatgctgcttcacgagaccaccgcgataataacactaaccccaatttaaaaaagagaaattgtatctctatgtatgaatatgtatatattgtatgtccatatccctgtggcattgtcttgctgaatgtaattctcccataaatgtttgttgttctatttaactatgccatatatatgtgtatttttaataattgtaatatgtttgccctgtttatgcatgtttatggtcatttattctcattgccga

SEQ ID NO: 82636 - DNA, 128 bp, Heterodera glycines
  Genomic contig location: Contig_ID=SeqID_330; Location=6196..6323; Strand=+
  SCN-specific regions: Sequence locations=1-128
cgtaatcacgcggtggcggcatccttttcatcgattacgacattcatttaccgtagcaatttatgccaatgaactcgctgaacatgggcaaagaagtggccaaacggtggatggccagcaacaacaga

SEQ ID NO: 82637 - DNA, 743 bp, Heterodera glycines
  Genomic contig location: Contig_ID=SeqID_330; Location=9418..10160; Strand=-
  SCN-specific regions: Sequence locations=1-113,136-166,188-248,271 -332,358-375,397-448,471-543,580-743
atgtccactttagtttgtggggtaccatcagtaaatgcattgggtgagcaacaacggatttgatgaaatttttcaagaaaaaatcatagaaaatttttttcttagaaaactcgaagaaaaacaaagttaaaaaaattcccagcgatttttttttgaaaaaactaatttattataaaactgaaaaaaatcgcttgaaacttttttgaattttttttttcatcaaattttcttagaaagaatttttataagattttttcttggccgagttttgtcctgctccgaaataattcatccaattcaaatttcactaaattttaggccattgtcgccaccagcggaagaaggaaaagaaaaagcggacgaatgaaagcaacgaaaattattaattatatttaagaaatggtcaacgatctcaaccaattggattcggatttgatgagaaatgctctctcactttcatttgttgattcctttatttgaattagtgttgttactcatttccgcccgaaattgacataaaaaatgtttttttctgcggcgtgctttttattaaaaaacttttaaatgaaaaaaaattaacaaaaacagaaaaatccaacacttcaccatacctacctaattttaaatcttggaagtttttgaagatggactctgaactgaagacttcaattttttgatttttgctcgggaatttggtacttttgttttgtgagttccccccccccccgagattttcaaataaa

SEQ ID NO: 82638 - DNA, 186 bp, Heterodera glycines
  Genomic contig location: Contig_ID=SeqID_331; Location=1022..1207; Strand=+
  SCN-specific regions: Sequence locations=1-186
agaatggcgcccttttccctttcgcccgtcgaccgaatgcgtcaaagtgtgttccgagttcgaagtcgtcttgtcgtcaatttgttgtccgaggggttggccacctttctgctgctgctggtcggcaatggcattggggcacaacacattttgggaggggggaagctggacaattacatgcaggtg

SEQ ID NO: 82639 - DNA, 1047 bp, Heterodera glycines
  Genomic contig location: Contig_ID=SeqID_2983; Location=199..1245; Strand=-
  SCN-specific regions: Sequence locations=1-278,301-515,537-692,715 -930,959-1047
atggaagagaatgacttgaccaatttaatgaacgcaaataatacggtaatttttttcggaattttaatttaaatttctacaaaaaattactacagttgtatttgttgtaccgtaatgtgtatccatgttggccactcataatcggggcaattgcaatcaatttggttgccatattcggaatggttgccaattttggggtcatttggacaacatttcgtacaaagtgagggacgagacgtctgctgctatatgagcttgcacaatttccaaaaaacttaaataaatgtctaaaaatctattccgataattaattataaaatttcaaacttggcggtactgaatcggttcgcgacgaactgaccccaccccggggccaaaaattttaatgcattttttcaagtaaattgaaattatttttttattgcacccccttaaaaatgtgttgttgcccatcatttttcaggtctctccatggcactgccaatgttctgctcgcactttgctccttttttgaactgctccaccagcatggccatttgctgttcctttacgtggcactttctggccacaatttcattcccctttcattggccatcaaaatttgctcgatttcactgtttgctgtcagcggaatttcgctaatcatggcattcactgggttggaccgactgttgtgcgtcctcatcctggcattgtaaatttttcaaaatttttgctgagaccggcaacaccctttttggcgtttatataaaattcgactaaaatgggcctaatttaccataattcggtcaatcgatttttaaaaatggaaatcaaaaaaaaaatgaaaaagtttctttggggttttcggataccgagacaaataattaacgaaaattttttagtccacgaacagtgaagaaaattccgtatcttggcacaatcatttttgtttgcgtgtgcatttcatcacacaatcttttacttgtctttgaatcaacatccaaaaagccacttttgatggtcaccggcacaattggcgatctgttaattgtatggccattttaa

SEQ ID NO: 82640 - DNA, 606 bp, Heterodera glycines
  Genomic contig location: Contig_ID=SeqID_2984; Location=125..730; Strand=-
  SCN-specific regions: Sequence locations=1-109,142-170,222-357,381 -404,426-477,551-552,575-606
atgcatttttatgatgagaaaaaacgtgaattcattgaacagtttgatgaatttaagtgcttatatggccaacgaaaacagaatgaatttgtgaagaaattgggcattaatacaacaacattaagaaaatggaaaaaagaattggtgcctcaatatgttaaaagtaacagattttttatatttttatttttataaattttcatttaagcaccatattccaacgaggacaaattaagaaaaataaaagaatatttcaaaattaaagaaagaaatgcgaagattagcgacgtaaaaattgcaaaaaaattgggaattggaattgcaacattaagaacatggagaaagaaatttgattcagtttcggagatgtgatttttgagttgccaattgtttagtaaattaacattttcctattttaattattttttggcatatgcttttcctgttattaaaaccaagatttccatttattcattgattttttgaaattaaaattatattaagttgaataatatcaaaaaaattttatctaatatttataaaaaatattccaatagaatttttgtgaagattgcttaagataatttgactaaatcagttaataaa

SEQ ID NO: 82641 - DNA, 1268 bp, Heterodera glycines
  Genomic contig location: Contig_ID=SeqID_2985; Location=1995..3262; Strand=+
  SCN-specific regions: Sequence locations=1-162,184-262,287-441,475 -744,766-791,845-849,871-1035,1057-1268
atgaatattccgttgactgatgcgtttttggggagagtaaaacggtgagtgatcactccaactgatcagcagcagagagttagtggtgttccgtggcccatttcgctcactgccattttctcaaagtgactcatcaattttcggcaccatcgattgattacattattctctacaactatttaagcaatcaggcgaatgattttgcaggaaattctactttttttttgcaagtacaacgcccaaaataggtccggtgatcagaacgaaacaccaaaaacccaaaaactcactcaaagcatttcagagctttttgagcagcacaaattattatttttttttgtcttcatggttatgaagaaatttgtgtctaatgaataaacggaatttttaatgaattcaatttaaacgttttattgatagtataaatgatggaacaaaaagtaataaaaataatttaaaatttaaacaataaatgcaagcttttgggtgaattaaattataaaaataagtaatgcttgggattgttaagagagtattaaatcaattcttattaatttccgcctaattacacgcattcttttgccaccttccgcacatttggaggcgaatatgaccaattgcagagagactgtgaaaaaagagaaaataaaaatataaaacaaattcattttaacaaaaattgcacctgaataaatgcagaaacgaaaatgatcaaattcaaaacggagacgcagaaaagtgaccacctgacaaatgagcaaagttacagaggcaatttgataatgagaatcattaggaaattaaattattttattagaaaaagtgaaaatgaaatttttaatttaccaaatgaggaagaaaatcttctcattgaaccaggtgatgcgcagatggcattggacgaacacgttcggagcaaggacagagtgacaaatgatcagacgggggaaaatgggcagatccttaaaagggcaaaagttcagtgattaagagagtatttttcggtgtcttcaacaaaaaacggatttaattaactttctaattaaaatttaaaccaaagtgccgaaagtgtccgaaacaaggcaaaaaattgcatatagagtaaaactactgaaaacttgacaaagtttcgcgctttatctttgaaatttataagaaattttgcttagataaaattatgcgctttgaaaatacataaatttgctgaaatatttgaaataattgctaaacaaaacgattatgtttttaaatcggatttgtccttaaaa

SEQ ID NO: 82642 - DNA, 764 bp, Heterodera glycines
  Genomic contig location: Contig_ID=SeqID_2985; Location=3283..4046; Strand=-
  SCN-specific regions: Sequence locations=1-68,98-143,166-281,318 -584,621-764
atgaaatgtttagtaagttaatctttttccaaaatgggatgtgagcttcgtttaccattcgtttccgcttttatttattattttttcttttttttttggcttttcccaccgcttcaaattttgcattttgggcattctcatcgctcttaatttattctaattttagcattcatcaaaaagcaaaaccgacgattttgggttcaatgtgtgcgaagtgctcaatgaggacggaacaacacaatcgaatcaccaaaacaattcagcaatttttttctacgaggtaaaaatgattaaaagaataaaataaataataatatgttttaccaattttgctttattagttttacctcaatttgttaatatgttcagtttttgccggtaatgcttcttatccaagcggcacttttctatctgccaaaatggacgcgggacaaattgcttcaaaactgtgagtaatttgttcagtttttgccggtaatgattcttatccaagcggcatttttctatatgccaaaatggacgcggcacaaattgcttcaaaacggtgagtgattttaagaaagtgcaaaaaaaataaatcttcgaatttaaaatatttaaatctaagtttataaaatttagcttgtttgttgacaaatgccgtggcacaatttgtcgtggttaacgcattgaccggccgagggcaccgctggtggggcattgaagtgggaaaagcattgctcaatggtgatgaaattaaggtggaaattgaagggaatgactaa

SEQ ID NO: 82643 - DNA, 1094 bp, Heterodera glycines
  Genomic contig location: Contig_ID=SeqID_2985; Location=4852..5945; Strand=-
  SCN-specific regions: Sequence locations=1-410,432-1072
atgaaacggagcaaccgcttacgcaagtgcaatcggaggcgcgccgagaatttcaaagcgtaagtaaagccgacgataaattcaaagtgtactttggcacactttgaaagggttgacaaaatacaatttataaagtctaaaaatttaagaaaataagttcgaaaaagtctcgacctcgatcaattgagttaagcaataacaaaaataaaactttagcttttatttttcaaataatttttcctttttttttggtttgatgaattttttccttttctatttttttaaaatttctcccagatgatttaaattttgaaaaatcatccgtcatcgaggtgggcactgctgatccgctgatcagtgaagccctttggcttggttaatcagtgatcattgctgggataatgcacttaaacatgctcatttgtcagtcgcttctaatgtggtgatcaattacgctttgatgtcaaaatcaatgactggggcagaagtggaaaattgtgccgaagtgttgtcatggtttaatgaggtccacgttgtgcggccgcttcaaagacagtgagcaaaagcacattgatggagagtttttgagggacaacaaaacatttgagcaaatcgaattggaaattttgaaaaaacaaaaaattctttttctgtctgagttttaattcagtaaagttcttccgtttgggaatcaaaagtttctggtccaaattcactacaaaatcatacggaatcatggccctaaactcggcgtgggtctgatcgcttatttatgcttatgcgttgaaattaaaattgcttcaaataacggccaattaagcatcaaagatcaaagatttcttcggcccaatccgacgtaaatgatgatgccattaaatgtaaattcactttaatctcctgcttttaattgatccgatgaatgaatgcctcacattttcattccccccccccccccccgtcggttttccgttttgtctttgtcccttccctttccatcgtttggtccgtcgaatcgcagcaaaatgcaaatgcttcgactgctgtaaattcaatgaatggcaggccacactgacagcaaaaaatgaatgaataaa

SEQ ID NO: 82644 - DNA, 722 bp, Heterodera glycines
  Genomic contig location: Contig_ID=SeqID_2985; Location=6859..7580; Strand=-
  SCN-specific regions: Sequence locations=1-20,62-405,477-576,598-722
atgttgaatactacaaaacaatcagaagcagataactggcagacagagggagaaggacagcagaacgactttttgttggcacaatcattggaaaattccataagcagcgaagaggagggactaccgtacagtcggagcaccatacaccggcggacgaattacggtagacggggaaagcgaatggacagaagaacgggtgaacgaaatccactttcactagaggtattgtgggatggaaattgggaggaaaaggaatttgattaaataaaaaaaaattaagggtaataaaataaaattggtggacgctgaaaatcggaaaaggcaaagggagaaacaattggaaaaggccaaaaaagaattggaaaatgtgaacaaaagctataaagaagcacagaaaaaagcgaaaaagtgaatttgaaatgaaaataaatgaaattaaatttaaaaatgtttaaaattaattaaatttaattgaaaaagtgtttatttgacagactgatcaaatacttggaaaaagaaggcgacggtgacaaaaaaaagaacactctgcgcaaagtgatcgaagaaattgagaaagaaaaatcatttgaaaatgaggaccaagcacaacgcttttacgtggccgcatttgacaattggaagcaggaaaccttgacaacgttggtggactaataattgatggatgaaaaataatgataataataatactaattagaaataaa

SEQ ID NO: 82645 - DNA, 858 bp, Heterodera glycines
  Genomic contig location: Contig_ID=SeqID_18051; Location=798..1655; Strand=-
  SCN-specific regions: Sequence locations=1-858
atgaaattgaccatcaaccagagactgggccaaggtcagcaagcgtacttgcaaatgtgccgccaaatcgggctcggagaaaccggagagcacttctggattcctccgccgttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatgcgtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaacagacggaaacaatgtccgtgttcatgctcccaaccgggaaattgatgcccaaggccgagccaaagtgctgaatattgtagctactaatatgctcaagttacaataa

SEQ ID NO: 82646 - DNA, 853 bp, Heterodera glycines
  misc_feature (738)..(738): n is a, c, g, or t
  misc_feature (754)..(754): n is a, c, g, or t
  misc_feature (787)..(787): n is a, c, g, or t
  misc_feature (794)..(794): n is a, c, g, or t
  misc_feature (803)..(803): n is a, c, g, or t
  Genomic contig location: Contig_ID=SeqID_18054; Location=312..1164; Strand=+
  SCN-specific regions: Sequence locations=1-27,50-853
atgccaacggagctaatcgaagagaaaagtcagctgaagcgaaaggatgtgccaaatccggaagatctctcatatcaaatcgacgcacgcgacgaggaattgtcaaaaagtttgccggcggcacaaacggacggcactttgacgtccaccgaatgcgatgccaacacctccatcacaactccgtccatttcggccgacctttgggcggccgcgcaacaacttagcacctcactgcataataacaataaaacctctgccgtcgcatatggaaaaacgtcaaatttggaagtgaatttgccggcacttcctccgattgtttgtggacaatttgtcatcgcactgcttgaactacccgaacgggtgtttcccatttatgtcgacgaacattccgtgccttggcattggttgcacgccgccaaaaacgaaaagcaggcgaccgatggccatgagaagcgattgatcggcaacgaatcggaggaagttcgtttgtttggcaaaatatcccatgttttacctttgctttctgaagagactgttcttcgactgtgccattgataagctctgtcccttccgtgccgtttgggtgcgcgagcgttcggccgtttatcaaagccaaggccacgcccactccccgctgttatctccccagggattgaccgttcaaaacgctccgatcactcccgaccgcgctcatctccttctaccgatcagtgaaaacgctccgatcactcccgaccnctctcatcctcttctntctcctcaacgatcaatcaacgtctcttctcanatcactnatcaatcgntgtgtttctccaataatatcatttttactccaatctctccccatttccaa

SEQ ID NO: 82647 - DNA, 883 bp, Heterodera glycines
  Genomic contig location: Contig_ID=SeqID_18055; Location=348..1230; Strand=-
  SCN-specific regions: Sequence locations=1-244,266-278,313-389,411 -771,794-883
atggcaggcgatgaagcgctgtcactgctgcggaggggcaattcgttttgggagaagggcaccgccggtcgggaaatggtcgacgcgagcacgacgatgtcggtgagcgctggaaggaaacaacagcagtcacaaaaccgttcagcgtcgctcctcctccgcctcggggtcgttttacttcaagaaaaaagtgccgagagcaacgagcacgacagatttggcacaaatggcaacaacgaacactcagaaaatggcaaagacattcaatcagcagaaggaggaaggacagaaaagagaagaggcacaggacagagccggaagagcagagatagaacaaacgatacaacgcatcgtcaaggaagaactgcggaaagtgagggaagttgggaaagagagacaaggggaaacttggagaggagggcagggacacgcagaaagtgcagggaatggagagagtgcgagagagaaagaggacgaagaagctgaggaagaggacagagaacaccagcagaacattatgcgaaaacagcacaatgtgacagccaagttccgtgccaaacactcggcgagggaaagaacggcacaaacggacggtcaaacgaacggagagaacggcaagaaaagtcagtgcccgtccaatcactcaactttttccattgagcagacagtgaaaaagagcttgtgaaaaaagtgcagcacaaaattgaggagggcggcacagaaggaaagcgaattcggagaagaatgacgccgagggggacagaaagagcggaagaaaggggagaagaagaagtgggagtgaccgaactgcacattctcgagcagggactgtacccaccgatgccgcataatcagcagcccatcggaaggatggccgaattcg

SEQ ID NO: 82648 - DNA, 1676 bp, Heterodera glycines
  Genomic contig location: Contig_ID=SeqID_18058; Location=286..1961; Strand=-
  SCN-specific regions: Sequence locations=1-211,241-488,510-846,869 -967,991-1676
atgcgcgtccatttcgtgccctattcgctgatgaaagtcaacccgaccgcgtggctttcccaagtcacccgccattcggcacaacattccgttgccaagtcccgtgacttgcactggtcgctgatggcgatcggcgaccactcgcaacaaattcaactaaaatcacttcgttgccttttggtagggaatggagaatcactaaaagttttgcaaaattctttttaaattttattttaagaactgttttccccggaagaatttaaaaaattattatcaaaaatcaaaagttagaaatttttcgaatttcaagaaaaatttttgaatatatttttagcgattttttaaaaaatttatgatgaattactaaaacttgcaattgaacatggttaaatatttgttaggaccaaaactttattacccttttttcattgtttttgattccaattatttcccccccccccatcggatttgttcaactttttttttctaacccccttcccaaaggtggcggatggtgctaacccttggtctctgtcctcgtgcgatcagttcatcgtcaccttcaaatcgcacggcatttggcccggtgcactttgtccatgcgccggctctgccgagactggcattgtggccatgcgtcggcccagccatcccgaacaggtcgcagttgcacgcaatggcggcggcacaacaacgacaaattgttccaccagcggtcgcggagtgctctcaatgttggccctaagccattgcgtggtccgtgtggaccaggagaactcactgacttcgctcacactccaagtcggtgtctgttgaattaaaaaaaacggattttttgcgcattttctttggaatttctggtttttcaagggtgagcaatgggaaggggtcatcaacaaatcttgtgggggataaatttgcttggaaggaatcacaaattcataataaatgcactaccattatctcatttgttctctcatcttcaggacactggccaagtaattcccggaggaatggccgttgtcgtcaaattgtgcggtgcgccgcggttgtgccgagcggacgaagtcggcgagatttgtctgcacgcaccgtccgccgccgtttgctaccacggcctcaaagggctctcccaaaacacatttgctgtgctgccgctcggctccgacgacaaacccattggtccgctggagtacgttcggtccggattggccggctttctcggccccgagggactcatcttcacggtcggctgcaaacagtcgcttctgcacgtgtccggacgtgtgcacagtgcggacgatgtaataataaattaacactcattatactattttaaatttaggattctttcgttttttaagatagccaaagaccgaatgattttttttatgccatgaaaatgttttcagttgattgccaccgtgctggctgttgagccgatgaagttcgtctaccggggccgcatcgccgtgttcagcgtcagcgttctgcgcgacgaacgcgtgtgcattgtgtgcgagcagcgtgcggagatcagcgaggaggaggcgttcaattggatggtgcgcgtgctgcaggcgtgcgaatccattcaccaattgggcatttattgtcttgctctcgtgccgcctaaccatttgccaaaggcaaaagcaactcgcccatttaaataa

SEQ ID NO: 82649 - DNA, 1944 bp, Heterodera glycines
  Genomic contig location: Contig_ID=SeqID_18059; Location=1101..3044; Strand=+
  SCN-specific regions: Sequence locations=1-570,593-1162,1198 -1507,1554-1560,1583-1944
atggataaaataaattggaaattacgagaaattgatcaacagaagagcaaggaaaagcaattgacagaatatttggaaagtggcgaatttaaatttgctttacaaatgagcgaaaaattcacaaaattattaccaatggtaaaacgatttaaggaaaaaacaatgaaagttgacgaatttatggaggaattggcaaatatccagcaaaatttagaagaagaattgcagagaaatgaacaaaatgaacatttgttcaatttaattacggtaattgcgcgaaattttggcggagttttcgttaaaattggcgatatacaccaaattgaaatttgttttgatggagcgcacaaaatgttgcaaaaactgtacgatttggccatagaacgattagtgaaggaaaaaaagggtgcaaatggcaatgacaaacaatttgaatgtcgtggcaatgacaggaacagttttaaagcggcaatcagagagctaacgggcggaaatacggcacagagtgccaaactattgcagtatatggacaaattcgtgccaaaaagggaagccccgtcgcatttgatcaattcattttttacgtttgcgacgcgacttgaagcatttttgtacgggaaaagcagcggcgatgccaatggagaaggagaagcggatcggcaagcagaggaggcaaaagcaacgaaaatggcacagccgaggcacagaattggcgcatttattgccgcgacgcaatgcctcggcatttcggcgacacaaatggaggagaggtaaagcaaaattggaagaaaaaactttattacacttggaaatcctgtaaagaaatgagcaagcttgaaaaaattagcctggataaagtagcaagcaaaggcttttgaaaaaggcttggacctgcataatttacctcattttcaccatttccacggaaattttgaaatcaatgctttaataaatttgttttagcatttttgactcaccaataaaagttgcaaaaatcaattcaatcgaggaaaagcgagcgccgctattcggaataataatagaaaagccgagagcagaaacggaaaagcaatggataaaagcggcgtgcaaaagtaaggcgacaagaaataaattttttttagtatttttacaaaaagatcaaattttatatttgctcgagaaaattttactaaaaataattttttcagaaaatttttcgatccttaggggtcaaaaagaccaatttaactgaaggagtgggggcccttctaatagaggctttttggaaaaatgccaaaaatggacaaatatagtaaatttggacatatcgcgaaataatatggaaaaatatagaaaaaatggatatagaaatccatccgaagcttcaaaccatgctaaaaatatgtttcaggcctcccatagaccaggaaaataaggatttccatataattgcaaccctaatgatcacgttaaaattaaaaaaaaacctgatgaatcaatgttcaaaaaaggttcaaaaatagacattaaaattttttatttaatttgaatttttaaaaataataattttagacaatttcaaaatgttgaagcaactggaagaacataaattttcgatttacgatgcaattaaattgatcagaaaaattgaccagcaaatcgaattccaccatataaagatagaaatcccagcagaagtcatcgcattggtagaacaattcggcagcgaacaaaaatatctgattggatggcacaattactctaaggatgtttacaaaaaaattcaaaaatgccaaaatgcgcggttgttgcaaaaaatcttggcacgatttattgaaaagttgcgcaaaattggcattgacccgaaagcgcagatggtctcgacggatttgagcatcggcgaaacgattcaacaaacaattaaattctattgcgaggcttagtaagaattcagacacatta

SEQ ID NO: 82650 - DNA, 775 bp, Heterodera glycines
  Genomic contig location: Contig_ID=SeqID_18060; Location=134..908; Strand=-
  SCN-specific regions: Sequence locations=1-177,200-525,554-568,608-775
atgcaggcacaatcaccagttgtaagaccgatgaatcttctgcctagaacgataatttgaattaccgtagccaaaatgtaccggaaacattttatccatttaccatcatggagtgtatttctaaaacaaaaaccactttgcatgagtgaatttgaattgttgttgataaaaatgcaaaaaatattggaagagatttattagttccaattttgctcattttctaaactgtgtatccgccccctgtcacctaagacccaatatgtatcatggattgattaaatcccgggataccatgagaccaaaagagagaagcgaaaaacgcgagaaattagcgagtcgagaatcgaagcttagaactcttaatgaaattaattaagacatatttttttaaatcaagaacacatatgaaaaaaggggtgggtaaacagaaaattaatctcgcgggatcccgtcccgcaaagaattttgagttccaatcccgcagcgggatcctcaaatttgattttttgtgcgggattatgcgggattttattgattttttttttaaatttttctaagacagaatgccaaatatttttaaataaattaaataataaatttaattaaagttaactcatttttcatcgcaaatttcattcaaaatttgtgaaattttcccggcggcgcctatcggcaccgccggataggcttttacttaataatcctgtagaaattgagtcaaaaactgcgtcatttggtcaattttagacaaaatctgttaacaaatcgcattaaa

SEQ ID NO: 82651 - DNA, 2184 bp, Heterodera glycines
  Genomic contig location: Contig_ID=SeqID_18061; Location=844..3027; Strand=+
  SCN-specific regions: Sequence locations=1-80,136-253,275-395,436 -605,629-676,723-966,990-1114,1136-1204,1253-1365,1391-1457,1546 -1751,1790-1954,1997-2184
atgtcccgttattttgctttgataattattcctttcctatttgatataattttagttgttaaaagcgatattcaagtttgttataaaacaaataattaacaaaaatgattaattaaattattatttacttttaatggtaattaataaagaaatgcgatttaaaatttttttttgatttaggcaattgttaattaaattttctatttatgaatttatgttttatgcgtatatttttgtaagaatttattaaaatgtcagaaaatcaaatgaattaaagttaggagtttaagaccaaaaaaataaataatcatttggaattaggcgtaaaaacaataataattctattaaaaatgttaatcttgttatgagaacgttttatgaatttaatttctctcttataaaaaaatattatataagaaaatttaaaaattttaaggaggcgtcatttttgcatttaaaattgtgctcaaacattgacaattcgtttaattattcaaaatcaaaagattggcaaaaattggaggaatatgtgccgaatttattgccatatgataagcaaaaagaattttcggaatgggaaatgtgttatgaaagcatccaaaaattcattatttattgcaattttcttcaaagcagcaaaaattattattataaccgaggtaggaagaaagaattgtattttaaaaagaacaaataacaattaaattaaaaaaataaaataagattctgttaattaattacggccccgttttggctccgggaaatgcgtcagtgaaaattttactgtcacaaaaacaacttccttgagttttcaaggctattgatcatgaatccggtatccatttcggtcaattccgagccccggacctgaattcgaacaaaaaatcgaaagtccaaattttcgaatttagcatttttggttcaaaaaaggcataattgacctccttttgaagaattggtggctttcagtttgtttccgtgtattaaaacttattttgaaccaaacacactaatttcgaaaatttggactgtcgaccttttgttcgaattcgggtccggggttcgaacgatgttcttaaagaatttaattttagattacaatacttaatgctacaaaattttatttaaaatatttgtatcactgacgcattttccggtcatgccccgttttcccattagtcacggtcctaaccaattaaatgccaaatttttaattaaaaaatatttaaaatgtaaattttaagatttttatgaatatgaatttgaattcattgctctcaaaccggaatttgcatattcaaatggggacacaatgccaatggatgatgcgatgcgccaaattgttgaggcatataaacaattgtttgaaaggaaaaagaagaatttcaaattgaatccgttttcaaagaaagcccctcctcaagtcaattttgtcaacaaagaaaattgtgcaaatgtaaaattatttaaaatttattaaataaaaaataagtttaaattttaataaattataaattggaaaaataataatgttttaaaataatacagaaactgattcatacttgtatattaattttttcatagttctaattttaattttctgtataaaatactggaagatacagctatagaaataatatcgggtggcaagaatctgatccaggcttgtagctgttttgtttttgtttttttgaaaaatattaaaaaatgattaagcttgtgaaaccaagagagagatcctttagaaacagataaaaaataaaaataattatataatttaatattatttgaaacagatattttttcagtgaattatttataattatgtgtaggaaatatctgttttcgtttacctgtatgctgtagagaaaaaagacctgtacctgtctgtgcctgtacaatgtggatccagaaaaatccattctgggtcaagttacggtacagatcgagtttgaatttttattttaaatttaaaaaaagatatttcatttttattcaaacgtttaatcaattttcgttaatttattcaaggtgattgcctggtccgctattcatgtaaaagcagtcggaaagaatcatttggccaaagaaaacttgcaaaaagtaaaaaatcatttgattgaaaatacgccgttggcattggattttcctcctccaattgttcaaggtatcaacaagtggtga

SEQ ID NO: 82652 - DNA, 229 bp, Heterodera glycines
  Genomic contig location: Contig_ID=SeqID_2987; Location=307..535; Strand=+
  SCN-specific regions: Sequence locations=1-229
atgcattttaaaagtaaatcacctaaactagacaagtaccgatcaatctgctaatgggtcgtacgaatcactttcaatgcttttttgatttccaccaaaatgaaaatgcatgaatcgcaattgcttgaattgaaaatttgcttgatatttcagtttcggaagatcatttaatacaaagttggagagaattagtgaagtggaggagcagctaaagacaatctaacgaaaa

SEQ ID NO: 82653 - DNA, 93 bp, Heterodera glycines
  Genomic contig location: Contig_ID=SeqID_2988; Location=1918..2010; Strand=+
  SCN-specific regions: Sequence locations=1-93
ggcacgtctgctgaacattgtgccgaccgtcgtgttgtgatgatcaaaatgaccagccaccgtatataatagataaataccgtattttccatc

SEQ ID NO: 82654 - DNA, 957 bp, Heterodera glycines
  Genomic contig location: Contig_ID=SeqID_2989; Location=179..1135; Strand=+
  SCN-specific regions: Sequence locations=1-238,260-371,394-395,417 -456,482-589,627-731,760-929
atgtcatcattaaccacttgttcatcaacagcagaggacgaattttcctctgatgtgtttggacaaggtggaaacggtaggcaaatatttaatttttgggctactgtatacatccaattaaatttaaacattcagcagaagtgaatgatggtgggaccaccagtgtttctgctgacgttaacagcagaaaaacagcaatcggtggtgagaaatttcttttttttgcgtaaattttgaattctgaagtacaattaaatgcactttgaggaagactaattaattgcttcataaatcatagctatttattgataaaaaaggggaaatttttgatttaaaaatttcgaattattttttaattttcagacggaggaatgaagagaaaaatgacggagttgttcattttgactgtagtgaacattacggtaacagtggcactgatcagtttcattgccccggttatataaattatttaattaaatttgcggttattttcaattttcagattgagaatgggcgggtaaatgctgagttggaaagtttgaagaaatttgttggaaaaatggaacagcaacatgggaataatggttggaattatattattaataatttttgtattcaatattattccccaacaaaatcttatggagagttaaattatttatgaaaaaaagtacagggcagatcagaaaattattaatgctaaactgagactctcggactataaatttgagaattaataaataataatataaattaattcattttcatttgaaaaaatgtttagatggtcaacagactgaattttgtgccaaaatggacaccgaaaaagacatggtcaaagccattgaaacaaaactcaacgaattggtggaacagcaaaagaaagaagcaatctttattggcgttttgaaagaccgatttggaaatggtaaaaatgaaaattaaaaataatattaa

SEQ ID NO: 82655 - DNA, 222 bp, Heterodera glycines
  Genomic contig location: Contig_ID=SeqID_2989; Location=2074..2295; Strand=+
  SCN-specific regions: Sequence locations=1-222
atggccgaggtttcagcaactgatcgacctggtcttctgcattctgttggctcttatcaaaccgatcttatgcgtttttctttatcctctactgctggccttcattctgcaatacgtcggcttagacaagttataaatttttatgtgtgacattttttatttttaactactcagcacggacgacggcgacgatgcgcattggatcctcaaccattatactga

SEQ ID NO: 82656 - DNA, 2698 bp, Heterodera glycines
  Genomic contig location: Contig_ID=SeqID_18062; Location=170..2867; Strand=-
  SCN-specific regions: Sequence locations=1-1010,1032-1415,1437 -1564,1586-2275,2297-2580,2602-2698
atggtcaaggcaagtgaactcacttatcgaattaatgaacagcacaaaaaagtaagagtcacagtttctgaccagtggcgagaattaacagacgaactcgagaaaaaagtagtcggagactacaaactgacatggctatgcgtcctatcatttgtaagtctagttctcttgattgattttctcttaaggtggcttccagtacttcttgaaacttacaccggtcctggatggctgggccgaataatttttggcgcaaagaagtcaagaggctcgcgcaacacgggaaacgtgacaattgatgaatttccaaataccagcgtaaccgttgaagatatccctttgcaaagcattccagggaacccaatgaattggccaccttcagtgtcaagttttcagaccatattttcatcttctgaccccacagcagcatcaacgacaaccaacgttgtaaacaaatcaccacgaaaaaggcttaggccctcttctgttttgcaaatcggaacgagcacaaccattttgattttgttgctgatgatcgcgttggtcgccatacctgtgaacgcagaacaagcatcggaatccgacttgaaagccggaacgggtatttttctcacactttcggatttgttggcactgcttggaatcgtggtctctcttggtgcaatggctggattcattgcattccatatgagtgtgctctcaaagagcaggagtttttgggctacggcctcatctaatcattccattatggaagaaattgttgctaatcatacaatgacgccacgcttaacagcgacagtccgttccctgattaacaacagaccagtaagctgtctggctgataccggagcaagtgtttctcttgcccggatgagtcttgccaatgaattgaaatgcaaaatttttccgacaaatcacaccgttagatcagcctccggacattggatcaacataacagcagcagccatggtacatatcgaaattgcaggtcagaaaatttttggcgaaataaaactcattcaggatgaagttatgagtgacagaagggattatcaagtcattcttggatgtgacttgatggcaaaacttccaccgattacttttgattttgttcaaggtctaatcagtatttcaggaaaatctgtaaccatgggagaaagaggtgacttgctttactccaatgtcaaagttgtggcacgtcatcatgttgacattcaaccaggatcctatagcatgctgaccggcaaacttgactcacaaattcaacttgatcaagttgtaacacattcactggatggacgactctccaaaatgcatgtcgggatgatctcaactgtcgcaaagcccgtggagggatgcatcaagatgatattgaccaacccaactgatgcaccaatcaacatttgtgccggaatgcacgtagcacttgccaatgaattgaaacaaagcgtggacggtccatggcttgaggaacaatcgcaagtaaaggaagccaatgtcaatccagaaattactacaaatgacccatcattcaaaatcaacttcgccaaatcctctgcaacgggtgaaaacctcaacaagctgaaaaaactctgcgttgagtttgctgatgtcttctcaaaatcccaatacgatttaggctcatgccttgtgggagaacatgacatcataacaaccacggaggatccgataactgccaagccgcgcaggacgccatttcgtttcagagaagaggtcagagatcatatgcagaaatggattaaagctggagtaatggtcaattctgacactccgtggatttcaaacattgttttggtacagaagaaggacggagggctgcggccatgcatagatttcagaaaactgaatgaaattacagtgcctgatcactttccactgccgagactagaagtcgttctcgagaaaattggcaattgccattggtacacctctttagacttgtcctccggataccttcagataagactgaccgaacgagccagcagaaaatgcggcatcattactgaagacgatgtctaccaaatgacgcacatgcctttcggacttcgcaacgccaccagtgccttcgccagagtcatggctcatgttctttcaggactggaagactctgttatagcctatgtcgacgatttcttgatttactccaaatcgcctgatttcgatttgcatttattggcactaaggaaagttttcactcggctacggcaattcaatttaaaggtaagtcccaaaaaatgtgtaatggcttcatcaaaaatggaatttttgggctttattatcaataaagacggatacacgcccagcttgggaaaagtggagatcatcaaagatattacagcgccgacttcgttgaaagaagtccgcagatttgttggaatggcgtcgtttttcaggaaacacataccaggattctcaacaattactgggccactcacaaagctgaccaagaaagacatgccattttcgtgggacgtcgaacaacatgaggcgttcaaccaaatcaagaagctcttgtctgaagatccgattctccgatttccggactattccaagccattccacatcttcacagatgcttcaacagttggacaaggcggagctctgatgcagaaagagcaggacaacagtgcatttcacgccgtggcctactgcagtcgcactttgtccgaagcagagc

SEQ ID NO: 82657 - DNA, 1111 bp, Heterodera glycines
  Genomic contig location: Contig_ID=SeqID_18063; Location=1478..2588; Strand=-
  SCN-specific regions: Sequence locations=1-195,224-1111
ggggggaaggaggaacagaggggggcggggaagggaagaaatttcggcagcgccaaaatgaccgaccctccccccctggttcggtggcaccaaaggtaaatgccatcaatggccaaccaaaaagggaaatgccaatgaccactccgcagtttcttcctaccacttccccacctctttcagcgtgtcttcggcagtcccttcccctccaatgcctcctggcagcactgtgccggctcttctcccgaattccgtggctatacctgcggcctttggaccattttccacaccattaccgttcacgcttatttggatgcagtaaagggtcattttggggacctgataccatttaaagcattagttttgctaattggtgtattaatcggctgttgccctgttcagatcggctttccttcaaccctttgcttccgttgcgtgccattcagggatgggtcagcactttcttcggatgtgaacactgcagaaaacacttcatgaaaatgaccaccgaactctttccgatgaacgagcagagagtgagtgagctgacttaggccaatcaaaggacaatcatttgacaaatgacaggtgaaccgtctccacgacatggtcatgtacctgtggagggctcacaacattgtcaacgcgcggctgcacggcgacatcacggaggtgcttttttggccgaatctcaggagcatatccgatgggggggggcagtcacagagtcgtacctctcccattcctcggcaatataatggcgtgggtggggggaaagtttgagagagacggcaatggcaagacagacagttagagactgacgagcccaactaatggacagtaccaaaaatatccataaaaaatagtttttttgtttcccatgccccaaaaaacgtccggtggccattttccccaattttctatggtatttctcccccccccccccccccttaaggaccctcaattcgtcaaataccaattcccgcctctgtttctctgctccacgtgccattcgggtggccatttcagtcggcgacaaacgcgcaatttccttctccgtttttacgggtccattcgcccttaccaccgaacgcattcaatggccgaaagtcgg

SEQ ID NO: 82658 - DNA, 405 bp, Heterodera glycines
  Genomic contig location: Contig_ID=SeqID_18067; Location=1271..1675; Strand=-
  SCN-specific regions: Sequence locations=1-144,166-405
atgggcgacatcactttggacattataagtatggcggatcaacaccgaagctgggaactgttcgccggtcaaatcattccgctgatcggcaccacaaatattaccaagctgcacattaacagttcgtaagtgtacaatgataatcaaataaataaacaatttttacagccattctagaaggtgctgagccgttataaaaaagacatcaaatgaaaattttaattgttaatatcattcgatagccttaacaattaattttctattagcctataaaatttcaaaaaaattcacaagctttcaaaaaagttatggccaaaatttttttgaaacttggttacttgtgtacttttgggaataactttgttcaaacttgacgaattttttgaaattttataggataataaa

SEQ ID NO: 82659 - DNA, 1131 bp, Heterodera glycines
  Genomic contig location: Contig_ID=SeqID_18068; Location=1363..2493; Strand=-
  SCN-specific regions: Sequence locations=1-83,105-730,752-953,975-1131
tccagtgacacatctctgaccagtctgaaggtggaatcgtttgtcttgccatacggcagcaaaatagctgcacacccaatgtatgccttaaggataacggccatcggaccacaagcagggctcggcttgtttccagcggaaacacttgaaaattggagcaagttattataacgcgacatgcgtcgcacaaactctttaccctgttttggttggttttcaccaacgataagctccataagctcttgagggtgtgggttcaattttggcaacacaacccttcctttttggcagcataggctgctgtcttcgtgtaggaagagaagagctccacaatgggggcatttgtggtcaccaagatttccggaatgagaatattccggaaaatgttttgctgcagcagcagcgcagtgccagccgttgtgcaccataaggcaacgttttgttaacgctgttgctggccccagcacattagttcgtggccgaactgttagtgcgggtgaaggcgaacggcttgatgatgccgaaagccttttttgaacacgcaaagaacgccctggtggcgttttcggcttgagaaatatctcatcgtcatgacaggagcccgccgctgggcatcttttaaccgcaactgttgaaaccgtataggaacggagccaattctccgtttttggcacacagaccattgttattgagctcaaacgtagccgaactgccctgaggagctcgtcctgggctgacctcatcagaaatgagttaaccggatcggatggcaacagagtcaggatcgtgcccgcggatcccgagcatttgagtcccgatggcgttcttgcgcagtcctccgagcgcagcatcaccgagatgggcctggatgaggacgaaatgccatgaagcaaagcagcggaagcaatgccattgcggcctcatgcatatgtgcccgtcctcgttcgggatttctccaggcccgggctgctgcgtgtgcccgtctcgccagctgtagtcgttcttggacctccctgatttcggcccggcatttctcgcgccctttttcactcggcttttcacctgatcagccgtcggctcgggaacatcccgccagtcaaacgattaaaaccctgaattggctaccgagtc

SEQ ID NO: 82660 - DNA, 415 bp, Heterodera glycines
  Genomic contig location: Contig_ID=SeqID_18070; Location=561..975; Strand=+
  SCN-specific regions: Sequence locations=1-100,144-268,360-415
aaactgattgaaattgaccgtttacctgaactgataaatttgcgtggacttcgaattcataactcggagagttcggcctctgaacgcctttcccacgtacaaaaaaatgaataaaataaacctattttaataattttatttttggacagattggcgacgaaattgtggaacaattggtggaatggaccaaattgttgcctttttattcggaattacctgttgaagttcatacttatttgctcacacatcgatgggccgaattggtgggaaatatttttattatttatttattttatttttaattattttttaaattatattaaaatgtaaaacaaattaaatttttctttttatttaaaggttttgttgtcaacctgcttctttgcccattgttcagctaataatgccagccaga

SEQ ID NO: 82661 - DNA, 1021 bp, Heterodera glycines
  Genomic contig location: Contig_ID=SeqID_18071; Location=26..1046; Strand=-
  SCN-specific regions: Sequence locations=1-44,69-102,124-298,325-1021
atgcccaaaaagtacaaaaaagcgaataaggacaaagttggtcttgctcttcctcctgttcctccaccgtctgttgaaccaccggccgcggcaattcagtacgaggatttgacctctgatgaggaattggactcaaaagccgctggaggcactgctactgctcatcctgttgatcagcagatggagtcgcttttggcactttcacccgaaaacaacggcgcgatgttggcactatctcctgactcggttgatcgtcttcttgaagaccaaaatgccggagaggtgaaacaaaatccagaaaataataataaaaataatttttaagtctgtgccaataacagcggagtccaatgaaaaggccctcgggtcgacagttttgaatgaggaagacgaatttttccaagcaaattcgggcgaaaatgaccaaatgaatgtagaaattgccaaaattgtgagtccgcttgaaaccatgggggcgctaattggggtcatttcccaaaaggatgatgaattggtcgagaaagggcctcgagattcttctgaaaaggcgaatgccggagagatggaagtggaaggaaatgaaaaggccctcgggtcatcagttctgagtgtggaccaagccgagaatgaaaatgagaaagcggataaaagcgagaatgagcaattttcaaaggaaaattctcgcgcatcagatgaagaggaaaatttcggtggtggtaagaaaatggtagtttgccaaattcgggaggacggagtcattgtgattgcttttggtcaagacgaaagagcgggattcgtctttgtggctaatgatttattaagtgaaatttgggaaacgttggccaggtcttcggacaccgcattgaaacttggggacataatttgggtcactaattggagagtgttgcagttaaacgaatcatgggattggatctccaactcaaaaaggattaacgccgaagccgaagcgacttcaattgcccaagtgacaatgtcactacggataaggacatcggcataa

SEQ ID NO: 82662 - DNA, 952 bp, Heterodera glycines
  Genomic contig location: Contig_ID=SeqID_18073; Location=551..1502; Strand=-
  SCN-specific regions: Sequence locations=1-80,102-200,222-248,286 -726,749-788,821-839,861-952
atgaggaatttttatccgcaccgcgcattgatattatcacattcaggtaaaaaacgaatacaattaaaataagagaataataaaattagtttcattttattataactaattaaagttgtgattaaatacgggtgccaatttgctgttttataataattagtgtcttatttgagaatataacctacgaaaacactctctcgcttatgcagtttttgggggttaaaggaggcggggcctatctttggtacaaaattaattcaaaattattaaataaaatatttttttgcgaaagaaaataaattttccagcaatttccggcctgtccggtgatggtcgtcgcaccttgcagcattggtccgatcactatgccgacctgttaatgtgccatttgcgcattaaccacggcaatatgggggcggcgcaacgttttgccgaaatggtccatctgattgaagcgctgatcttcagcgcaaaaagggaacaagattttttaacctatttggccatggtcactgaacagggccctttcaatgtcacgttgccggcaattttcacgccaatgcttttgtatgggaggccgaaatgaaaagtcgaacagaacaagaaaaaatgacatggaaaaacaaaattcaactcttataccttatcattatcacggtgactgatcacaattgttcgataaaatgctctttcatttttgaccccacactttgtggatcccccgacttttcagattttttgaaattttgcgggaaaatacataaagtttagagccattgaatgataccaatttaaattatttaaatcttaaattaaaaaagcccacatggcaaattgacttttttatttatataaaaatgggctttatttcaggtggagtgctctagttcagggggttataattcaatggtaactctggttaaatcagacaaaaaaatttggagtaaataaa

SEQ ID NO: 82663 - DNA, 786 bp, Heterodera glycines
  Genomic contig location: Contig_ID=SeqID_18077; Location=470..1255; Strand=-
  SCN-specific regions: Sequence locations=1-78,100-116,274-318,344 -462,484-765
atgaaattttgcctattattctctttaagtgtttttttgatcgtcctaattaatattaattatgttgggtcagtggataaaaaattggaacaaaaaacatttgatgaaatatttggagaaaaatgggaagaaaaagaagaagaaaaacgaaatgaactcaaaaaaagagaaataattggaaaattttataaaataaaagaaaaaattaagcaaaaaggaagaaaattctcaaaaaaagaatggaataaaattgaaaataaaataacgaaaaaattgctgacaaatcgaaacaaaatttatgaatggattaaagaatttggtcttcaaaaacaaataaagaaaagctacaaatcaaaaactgatgaagaaaaatttgaaattgtgcaaaaattcattgtaatgaaaaatgaatttaaacaaaaaagaaaatattcaacaaaagaatgggagaaaaattatgccgaaatttataagaaaattggagttagcatttcagtaattaagaaatggaagaaacaatttggcataagcaagaaaataataacgaaggaagaaaaaatgaaaatttattgcgaaattaaaaaagaaaatccgaaaatgagtgacacggaaattgcaaaaatgatgaaaattgatagaacgaacatttcaaaatggaaaaaacaatttggagaagaaataaatgagcaatgaaaacgtttaatccaagagggaaatcgaagagagcagagaaatgagacatcggattctgatttttgaatttctcttttttaaactaaaaataaa

SEQ ID NO: 82664 - DNA, 471 bp, Heterodera glycines
  Genomic contig location: Contig_ID=SeqID_18078; Location=74..544; Strand=-
  SCN-specific regions: Sequence locations=1-13,35-237,263-471
atgcccatcatcatttatttttcattaaattttcaacttgcgtttctgcttttcaatattgatatacaaggatgggattggcttctgtattacaacaaactctcaccttttccaattattttaccgtccgctttaaatccaatcgtatcattttgcaccatcaatgcttaccgtatcaaatttgtttcgaatataaaatgtttcggtatgtgataattagttgactgtttgattttcatttatttaattttttttaatttatgttgattatttaggaaaaagcatcaagcgattgtttcgcatgaaaattggtgatcaaaatgcggtttcaaatattcagatgcagcaacattagtagcaacaaaatcattgttttcacaaaatgcaattttaatttcgtatttatcctggcattgattttcaagaattgcttttcattaatgaaattattagatttaacaaaaaattaaa

SEQ ID NO: 82665 - DNA, 375 bp, Heterodera glycines
  Genomic contig location: Contig_ID=SeqID_18078; Location=656..1030; Strand=-
  SCN-specific regions: Sequence locations=1-124,148-280,317-375
atgttcatttgcttttttccaccggctgatcacgcaatattggacgacaaatctgtcgcggaaattttgggcataaatctcgacgaccaaattattttggctgcatatgcaattaatgtaacggtaaatcaataaaatttaaaaattcgtttttttaatttaggatatccatttggctttaagtttatattaccttgtcattataagcacttttgcttatatcataatatttggactagcatattgtatcaaaaaattcttggacatgaaaaccaaatggtaaattaatttaaaattattttttattttaatttttgtgtttgaagcgtttcatcttcttctgaaatagccaaaaagatgattgaagtgaataaa

SEQ ID NO: 82666 - DNA, 1087 bp, Heterodera glycines
  Genomic contig location: Contig_ID=SeqID_2991; Location=51..1137; Strand=-
  SCN-specific regions: Sequence locations=1-205,227-267,289-1087
atgtctgatcagtctgtccaaaatcgtagcaccgatcaatcgccgcaacaagaagaagccgtctcccgaccgccggaatttacgccgtccgatcacactgaacccacacgaacggaacggatgaatggtacaaaacatcaacattgcattgatcaacaacgactgatcagcaacgtgccatgtctgatcagcacaaccgatactgatcaaaagggtgctgatcaacagtactattaccaccgaaacaacaatcctgatgttgttatccaacaacaacagcatgatgatcagcttggaaatcttgacggcattttgatgaaggacgatgacagcgttgagtgccatgccaaactgtccaccgcttcatccgccattgtgtttatgccgtcgacgccaagcgtgattgccgcttcgtcgttggaaagctgcagcggaagtggttcaccggtacgcggcggtggatgccgctcatcaccgcccagtccgtcgtcgccgtgcagttcaaccgcaacaattggtccacgctttgtgcgcacaccaactacaatgtcttgcggtaccggtcgcatgcatctactaccgcatcaaggctcttcccaagcgttactatacgtgccggaacagcgacgcgtctcaaccatttccggccattcggtgcgctcgtgtcccaacgacatatgccacaccgggttaaaggaggaagagcacgcagacagtggcggacaatcgtcggcggcgcttttggctcgagcggacgaccaccaacacgcggaagaggaggaagcggacgagttccaatcgctgatccggcaccaccaccatcaccgcccccgccatcacagtccatccagctcagtgccggaatgtagcagtggccgcgtggcggcggctgcgtcagcatcagccgctgctctgtgctcattttcacgcgcgcaagctgcctcggacgcgtactgtcgcgtgtacggtggcggaagcagcggcgtccgcggcacagatggtacagcaaccgctggtgatcaaatgcaacagcctaatcggttgctggcggttatccaggaccggaaccgcaaagcgagtcccgcag

SEQ ID NO: 82667 - DNA, 106 bp, Heterodera glycines
  Genomic contig location: Contig_ID=SeqID_2991; Location=2142..2247; Strand=-
  SCN-specific regions: Sequence locations=1-73,96-106
cccgaagatgtgagcaaagtccaaatttttgtgactgcgccaattgttcggtccgagggtttaaggaagacaatcaataaataaatgtttattgacgaacaataaa

SEQ ID NO: 82668 - DNA, 2853 bp, Heterodera glycines
  Genomic contig location: Contig_ID=SeqID_2991; Location=2576..5428; Strand=+
  SCN-specific regions: Sequence locations=1-81,119-1617,1639-2010,2032- 2853
atgacgcaacccgccgcggttcagccaaatctgcagcaattaatcgacgtaattgctcagcaacagacgcaaatcaaccagctgataaatgttcaaagaaacaatcagccaaatccagcaatcatccaaacaataccgtcaatgccggacgtcgcaattttcgaacaatgcgacgaaaagcatcgcatcaccgaatggctggagcgtttcacttttgccattgactcgtgcgcaccgaacgcggccgatgacataaaagtcaaggcactgatgaacaaactgtcggaaactgcgttcagcgagtacagcaaatttgttctcccggccaaggtgacggatttcgactttgatgaaacaatttcgaaattggagaagctgtttgccaaaccacaatcaatatttgtggaccgatttgcatgtctgatggccaccaaagacgatggcgaagaatttcaacaatttgttaacaggcacaaacgacttttgaaagattttcagtttgacaaattgaatgaggaacaattcaaagggctaatgctcctaactgcgctgaagtcttcaaaggacgcagttcttcggcaacgtattctcgccaaacttacaaaggatggcgacgccgtcaaatatgatgaactgattgaggattgcatcaattttttgtctacaatccatgaggcaaaattgatcgaagcaacttccgtgtcatcaaggacagtgaatgcagtgaagccaaaccaaagaagggagagaccaaagccacaatccaagcaaggccaaccaaacgcaactccaactcagcttcaatgttggagatgtgggaaaacgaaccacacccacagagaatgctcgcacaaatcggctaagtgtcccaaatgtcactacaccggccatttggagaaccaatgcgaaaaagtgcaagagtggcgccgcaaaaacttcaaagtgaagaaagttggaacgcttagcattggaatggcactcaaatcaatcaacagtgcttctcttataaagataaaagtcctgctgaacggaaggatcgtgaagtttattctcgactccggggcagagatcaatgtcatcgatgaggaaacttatcgactgatcggacagccaaaaatttgggaatgtgccgaaagaggcagaatgttcgatgggacagaaaaatcttttatcggaaagggagaaggacatttcgaattccaaggcgtaaaagttaaagaaaatttttatgttgccgaaaaaggatcgatgaatctgttgagcatccaaacaatggatgcatttggattgttggatggcatcaaagccaaaatcaactctccgataaatctttgcagcgcaggggaagaattgagaggcaaaacacatgccccaatcaaatccaacaaagttgccggcacaccaaataaggacgccgagaaagaaatcagtcagctaaagcaggagtacaccaatgtttttaaaactgaattgggactctgcacaaaggtcaaagcgcacttagaattgaacgccaacgcacggccaatatacagaaaggcccgtccggtcccgtacaacgccaaagaagcagttgacggagaattggatcgttgggagaaaatgggagtcatcggcaaagttgagcacacagaatgggcagcaccgattttggtcgtcaaaaaggccgatggtagcgctcgactgtgcatcgactattcaaccggactcaacaatgcgctaaaagaccaccagcacccgttaccattaccggaagacatttttgccaccttaaatggaggccagtacttttcgcaaattgatctccgggatgcgtatcttcaagtggagctggacgaagcatcgaaaaagctgtgtgccattgccacccatagaggaaattatgaagtcaaaagacttccctttggcatcaaaacagctcctggcattttccagtcgataatggaccaaatgttggcagattttgacttcgcgacagcctacctagacgacatcatcatcgtcagcaagggccaaaaagaacattctgaacatttgaaaaagatgttctcgcgatttcaagaatggggatttcgcgtcaaacgtgaaaaatgttcgattttccaagatgaaattaaatatctcggacaaataatcgacaaaaacggacgcagacctgaccccagcaaaatcaccgcgatcaatgagatgccagaaccgatggatgtctcttcacttcggtcatatttgggaatggtaaaccattaccaacaattcatcaaaaacatgcgcttcgtcagaaagccgcttgatgatttgctgaaaaaggacgccgaatggaattggagcgataaatgcaaaaatgcatttgacaaaatcaaaaaaattttgtcatcaaaattactgctcacgcactatgaccctcaaaaagagatcgtagtagcagcagacgcatctgatcagggaattggagcagtgatctcgcacaaattcccggacggaacgatgaaagccattgcgcatgcatcatccgccttaactcctgccgagaagaactactcgcaaattgaaaaggaagcactagcaataatttttgcagtgcagaaatttcacaaaatgatctatggacgtaaatttacgctcctaactgatcataagcctcttctcgccatcttcggcaacaaaaaaggagtgcggcaatgcagtgccaatcggctgctccgatggtcactcattctcttggcatacgactttaacattgagtatgtcaataccaacgacttcggccaagctgatgcactttcacggctaattgccaaaggaaaagatgcggaagaccgcgtcatcaaaatacttcggtcgattcggaggtag

SEQ ID NO: 82669 - DNA, 944 bp, Heterodera glycines
  Genomic contig location: Contig_ID=SeqID_18083; Location=17..960; Strand=+
  SCN-specific regions: Sequence locations=1-210,233-416,441-944
gcaacagctgaccagcgaaaatcaaatggaaagcgaagaggctggtgaaattgtggccggaccaggtaattaggatagcgtatctcaccaattacattaaccagcgatcaacatgatgatgatcgcactgccaagtctgaaccggaaaatgtgccgctacgaaaggcaccggcgcgcgttggaggaagcgggtgggacaaatgggggaaataggggaaaatgggggacaaatagagagaaaaaaatggatacaaatgggaaattaaaggaaaaagtgcattttcagcactcgcagaggacgacggaatgtcttcgagcgaatcgctgtcggaagacattcgaattttgaccaacgactttttctccgaagcgcccacttccaactcaaagtgcttaccccttcttccgttttctcattttccttataattcccccattttccctcttagagggtccgcttctttgggtccctccggcggttgtcccagtgccacactgttcaacggttttcgtgcctcattttcgggcgtaattgacatgcgcaaaaagtcaatggcggatgaaattgtgccctcaatttttgtgccgcgcaaacggtcggcctgcgactttggcacgttcagcgcattacgagaaatgtcgcgccaaaacaccgctccaattaaaatacgcgtgaccaccgtccgtggtactgtactttacagtcattttggaatacttttgtggagattttttttgtttcgggcatttgattgtaaaacaagtcattttgatgttttaattccgacagatgacagcagtaaacggccagagactgaaattgtccatcgttcgcagcttttggcgcccgaaagtgtcgcgtgggcggtgccgacgacgcgccaaaattcagcggaagtgccaaaagagaaaagcaatgcgcaaccgctaaaacatcaacgtaa

SEQ ID NO: 82670 - DNA, 272 bp, Heterodera glycines
  Genomic contig location: Contig_ID=SeqID_18084; Location=796..1067; Strand=-
  SCN-specific regions: Sequence locations=1-29,61-67,90-215,237-272
tcctccttgctattcgtgttgtccctcgtgcggcggcggcggcggcggtttcggcagcggtacgttgaataaaatggcacattttaaatgattaatgaattttcaacggaaaggtgggggactcggaggactcagcagcctttttggaggtcttggaaagaaaaagtgaaggacgagggaaaaacagagaaagtgcaaagaaacaaacatttaattaattgttctaattattatatttattccattttatgcattcttaataaatttttatt

SEQ ID NO: 82671 - DNA, 357 bp, Heterodera glycines
  Genomic contig location: Contig_ID=SeqID_18084; Location=1..357; Strand=+
  SCN-specific regions: Sequence locations=1-215,237-260,282-357
  Gene Ontology: Mol. function=serotonin receptor activity; Cellular component=integral to plasma membrane; Biological process=synaptic transmission
ccccccccaaatccgttgattcaccatttcttttgccattgctttccgtttctccgtttaaggcacttttctgtgctgttgggtgccattcttctcgctgaacattgccaatgctttgtgcattgaaatgggtgccgattggtgccaaattggcttcggcccctttttctactccacttggctcggctacatgaattccttcatgaacccactaatttacacaatgtcagtccccgaatattctttaattgattaattagtgcttcttttcagttttaatgccgaatttcgtcgcgcatttaaaagtttgctgttgggtcggcgcggaaatgtttttgccagacgaatttaaaagtg

SEQ ID NO: 82672 - DNA, 1342 bp, Heterodera glycines
  Genomic contig location: Contig_ID=SeqID_18086; Location=339..1680; Strand=-
  SCN-specific regions: Sequence locations=1-38,60-356,378-626,653 -758,782-792,814-978,1001-1029,1054-1122,1145-1342
atgcgttttattattctgaatgttcccaattttgaaaatgaaatagtgcacaaaaagggagggatggttagacgaaaagagaaatttttaggaagggacgcaccccatctgatattcacccttttctgttccataagaggccagaggcgactgtgttcgtcgacaagtaattgtccaattaaggtacttggactttccacagtgaaatgtggtacaaattttggaactgtcccgcctcacggtgggacttaaaaacatggttaatccaagttcaaaacttcagaggagaattttaagttttgaatttttacaatttaatttcttagagtcaaaaaatttcggaaccaatttttaaaacgaaacagtgcacaaaaagagagggagggtagaagacgagagtaattttttgaaaggatcgcaccccattgaatatttccttatttctttttcataactgtccaaaggtgactgctgtcattggctcttctgtagtccttaaggtttgtgccgtgccatttaaggcgatgttacgctttatttacaccaacaaattgagtgttttggacggacaaaatgcaatggctgtgttttatgcgggtcaaaaattaaattgatttcattgatggattaattattatttatttattatttagccaaaaaatatgccatcatcggtctgatcgaaggattcgctgactttcccattgcaaaattgccaaatgttttccttgcctttgcccaagctcgtctcctgcaagaaaatgtacaaaaattaattttcgatttattaaataataatttcacttttattttgggaatttgctgatcgatgcttggcttacattgaccaaaaagcacaaatactgatcagatcggatgattttttaccaatttatcaacaatatttctgtgagattctgagccgtgatcagctcaaagttggagaagaaagtttcatttggcaagccgtaagaaattgataatgttaaaacaatataatggaattaactcacttaaatttgattttggaattttattaaattaattaattttcaaatctcattaaagtctgacaattacgaaaaagtttcgggcactttttaatttcgtaattttattttgacataattaagaattttgttgtatatcgtaacaaatataggaattcaatgtttttgctaatttgagaaatttaaattgtaggcactgcgttgggctgacgaacggtgccgtcaaaatggcatcgaatgttcgggggaaaatcgtcggcaaatgcttggcccaattttgatggctattcgattcccactaatggcacaggatgaatttctgaaaatcattg

SEQ ID NO: 82673 - DNA, 2028 bp, Heterodera glycines
  misc_feature (1974)..(1974): n is a, c, g, or t
  misc_feature (2016)..(2016): n is a, c, g, or t
  Genomic contig location: Contig_ID=SeqID_18087; Location=17..2044; Strand=-
  SCN-specific regions: Sequence locations=1-1176,1198-2028
atggcagcaaatccaacaattgatgaattgacgaaattgctggccaagcagcagaaactagtggaacaattgctgattgctcaacagacgaatgccgcgccagctcaatcaactcaactcccagctctttcaaacgtcgaatgttttgatcttgatgatcaatctgggaagaacatcgaaagctggatcgaccgttttgtgttggccctcgactgctcttcatcaaacatccaggaccaactgaaagtgaagctggtgctgacgaaattgagcgagggagcatacaacgaatacagcaaattttgtctgccgaagaagccgaccgagttcgacttttcggagacatcggcacaactgaaaagtttgtttgccaagccccaatcggtttggattgaccgatacgaatgtttgcgggcagtgaagcaggacgacgaagacttccgtgctttcgtcaaccgccacaagcggctgcttcgcgattttgattttaagaagctgaacgaagagcagttcaattgcctcatgcttctgatcgctctgaaatcgccgaaagacgccgaactgaggaagcgaattttgggaaagctgacagcagacggcgacaaagcaaagtacgacaatgtcgtcagtgacttgcagatgttcctgtcaacaattgctgaagctaaggccattgagcgcccatcccattcgaatgttttggcgatcaatcggagaccatttcagaagagggaaccaaacaaaagcccaactcagcctacttgttggcgttgtggcggtggacatgaaccaagatgttgtcctcatgcgaaagcaacatgccgaaaatgttcaaaagttggacatttgcaaaatatgtgtgcgcgtcatcgagaatggctttcgaagcattcgagaaagccgacgcaaggaaagcagatgaatgctttacaactgggaggtatttcagtgaacgcactgaaccaaccgagccgtcttgtggaggcaccagttgatgtgaatggcaaacccattgattttgtgttcgatccgggagctgagataaccgtgatcgacgaagaagcacatcttcaaattggacgtccccgactaattcaatgcagcgaaagtgccaagtaccacgatggaactgaatgcaccctgctggggaagggttttgcgacttttacgttcggaggacacacacacaaaggacaattttatgtgaccaaaaagggttcactaaatttattgggaatcgacattttggacgcttttggcttattggacacattcagagccaaagttaaaatggcaatgaaagtgaatgtcgttcaagcggaagggaaggaccgaatgaagagtcaaatcctgacgaagaaggacacgactttgctcgaccttcagtcaaattttccgcatgtttttgcagaaggcctgggccactgcaccaaagccaaagcccatctcgaattgaaagcggatgctgttcccgtgtactgcaggccacgtccagtgccattcaacacacgtttgattgttgaggccgaattggaccgattgttggcgcagaaagtgatcagaccgatcgatcacacccgttgggccgcacctattgtggttgttaagaaggccaacggagcagcacgcgtttgtgcagatttttcaacgggcttaaacaacgagttgcttttgaatcagcatccattgccgttgcccgaagacattttctccaaattgaatggaggacgaattttttctcagatcgaccttaaggatgcgtatctccaggttgaattggatgagaaatcgaaagaactgtgcacaatcgccacgcacaaaggaaatttccaatatttgcgcttaccatttggggtgaaatcagcgccagggattttccaatcgatcatggattcgattttggccgattgtcagttcgcttttgcttaccttgacgacatgatcgtggtcagtcgttcacatgaggagcatcgnaaacatttgaatgaagttttcaaacgaatcggaaattttggnattccggattaa

SEQ ID NO: 82674 - DNA, 1731 bp, Heterodera glycines
  Genomic contig location: Contig_ID=SeqID_18088; Location=498..2228; Strand=+
  SCN-specific regions: Sequence locations=1-365,416-850,872-1201,1230 -1504,1527-1731
atggctgaaaatcttcaacaaaaaatcaaagacaagattgggactggttattacagcatcacaagcgatggttggcaacaacctacaaaatcaccctcattgcagaggttattactaattaaaaactataaaaacctaatcaatgtgatattatcattttttagtgtgacaattcattcagtcgatgaaaattttgtgcgaagcgattttgttctcaatgttgcgccaatatatgatgctcacaccggcgaaaatctcgcagaacacatcgaaaagtgtttgattaataatgggttttcaatggaaaaattggttatgatggtcagagatgacgcaaaaaacatgatcaaaacatgccgaatattagaaattgaaaggtaaaatataattggtaaaatatttaaaaatattgtttagctttcaatgtgttaaccattttttgcatcttacaatatgtgatgttttgaaagaaccgaaattatctgatctgatcgaaaaagtgagagaatgggtgaaagagtgccgtactacaaaaggagctgcattatttcggaaaaagcaaaatgaacagggtcaaaaaacaacaaaactgatcatggtaaaaacagtaaaatgaacatggcgtgattttttaaattttagtcagttcccaccaggtggaattctacctatgcaatgctttctcaatttcgccagcaaaaaaaagcaatccttgcgcttgagtttgatagaatgcattcagaaattcgaacggttaagcgggcaaaagtcgaaaaaatttctaatgatttaccgagaattgatgcagtcgattttgatttattgcgtcatgtctgttcgattttggacatttttgatgcggagactcgaaaagttagaagattttcatctcaaacttagttacaatgttttatcaattttagttttctactgaaacatccatcgcttcatctgttatcccaactctaaaaaaaatccgtgactttctcgcttttactccattccacccatctgttcaatttcttgccacttcattggcaaatgcaatcgatcgccgtgtttctaatctggcacataatacagcgctccaaattgcaactattcttgacccacgatttgcgtatgatgaaaacatttggcgtaaaagcttatgggcagatattgaggaagaattgaaaaattttgccaaatcaagtccatgaatatttatttttaattttcaattttttgaattcagttgagggccaaaaaaatgtgtcggtcgatgatgagcatttggatgatcaaaatgccgccttttctggcttagttcaccatgataacgtcgatttgagtgctttggacgaaggtggaagcagcgatgagagtgttcgatgttcgaaatattagcaattttttttattttattgcatttaagatgacatttgggttactcctaaatcgccaggtgccgggtcaattccatcaacactttcgggagaaattaatgctgatctcaattccaaaattgaatcacaattggctcattacaaggccattgttcgtcctgcaattgactctgatgttttttgttggtggcgcgaaaacgctccaaaatttccagaattggcaaggctggcacggattttcctaacagcaccggctacttctgtttgtagtgaacgtgtcttctcgaaagctgggctcctttacgcaaattcgcttagaaatcggttcaaacattttgtctta

SEQ ID NO: 82675 - DNA, 2173 bp, Heterodera glycines
  Genomic contig location: Contig_ID=SeqID_18089; Location=25..2197; Strand=-
  SCN-specific regions: Sequence locations=1-57,80-184,206-430,454 -1254,1276-1764,1786-1955,1978-2173
atgccttcatccaactcattctatgtgatcgttccttccaacacaaatgttgaaggaaatcgcacaaactcttttcgagttcgactaccaagaaaacttcaatttaattcggaatgggatgtgggcttaggtgtgatcatatacccccattcgtggccctcactcggcacatcagaggaccaatttgttcaaattgaatggaaaattggagagaatgttcaaataccaattccatcctctaacgtgacaaaccccgttgagctttggaaaagtctttacaaactgcttgaagaaggcaacaaaccgttcgcagttaaagtggaaggcgtacagaaaaaattcactgaagcggccaatacagcacgtcaattgggcagagccgagtacatcaataaacaacaacaacaacaaagagacaaaagaaatgttaatgatgatgatgatgatgatgataaaaacgaagaagaattattaaacgcccttttagcgggggttgacacgttgcttgacctttacggggcaaccagtggtggtctacttgagagagaaaaacgtgcagcaacaagcaaggtccccctgcggaattgggatgacactgaagaggaataccagaaaaagcttgataaatattttttgcgtctacgtggccgtaatttagaacacttagagggactgataacagaaaagttgaatgcggaaattgcactgatggatgacgaagaaaggacaattctcgatcaaaccaaagaattaggcatgacagcatggataaaagttttccaatcagcatactctgcatgtttcctacattttgacagtgcaacgaacagattttcgttgaaactggacgatcgttatgtgcaaaaaataaaaatttcagaccaattggcctacattttgggttttaactcaaccgaattcactgaaaaagaaacgattgcaaaatttatgccagacatgagtggaggagttgcttcttttcatgtttatgcacctgatctaattgaaccaatgatgattggtgacgtgattgccccagttttgcgtatcgttacgattcggggaaaacctgacgaaattatagaggagcagtttctctccgtccaataccatcgcgtactagtcaaagaaataagtgaaattttcatcgaaatcagaacatccggtggtaacttaatgccatttcaatacggtacatgtacattaacgctacactttagaaagagttcctacttttaaaaatgaacagtgttcaaataaataaaattcttgctcgaaacccagtcacgcgttcgacctttttagggtgttttccatcagatcaaattccagcaggagcaacaacaccagttccttactcaatggtgattaacgttgatccgagcggttcgcctggttcacattgggttgccgtgtattgcgagcagcaaaatcgggtggaatactacgattcgacaggaatttggccaccgctaagccctttcatccaaaaatttttaaagagttttgctcaaattcagtttcatcaactttcgctccaagcaccatactcacactcatgcggaaagcatgtgattttctttatatttggacggtgtatggggatgcactttgaagcaattttgcaactgctaaaacgcgcaaaaatatcaccagatttttttgtgaacaaatttatgcaaaaaaatgtgtttaaacaaatataaataactagaaaactcaatttaaaaagcgcaacaaaaaaaagaaagaaaaatgcacgttgattttgatccttttaaagttgaatggtcagcattaacccaaatttctccagaagtagtcgtccaatacggtggttataatgtgttcagaggggttccataccagcgcggtagtggtatcgggtctgtttttaggagtctattgcgttacctaataccaattgggaaagaaatcgggacagccatcgggcgccaaggacttgaatctggaaatcgagttctatccaatgtattagagggtagggacctcaaagagtcacttgttagtgagggaaaaacggggctcaaaaatttgctagagaaagcagccaacaacataaatgcccaaaaaggtcaagggttcgactttaaacgatacacaaagagaaatgatgcaagagaaggtgttgcaattggtaaagcgaaaaaag

SEQ ID NO: 82676 - DNA, 2098 bp, Heterodera glycines
  Genomic contig location: Contig_ID=SeqID_18091; Location=312..2409; Strand=-
  SCN-specific regions: Sequence locations=1-32,54-876,898-966,988 -1148,1188-1759,1781-2098
atgggacgtgaaaatgtagtgccgatatttttggagaatggccattgggatggtctgaagaattatgtctgctttttcaaccgtggaaggaagttctgcgttgaatgtgaatgtttttacgatcaggatgtttatcatacgatggattgccgggcgagatgttattactgcaatagagttggaggaatgccgtgtgaaaaggagagtggagtgaagattgaatgcccgaagtgtcgacgttacttttacaattggggatgctacagctatcatcagggacatcagacttgcaatttatggaaacgttgtgtgatttgtgaaaaaacttatcgaattaatccgaagaaggatcatgaatgcggagagacttattgccagctttgtagtgtgagccacgaccccaagcgggggtgttatattatgccgatcgaggagaaagaggaaaaggatgtttaccgaattgtcgtttgggtaagttttatagtaaactaaatgaaaataaataattttaacttcaggattcggagacatcgcaggattctatttacaagggggaccagaaggagcatgttattaattatatttcggtgagagttacgtgtacggaatgctgtgatgacaaaaacaggacgaattgcaaaatttgtggggaggagaggatcaaggattggagcgaggcggagggacatgagccgaccaaggattttgtggagtggattttaactgcttttacgaattacgatacgtacatatttgcacataacgccggacgttttgacggtaatgaaaacaattaatctaaatttttaaatcctaaattttaggtcattttgtttttaattacctctgccgtaccgggaagaacccgctaccgctcatcaatggattgaaaatttatgaatttaaagtgcaaaactcgaagaaacattcaaggctgatttggagagactcatgtttattgatgccggtgaagcttgagtcgctgaaggcgacatttaatttggactgtgaggacaagccctttttcccctattactacaacaagaaagaaaattatggagttcgattacaacatctgccaacaatggaagattattcaccagggtctatgaataaagagaaatttataaaattcgaaaaatggtaggaaaataatttaaaaaaaaacaataaaatcttattttttaggtataacgaaaacaaggagacacccttttatttggatgaagaattgaagaattattgccgaaacgacacggagattttattgctgtcaattattgagtttaggagaattttgatcaacgacattacgaaggggtttgacccgttgccgaggagttgtacgaatgcgggggtcgcgatgaatatttttaaggcaatgtttttattgacggagcagttatcgattgtgccggagaagggatatgagcggtgtgatcgggcaagtgtgatggcaataaagtatttggagtggcggagcaagcgggatgggattgagataaggcacgcggggaatggacgagaggtcaaagttggaaattacaaattggacggatttattgggaataacggaggtagggacaaatgcattgaggtgatgggatgttacatacacggatgtttgaattgttatgacccggcggcggaactgattggaggaaggacggctcaggaattgaacgatgagacgcaggagagattgatggagctgcgtaagactttggacgtcgaagaagtttgggtaagtttatctgacatttacatttttattgtgagtttttaggggtgccaaattgaaaaggaactgaaaaaggatgaggagatgcgggacttcttcgacgacagagggaatgagaaggggccgattgatccgcggatggcttatgcaggagggaggacgggaccgatgaaattgtttgcaaaatcggacgagaagaaaaaaattagcgtttacgatattgtgagtctgtatccgtctgtgaattacggtacagcttacccgattggattgccagagattattatacctaagagcgatgagattaatgttaattggacgagaccagaggatttgaagtataagggattgtataaa

SEQ ID NO: 82677 - DNA, 712 bp, Heterodera glycines
  Genomic contig location: Contig_ID=SeqID_18092; Location=753..1464; Strand=-
  SCN-specific regions: Sequence locations=1-247,269-329,351-478,501 -523,599-670,692-712
atgaacccgagattctcaaatagccgtacccgtgccgaccgtgacctggatctcgcatcagataagtgatcaaaaaacgcctagtttaatcacaaaaagtgccagaaccgcccggctggcactaagccatcctgcaccaattttgtatgccatgccgtgcctgccatgcattcattcttcacctgttcgcctctgtcatgcaaccggcgccgtacgaggacttgtgcagcagcacactgccgccggaggacgactcagcgccgggctgtgtccgccggctggcccggccgtagatggacgagtgaatgccgccgaaccgactgaggccggccgcgtcaccgacacaacaagcccaattcaaacagtcggcaatggcacggatcagctgcgctcgcatgtccttgttcaacgaaaagtagatcacctgtagaacggagggtgatcaatttgatacgattggaaattttactcaaaatttaaatttaagcatttgaaatttgagaaaaatcaaaaaaagacgaacaaaaatattaaaaatttgaaaaaagaaattaaattttgaaaattttgatttaaaaaattctcatattttttttttgatttgatgaaaatgttaacaaattttctcaaatcacccagaaatttagtaagaaaatcaaaaaaatatgtgccaaaatttgtttaaaattggcataaaaatgccaaaaataaa

SEQ ID NO: 82678 - DNA, 2790 bp, Heterodera glycines
  Genomic contig location: Contig_ID=SeqID_2993; Location=265..3054; Strand=+
  SCN-specific regions: Sequence locations=1-271,308-514,536-629,657 -819,841-882,909-910,940-1262,1285-1371,1393-1535,1558-1868,1890 -2147,2169-2208,2235-2248,2470-2790
  Gene Ontology: Mol. function=translation initiation factor activity; Cellular component=ribosome; Biological process=regulation of cell cycle
tccagcgaaaattcggcgtccatcgaggcggaccacaacaacagcaaattgcgctacgccgacgagaccaccatcatcccgcacgacctcgtggagcggcattttctgcaaaacacttggtatgtgttgtgttgtaaggcgtgcacaacaggtttgagacatcatggtgggaccagggagagccaaaaaaaaaggaaaaaaaatccggaatttttgaatctcgaatgctcaaaaaacttgaaaatggagccatgttcggtaatagcagggctaccccccattttcgaaaaatttaatttgaatttttgactttttgttcgaattcgggacctgggtcggaattgttcgaaatggatacaggattcgtggtcaatgacctcgaaaaaatttttggaaaatagatgggtcgtgagaccaccctgctttactccagggagacccaagagaaaaaagaaaaacacggaattttgaactcgaaaaatggaaagatttcaccatggtactggatttatagaaggaattgaagagacacatgggtgtcagtcagcattttttcccatttctcatggacccgcaaaacctcaaaaatttaagccgaaaaatcaaaaattcattcaccgacaatatcacatttctatttttgtctatttttcaaaaattcttacggcattgtataactaaataaaaatgaacggctgattttttaacgactttttgtaaaaaaaaaaattcaaaattttaaactggcattaaatttgtggaaaaatgggttcacaatgtcgtatccaatttattaatttttcattttttgacagggctctctggtacttgaagggcgatcgcaacaagaattggaccgattgtctgaagaaagtgtccacctttgacaccgtcgaagatttctgggcgtaggttttaaaaaatttttgggggtattttttggacaatttgaaaaacaactaaaaaaatgttttttccccgttattttttcgtgaattttacattaaatagcaatggttaacatgggaatacgtggttgggctgttggtccgaaactaaattgaaagattgacatgaaacagtcaattttgggaaaatttcggaaaaaatttttccactgtccttcttatgggtgtaccccaaaatttcgccgccgaagttttcctttaaaaatttttcaaacttaaaaagtaaaatcttttaaacaccccaaaaaatttttttcgaaaattttgacggcgaattttggggtgcaccctttcatttatgatatttgtaaaatcatttgggccttcttcaaggttgtacaaccacatccagccggcgtccgggctgagctggaacagcgactattacctgttcaaggaaggcatcaaaccgatgtgggaggacaaaggcaatttggagggtggtcgttggcttgtgcaggtgaatacgcgaaacacaacccagtctcggcttagtctcgaagttggctttttgtgttgttggagggagaattggccggagttgcgaccaccacccaccaagcaagtttttcaaattttttgttgaattactaagatttttcaaaaaaaaaccgctgaaaatttctttttttaaattttgaaggaggtgggaatcttgagactttttctgagatttttttttcatacactgattcacctccgctgtttattccccgccccatatcgtttcctccttccgaaagggaggggggacgaaaaaatttcggaaggggtgggaagagggagccccgacatttgcggcccagacatttgcggtccgacttttgcggccccgacatttgcgcctatgtccaaaatcggactcaaaattgaattttttcaacccctgatagcctaataagcattaaaattaagaaaacacggttttatggttcattatgatcaataattttttgtttgaaaatttcagtattttttcaacttttttttgaagatcaaatgatcccgcttctgtcacgtcgatatactcggataatgtttaagactacgaagatccgaaagattgtgctctattatataaatttcatttggcatgagttatttgggccggtgatcacgaatacgtgatcagatttcaattatgacatcgctaagccctcagaatccccgtgtgattggggattctgaggcatcatttgaggggggagggggggggggaagttcgaatccgggcggtgtactttatttatctatttatttttgtgttatttttcagtgcgtttaatttatatttaaagatttgttgtaaattaataataaaagaatttatgtaaaaaataataattatgttttaataaagaatttcatattatttttaaattgaatttataaaaattaatttcatattaatttaaatattcaattcttgtacatttcaaaattctctttttaattaataaaaggaataattaattttattttttaaaatttataataaattgctttcaatttttgtacctcttttatcacttttgtacctcttctaatcactgttgtacctcttctaatcattgttggacctcttctaatcactcttctaatcgctgttgtacctcttctaatcactgttgtaccacttctaatcactgttgtacctcttctaatcactgttgtacctcttctaatcactgttgtacctcttctaatcactgctgcacctcttctaatcactgttggacctcttctaatcactgtttacctcttctattccctgttgtacctcttttgatcactgttgcaacctcttctactccttttgtac

SEQ ID NO: 82679 - DNA, 776 bp, Heterodera glycines
  Genomic contig location: Contig_ID=SeqID_2994; Location=784..1559; Strand=+
  SCN-specific regions: Sequence locations=1-38,60-176,203-495,541-776
atgtactggcaggagatgatgatgtgcatcattggggaacagtttgagaaatggagtgaccacatttgcggtgcggtggtcaacattcgtcaaaagggtgacaaagtgaggaaaaaaggggcttttgaaaaaatgcaattttcaattccttccacctatctagtctaaatatcaacaaaaaaaaaaaaattattaaaaatttgaaggaacagagaattttgttcttgtttctgcagcgattttttaggattaaccgacgcattgacggatatttgtttcgaaaattccaagccgaaatccatgtagaaccgaattctaacaacaaaaaaaagtgtaatttttgaatctcgtactttcatggtcaataaattactccttttcgaagattgagtatgggaacaaattaatcctcgcccatctagcaatacccgggtaaattgggaacccggtctcatggtcctggtttttcaaaactgtgctctacaaagctagcacatttaaaaaaaatagaaaaaaataaaaaattttattgttttttttctaggtttcgttgtggacgcgcgacgcgaaggatgacagcgccaacatgcaaattgggcacattctgaaggccaaactgaacattccggacaccgaaaatttgcgctacgaagtgcacgcggagtactcggcacgcacgggcagtgcggtgaagtcgaagtgagcaagcagcgaagcgagcggacgggagggggggggtgcacggactcaccccaaaatttcgccgcaaaatttaa

SEQ ID NO: 82680 - DNA, 313 bp, Heterodera glycines
  Genomic contig location: Contig_ID=SeqID_18094; Location=744..1056; Strand=+
  SCN-specific regions: Sequence locations=1-84,106-107,131-313
atggcatggcatttgaagaaaagtaaagcaaaaaaggaaaagcgaaggaaaatgcaattagaaaagaaatgccaaagtgccgatgaggaaaaaggaaaagaaagtgccaaaacaaacacagcaaaagcaaagccaaaagtggggacaacgacagacacacagtggcgggtcgaagacgtacaagaaagcgagaagacagacggggagcagttcatcgcggtcaactgcggcagagggtatattcagtaacgcgagacatgcatttggattcgaatcgaaaacgttaaaaatataaaaaactgacatatacaaa

SEQ ID NO: 82681 - DNA, 616 bp, Heterodera glycines
  Genomic contig location: Contig_ID=SeqID_18094; Location=140..755; Strand=-
  SCN-specific regions: Sequence locations=1-63,87-110,132-327,350 -374,397-437,459-616
atgccatgccatctctctaaagtccgtccattcgcttcagtgaccgacatcactcatcagcaccctttccatgccattctctctcccgccgccagttccattcattcatcaaccaatggttatattttcaagagataaatcgagatttatttgaatttgcttcagatggtcggtacggccgaatgcgcgagttcactgacgaggagtccaacctgtgcctgttgttgaaccgcgtcgtggacatgcaaaattcggagaggtgcatcaacaagaatgctttttttattatgaaatattccccccccgcccccacagacacaccgttttccttgtcgtctctctgttcgtctattttttggccagcaaacgctgcggcccggcagaaaatgccaaaaagcaaagtgtacgcaatttgctcgcatagttgaattccgattttgtacttcttctttttgctcaggtactactccgccatttcaacactcttcttggctacagcaactccgacaagtgcttcacaatccctcccgcgcgacttcgacgtgccgccgtttgcaacgcttttttgtacggattgcccgaggtgttggattcgaatttgctgattggcaaccag

SEQ ID NO: 82682 - DNA, 196 bp, Heterodera glycines
  Genomic contig location: Contig_ID=SeqID_18096; Location=904..1099; Strand=+
  SCN-specific regions: Sequence locations=1-196
acaaaaaggcagagacagcggcgacaacaaaaaggacagtcgtcgccaaacgcattttgaaacggaaagtgccaaatccatcggcaagaaaactgacggcggatgcgagccgacatttgggaggacaaagcgccaccgcaattcgagtgaagaaacgccggtcgaggagtttggacaccatgttgaggtgcaaatg

SEQ ID NO: 82683 - DNA, 1455 bp, Heterodera glycines
  Genomic contig location: Contig_ID=SeqID_18097; Location=133..1587; Strand=+
  SCN-specific regions: Sequence locations=1-612,655-1455
tcttacgaagccgcttctgcttacataacagaattttcgtcaaagagtgcgtccaattcaaatcccgttcatttgcttctctttgccttttagccactctttttgtgtgccccgtgccgcccactttggatgagaatgggctcaagggatacttcctcacttttggagatgttcggtccgttgtcgtgccacacaaccctttcacgggtgaacatcgcgggttcggtttcgtcgactttgccaacgaaacttcggccaaagcggcgtatgccaagaggggactgatttgggtgcgttttcaattttgagtaaaaatcgccatttcaaattaatggcaaacttagcctcgcggcggattgaaacccttcaatttgaattggtaccgtcccaaacgaccgttttctccgccttcgtcaaactcggaactttacgtcttcggactcagtcaaaaatgtaccgaattcgcaattttctcctattttggtcgctacggttccattgaacgcgcacaaatcggacgcacgacggacggcggtcgcgcagcgctccttcgcttcaccgattggcacagtgctttgcgcgcaatcgaagaaaacccaaaacaatgcgaatgggcaaagacagtggcagaagcacaggaacaggtggcagcagatgaggcatttacatgattaatcgaattaattaattaaggacggaacaccgccaatgaaaaaatgggtcaatgttttcgatttgccaaaaaggtaagaatttttgcaaatggaaatgaactacaaaacaccaaattgtttgttcagcaccaatgaaaattcgccgtcttttcgtccctcccgtcgatcggagaactcatcgccgaccattcacaagcagttcttcccggacctggttcagcagaaggcaagtgaatttgggtgtgtacgagtttggactgatcagttgtcaggatcaatcaccaaactttggaatgccaaaattggcggttttagagaaaggggcgttcgcagtccatgtgccgttttttggcgaaggaggaggacgacgcttacaatggcacgtcggacagagaccaatttgaggagggcaaaagggacaatgagtggcagcagaaggggcatcattcgcaatcagaagcactaaaccgagcaaaagtcaggtacagcgaagcaaaccttattgtaaacttaattgactacgactaacttaattaattgcccttaattccttttagtattggtgcaaaacgccctctgacgggtgcttcgtcttcgtcggaggacgactctgaggtgctcgtcacacgagagcatgtgccgcgtaagggccgtacgcttttccgtgccgtcgatgctatgcgttgcgacagtgttggttcggcagtctcggcacaacagcaccggagtcgttcgcacaagccaaaacccgggtggaacagtgtcagcggcgaagggagcg

SEQ ID NO: 82684 - DNA, 507 bp, Heterodera glycines
  Genomic contig location: Contig_ID=SeqID_18098; Location=1097..1603; Strand=+
  SCN-specific regions: Sequence locations=1-98,132-507
atgccatcgtcggtggaactgatgagacatttgttgagcacgggtgagcattcggatgtgcactttttggtgggggacggagacgcaaaagaggcgagtttaattaaaaataaaaattttattttatttttcaattgcaatttcattaattatccacgttttttaaaggttttgccagcacatcagcttattttgaagagcgcttccgatgtttttgaggcaatgttccgttttgacgccaaaaaagaaagaccggaaaatggtaaaaaaataataattttaagggaaaataccaattatgctatttgttcttcattttgtctctgctaatttccctaattaatttaacaattagtttctggtaattgtcctgatgttgtggagatacctgacattgaagcagaagcgttcaaaataatgttgagcttcatctatacggacgatttaagtgatttgaatggagacaatgcaatggcagtgctttacgccggtggatttaatttttaa

SEQ ID NO: 82685 - DNA, 545 bp, Heterodera glycines
  Genomic contig location: Contig_ID=SeqID_18099; Location=643..1187; Strand=+
  SCN-specific regions: Sequence locations=1-248,280-545
atgcttttgttcgaattcgggtttgttgagctcgaaacttgtcgaaattgtgtgagattcatgatccaagtgtaagcaatttttaaggatttttccatcaaatgtttgcgttacatttgtcaaaatgcggctgacttgttcggatcagatgaatttttgcaaattgatcagaaaatgttatgcaatcttctcgagagtgatcgtttgttactcaacgatgaatttgaaatttggaaaattgtaatttcaatttaattttttattttcattttttaatttcgatatttttttctatttaggcactccgttgggccgatgaaaaatgtcgtcagaatggcattgaatgctcctcgggaaattgtcgttccgtacttggtcctgcactgttcaaaattcgttttcctaatatccatgagaaggattttgcaaaatgcgtcggtaaaaattttgaaatcggaaattaaatagaaattgttttggtcgatatgaaattttacctttaatgcttgaatttcatacatggataaggagggtcagcaagggga

SEQ ID NO: 82686 - DNA, 316 bp, Heterodera glycines
  Genomic contig location: Contig_ID=SeqID_18103; Location=290..605; Strand=-
  SCN-specific regions: Sequence locations=1-63,85-128,226-232,275-316
atggcacaatcacttgttagattgttttatatagttagataatatttgccaacttgattcatagtatatttattttttaattaacttgctcagtagtctaacaaaacttacgaacgtgaagtcatatctatattaaaattttctattttaatataactacattatttttttatatttaatcatatttattgttgctgattaaaaaatttaaaaatattatttttaggtacagttaaaaaatttacattcatttaaataattgaatataatattacttggtttaatgaataccctaaattaatcaagtaaaaataaa

SEQ ID NO: 82687 - DNA, 1451 bp, Heterodera glycines
  Genomic contig location: Contig_ID=SeqID_18106; Location=1097..2547; Strand=+
  SCN-specific regions: Sequence locations=1-1043,1065-1281,1305 -1346,1368-1427,1450-1451
atgaaccgccggtaaaataatatttagacaaagttttccattgccctgatttgattttccacaatttcagttggatttgcaccgacgtgtggatggacatgttcccattttttgaccgtcttcaactcggactcaaattggcacttctttcgccacgtttcgaatttttggtcgacaaacatttcgatggcacaagcgaattgccaattttgaaaaatatcgtattgcgcaagaacaaagtgacagcggtgccagaattgcgtgtgtttattgacaatgccaattatgtgccctttccggtgcccgaccattcgctgcccaagaaaattcgttttaagcatcttcggatttggtaattcaaattccgacatggattaacggatacatgttcctattttcagctacatcgaccattctgtcatcgcatttatccgtgccaatcagcaaatgttcgacaaaggaacaaacttggagttcttctatgtgtcttggaacgaaaccttttttgtccagccaatttggaatgctttgatccgccatattttgccaatttttgtgccaaatattcgccaattgaaatttccatgtgctgatcaactgtactgtttgcttcgtttcacttctccaaaagtgctctccgatctcaacattcattcaatcgatgctggtcgtctgttcccaaatgccattgattctggtgaccaattgctcgatgagatttgtggtgattctgatcagccacttgcatattctgctggccaaattttgtctgaatggcttcacatcccggcaaaagatggccaaccgaagaaattgatttgctggagtgattcgtcagaaatcgctgatttagtcaacaatttcaagaaggtgtgtggccacagtttcgttggattaattgccatttgattttcatttcccattgtttagaaatttcgccgtgccaccacttcttccgccagctatcaaattcaatttactgttcatgtgccaacggaaattgtgccatttcaattggtgaacgaacggatcaacgaaatgctgacattggagaaagcagaaaacaatgatgaaagtatggatgaagaagatgatgatgaatgggatgagcgatggataatgaagcgatgtcaaattggggagactacggccgcgttaaaccaaaattcgggcaatttgaacaatgtcagctttacgttctatggaaattgcattgggtgagttgcaacagcttttgctttaataatcaaattaaaaactgcgctaaatttaggccattgtcgacaccgacagaagacgaagaagcgggacaaagcgccggaaaagagtcgacgtattgtgacatgaatggattaatttggaaatgatcgatcattatgtattatgtgatgaaatgaattttatgaaggaaattcgcaaatatctacattcatatatatgtgtacatgtaa

SEQ ID NO: 82688 - DNA, 306 bp, Heterodera glycines
  Genomic contig location: Contig_ID=SeqID_18106; Location=2861..3166; Strand=-
  SCN-specific regions: Sequence locations=1-126,186-306
gcatttctccgtgccaacacttcttcgaccaactacatcattcgtcttgatgtttatgaatcaacgccaatggaaccatttgaattgataaacgaacgaaccaacgaaatgctaacattggagaaagaagaagacgaagatgaaaatatggatgaagaacacgatgatgatgatgatgatggtaaatatatcggttttttgttgaagcgatggcaaattgggaagacagttcaatgggaggacgaaaatttggaaaatttgaacaatgtggatattcgcctttatggagagtttgacattgggtga

SEQ ID NO: 82689 - DNA, 996 bp, Heterodera glycines
  Genomic contig location: Contig_ID=SeqID_18109; Location=81..1076; Strand=-
  SCN-specific regions: Sequence locations=1-37,67-249,285-482,507 -508,530-862,884-996
atgaggtagtctattatttttacagatacattatcacaaaatttttcataatctttattgtgttggattatgttttatgtatatcattgcatttttcattattttatttttattagggtgggaaataagtcctgtcatagcattgtttaaggattttttataaaatcgctcaaataaatcattgtttattagaatatatcattcgaaagagaaacttttggctctttaaaaagtcagctttatttctggtttttattttgttttataatttttatgatttttatcagcttcccaaaatgcaattttttcgtagttttttgaatgattcttaattccgagacctagcaataggaaaaaacaattatgaataccgtacctattgaattagtacccccgggggttctatttttcaacccccctcgaaaggggggttatattacagagggaggttctaattcagaggggggttttttcaacgctcatttttcaaaaacccaccaaaaaatggctacttattttgtaaacatttcgccaaaaaattgattttttttgtaatttcatttgttttagttcattctccatatttttcatcttttacgaatgacggacgagagaaacccttctgcatctgttaaaaaaggtagttcaaaattataggttttaggtacctacctgttcataacttgttcattatacaattaatttcaatttaggtgtgctgttactgcaataacatctgttctggagcgcaccagtgccgcaaatgctcaaagccgtgccatgcaattgctccgtgctctttttgcggccgaggacaacaagggattcagcgcaaaagtcacctgctgcaactgttggctcaacgatgatgacgatgatgttgtgatggacaaaaacgcgaacttcgccggtataaatgaagcgacaaacaatgaccaagacgacgacgcattcgaacaatttgccaacagccaaatcaatcggagaggacaatga

SEQ ID NO: 82690 - DNA, 2568 bp, Heterodera glycines
  Genomic contig location: Contig_ID=SeqID_2995; Location=635..3202; Strand=+
  SCN-specific regions: Sequence locations=1-11,35-176,205-351,375 -395,512-692,719-776,815-887,922-1007,1036-1061,1104-1167,1352 -1508,1548-1553,1583-2055,2103-2121,2144-2232,2265-2447,2469-2568
atggttaaaactaaaatactttttaaagagaaaactgtgaacaatttccgggccgtcctcattttgtcggcgaaccccaccccccccccccacttttccaataatttttgtgcggtcattacaattcatttatggtaaacgaggacacaaaaataagggaaagaacagagggataaaaatatttgtaactgttactttttataagtacttaaagtttggaattcaaatcgaatttattcgcccgtcgattgatcctcccccattatccgaatctgttctattttacgctaccgtacaattttcaaaaacatttttgcaataaatttatagtacataattagctaattatttcacacaacaactcaattagcaacaagtttttggccatttgaaggtaaaaaataataattaagaattgcttattaaatattaattttctaataaattgtacaaataatataaaatatgttttaaaatgaaaattttcagaaaaatccaacaaaaacaaaacgaaatttttcaattgaaatggcgggggtaaagcaagagcagcagcagaaaaagcaatatgagctccgcaaaaacatgacaatgttggatagagcggttgtggcagttgaaaatgcgcgagacgcagcagcggaaaatggtgggcaaaaaaaatgtgtacatttggaaaaaacggtagaaaattattttttagcttttttaaaatatcaaaaaaaaatgagagagataacctcgacaaaaatggccggttttttagtgatttaacgaatttttctaaaataaaataatataaatttaaaaaaatgaccaatatttttactgcaaaatttttcgaattttcaattctcaacttaaaaaaaaaattggttgaaaaaatcattttaaattggaattttttattcttaaaaaatcttatgagcttttggtttttgtacagctttgttgtacaggactttactaagaaattaaatccttgaaattaatggaaaaaagtagagaatattaattgttttttatataaattttcaaaaaaggaccctctattttgtcacatttaaaattttaattacaataaattgaaaaaaaaattaattggttttttcaaattatgttcgttgattcgccgttccttcatatttatatcattaattccattttcttccccctgtcccctccacttccctttcctctcctcctctctctcttcccgtctccccttttctgtccatctctctctttgctatttaccgcacaattatcttctctcttcccgtcgccccttttctctcctcttctctctctctctcttcccgtctcccccttttatattctctctctctctgctgttatttaccgcacaattaacgtatttttgctagtaattttttgaatatttgtgtttaatctcttacatgctaatcaattgcctgtggcaggcattgaaaaatgttgtattgacccctccccctcccccaccgcatttcctccatcatttgtaacattttattttcatggaaaagaataaaaaataaacagtgcctctacttttgaatttaataaatttctttaatgagcaaatgcccttaattgacccccaatgctaatttggtttaattaattgcataatatgctcccctaatgtattattccctatttgtgtgggatggttaattaaattctattaaatattttgtgttcctagagaaattgtgtttaataactaatactaattatcttaccaattaaacaaacgatgaacaccacgccaaaaaaaccgttctcctcgtccaatggcctaagtataaatagcatgaaaatttaaacaattcaaagcttttccaaactaattattttcagaccaacaacaggcttctcctgaatatttcaacgagattgctcaacggttcgaaaattcggaggaccgcagcgtaaaatcattttgcatgcccaaatctatttggtattatctacaatttttcaggcacgtgcctgggtccaaagaatgctggacgaggtgcaagaaaacaacgagcaggcccgcgtgagaaaattatttttaaaatgatttaatcataaataaattaatttattatgagagggttcaaaattgccaatttcacattttggcataaaaaaggaaattgtcaaattatggtcatcattttcatggccttaaaatttggaatttggcaggtgtttcgatacagctgatcgaatacactcataataataataattattattattatttaattcaccaggtttaattatttatttataacgcagatggaggacaaagaacgcatttcggcgttggaaaagcaaatgcttatggtttcggtcggccttctcatttgcgctggcgccgtgcttttcaagcacttgaagaattgagggctcaaacgaagaattccattggcacgaaaagaaaaatcaacaacaaatgaaataattttaattaacttaacaatcgttgccattggatatttaatttgtaattcgttggctaattgctttaatgttttttaatccatctttttattataatttggttgggaa

SEQ ID NO: 82691 - DNA, 782 bp, Heterodera glycines
  Genomic contig location: Contig_ID=SeqID_2996; Location=371..1152; Strand=+
  SCN-specific regions: Sequence locations=1-46,78-83,107-116,157 -355,377-567,589-674,696-782
atggatccgtcaacttttgttcgaagtcaaagagaccaaccgaaaagaagtgaggaaattattattgaaatttaaatttcaactttcatttgggttttgttgcaaaaatgtacacaaaaatactaaacccctttgaaaatttgtttaaaaattattcatatttttcccaattgcctttgtttataattggaaataatttctcagctttttttttcaggacaacaaagcgaccaccagcgaaggcactgttttcattttgggcgtttgtttcggcatttccgtcggcttcatcattgacagaatgttcctgcactgagtgatgagagaaggcacgaagaaaagaaccaatggcacgaaaaacgaaaattaaaaaggctaatttaacaacaacaaaaattcgttgccattgaatgcctaatttcgtaatcgttttctaattgtttttaacgcttttaatccatcttattatggtctgagttggggagtaaacgatgcataattaactcattgggatcttatgtcttgggaaatttttagtgccccaagcaggactaatcaattaatcccaatatttgtttcatttttaatggtcagacggtgcctaaagtttattaatttatgcttaaaactttaaaaattatatgaaaatttcttcagagcacatttttaaaattattcttcatgaaaacaggaaatttgaaatttaattttttttttgcaaatttgacgaaaaagtgattggatcaattatctgacaagacaatattaaatattttagaaaa

SEQ ID NO: 82692 - DNA, 390 bp, Heterodera glycines
  Genomic contig location: Contig_ID=SeqID_18110; Location=293..682; Strand=-
  SCN-specific regions: Sequence locations=1-39,71-259,302-390
atgaccgcgaagaggccgagtgagtaccttcggtgcaggaaaattattaaattataaaaattttttaattgctttttaaatatgccaaaaaatgtaggcttaactttcttagtgataattcgatcactcatattttttgctaattgagcagaagcgtaacaaactttgcagggatactccccggtaaaggtctaacttacactgaaatgagcgccgagctagctggctcaaaaaaattttcgaaaatgtgagtctttcgtttttatttattttttgcaaaattaattcttaaatattttttcagaaagggttctgaatcgctccaaattttattttcatgttagtttaggcactctgatgctttttctatcaaaaagggagatgaataaa

SEQ ID NO: 82693 - DNA, 477 bp, Heterodera glycines
  Genomic contig location: Contig_ID=SeqID_18111; Location=2212..2688; Strand=+
  SCN-specific regions: Sequence locations=1-232,254-360,385-431,457-477
atgaagtaagttatgaattttaagaattttaaaccgaatacgattttgaagctatgagcattttgggaacaacatgtctccaaatttgccaaaaatttcaaaaaaaaaatatcgataaagccaaataacgaaaacacgcaaatttttgtgtttttttggggagtgtattttttaaaaatttccagaccgatccttaggggtgttttttcgcttcttttttttcatttttttcaatatatggaccaaaaatcttaaccaaaccaaatttttttttttagtctaagtagcatatgcgcaaaaaaccaaccctagcaatgagtaaaaaaagagtttaatgagtaaagagagatttttacttttaaataaaataaaatccaatttcagtgtttttgttctccgggattcaagactcgaaaatttttttttgccacttattcattcatttattcattcaattcaattatacttgtattaaaa

SEQ ID NO: 82694 - DNA, 824 bp, Heterodera glycines
  Genomic contig location: Contig_ID=SeqID_18112; Location=805..1628; Strand=+
  SCN-specific regions: Sequence locations=1-112,134-154,196-283,405 -471,493-504,526-824
atgctaaatcccgcaaaattgcaacaactttggacgaccgttttcaccccgcagaacagcaacggaagtgaaacattactgacaaacaattcatttgctcaaaagaagcaaatgtttccctccaccccgggggaaggtgaattttgagaaatacaaaaataaataatattaattaattattaaaatttaaaataacagcagcaggcagccatcatcattatcgtcatagccatcatcaacagaacagctcattaacgacgacgcccaaacaacggcacaaaaggggggaggggagaaaagaagacgaagaaaaaagagacaacaaaaggcataataatgaggaggaaaatgagcaggatgatgagccaaatgaggaggaggatgaggaagagcagagggaagggacacgcaattgtcgcggcgatggcgacgaagcggcgggggactgcgaacgccggcggagaacgcccgacgcgtcgccgacgacgccattctccgaaaagcaacaacaaaatgttgcttcatcaaccgttttggaaattaaagaggagaagcaaaaggacgaaggaattgaggagaagcaaaacggaggcgaaagggaaggtaccaatggacgaaagaacggggcgaaaaacaaagggaacaatggcaatttgacgcgggtgcaatcgccgacaacgaaggacactgacggaggcgagcggaggatgaagcgagcggcgagaaatgtcgccggattggagcaaacggggggagcggcaacggacaaatcgcaatcggcgcagccgaaaagcgaacagcggtcagtgggcggggagggataa

SEQ ID NO: 82695 - DNA, 808 bp, Heterodera glycines
  Genomic contig location: Contig_ID=SeqID_18113; Location=240..1047; Strand=+
  SCN-specific regions: Sequence locations=1-454,481-733,755-770,792-808
atgccgttggcagtgcaaatgaatgtcgcgatgcatgagactgtcctcagggcacgcgctctgataagctttcatacggtaaggacaaggccatttttgtttgccttgggcacactttggccaatttccggcgataatttgcatatattttcgccctcatttgccttaaggggaatttcaaagagatgtacgccattttggaaagccacaaattctcacaagacagccattcgatgctgcagaaaatatggtgggacgcacattatcaggaagcagagcgaatgcgggggaggtgaaaaagggagagaaaattggagaaaagtggaaatttggggaagagaaattggaaaaagaaattggaatcaaaaatgaaaataatgaaagaattttaaggacacttggcccagtggacaagtacagagtgcgcaagaagtacccgtgtccagcgacaatttgggacggggaacagaaaacgcactgttttaaggaaaaaacggttgggcatagggcacaccaaataatgggaaagtaatgaaacatgccatctttgcagaggacaatgctccgagaacattatctgaacgacccctacccgaacccggcaaagaaaaaacagctggcggaagaggcaaacctcacaccgatgcagggtaattaatggaataattaattaattgattaggttccggaattgcgattcacgaaaaacgaagttttgaatttaaatgacgaattaaatttaaaaaacaaacaattatttcatttaagttggcaattggttcaaaaaccgacgacaggttggtgacaa

SEQ ID NO: 82696 - DNA, 699 bp, Heterodera glycines
  Genomic contig location: Contig_ID=SeqID_18114; Location=143..841; Strand=-
  SCN-specific regions: Sequence locations=1-131,153-528,567-579,601 -637,659-699
atgtccaggaaatccaggcttttgccttggcctagatttttttgctcatttgacctgggtttcctgaacaaaaatccaggtccaggaaaaatccatgttgccgaaaaatggcctagacctggatccaggaaaaatccaggcctggatccaggtccaggccgggctctaatggtgaatgactcccgtgtgtcaaaagcaagagttaagcgtttttacctgttcaacaacaaaaaacgataaatgaactgaacacacaatccaaacactgaaaagaattgtatgattatccaactgttgatcagcaattcttcaaattgagccgaaagtgacatctattcagagaattgtgaaacggaaagagatattgtccaaccatctgttgatagggtaatctaaaatatcatttaggaagagccggctgggatttttatgttctaaaaaccgcaaatatgcacataatataccgtatttcctcgattagtaccccccccccccccttaaatataagcccactttggagggggatttaacaatagaagccccggggcttataatcgaggaaatactgtatgccaaaagcctcaaaaatgtgttcaaaaaacgccaaaattgtcagaactaaaaaaactgctcgtaaaatacgttaattacttaaaaagtttctttctttattcatttcgctatcacaatgcaaataaa

SEQ ID NO: 82697 - DNA, 583 bp, Heterodera glycines
  Genomic contig location: Contig_ID=SeqID_18115; Location=18..600; Strand=-
  SCN-specific regions: Sequence locations=1-583
tttattcatgtgaataaaaaggctcttaatggggtgttacgacaattgcggaccggacaattgcggaccgtacaattgcggacgacaattgcggacgacaattgcggaccgtacaattgcgtaagacaattgcggacgacaattgcggacgacaattgcggaccgtacaattgcggaccgtacaattgcggacgacaattgcggacgacaattgcggaccgtacaattgcggacgacaattgcggacgacaattgcgtaagacaattgcggacgacaattgcggacgacaattgcgtaagacaattgcggacgacaattgcggacgacaattgcgtaagacaattgcggacgacaattgcggacgacaattgcggacgacaattgcggacgacaattgcgtaagacaattgcggacgacaattgcggacgacaattgcggacgacaattgcggacgacaattgcggacgacaattgcgtaagacaattgcggacgacaattgcggaccgtacaattgcggacgacaattgcggacgacaattgcggacgacaattgcggacgacaattgcggacgacaattgc

SEQ ID NO: 82698 - DNA, 631 bp, Heterodera glycines
  Genomic contig location: Contig_ID=SeqID_18118; Location=1108..1738; Strand=+
  SCN-specific regions: Sequence locations=1-62,97-249,271-631
  Gene Ontology: Mol. function=ligand-dependent nuclear receptor activity; Cellular component=nucleus; Biological process=neuronal remodeling
atgcttacagattccttcgacgacgacccttcccttccaacgacggattttgattatttgtacggccatgctcagcagcagcagcagttcagcaccaacgacgagttggagcccgatgactccgctgcggcccaattcggttgtgggggaacgaagcggaagagggcattctccttctccagtgcgccttccgcttccgccaccaacacaatgacgaccagcacaacgacgattatggggctggtgaacgggggaggcggcgcggggccgtcgtcggcgatggtcggcggcggtggcccaacagcggcggttgtggagaagagaccggccaccaaaatttgccgagtttgtggcgacaaagcgtacaggtggacaatgccacaaatactgctccaaaccgccttttgttcagctacaacttcaacgtgatcacttgcgaatcgtgcaaagcattcttccggcgaaatgccaacaaagagaaggttttggcgcccaatcgaccgaatttgaatttcgtcccaaaggaaattcggtgtccattcaacgaacagtgcgacattaacattctgtcgagacgcttttgccaacggtgccgactgcagaagtgcttcaatgttggcatgaaaaagga

SEQ ID NO: 82699 - DNA, 749 bp, Heterodera glycines
  Genomic contig location: Contig_ID=SeqID_18119; Location=1005..1753; Strand=+
  SCN-specific regions: Sequence locations=1-60,92-284,366-388,427 -449,726-749
  Gene Ontology: Mol. function=poly(A) binding; Cellular component =nucleoplasm; Biological process=N-linked glycosylation
atggtaaaaataaaatttccttttttcaaaaatattccaaaaatgaaaatttcgaatttgaatttgttttaatttttaaattctttaatgccattttgcctatctctttcgaacccctaaaaataaattttgcacattttcagtcgcttctcagcgcagcgattgacgaaaaattgtcctattttttgttgatggcattttttctgatcatcgtcgttggccttctgcagctgatgatcaaaggaattgccgataaaattttgatgcgattttggcggaacaatggaaaagggaaggaggaggagaaggaagaattggtggaagaaaaaggaagaggagagaaaggaggacgacatgaggaggagccaattttagaggagaatgattgggatgaggaggaggaagaagaaaaagaggaggaggaggctgaaggagaggaatttgttggggaagaggatgaggaagaagaattggtggaagaaaatggaagaggagaggacgaagcaagacgacaggaagaggcacttttggaggaattggaaggggaaagggatgaagaggaggaagaaggagaggggaatgaacgagaggaatttgttggggaagagaatgaggaagaagaagaaaaggaggatggaatggaggcatttttggaggaattggaagggacgacagatgaagaggaggaagaagaggaggaatttgacaatgacgaggaggagaagcggaagacgaagaaccaattgtga

SEQ ID NO: 82700 - DNA, 358 bp, Heterodera glycines
  Genomic contig location: Contig_ID=SeqID_18120; Location=208..565; Strand=+
  SCN-specific regions: Sequence locations=1-167,190-194,224-235,266-358
atggcatttctcaaaggagtcagcttgacctctcatcgcgtattcatactttacacttttttttcaaacacagtgcgacttttgtggacagcgatttgttctcaactcacatctgaaggaccatcggcgcactcacacggtgagaaaccgtttgaggtgagttacggatttgcggttttaaaaacaaaatgcactattttgatttatttattttttaattccattacctatttggtttttattataaaattaaataaataaatttcaaattcagtgcaccgaatgtggccgacgatttgctcagataagcaatttgcgtgtgcatttgaacagaaaaaaaaagtgcggaaagaaatga

SEQ ID NO: 82701 - DNA, 2269 bp, Heterodera glycines
  Genomic contig location: Contig_ID=SeqID_18121; Location=196..2464; Strand=+
  SCN-specific regions: Sequence locations=1-140,164-191,228-551,573 -672,702-879,901-955,978-1088,1111-1334,1356-1842,1877-2241,2263-2269
atgccattttctttgtgtgtgacaatgttgctcatctgttccaatctggctttgcaaaaagtaaataaaatacaatgatttaagttaatttagtgattttttttcaagttgggaacgcttttatttttgtgagagataactttacaaatttgttttggaaaacggttgagaaaagtgagtgtttgtttttcaaaaaaacaattaaataaaacattaattatttttttctaattcaagtttggaatgcaactcttttcgtgcggaacggtgttgttgttgtcgtctggggtaccatcgaaaaaagtttgtactttttttcattatgccctcttaaagaaaaaaattattaaaaattggaaaatttttgacccttctaaatgaaaatcatcactaactactcatactagtatttaatttttctacttttcagttttcactgttttcaacgttctaattcgttcaattgcgcatttcttcacatcggcttacaatgcgtttgccggatttgtgttgggcgtttggcattctgtgcgcttttctcccccagcgacaaaagtggaggaattgttgaacaaggcgcaagaaataaaagttcgttagttttctgagtcaaaataaaaatcgctaaaaagtaaaatgagcagattttcaagacttgttaatttttgacataaaaaattattgtttttcaaaaattgtgttatttttttggtgaaaaacatatcttagaaaaaaattccagacctttttcttttttgctaaattgaacagacattaggtatatgaaaatgtattttctttttaggaccaagacctgccttctgatgatcacccgctgattcagcattttcatcgcattttgactgccacattggctgaggagcggacggtcctggagcaacggcttcgtgaattggcccagcaaaaacaacagcagagctcaccatcagcaatattggtattgaaaagaaaaggaaaaacgagactttctcttttatttaaaatcggggaaccaaagagttggaaaatgcaaaaaaaaaaaagagccatttttaagtagttaaaaatgttacctttttttggtgaataaatctcaaatttagtttagaaaaaatcttcatttgcgttatttaatagtccacatttatcttccacaaattgacattaaaaggtttggttagcttttaaaacttgcgagaaatttttcttacaaattttctaatttttttttgtgtgcactcaaatcttctgttacggttttttagcccactccaacaattgacggaaacgcactgaaggacaacttgcgaaaagagcttgacttgaaattgcgcgttgaaaaggaggaaatcaacaaaacggtcaaccattttgaggagcaaataatgacggttagttttttttggtacttgttcagtttacctgacagatttcacatacattttcagatgcctataaatgggttttagaaactaatgaaaatagttttatggggtttttgatgtctctgatcatgaaacaggaagaataaaattcgaaatttgtatggatgatatcctcatgggcatcttgtcaatgagggtattattggtacatgaaacctatcaattctttgtccctgtacagctcatgtagtgaacggtagcgctgatctgagcccggattcgtgatcagcgaccctaaaaaccccttaaaacttattttcattaagtacctttttttccaataattccatataaattgtatccaaaagaaaagcggtccacgaatgattatttatttttttagcacaattgaataatttaaattcagtcagtcgatgcgcctttcaagcgttgtctgagaataaatgaaaattattttattcaaattttttagggccaaactttagcagattcattctttgtcagaattccctattctttactatattttaccaattatgttttcaaaagatttttctagtaaatttagttttttgacaacttattgttgcttaaaaattcctttcgaaacggtggtgtaataatacccttattcttaaacatttttcttttttttgcagaaacttcgcacgctcattgaacaaatgcattcccaaaaagacgtgttggagcatgagattgatgaagtgcgcaagacgcaattggagttgaaaaaagacgtggaagacacagggaaaccgttgttgaagaaggagaaaatcacacaacagttgaaggaggacggacgaacggaaacgatcaaagtgagaaattattgggattag

SEQ ID NO: 82702 - DNA, 1246 bp, Heterodera glycines
  misc_feature (328)..(328): n is a, c, g, or t
  Genomic contig location: Contig_ID=SeqID_18122; Location=959..2204; Strand=+
  SCN-specific regions: Sequence locations=1-104,127-127,149-188,210 -236,258-653,679-738,780-1087,1121-1246
atggccaaaattgtcggggttggaggtcggggcggggtaggggtcgcaactctaaaaaatatgggcgggccggctttgaaccggcgtctctggctttccggaccagtgttctaccagctgaactaccgatcctgccctctccagctgcccactttgatcgatcgcataggatcaattgttgcctcaactggtccattaatcttcctcttcgggaagcttcttcttcttctctatctcagaagagagaccagagcgggagggaatggaactgcccagaaaatggtcaaatgctttggtgagacaagaaacaatgatcaatgctattgcncattcttgcctaaagtgcttgctcaaaaaggacgagtccaaaagccattttcagacacacagaaattgataatccgactgtaatggctaatcaaaaaatggctgtgggagcccaaaatggtgtggtagcataagcaacaggtgccaaaatgaaggaaagatggcccaattttttcctaaataataaggggcaatggtaaacgttatcctggctatgtctttcttgggtcgcgcacttcacaaatagtgggcaacaacacacattttgctgccacatcagcacagcagcaaatttttcgttcattttactaagcgtttgggtctggaaaaaattattaatataaattatatctgtaaaaatttactgaaatttttctgctataaatggaagcgccttttttaatttttctcagtaaattaattttgcatgttatttttgaaaataaatctttcctcatttttggaaaaaacggtaattctttaagcttcttttaattttgaactaaaaaatattagcaattaaaaaaaaatctgactgtttttagagccttttagcctaaaaagcaaatcccttgcaataaaattgttcaaaaataaaattgttcaaagaagaaaatatgtatggttgcctgaattggtgctgttcacttgccaagcaattctcttttattgcaacagattctacttcatttttacaagcaaattttatctgataatgatgacgtaatgccaatgccattctcattttttacttcatgttgagagagagagggagagagagagagagagagagtagaattattttacatattgcgaagatagcgagaatgcgaaggagtgattgagagtcagagaatttagtaaaagaaaaagaaggagagagaagagagagactagagactgactctaaaatatttaa

SEQ ID NO: 82703 - DNA, 153 bp, Heterodera glycines
  Genomic contig location: Contig_ID=SeqID_18122; Location=2515..2667; Strand=-
  SCN-specific regions: Sequence locations=1-153
tgattgcacgtaattgccgaaaaaattcgagaccaatttcggatgttgaccgactaattgcaaaacgaaagccgtctttgtcaaagcgccttaccgagtcaaaaaatttggaaatgtatctcatatgcaatttcaaccaataaatttgaagaa

SEQ ID NO: 82704 - DNA, 63 bp, Heterodera glycines
  Genomic contig location: Contig_ID=SeqID_2997; Location=407..469; Strand=-
  SCN-specific regions: Sequence locations=1-63
atggccacgcttatttgccttggtgtgccatcttttgaggttggcacaatgaatgaatggctg

SEQ ID NO: 82705 - DNA, 297 bp, Heterodera glycines
  Genomic contig location: Contig_ID=SeqID_2997; Location=767..1063; Strand=-
  SCN-specific regions: Sequence locations=1-99,139-158,187-222
atgctacggtacagcgcatttttgtttggcattttgttctgcattatgtcgtcgatctgtccgccaatctggtccaatgaaataaacagtaagtaaaacttaaatattaaattttattaaaaaatatattaattaaaaccaaataaaattccaaaccttaaagttttatttcaaattttttaaattatttcaacaaaagaattccataattttcagggtgccatttttaaagttaaaaaaaaatatatattttaatataggaaattttttcattaacttttcatattttaaattaaa

SEQ ID NO: 82706 - DNA, 212 bp, Heterodera glycines
  Genomic contig location: Contig_ID=SeqID_2998; Location=540..751; Strand=+
  SCN-specific regions: Sequence locations=1-58,86-212
atgcgacatatttcaggtgaatgataagaaatcatatggtgtaaaacagtttaaaaaataggaaattcatttatatttaaatttttgtttgtctccagaccaattagggaaccatggaaatgctaagcgaaaatctaatcctgaaatggcataaaattaatgccgcacacacacatcgttttgtttacggagttgcagcacccggatttgga

SEQ ID NO: 82707 - DNA, 1874 bp, Heterodera glycines
  Genomic contig location: Contig_ID=SeqID_2998; Location=1042..2915; Strand=+
  SCN-specific regions: Sequence locations=1-185,226-495,517-680,743 -764,853-984,1006-1060,1108-1147,1172-1429,1472-1668,1690-1813,1842 -1874
ggttctgatcactcacagagcagctattactgctgtcccatattttctgatcaatcgattgaactgtgtggatttgtttgatcagcacaagcatcaacagcaagagtgggcggggatgggaagcgggatgattgtgacgcgtacactaatgggtgtcgcggagggtgccgacgaactctcaaccgcaccaccaccaccatcatcatcatcacatcatctccatcagcagcatttcagtgtgctgctactttatttgtgtgtgtgtgtgtgtactcattaaccactgttattatcgataaaaaccggttgctagctgtgagtaaatgaattagcacatcgaccgtccgcccgcctgaccgccacacatcccctgcggggggagtggcgggagatggcggtaaaaatgggagaccgcggaacagtgtgcggacggttggtgtgtgggatggtgtgaaatattattaaacggttgcgcgggactcaattcattcaatttatgtaataattaaatttaaatgaaaattgattggagcggggcggaaagaatatgggaatggtcaaaagtcagcagaaaatgaacaatggacaagaatgttgagaaaaagtgatgattaaatgaggagagttgataaattagtgaaaaaatgcaattaataatttaatatatggcgcgaaacgagaaatttataaataaataaattaaattatttgaataattacaaaaatttttaagattttaattccaatgaactaaggctatgaccataatataaataaatttacattttaatagttaaaaaaaaagcaacagaattaaataaaataaagaaaaaaaaatttaagataaaatttgcaattaaatgctttaatggcttgctatgggcaaatcgatgggcaaaaacgaacattgatgatgattgtgtgggggaatgggtgttgtacgtgggtgtaaaatggcgaaaaaaaacaatttgtgtaaaagtgggaagaaaaatgctaacaataaggaaggaacgaagctgacacgacactcttctgtgaacatgagtcatgtcatcacagaagaagaagaagaagcaatgaacaaaaaaagaaaaaaaaagaaaatgcgaatgcgtaaatgtttaattttatgttcgaaaatgagaaaaaaattttaattaaaaaatttgtagaaatcataaacgatttatgcattaataatcgatgtatgaaagtttggacgcaacagaaaatttgcgtaaaattgaattttcgtaatcggctgatcacggatccgacatacatttcgaccacttcctaaatcctaaccccgattctgacacaacgtcgaaaatatcactaatccggcatttggaataattccaaattcgtaaccagactcggatacaaacatgtaaagcacacctcgatacccttagggaataaattttgacactggattttgatgaaaaattattttagccattttcacagaaatgcttttaattaaacaaaatgtaacatttatttaacccaattttgacccagattttctcatagtgtgtttgcatttgaagcaactcggagcttgattggggtagggagtgagctgctctcccgcttctgcttgctgattttgatgacgggaagaagcggtggaaaagcaatgaaattgaggttggatattttgcagcccccgcctcccccgcgggcaaaaatgggcaggaatttgagaagacgaagatggaaatggacacacacacggcgtgggaaatgaatgagaatgaaattgcaaaaccccaaatgaaggacatttaagagcaatggttgcttgttggtggtggtggcggtgctggtggggaggaagtagcggaaaaggcaattaacaaacg

SEQ ID NO: 82708 - DNA, 544 bp, Heterodera glycines
  Genomic contig location: Contig_ID=SeqID_3001; Location=555..1098; Strand=+
  SCN-specific regions: Sequence locations=1-34,66-110,137-213,250-544
atggttgagcacgatggaggcaccaattttgaggaggaagaaggcaaacaggaagatgaagaggaattggatgggcgcccggcccaaaagcggccccgttatgtggcacctgttgaggaggaggaggaagaagccgggaatggcaccagtgccggcaactgtacggcggaggtcgacgagctgaaggcggtgatcgaaggaatgaaaactgagcttgaagcggccaatgaagaggttggagagttgaaagccgagatgggcaagctgagcgcagaaaacggaacattgaaggcggacatccgttcaatcaaagcaaagatcggaagtatggcaataatcatccgtgggaacagagaggagcgcaatgagatgcacgaggaaatgcaagagatgaaggcggacatggccgagttgagagcggaaaatgcaaatttgaaggccgacttcggcacaatcaaagcgggcattggcggaatgagacaaatgtgcggcgagatgaaagaggagcagggcaagatccaaagaggaaatgcaagagatgcag

SEQ ID NO: 82709 - DNA, 430 bp, Heterodera glycines
  Genomic contig location: Contig_ID=SeqID_18126; Location=712..1141; Strand=-
  SCN-specific regions: Sequence locations=1-206,239-402,425-430
taaaatggcagaaaattgctcccaatttgccatcaaatgatgccacggcactgcaatcttttcacgcactgttcagaaactacagaacagtggcactgcatgaactgaagcagcaatgggaattgcaaaagtcaattgcaaacaaagcgggaagaaatgtgaaagaaacggccaaaaaggttttagttgccaacataattaattaattaccattactggtttgattttggtgtatttaaatcacaaaaaagtacttaaaaagttcaaatttactaaatgcccgataaaccctatgctgcgaccctaattttaactattgttatttaaaagtttttaggtgcccaaccgtcaaagtaggatttttagttatttattaataactcactctaatttgaaagatggacggagaaaaattagcgcctataataaa

SEQ ID NO: 82710 - DNA, 2434 bp, Heterodera glycines
  Genomic contig location: Contig_ID=SeqID_18128; Location=105..2538; Strand=-
  SCN-specific regions: Sequence locations=1-391,431-461,483-748,770 -1017,1039-1055,1077-2198,2223-2434
atgccaaaatcaagagttcaaataactgagccttttcaaaacgttggccttgattacatgggtccacttcaaattaaaagtttcactgaaaaatgttggataatacttttcacatgtttctccacacgtgggatacacctcgaattagtgacatcattatcagttcaacactttctcaatgcatttcgcagatttatttcaagaaaagggacaccgaagaatatttggagtgacaatgcatcacaattaaaacttgcatcaaaagtattacctgaagtcctaaaattaaaggacatacttaaagacgactcaattaaaaactatttcgaaaaggaaaacataaaatggattttttcaattgaattagccccttggcaaaacggagcaatcgaacggttaaatcaaaatgtaaaatcagcaatgaaaaaagcaatcggaaggaaattgatagaatttgattcatttcaaacacttatttgtgaaatcgaagcattagtaaactcacgaccaattacattcatttatgacgaaattaattcgtaccaaattcttagaccaatcgattttatactcccgcacaaaaatctatgcattcccccaattttggaagaaaatgaaactaatgacccaacatatttaccaaaaccaacttattatgaccaaacaatagagttatggaaaaagacaacaaaaattttggatgactattggaaaatttggacagaagaatatttgccgagtctgagagaaagatacaaaacagaaaataaaaacccaaagaattgtgtaaaatcttttccagaaccaaatgaagttgtcataattcacgatgagacaccaagagcaatgtggaaaacaggaattattaaaaatgtcataaaaggaaaagacggtatcataagaggtgctaatattgaactaccaagcaaacatgtcattaaccgtccattaaaattactatatccgttagagattaacaaaaatgactgtgaagagaatgagactatcacaaacttaataaaaaccactgaacacaaacaaattggtacaaatcgaaagagaaaacaaagtgtcctatcatccccaaaattaagcaaagtatttttaaacacactcacgtttcttctattatttatgcaactcttaccatgcttatcccatttatatgaatgtccaaaaaccaatgaaaaatggagaacgaagtatacaacattttgtgttgaaaatggatttactatcagacaaaataaattaacaatggaattttgttatcgtaaaatattttgtcacaaacaacacgtcataaaaaatcacccaccctattgtggaccacaatgcaaatgtcctgattggacaattttttgtagttttgcctcatatcaccgaataaaaagagaaataactgatcaggagaatattcaaaatattatttcattctttaaaccaaacgtttgttcattcaataaaacggaaaaatgctccctaatggataaaaatatatttagttcaataatgctttatgataatagcattcattcagtcaaaagtcttaatttacttcatacacaagccaattctcgaattgattatcgttgccttggggagggcaatctgacgattggtacacaaaaattctgtcaagaacacgaatgcactgacacacatggaacaaaattttgcttttacgagccacacgaaaaaacttatcttgtgaaatcagaccgagaaattatcccaataaaagcatggggaagcatcgaaagaattttttatttggctaatgacacattgatggatgaactcaaacgtaaaaaaagagaattcgatccgttcgaaaacgaacaaatatccgctgaatgtacaaaaggtggaataaaaataaacccaactcatactaccacggaattagaaattttggttgataaatactttatcctaaagcgaagtccacagagcgaagaatttatttctctacctacaaaaattactatgaacgaatataaaccagtcattaaatttatgaaaggcacaagcgtatctgagtacaaaaacttaacatgtcctccatcaccaatctgtgaattaattatctgtcgcttctgtatggaatacattcgaaacccacaatgcataggtcaaatgcattgggcactaattctgatcatgataatgctcaccctttacgttatcacccttagtcttaaaattataaaaatactataccgcttcaccatatttatttttctatcagtctacaattgcggtagaaaaagaaaattacagaaaataaaaataattaaacggaaacaatttatttatttaatcatgattaggcttttactcaattcgccgactattttttcatgtgatgaagtcactaacatggtagcaggaacaaacgactgcgcaattgatcaaaacggaaagattgaat

SEQ ID NO: 82711 - DNA, 46 bp, Heterodera glycines
  Genomic contig location: Contig_ID=SeqID_18129; Location=74..119; Strand=-
  SCN-specific regions: Sequence locations=1-46
atgtttgaaagacgtatggtaattgacatccccgaattctatgttg

SEQ ID NO: 82712 - DNA, 151 bp, Heterodera glycines
  Genomic contig location: Contig_ID=SeqID_18129; Location=740..890; Strand=+
  SCN-specific regions: Sequence locations=1-151
atggatgctaatgaaaatatgcaaacagaagacaataaaaaaggaaaagtgaccaatgatgagcgtaacttggtcgtctcatttattcagtttttgcgtcacaaagtctcatcgaaccaatgcactgatgaacagattgaaggccttgaag

SEQ ID NO: 82713 - DNA, 457 bp, Heterodera glycines
  Genomic contig location: Contig_ID=SeqID_18130; Location=40..496; Strand=+
  SCN-specific regions: Sequence locations=1-396,418-457
atgcttcgtgttggagaggctgtgagttattaccatggatttttttaaagtccgattttaactcggcaagcacaaatcttttgttgaatcgctttttccgttttcagcttgctagatcgatgcaagagagtaacccggatttggttgagcagctccgtcgtcagttcggtggagaggacggaaacgatggtggcgccggagctggaggcaatcagaacaacaacaaccagcagcctccgcccggcagtgtttgagaagtaaaaatatcagtgaaaaggagggaacggacagaaatttatgtgatggtccgattaattgtccttctccttgtgctattccttttgatttcatcagaaaaactattatattattatgtgttctctccagcaggaaccgttatttgttaatgtcacataacgcttataaatctattcttggaaaacatcttatgaaccaa

SEQ ID NO: 82714 - DNA, 451 bp, Heterodera glycines
  Genomic contig location: Contig_ID=SeqID_18130; Location=2088..2538; Strand=+
  SCN-specific regions: Sequence locations=1-451
atgacggcacttcgatacgacgcagcaaaagtggtgataactgagcaaaaccaagaggtccgaattttccatttgttgtccgaaatggccccaaatttaatatttattcaagttgcaggttgttggcctctctccgtgctttttggcgcgcctttttggcttcgtcttttctcgcggggtcgtgcggttggtggttgtccggggggtgctcggtccgttcggtgctcttttcttcctgcgtgttccgtggctttcgtcctccgagtttgggttggcttcggcccggcgcttccctggctcgggttgttgccgttgtgccgtccgtcgccttcgtcttcgcttccggcgtgttcttcggcccgtgcgtgttcggctctcttttttggctgctgcgctggctcttcgcccgtttccctctgctcgtcgcgttcgttgcttctcgcctccgcga

SEQ ID NO: 82715 - DNA, 1434 bp, Heterodera glycines
  Genomic contig location: Contig_ID=SeqID_18131; Location=1064..2497; Strand=+
  SCN-specific regions: Sequence locations=1-292,315-321,343-451,585 -611,647-670,718-732,754-1033,1064-1241,1277-1434
atgaccgagcagcactttggcattaattgcgttgacctcgaattgccgatggacatttcacaattcaccgttaacgtctcagcaacactttttgatctatcgtgtgcaatgtttcttaaagaacgggaccttgacgaactgcccgacaattatcttcaagtctcaaagcgtggcaacttgaagcctgtgaaatgatgcctacagtaatgagatgcaaaaagtagagtgattctcttgttagccgacatttttgaccgaattttgcggatgattagtgaacaaaaaaatgatgaattaataaataatttataattgagatacaatttttaaaaattgtcatgaaaaaataaaacgtagcagcagggcactactgtattgctctgtgatggctggcagatttgctcgttcttataagatttttccaaaattaaaatcagctttttaatttagcaaaattataaatgaaaaaaattaaaaaaaattaaaaaatacttttaacctaaaaaatatattaaataaattaaaaaattaattcttttttaagttgttttagaataattcgtaatttttttaaatttttttaactgcctcttgattttttaaggcatttataaaaaataaatcctttttaaaataaattgtctagaagtgtacatttgtttatattaggtttttaattttataaatcatatttttgtttatttatattatattttaccaattgtttattaaattcatcattttctaatcatccgtaaattcatttgcatatgtcggtcctaaaatgctgcactacgattatgtaaaatctcttctcaaatgacaagtttagatcctctgaacttgttgggtgttttgttggcaacaaattgcccataactcatggtcaaatattcgcgttgtgtcgtcgacatcttgggaaatctcgttttgccgcgggttttcgaattcggcactgttccagacgcagtccagaacaaaacaaaattataatcgaatcgactttggatttttcttttaccaaaaaaaagtgatttaaaaatttttttaataattattatttccttaattaaggttttccataactcgaagtttcccaatcaacattcacgcggttgaaacagcaaaaaaacgaattcctattttcttaattgattttggaaacaaccccgatcaaagtgcactccgagaaaaaagtgatggcattgagatgctaacggatatggacaaaaaggtgaatcaattttaaataaatttaagtatttattttattaatctagaactttttggggaaaattagggtttttaattatggctcgtgtagtgacctacaaaaaatgcaggtctggtctggtatatgtatatgcaatttggaaaaagcaaaaattcaattttttgaaatgttatactaattgtttataacttaagcaaaaa

SEQ ID NO: 82716 - DNA, 2189 bp, Heterodera glycines
  Genomic contig location: Contig_ID=SeqID_18132; Location=1..2189; Strand=-
  SCN-specific regions: Sequence locations=1-100,157-648,670-833,880 -993,1019-1034,1062-1069,1091-1236,1270-1282,1304-1490,1540-1901,1923- 1926,1950-1974,1998-2189
  Gene Ontology: Mol. function=protein binding
tcatgtccaaagcggcgattgctgggctaaagttgatgctgagcacgggagagtacgcggatgtgcactttttggcgggggacggagacgcaaaagaggcaaattttgaaaataaaaataataaaattcgatttttaaaaataaaatcttttttaagcttgtaccagcacataaactaattttgaagtttgcttccgacgtatttgaggcaatgttccgttttgacgccaacaaagaacaaagcgaagacggtaaaaaatggattaattatttttgttaattgattcaattagtctctgctaattaacctaataaatagggatgcgacttttagtgacgaaagtctcgaattagttaactaaaatagtgacgaaaaagtgccaaaatagtgaaaaaaaggaattttccaaaaaatgttgaaaaagtgtaaaaataatgataaaacgctaaaatagtgaattttcactattttaagtgacgaagttgccaaaattgtgatttctaatgaccaaaaaatacgtccaaatgaaaaaattttaacgcagaaatgcgttttttgagctgctttcttcaaatcaattgagcaaaaaaaaaaaatcactagaaattgtatccctaattttcaattggtttcggttgatgctctaatttaaatttaattagcatctgctaattgtcttaattatttctcaattagtctctgctaattgccctgttgtggaagtgcccgacgttgaagcagcagcgttcaaagtgatgttgagcttcatttacacggcagatttaagtgaattgaacggagacaatgcaatggcagtgctttacgccggtggattaatttttagaatttaatttattaatattgaatctttttaattagccaaaaaatacaatattcctgatttgattgaccggtctttgcaaatccccttctccaaattgcgcaatgttttcttcgctttagcccaggcccgtcttttcgacttggaggtgaaataatatttttaaattattatatggaataatctcatcgattaaatttattttttaaagaaaaacatccaatttattgtttattttagaattatgtcaacaattgcttggcttacattgacaataacgcggacattttaatcaaatctgatgcttttttgcaaattgaccaaaaaatgttgtgcgaaattttggaacgtgacgaattgaaaatccgtgaagaaatttcaatttggaatgcagtaaattttactttaaaaataaattaatttaattggaaaatatgtccattaatttaaattatttttttcggcactccgttggaccgaccaaaagtgccgtgaaaatggcattgaatgttcagcagagaatcgccgtcaaatgcttggcccggcattgttcaaaattcgctttccacttttctcaaaagaggatttttcgggaaaaattggtaaaaaaattaatttgtttttttttggtccacctcttttttgaactttttttattttataaaattattataattaattttttttaattttttttcaattgttcgctactgtattttccatattaatttacagttacatccggcattttaacagcagaagaagtggtcaaccttcaacaacaataccgtaggaattctactggtggcttactgtacccactgcaatttccgaggcacggacgacgcacatttgctgaatcgaaaatggaaatttttctggaaattgaaaaaacatcggaatttgtacgtgagaaggccgggtgcagtcggtacagcgacaaagtgtacatcgatggattgccatggaaaataatggcacaaattagcaaaccgtggggaggctttgatgaatggtttgacatttatcttgtgtgcaccgccgcttcaaaaattgatggtgaaaatttaaacttaaaaaacaatattttgtattgttttagttttaaacctttgacggacttatggcgcaataaaaaaaattcacaaaatggggcaatacaaaaaaaaagcaaaaatatttttttgttttttttaatgattcgtttgcccacgtttagccagagtttgtggttgtaacttttttctttgtcaaccaaatccaaaagattgttgggtatcattcgaaagtccttcacatgcttgtgggacctgcaaaatttcggaaaatttcgttaaggttcaaaaa

SEQ ID NO: 82717 - DNA, 59 bp, Heterodera glycines
  Genomic contig location: Contig_ID=SeqID_18133; Location=800..858; Strand=-
  SCN-specific regions: Sequence locations=1-3,49-59
tgtcctaccgggaccgggacctgagcttttcaaaacccgggaccgggaaccgggaccgc

SEQ ID NO: 82718 - DNA, 286 bp, Heterodera glycines
  Genomic contig location: Contig_ID=SeqID_18134; Location=134..419; Strand=-
  SCN-specific regions: Sequence locations=1-170,221-286
atgaagaaatctgttaccttcgctgttcccgaacaaaaagaaatcaatcaaccaaacgcggaagtggagccaccaaagtcggacactacaaagaagcgcaaggtggaggaccgggaactgtggaaattggcaaaagggaaattcatgctcgcgacgtacttatgtgcaggttaaattgaaatattaaatttaaataaataaacttaataaaatttatttagacgactgggaccgactgtttcataatcaacagaaagtcgcgcgcttggaagatggccgttttgcg

SEQ ID NO: 82719 - DNA, 965 bp, Heterodera glycines
  Genomic contig location: Contig_ID=SeqID_18134; Location=1130..2094; Strand=+
  SCN-specific regions: Sequence locations=1-198,225-266,288-297,320 -603,632-876,917-965
atggagaaagagaaagtcgagctgcaaacggatatgctgcgcaaggaaatggagaagcactttcggcgtcaaatgttggagatggaagaaagattggatcaaaaatggacttcgctggtggataaagagcgacaaagggcgcagcgaatcgcaactcaaagttctgcggttattggtcagctaatgatgacaaagggggatgaagagaaagaaaatgaaaaagaggggagaaaaaaataattatcagcaatcgctgtcaatggtgtttgggggagggcccagtttcgttcgggagtaggaaatgtggtcatgttttttgttgtccccaatgctctgtcccgataattgccagtgatgaacccaattgtctgatttgtttcgagaaagtcacccaattggaatatttaggatcttaaaatcgatgaaaaataccgaaaataattaaattgatgtaacatgatcctaaatattagtgctgctcgagagtatcagtcttgagtctaggctcaaaaaattgtcggtactaaaaatttttttaaacgcttttaagaaaataagaatgtctctttttttcagcactactaaacatgtcatctccctttcattcaatgattttattttaaaaatgtattgagaattacagaaattttggcttttagcacaacactctaattaaaatttccgtaattgaaaaccctattatgatcattgtccctcaccccccttaaattatgggttgagcggtaccggtgctggtactgtaaaattgtgtacctagtaccggttttgaccggtacctgtactaatactgattttcccaatcaaaaaataccgctttttcaatccaaaaattatcggtaccgattaccgttcaactcttcctttaatacataaatgtttttcatgcaattgaatttaatcattttaatccatttttattttgaacaaatttattgaattaaaaa

SEQ ID NO: 82720 - DNA, 256 bp, Heterodera glycines
  Genomic contig location: Contig_ID=SeqID_18135; Location=730..985; Strand=+
  SCN-specific regions: Sequence locations=1-156,204-256
cttcatcttgtccatgtcaaagatgggctctcattgcaagaagctgttgatgcatcggacgggcttgcggtcattggcattttttatcacatcggcgatgatggcacatcaatggccaatttggaaagtggactgaaaagagtggcagaaaaaggcatttttttttaaaatgaaaatataaaaattattttaaatgaaaatttctcactaaaattattgctttctactaaattgaaaaaaaaaacaaaattttcca

SEQ ID NO: 82721 - DNA, 703 bp, Heterodera glycines
  Genomic contig location: Contig_ID=SeqID_18137; Location=2175..2877; Strand=-
  SCN-specific regions: Sequence locations=1-499,521-561,597-703
atgctcaagttaaagtgtcgtttggtgtgtccaatgaaatttcaccaccatttttttacatggacccattggcccatttatttcaattagcaaatggccaaacgtcggacgattgccaatttaaaataaaccaagcaaaacttcttttaaagcaattcactgatcacattttggcttctggcgaggaacagttaaagcgaatggtttcagaagctgactttttgaagattaaattgagttctgagcaaaaattgttcgaaattggcccaaacggactgcacgagtaccaaacagtaaaccaaattcaaaaggaactcgaaaatgtgctttatagtaaagaaaatgtctcggctattaccattaagaacactgtgacaatgtttgaaataatggaaaaattcgcaatttaaatgtatcggcacaatcctttttagacggcatgcagcacattacaatggaagcaaatgaggaattttaatttgttttctatgccatttcctcttttgtattgacatgttaattacgtcatattaaaaccaccctaaactgtttccaattttggttaaattctttatttatttttggtgttattttttgaaaaaaaggttccatgattagaggattatgttttgaaaaattggaagatcattcattgatataattttataacttttcaaatttgccggcttctacttttaataaa

SEQ ID NO: 82722 - DNA, 529 bp, Heterodera glycines
  Genomic contig location: Contig_ID=SeqID_18138; Location=2528..3056; Strand=+
  SCN-specific regions: Sequence locations=1-252,274-351,373-384,408-529
atgtcaactatagatgttgaagagactatcaagagaattcaatcgcaaaaaggtgtcaccggagtgattataatggacaatataggtaagaactcaaaaaaacaaacgagggtctcacaaaatatgtttctgaaaaaaccatttttcctcgtgtttaggccgtgccattcgttccacgtttgatgatgacaccaccgcgcaccatgccgcacttcttcaacagctctgcgaacggtccaaaaatgttgtgcgcgaaatggacacgagcaacgacctgagcttcatgcggttgcgcaccaaaaagaatgagatcatgatcgcaccagacaaaggcatgcgctcgtctttcccgctttttggggcctttaaatttgcaaattttaaatttgggtgtgtgaaaaagaagtcaccgacaaatttgtaggttcaagtctgtttcttttaatggcgttttgctctcggttttattttttcgattccattttcggaaaatagcgagacatgcctctttttcacgagattactgaca

SEQ ID NO: 82723 - DNA, 1384 bp, Heterodera glycines
  Genomic contig location: Contig_ID=SeqID_3003; Location=661..2044; Strand=-
  SCN-specific regions: Sequence locations=1-1384
catttctatcactgggactcaatccaccaacattccaatcaacgggactcaatccaccaacattccaatcactgggactcaacccaccagcatttcaatcgccaacacttaaccctccagcatttctatcactgggactcaatccaccaacattccaatcaacgggactcaatccaccaacattccaatcactgggactcaacccaccaacatttcaatcgccaacacttaaccctccagtatttcaatcaacgtgactcaatccaccaacattccaatcaacgtgactcaatccaccaacattccaatcaacgggactcaatccaccaacattccaatcactgggactcaacccaccaacatttcaatcgccaacacttaaccctccagcatttctatcactgggactcaatccaccaacattccaatcaacgggactcaatccaccaacattccaatcactgggactcaacccaccaacatttcaatcgccaacacttaaccctccagtatttcaatcactgggactcaatccaccaacattccaattaacgggactcaatccaccaacattccaatcactgggactcaacccaccaacatttcaatcgccaacacttaaccctccagcatttcaatcactgggactcaatccaccaacattccaatcaacgtgactcaaccctccagcatttcaatcactgggactctattctccagcatttcaatcaacgggactcaactcaccatcattccaatcgctgggacctaacctcacctgattcttcggtatcgcaaccaacacttaattctcctgcatttcaatcactgggactcaacccaccaacattccaatcaacgggactcaatccaccagcattccaatcaccgggactcaactcaccatcattccaatcgctgggacctaacctcacctgattcttcggtatcgcaaccaccgagactcaattctcctgcatttcaatcactgggactcaaccctccagcatttcaatcaccgggactcaacacacctgcattccaatcaccgggactcagctctccgacattccagtcactgggactcaattctccggcattccaatcagcgggactcaactcaccatcattccaatcgctggaacctaacctcacctgattcttcggtatcgcaaccaccgagactcaattctcctgcatttcaatcactgggactcaacccaccaacattccaatcaacgggactcaatccaccagcatttcaatcactgggactcaacccaccaacattccagtcactgggactcattctcctgcatttcaatcaccggaactcaaccctccagcatttcaatcactgggactcaatcctccggcatttcaa

SEQ ID NO: 82724 - DNA, 617 bp, Heterodera glycines
  Genomic contig location: Contig_ID=SeqID_3004; Location=902..1518; Strand=-
  SCN-specific regions: Sequence locations=1-208,232-259,281-296,318 -357,379-394,451-546,568-590,612-617
atgtttgcattgtccacattcattttcaattacggcggtaatttggtgcagaataaacgcaattaaaagggcagtaataattgcgggtttcatgttcgtgttgggtttttatctaccttttgattttgaaaaactcattaaatttgttaaattttaacattaaatttgggttttgctttctgcggtccaattttttcattgttttatcttttttttaaaatttttttaaatgaccgccttaggtatatttataggatggattaatttaaaaatattaaaagaacttggatggtaaaagaaggaaattttaaactttcaacgattattcagcattgggtggaagagaaaaatgcaaattttttgaaacattaaatgtctgctgaattggaaatgctataaaattgattaattaaagaaaacaaaataaagtataaatatttaataattttagtaaggaataaactattaattaacaccgctaataatcatgctcgtgttcgtatcctaattaccctagccaataacgagttacaagtagtagatttaaaaaagcggaaaaatacgtcaattaattcgaactaaaaaatggtggagcgagaagaaatgacaagaataaa

SEQ ID NO: 82725 - DNA, 1035 bp, Heterodera glycines
  Genomic contig location: Contig_ID=SeqID_3004; Location=1594..2628; Strand=+
  SCN-specific regions: Sequence locations=1-66,89-421,450-563,585 -621,645-1035
atgatcactgcttgggctcagaatggcgaaatcgaatggccacgggtgttgggagagaacccaaatttgtggggaaaggaacaaaaagtgttggccgatgcgaaggcaaccgaagacaaacagttccaagacccgaaatttgaacaaaattttaagtgggtttcaccaaatgtatctttatttcctaatctgcatagcattttgttgtgcacccattaatttgccttaatttagggcaatgaatgccattggtatggctcatcgcggtgcctaccattacttcagaggagagccgggaagtgccggtgccttggagcaagtgcggcattttctaaacacaagcataagggcgggattcaatgtgcacaaagactttgctgtggtcaatgttgaaatatgtgagtttttaaaaaagtttcagtatattttaatattttaaaatattaattgccaacttggttattctcggacagtgaactcaaaataaatgaggaagggaagcgggtttacctaattagcatataattccaagaaattgtgatcgaaagttgctaattcaaattagaatctcattaatagtacactgttaattattttgttatttaattctgttgttcagataagaatgaaggtgcagacaaggaccaattcacgggaaagctgctcaattttgtcaagttactaaagagcaaagtgccgaaccttttcatccacaccagtgtcgatcattggtcggcactgatcaacaacgatcatgacgagttcttcgctcaatttccgctttcggtgatcgattatgacagtcaacagagtccggcattgccgcgcccgtggaaagtatggcagcggtggttgcacacaatgactgtgccggtgaatggcatttcgggcaatgtttggctgagtcgagtgaattgcagcgtcaaaatgatgccaaacattttctgatgagcgaaaaacaaagtgatcattggaatcatcctgttgaaaaatttatgaaattttaagtaccaaaaacatttcaaaacaaaggca

SEQ ID NO: 82726 - DNA, 829 bp, Heterodera glycines
  Genomic contig location: Contig_ID=SeqID_3004; Location=2830..3658; Strand=-
  SCN-specific regions: Sequence locations=1-122,144-167,189-267,297 -439,477-680,717-829
atggcattgccattaacacataaagtggcaccatttagtcacatgactgaatacattaaaaattttacgatgaatctaaaaatggggcaattaaagaacacaaaatttaaagaaaaggagaaaaatgtacgaaaaatatatttgacttgtccaattagtgtaagcacaaatttttaccaaattataaaatgttaagaaaaagaaaagagcgcagtaaaagcgaaatagaaagaggaaaagaaaaaaacaaaaacgaaagaatacatacatttctttgtttctctgtttcctttttcaacccatgggaaaattgactgaatattttctttcttatatattaatttttttgtttcttatgattgtgtgagtccagtgaatcgttcggtgcgattcgtcgcggagagcgaagtgcgacagtttgtggagggacggacaaaggacaacagcagcagcaacaacaacaacaaaaacaataaaaaaattcgcctggaggagcaattagttctaattgaggagggacgcgggcggttaaaaatacgcgtcgaatggtcggccattttgactgaccatcggatggagcgggaacactttgtccgttccgttgatacggacatttgtcgttcctttggtcgatgaagcggctgggctcccactttttttaaaaattgtgactcacattcattatttttatatacatttatttttgttatttttaaggcaaaaatgctatcgtaacattttctataaatcaaatcagtgattaagtaaagaattgtgggtgcaaaagcaaagaaaattctagagctcatgttaaattttatccaataaa

SEQ ID NO: 82727 - DNA, 632 bp, Heterodera glycines
  Genomic contig location: Contig_ID=SeqID_3006; Location=2477..3108; Strand=+
  SCN-specific regions: Sequence locations=1-376,399-428,450-632
atgaccttccgttgtgcacatttggcaaaacagtaagtgaaataatttgggcaaaatcttttgcgtcattagttattgcttggatgtcaagttcttcattgtcttaaaattaaatgatggtttttttatttagagctcgaccaggacttgagtccaggcctgggtttttctgcgcctgggttttcctggatttgctcagaaaatcaaggtcctgatcaaatatgaaacccagatccaggtctagagttggcataaaaatctatattttctggacaacatttagaatttataaaaacaccaatgatttagttcaaattataaaaatgaaatggattaaaatatattattatcgtaattagaaaaagggagatattccaacactattaacataatttaaatctttgattgacttttttattacaaatttcaaaaaagcaaagccaaagcctatgtttttcctagaccttggttaaaatccaggtacatgtctccaggccttgtcgagctctaattatatttgactaattaccctccttttggtcattgggtgccatcgcgacgacacaattcaaaaacaccacaccaaaaatgataagcgacttggtgtcaaacatttattatttatcgtgaaa

SEQ ID NO: 82728 - DNA, 904 bp, Heterodera glycines
  Genomic contig location: Contig_ID=SeqID_3006; Location=3178..4081; Strand=-
  SCN-specific regions: Sequence locations=1-723,746-746,768-904
atgcattatccgacgcatgtaaaacttccgcaaattgaccgtcgaataggcaaagtcgaagatgcgttccatgaacattcggccagcagcgattgccacttggggcccatagccgccgaagccgcacaattggaagaacgactcgtccatcaaatgctcgccaatcactggcaaattgtcgaaagtgttgaagtcctcgtaggagttccaggcattgatcaccttggacagaaaggaaaacttttttcattgaattttttgattttaatttaggctttgagttcattcattactcgggaaaagatttgttcatcaactgcatttttttctgtgacctttgacgaaaaaaacctacaaattgtaagttttaagaaaattgcatccggcataattcttgccaccactccaaaatttgatcgctatttctgcgttacatccatgacacttctgcaactttagcgttctccttgcttttttctagggtatggcaccgacccttcgaggtgagaaaagtcggagtttttcgggctcagctaggccggagtcgaagtccgggtcggggtggaccaaatcggtcagagttggggttcggagtttttcatttttgcctttgctcatatagtcaaaaaattataccatgtttatttttgtaaaaattgttgcaccatcatgatgaaatatttattgtaatttgccttaatcagtgctaatcgacaacctttcattaaatatttattattaaaatcagacattatttcctacatttcctctttttgttttgctcattttggtatatcgatttcgatttccttcctgtcacctggccaattccacagaattttcgtcaatcaaattaaaattttcatgtgaattttgttttcagttctcctcattggcgaataaa

SEQ ID NO: 82729 - DNA, 564 bp, Heterodera glycines
  Genomic contig location: Contig_ID=SeqID_18140; Location=358..921; Strand=-
  SCN-specific regions: Sequence locations=1-201,223-495,517-541,563-564
atgatttttgttgtcggcattttcaggggaatttggcaatgtgtcagttgctgatacactacggagccgacggtcagtgagtgggtgatgagtcacttttggccgcgacgccggcgaagggccaaaaacagcagaaaaatcagcaacacaaccacaacaataataacaaccgattgcgcagctcgtgtccatcgacaatttcgaatgcaaaacacaaaacaacttacggaaacgcggctccaagaatttaacaattttttgagtttatagagtgatggtgagccaagcgatggtgatgacggtgaagctgtacaacgccactctgacgaggccgtgttggacgcacttcggcatcaattcgccatgcttcggctggacgaactgcgcgagcggttgcgccgccgcaattgcattgcggggccaatgaatgcgggcaatcgacgcatttacgaggccaaattggctcatttggagacacgacaatggcacggaaaaggaggacaacagcagcagcagagggacccaaacgcaataaaacgtaacaaaaggggcgggaatttttaa

SEQ ID NO: 82730 - DNA, 841 bp, Heterodera glycines
  Genomic contig location: Contig_ID=SeqID_18142; Location=309..1149; Strand=+
  SCN-specific regions: Sequence locations=1-602,624-689,721-841
atgccctcgggacattggaccatttggcgaccttctccatgcgcatacgaatcaacagcagtcttctgtcaatgttttgccgtcgaacccttcgaaacggcacagggaaaggctaaacggagaattggagacggtgagttacggtattcccattcgatgggaacaaaaaacagtgaaattaatatgggccattcataattgaggataattccagcgattgttttgctctcttttcaggtggcctctctgttgccctacgaggagtcggttcttcaaaggttggacaaattgtcagtgctccgtctggcagtcgcatttttgcagatcaaagcacatttccaaggtgaataaaagtgattagtacgtgctatttgatgttgggtaattatcggtgatattctgctaatgaagggtggacggggaggggggcaccgacttgaaaatcatatccatccgtcatgctaaaaggggttcatttcagtgtcgagtggggtgaagaacagctgaagagaaactgagaagttggcacttgacaaatgaggggagagggaaaggcattgccaatgggcatttaccaagatattagtaccattctcaattaatgaacaaacaaatgacataacgaaatgtccatccgagtacgaagggggcgagaaagacaaacaaacggcgaaaatggcacaaatggcggaaaggggagggggagggggagggggggggagtgattatgagaaagcgcgagggaatggccaaagcggcacggaacagtcaatgggaggggtcccttttttgggcttctcggcgggaaatttcggcaaatctgaggacaaaaaggagacaa

SEQ ID NO: 82731 - DNA, 324 bp, Heterodera glycines
  Genomic contig location: Contig_ID=SeqID_18144; Location=68..391; Strand=-
  SCN-specific regions: Sequence locations=1-38,96-324
atggcgtacggtaactgtgtgaagcgtgccgatgagaaggtgaatttgggaaattaaatttgtttttaaatgtccggggtattttcccaatttttctgtttgtgccggatttaatccgaatttttcaaattaaatgcgcccgtagcccctggggggaggggcggtggaagtgctaattgtttgaattgtatttaaatgctcatcaatcagtagacatgggacgcgtggggcaaagaaataaacaatgcgttgagcggaggtgggctttaaaaattatgaaataacaaataaaattcgaattttcaggcaaaattgacctgctaa

SEQ ID NO: 82732 - DNA, 1128 bp, Heterodera glycines
  Genomic contig location: Contig_ID=SeqID_18146; Location=1589..2716; Strand=+
  SCN-specific regions: Sequence locations=1-130,154-242,364-1128
  Gene Ontology: Mol. function=low affinity sodium:dicarboxylate symporter activity; Cellular component=integral to plasma membrane; Biological process=transport
gtccgcttggccttggccatgctgaggccggcgaagcgccttttgacctgcattttggtgccccttttgctcagcccattgccgctgtttttcagaacgaaggcaaatttgaataaaattgtgaaaaatgaaataaaaataataataaattaacaaaaaagaaaaaacccacaaatgggttaaggaggcttcctgcgcttatgtggtgatgataatggggtcggttttgggctctgtttttcaatatataaaaatgttaatttattattaataaccctaaattttctttttcatataattttaattatattattatttttttgttttttcaataatttaaaattttctttttcttttttataaccctttttaattccaaatcttaaaacatttatttatttatttatcctttttttgttatttcccccatttagcctgtttttggctcaccgaagcattgccattggccgtcaccgctttggtgcccgttttcgccttccctttgttgtccattgacacggccagcagagtgtcctccgtttacctatcggtgcattttttaacaaaaaaatcactgaattttcaatgataattttgtttttatttttttgttaaggatagcaatttcgtttttttcggctcaatgataatggcaggtgaataactctaattggggatggcttttccatttttaatttgttcgactttaattgcccgaagaatttaatttaattgccctcatttgtcagttgcggttgagtcctcgcgacttcacgaacgaattgcgctgaatgttttgctgctgaccgggccaaacccgcgctggtatgcccataatttgcccaattaaaaattgttttaaactctttaattgttaattaggctaatgctcggcttccaattggccaccgcttttctctccatgtggatttcgaacacagcgacgacaatgtaaaaatagtcaatattaaatatttgaaattgaatggatgcaattttaggatgatggtcagttttgtggtgacaaaagggggaaggaacatttgaaacaatcaaaacgatggcattttgttgaaacaataattttaaatgcaggtgccaattgttgtggcggtgatcaaagagttg

SEQ ID NO: 82733 - DNA, 1006 bp, Heterodera glycines
  Genomic contig location: Contig_ID=SeqID_18147; Location=1248..2253; Strand=+
  SCN-specific regions: Sequence locations=1-128,151-195,220-251,307 -325,351-502,539-645,721-1006
atgtacaccaataaaattgcaatcaattttttttttgatttgaaactacgcgatttaggttgacaatacattctaattttacagcaatttacttcgtacctttgccctttaaatcgttcaatgaattctttattttttaaaataaaaaatgcacattttatgattaaagtataatttttggaattctcttaaaacattttattttaaatttaattataagtttcgggcggtgcctatcggcaccggtcatcattaaatattataatatcgtttactaaaaatttttaataaatataatgaaaatttctggtatttgatggtactcataaatatatttaaattattataaaccgtagctgccactgaatatttgccgccatcgaacaccagcttgcccctcatgacaaaacttcttcagagtcttctttattctaccgtttacctaaaataaagttaggatttaacagatttatgtaaggcttgatataaaattttcagtaagtttatttttaatttaatttaattaatttctataaaacaactatagttttgtaaagttgttgaatgtgtatccaattaatcattttcgtttaaatcaattttcacctttttgctaattcgctttttatcatttttttgttaaccaaatttttttttaattttttataaattaaagattttttatttttctcataaataatttttaattgttaaaaattacatagcctaaaatttttagccaaaccggaccggacttttaaggttgaaaaaccggggaaaaccgggaaaaaaccggaaatttcccggtcccggtcaaaactggtcaaaaccaggacttcggtactaagttgtccgtgttttggtcctggtcccgaccaacactacctgaaactgatgctcccccttagagatatgtagaacaatattttttcgttgatttttatttatgattgtatttatatcttattttattttttgccatgaatcattattgttaatcccttta

SEQ ID NO: 82734 - DNA, 129 bp, Heterodera glycines
  Genomic contig location: Contig_ID=SeqID_18147; Location=3260..3388; Strand=+
  SCN-specific regions: Sequence locations=1-129
atgaccatgagagtgaatataaatgtaatgctaatgaaagatatgggagaatactgttcaaaattgttaacattttcgttggataatgaagcatgtacagaggggaatagcgatataaaaagaagaacg

SEQ ID NO: 82735 - DNA, 1305 bp, Heterodera glycines
  Genomic contig location: Contig_ID=SeqID_18148; Location=200..1504; Strand=+
  SCN-specific regions: Sequence locations=1-55,95-206,228-520,543 -547,571-777,800-811,833-1037,1060-1305
atggtcgaagatcggccatacatcaaaattatttcgggccttgaaacggtatgccaaaaaatctctttttaaaataattttggttgcattaggaagcccatccggcatttaaaaattacctgggcgagttcaaatatttgtgggtcgatttccacgccgttctgaacaaagtgttgcgcataaatacgtcaaaaaattaccagcaaattgagaacagttgccaaatgtcggaggaatcgcccgtggtacggcaaaatggcacaattcagctaatgttacggcccgaagtacagtaaaacacacggacgattttgatcatgatcatggaaagggttaagccaaaagcggggtctgttgtcccttccggttcctatttgttgatcaacaaaagtgatcgatcagtgccttcacatgagtgatcaaaaggcatttgccgcgtctgatcgggccgggaactgcgcttcactttcttacatatttatgcattccaaaaacggcagtgaaatcaaactgatcaaagaatggacaagttttatcctaaaataagaaactgatcagagaatggaacagattttattccaaataaacatggtgggggttctccattttatgagtccattaattcacagacatttattttcatcctcaatttttgttgggtcattgcttttttatggcacatattcattcaaaagttctaaaatagtagaaacagaaacaaaacaaattctcacaaaatggaaatgaaaagacaacccaaaaaattgtgattctgattaaaaatagaaaattgcaaaagtaactgaaggagattaattaattaattaattaactggacttggctgtattaaaataagttgattttgccaatttacaaactaagtaggtttcttaaattttgaatgatcaaagactgaccaatcagtttcatcacttccaattggtcaattccgttcatatgatcagtttcatcacttccaattggtcaattccgttcatatgtttggggtggctgggcccaatttctttcaaaagcttattatttattcaattaatttcctaaatttccgccctattctaaaattttcgctttttcagtcccttttttgcgattttggcaaaaaatttgcatttgtgaagcattattttgttgaactgaagagacaggtcaacatggaataccaattcattactgaggcgagtgaaatgctgaaaaagatggaagaggcctatgaaaattggatggggatttgcgggacgaaatgccgaattggaaatccaaaagtggcggacgacgtccaaatg

SEQ ID NO: 82736 - DNA, 933 bp, Heterodera glycines
  Genomic contig location: Contig_ID=SeqID_18150; Location=1219..2151; Strand=-
  SCN-specific regions: Sequence locations=1-405,427-631,661-933
atgcgctgggaacagaaccattggcacggcgactgggatgagcaaatgcgaacccatcccgagacgatttaccctgattacgatattctggtcaactcgaagccgtacttcctgctcaatgccactttaatctcacgctttcccaaaccgttgaacgggcagcagttttttgtttggttggacgccggatatggtaagcttcggcattcgatcttacaaaaaggatcagtgaattcaattctgtacgaagtgcttaattaacaggccatggatctgcctcagaaataccctacggagtgtggtcgccggtgctaaaatcagataaaatcactttggttcagctgacaccgaaaattgaccgggtcgaacgatacactttggacaaggcaagcagagcaaaagcgaaacaaacggcattggcaatccctcaaatgtcccttccttccctttaaggtgtatcggaaacaaaaatcggtggtcagtggaggtaaacaagcgtcccaatgcgattttcgcctttccaattttaggcttcttagcgggttcttccgagacaatcaaacgctttcacatatttttccacaagtccttcttagagatgttggacgagaaaatggtggacgatgaccaggcactaattaattaattaattatccatttgctttgctcttccgaatgtccttttcacttttcagacgactttgctcgtgacgatacaaaaataccaatccgatttcaacatcatattcggtggatggttcgatgccttcaaacttttgcccagtcagtgaccgttggcgccgcgcccgacgaaattcgatactcacttaatgcccactgcacatgatctaattcgctaaattcaattcatttcctattaattttaaaattttctaatgaaaaaacaatttttcattttaaccgtttaataaa

SEQ ID NO: 82737 - DNA, 429 bp, Heterodera glycines
  Genomic contig location: Contig_ID=SeqID_18151; Location=26..454; Strand=-
  SCN-specific regions: Sequence locations=1-21,43-91,113-242,299-429
atgagtagagttcgacctggacctggatccaggcctggatttttcctggatccaggtccaggttttgacaacctggatttttcctggacatggattttcctggatttttgtccaggaaatccaggtccaggtcaaatgtgaaaaaaaatccaggtccaggcaaaacaggaaaaaacctggattttcctggacaaaattttagaatttattatttcaagtgaccgatattttttcaagttttcaaaaaatgattaaatatatttaaaaacaaattattattgtaaattagatatttttagatgttcccaagcaattaattgaatttttcaaacatttttttgatttttaaaatgagtttaaaaaaatccaggtccaggtctcgaggagcctggatttttcctggacctggatttagtaggtcgtaataaa

SEQ ID NO: 82738 - DNA, 770 bp, Heterodera glycines
  Genomic contig location: Contig_ID=SeqID_18152; Location=142..911; Strand=+
  SCN-specific regions: Sequence locations=1-53,75-492,514-711,756-770
atggactgtcccaaaaaagttaaaattccccctgaacttattttggagttggccaatttccttcattacaattttcgctggttcggcatccgaatttctttgttctttgaccattttctcgccaaaaatcaaaggaaaattcgtcgcaataaaattaaggtataatgatttttcctctgcattaaataattggaaatgagaacaagggaaggtccattacagaactcattagacatttggtacctagtttttaatttgagctttttctcttgggtcctttttcaaatccgtttattttttctaatccctttattaattgtgtataattatactcccaatgctgttttcagcaactctttgaagaaatccgtgctcaagagaaagctgtggccgatgcgaaaaagttgttggaagatgcagctgttcgtttcggagaagcaactgctcgtctcaaagatttgaagcagcgctacaaaaagcttgtctcatttttatatttcgatttttattatagtgactaatttattgcaaacacagttggagtccgaaagaccggttttgacgccgcagatggttcccagcagcgaaactccaagtcctgaacccgtctcatcggtactgtaacttcaaaatttctttgctttttgtattttatggcaaggtgttccgtttaagtatctgagtagtgtcaacaggcgccgccatggattttatatatgaaaataacaattttctaatatttttcttgaaaaacttattaatttccaaaa

SEQ ID NO: 82739 - DNA, 754 bp, Heterodera glycines
  Genomic contig location: Contig_ID=SeqID_18153; Location=389..1142; Strand=-
  SCN-specific regions: Sequence locations=1-334,373-754
  Gene Ontology: Mol. function=enzyme activator activity; Cellular component=nucleoplasm; Biological process=meiosis
gtgtgcggattgaaatggtctccgaacaaagagtatttggcatccggtgggaatgacaaccaattgttggtgtggagcctgcgacggtcggagcccattcagacgtacacagagcacaacgcggccgtcaaagcattggcatggtcagttggggacgtcccaacacgggcgatgggggaacacctacaaaatcagtggaaatttgtactccgaaatactgtcctcatattttgtaggtcgccccaccatccgagcattttggtcagcggtggaggcaccgccgaccgatcgttgcgtttttggaacacaatgaccggacaggcaatgcaatgtgtggagacgggcagccaggtggggaagaaaagggcgaggtcctccgtcccttaacatgctgttccaaattgttaggtttgtaacgtcgcatggtcaaagcacagctccgagttggtgtccacccacggctactcgtacaaccaagtgattctgtggaaatacccgagcatgcagcccatcacaaagctgtccgggcaccagtcacgcgtactttacttggtatgtttggtcgaatgaaactgaccgatttcattgtttactagtaattcacttaataatccctcccaaggcgatgtccccggacggcgagtccattgtcactggggccggtgatgagacactccgattttggcacgtcttttctaagtcatcaaatctgaaaaccgtacgttcgcgcctcaacttgcacagttgtatccgt

SEQ ID NO: 82740 - DNA, 1177 bp, Heterodera glycines
  Genomic contig location: Contig_ID=SeqID_18154; Location=1..1177; Strand=-
  SCN-specific regions: Sequence locations=1-116,139-271,293-543,565 -972,994-1177
  Gene Ontology: Mol. function=enzyme activator activity; Cellular component=cytoplasm; Biological process=meiosis
ttatcattttcctttttgttaagacagtcaacgtctgttaaaatcaccgcgaaaaccgcagagaaaagtgccgaagaatccgtacaaagttttggacgcgcccgagttgcaggatgatttctacctgaatttggtctgtttttaaacaacaactgctttttcccctgcttatttacgtaaaccactggtcagtcaccatttgctactccgtagtagagaaaaacaaaccctcaaaaatgctaacgaaattgtcaagaaaattagtcctaatatctttaaaatttgccttctttcttcataatccatctcaattatgaatttgttttcgaacaataaatgcaattaaatttgcaaataattcttggtcaaatgcgtttgtccgcaaatttggtaaaaacacaaaagatcatatcccattttgtgtcctggctttttaagtttggtccatctcgctctgttccattattttatttgttgtttttaggttgattggtcctcccaaaatatgctttcggttgggctgaacacgtgcgtttatttgtggagtgcctgcaacagccaagttgtgaagctgtgcgatttgagttcggagaacaacgaatcagtgacgtcagtccattggtcagaacggggcgatttgctcgcggttggcacgcagaaaggctttttgcaggtgaactatgaatgcctgttaatttaaacgagacatttgtctttttttcattcaattctttacatatttatccgtttttatggcttcagttccaaaacttggacaaatttttgaccctcgaattaaaaatcaatcaggaaagggctcctggttagtcctttacgggatcatatccgatctgtgctctcctaatcatactaattttacagatacatattttgagaaatataattgaattcgttttctcagatttgggacacacatgcgcagaaaatgctgcacaacttgaaaatccatgacatgcgcatcggttgcttggcatggaacgaaaacgtcatttgctcgggctcgcgtgatcgcttcattcttcaccgcgacttgcgcgacattcaacggtcggagaaacggatgagtgcccatcggcaggaggtgggctttcgagaacacacatatattctgacaatgaattcgaagcaacgacatcataatttttggggggggggg

SEQ ID NO: 82741 - DNA, 969 bp, Heterodera glycines
  Genomic contig location: Contig_ID=SeqID_18157; Location=497..1465; Strand=+
  SCN-specific regions: Sequence locations=1-244,266-969
atgacgagaatcgtgaccggtccaaccaccgcaacacataaggcctggatcgtgctgataacctgcctggctactcgtgccgtctatcttgaaccggtcctggacctaacggcctcgtcatttcttctcattctgcgccgcttcacgtgccgacgaggcgtgccaactcggatccttaccgacaacggaactcaattcgttctggcatccaaagtttccgcggctctcgaagccggcagagtgccaacttcagcactggaccgattcctggcacgagaggcaatccattggcgttttatccctcagttgtcaccttggcaagggggagtctacgaaagactcgttgccttggtcaagagctgcttcaaacgagagcttggccgcgtaatgctctcatgggaagagctggtcacatacacagccgaagtcgaagcagtactcaaccaaaggccgctctgtcatgtctctgaagagcctgacggaatcctgccacttcggccaattgacttcctccttccaagagcaaaacttggcattgcattcactgccgatactgacctcgatgagttccgaatttcttccaccaatcaaagagatgcgcttatccagcgttggcattccgtgtcatcatcaatcgaccatttctggaatcgctggcagaaggaatacctgctgatgcttcgccagagattgcagtggaagttcaagaaacagaggaaccaaattgcgcgagagcccatggaaggagaagttgtgctgatctctgaagaaaaacttcctcgcaactgttggccgatgggacgaattgtcgagttacaacgctcacacggggagattcgaaacgccaaaattcgattggccacaggaaaggtgctaagccggcccctaaatcgtctttatcccttggaagtggcttcccctgccggacaagatgagagccaccagcagctcgacaaacccgccgcttga

SEQ ID NO: 82742 - DNA, 1693 bp, Heterodera glycines
  Genomic contig location: Contig_ID=SeqID_18158; Location=670..2362; Strand=+
  SCN-specific regions: Sequence locations=1-703,726-823,847-953,975 -985,1016-1065,1091-1101,1123-1243,1268-1297,1319-1452,1511-1693
atgacaaatgaatacaaacaaaaaggaaaatattcgcaaaaagaatggaacaaaaattatgccgaaatttgtaagaaaattggagtaagcaaagggacaattatcaaatggaagaaacagtttggcattagtcttaagagaataacggaaaaagaaaaaatggcaaaaatgaaaatttattggcaaataaaaagagaaaatccaaaaataagtgaacagaaaattgccaaaatgaccaacacttcggcgaagaacttttggaaatggaaagccaaatttggagaagcgaaataatgaggaagaaatgaaagccaaaaaagaggacaaagaaattctcgaaaattcggaaaattatattttatgtgacttttgtttttgttcattaacagggctgcaaaaaatatgcaaatgcataagtagtaacccctgccacaccttcgccgcttgacgctaattagaagtgacaggtggcggaggagggtgtcaattagtcactaattgggggggggggtgtgctaattggtcagcggtcaagagggcactaattggtcagccgtagggtgtggggtggtgtcaattaattagggaaacctaaacctatgcgaggggtgtgtaaaattttcatgtactttttttttgacataaaatttgattgatttaaaaagtgacagccgagggggagggggaatttgattggtcagcgaagtgacagatgagggaaaaattcaaatttctgatgggcggggatcggaaaattatgattgatcaacaatgtgacatttgcgggggcattcaaatttgcggggagcggggtgggagggtagagagggatatttctcatcttttctctgtccacccctgtccaaacagagcaatgcatatcgatttgacgggggaacgccgtcactttctcaccgctttactcattgccattaaatgaccaaacgaccttttccataattctcccctatttttaggtgtgttatttttccatatttttctcaacatttgttcaacaccaatggcgcccgggggcaaaacgtatgctcgacttaaaaatgtgagtaaatgaataaatttttgatttgtatttttcgtaagtaaatgactaaattttgttatgtcgttaacatgtttaggcatcaaagcccatcggctcgtcaagttcatcgtcagaggatgaacttcccagcaggaaaaaaaggccactgccaaccatgaaagcaccaatggtcagtttaagtgtttaaaatttttgaaattttttcgtccttttccgccagtgaaaaggatggattttaatgagaaaaatttgtaccaaatgaaaaaaaaaattcctttttttttcttaatactttagaacgttgcgaatcgaaccggcctgggcaccgacactgcactggtccaacagccagcaccaaaaaaattgcccattacacgcaaaagcgtgggtttaaaaaattaattaattttatcaaaataataaatattcctttttttttaataatttcccgttaattttgtaggccaagggaaatgccgccgcaccatcctcctccgtttccgtccgcaatccaacgcgccgcgctccttcaacccgtaaagctgttgcacaacaaccgcaacaacgcaaattagaaaagcgaaaagcggtaaatttgtgctgaaattttttatgtgatttttcattaaa

SEQ ID NO: 82743 - DNA, 574 bp, Heterodera glycines
  Genomic contig location: Contig_ID=SeqID_18158; Location=2488..3061; Strand=+
  SCN-specific regions: Sequence locations=1-409,549-574
atgcgttgtaccggctcctcttcgatggcagcaacgagaactacttcacccatttggagcgagcccgtcacccgtcacctcgtccacacatgcgccgtgtgtgcgaagaagtacgagttcgtgttggtgcggttcccggacactggagtcgagacgccatggcatcctgtgttacaaaagcatcgcaacattcgtgatggttggacgttgctagacctagcaatgttggtaagcgaaatttgtttcaattttttgaaattggtcatcgaaaaaaaaaatatttgaggagcccgacacaatttacgcttttgacgcagcatggcaacaatgtgttgcacctgatgaagcgattggagggaatgaaaatgatgacggtggcgatgatgagaacggcagaggaaacaacagcggaggaagaaacaagaagaagggtggccaaagacggggcggaggaggtgggcaaaaagacggaggagggagcaaagacggagtgaggaggacgaaggaagaggcgaagaagaaacaagagagagaggagacgaagaggaaacgtaagaagcaagagaaaaattga

SEQ ID NO: 82744 - DNA, 366 bp, Heterodera glycines
  Genomic contig location: Contig_ID=SeqID_18161; Location=649..1014; Strand=-
  SCN-specific regions: Sequence locations=1-56,101-112,153-328,365-366
atgaaaatttgcttgacgaaaatcaaaaaagcacaaaaattcaacgattacgaaagtaataaaaaatataattaacaaaaaaatttttatttaatttttagctttgaaattcggccaattcttccttcttcacttcacacagaacacattgaactcactgaagcggttgtgcttaacgttacaaacaaaagttgagtttagtttctcgaacagtgcaattttttgcataaaaatgctttaatggacggttaattgagtcaatttttgttgaaatttttgtgccaaatttttcatgatttttttgaaattttctgaaaagttttgtttctgtaattatttctttttatatgtttatcaaatattaaa

SEQ ID NO: 82745 - DNA, 87 bp, Heterodera glycines
  Genomic contig location: Contig_ID=SeqID_18163; Location=860..946; Strand=-
  SCN-specific regions: Sequence locations=1-87
aaaggagactccaccttctgctgctggtgacgtcgtggcggtgccatcggaacgcgttgttgatgagcagcaaaaggaggacgaggg

SEQ ID NO: 82746 - DNA, 1191 bp, Heterodera glycines
  misc_feature (403)..(403): n is a, c, g, or t
  misc_feature (416)..(416): n is a, c, g, or t
  Genomic contig location: Contig_ID=SeqID_18165; Location=583..1773; Strand=+
  SCN-specific regions: Sequence locations=1-122,144-189,246-521,543 -567,589-593,615-621,643-668,691-826,848-901,923-1114,1136-1191
atgagaatggctttcatgttcgggtggatgaccgatgtgcgtgccaccaaaatcaaattgacagtggacaacggaatgcaacaaaatttatcaacagttcaatggcaccgccgaagaacaaaagaaacagttcaaagtcaattggtgcagttgggttcaatgatgacatacctatatgtaaatcgctgcttatttaattacaaataaaaattattttaaacaatattaattatttcaatttaaatgaatctatcccacaagtaacttcttatttcaattttaatgaatagcaaaatctttggtaatagaaataattaatgaaaagtgacaatttaattttgttcagaatctcttttgtttccaggtgtaaaatgaaaaaaatcttatgaatctccgccaaatntggtcgattgtcnccgacggtaaagacgcaactcgttttggtcaaatttgtttttaccccaaatcgttttattattccaactcttttataaaattgaaacgcgaaaaatcgaggccgaatcaattagaatttttaagtcaattgcgattcaccttttttggacgaaatttttatttttaatagaacctgaaaacatatttcctgctgttttctgggtagctagcttatcacgaataacatacatttcttccgataacaattaaaaattctcaaaaaacaatatatttctttcgaaattcaaatctgaaccttaaaacattagttcaaaatcgcaaaaattggtattgttgataaaaaatctgttaataaatttggggaattggagatgggccaaatatattttgtccagtcaacactggaataaaactttattcaagtaaaaattgggaagcgacgatattttagaaaacaaaattgagggcagtataaaattaaaagaatttcagagcataaaaaataaactaaaagcgaatgatgatgaaaaaagggatggaattgtgaactagtaaagggatgcttccttgcgatcgagttgatagttagttgaccatgatccagtccggaaggttgtctccgatgttaaaagggacattgtggcatgcttccgctgtgaattggacttcaagatttttttttaatgctaacatggcgatttgcctttactcacaaagacaaaaaaaggcacctgccaattttgacgatgaaactttgccgttaattttcgttaa

SEQ ID NO: 82747 - DNA, 1227 bp, Heterodera glycines
  Genomic contig location: Contig_ID=SeqID_18167; Location=332..1558; Strand=+
  SCN-specific regions: Sequence locations=1-350,381-567,615-632,654 -908,931-1032,1093-1227
atgtctattagtcgagaacatacaaaagaagatgaaattgaaatacgactgctgaccaattcgttgtgggtccaccgactcgtccgaaccagcaagccgtgcactctgttcgagttcaaaaacgaactttacaaggtgctttggacgcgtgcagaaggatatgagtcggttgcagagatcgctaacgaattgtagtgagtttgttttgttttcttcacggttcttggtacatgggaaattcagtatgaattccgggatttgcgcgatttatttttcacgagaaaggggttacgatacgtttgaggagatggtgcattcggaggaactcgaaaatggtgatttttcagactgataatttaaattttatttttcccttaaagtgatcacaattgagagaattccttggaaaccatcctacattatgtaactactaaaattatctttggagaattcatttacctaattttgttaagttatcactaccgtgcaacgctaaacaacgaagggatcttttccgatattcgaaagcgcaatcaacagaaaaagaaacagtcagcagaaaaggggaattttatttgtttttaaaaattttatactacaaatttaattttaaacttttgttgtagaaagtcttgaccatttttattttgccttcgtttgtttcactttcctaagcaaaaaatgttcagttacaggaatgcttcgttccaagatttgaatcgcaaattggctggactaccgacggaagcggagcttcggatgagtgcgagaacggctgcgaagagagcacgcaaaagcaaacaaatttgtggggaaataatctcttacgaaatcgatgttggaagtgacaacgatgacgaactgaacgaagtgacggaatttattggggacgacggcgacgaatggacagaaggcagagaggacggagactcttctggagggtaagcggagaacgaaggagggggggggggggattagcagaaagtaattggctaattagtgaaatgggacaaaaacgaattaaatgcaataattttaggtatttgttttcatagaaaattaaaaattctttttatgatacaaaaatattttagttctgtgtttgctgaaaatattgccatcgtggagaaaacgaaccatcacaacgaaaaaaggaaaagggacaatgagaaagaatacgcattgaaaatgggcaaatgcttttcatcagacttctacgagatttga

SEQ ID NO: 82748 - DNA, 643 bp, Heterodera glycines
  misc_feature (553)..(554): n is a, c, g, or t
  Genomic contig location: Contig_ID=SeqID_18168; Location=750..1392; Strand=+
  SCN-specific regions: Sequence locations=1-3,44-128,191-569,591-643
atgtttgaatttatatatttgtttcttatttttccaattttttgtggcggaatgcaacattattcaccttcatcatttaaaggaggaattataaacaaaattattcgaattccttattcaccaggtacaaaaaattaattattaatatttgaataaaattataaaaataaataaataaaaaacaaaaattcacgaaaattcacgaaaattaagaaaaaaatgaaagctttttgttaaacaattaaaactcagcaaataaattatggcgtaaaatttgtattggcgcaaaatcaaaccgaaatttgtccacagcaaataataaacgtagaaagacaaaggccatacgccgaagaaaagcggcaatttggcgacctaaagccgacaaaactccgatggcattttcctttgtttttttttgttggttttacgctcggaaggggaataatccgttgcagcaaaaagccgaagaaaagaacggacagaaagaggcagagcagaactccgaccaaataaaaggcggcgacactccgcacaaaggcgacgcgggtataanntttagatggtatgacaccctttttgaaaaatttttcgtgcaattttttcagcgagaaattccgaaacgcttccaacgcagccatattaa

SEQ ID NO: 82749 - DNA, 978 bp, Heterodera glycines
  Genomic contig location: Contig_ID=SeqID_3010; Location=809..1786; Strand=+
  SCN-specific regions: Sequence locations=1-433,456-920,953-978
atgaaattattgtgccgtcatttctcaacaattgcccatctctttgctttgtctttttcaattttggcgatctcttcattgaatttccggccgatgacaatgccacggcatcggatggacaagcggtggccaaatggctgttcactccacacccaaacaatgtgccaaaggtgctggttgcagatgcatgacgtgaatttggcgtcgaagttggacgccttcaaagcggtgcttactaatttatttatttggcgtttttacggtctttggagtcgctgaaaaaaacccttattttttcactattttggtgttttgtcactttttcccactatttcgacattgtttggaaaattctcaacacctctaagaatcgacaaaaaattcacccctaagaatcaacctaaaattaaaaaagacacccttaagaattggaaaattttcaaaatgtaatttttgactgcgtggcgcaagtgtccggttttgctaggcggcccaatgccgcggcgcaaaagtcacaccacatctctcatcaaagtagccatcattatgggttctcgtatcgccccaacccaaaaagtggcattaatttattatttaataagtttttccacattttaggcattttccaatgcttcttctcccgtcaattttatcgctgtcatttggtttccgtcgtcttttgctgcttctgttgtgccctttgatctgatcaacgaattgactcgggaacaattggcattgaaaggaactgagtttagcagatgttttctgctggtccgttgtccaattgcgcgagacgcgagcaaatggtcaaaatgggaaaaggaagcgattaattggcgaattggtgatcagtggaacagaattgacattcaaattaatgatcaggatggaatcgaagatggatcagcgaatgctttttcaaaaatccaaaataaatttgaaaaaagaatgcttttattccaaataatgttttaa

SEQ ID NO: 82750 - DNA, 647 bp, Heterodera glycines
  Genomic contig location: Contig_ID=SeqID_3010; Location=1794..2440; Strand=-
  SCN-specific regions: Sequence locations=1-89,111-342,364-388,410-647
atgtgcaaaccaacttcgaaaagcctaaaccttcctccactgtcagtttttcttgagtacgttcgttcatcaattcaaaatggcataattttttgcaatttctgatttttaaccccgaaatcttattcttgaccagcgttatctttattttaaaaaaattcaatttcatggctataaaaatgtttgtttttcgattggtctctcattgtgcaaaaatatttccaacataattattctgccctttgtgtgaccacatttgaaataaggcaaattgtgctaattgcctgaaaatgaaccgacggtaaacaattttaaaagtcacaaattcttcatttatttagctaaaccattttcacagtttcagctgggtctgctttgacgtttggatggatattttccccctttttgaccacgctcaacttggactcaaattggcactgatttcgccacgtttcaattctctggtggacaagcatttcgatggcaaacgcgaattgacaatttggggttcagtcatagtttccaaggacagtgacgcagcggtggcaaaattgtttgtgtttattggtgccaattttgtgggatttccattgcccgaccaatcgctgcccagcaaaatacgcttcaatcaacttgagattgagtaa

SEQ ID NO: 82751 - DNA, 490 bp, Heterodera glycines
  Genomic contig location: Contig_ID=SeqID_3011; Location=1987..2476; Strand=+
  SCN-specific regions: Sequence locations=1-380,403-490
atgcgtggagcagtacaaacatttgtttgtcttctcgacggagaatttgcgctctgcaaggctggcggaggtaaaaattaaaaaaaaaagcattttttccataaatttttgggacggacggtcataaataccacgtttcgttgagtttaaaaaaagttatggccaaaaatttcggaaaatcagtttttttaaatgttttttgtcataacttttaaaattttgctgacagatagagaacactagagctatcgaatggtagataatacattggttcaatttggactaaggaaagtgggtacttgtgggttttcggcctacaccacaaaatcgctgcgaaccctccccccctcttttacaccggccctccccttcgctgcgaaccctcccctcccccctcttttacaccggccccccttcgctgcgaaccctccccccccccaaaaaaatgtatgttggtaatactgacttttactggtcccataaaaaagga

SEQ ID NO: 82752 - DNA, 211 bp, Heterodera glycines
  Genomic contig location: Contig_ID=SeqID_18170; Location=668..878; Strand=-
  SCN-specific regions: Sequence locations=1-211
gatgaattgatcggagaagtgctcaacttaattcacgcagaaagcccggaacagtgaccgtcttgatgcttttaaatgcacttacgagaaaaaaacaattccgcattttggtctcacttattatgctcattttatcctctcaccaacatatgacattgtccaatgcttctttttttgcatttataaacggtgagttggatcagaccgggtc

SEQ ID NO: 82753 - DNA, 1454 bp, Heterodera glycines
  Genomic contig location: Contig_ID=SeqID_18171; Location=715..2168; Strand=+
  SCN-specific regions: Sequence locations=1-166,193-466,488-576,619 -813,878-948,970-987,1009-1125,1147-1454
atggactcggcggcagattccattcgacagctacaacgtgcagtgcgcgaacagcagcagatgatctttttgctgagaagtcagatcgttgatcagagagcagtgttgcttcagaatatgacgcggattgaatcaacggaggggtacttggccaatgtaagttcaattttcaaacaagtatttaaaactaattaatttcgcttatttttataaataatcatttgattatttcagtctcgcgggaaccagagattcagcccgagatactctcccatggcgggagtggagctttcgctgctcggccgtcgacttgaggaacgagaacgccgacaacagtctcgtttgggtaggctgtaattttttttattgaaataacaaataattcaagtgcaagtggagaataataataatgctgcgggtccaagtgatggaaatgttcggcccataccaaatgaaaaccgtaaactaggaaatttttgtttaataaatttcgatttttttttgaagagcagctgactccgctaagttcacgttcgggaaacaatggggctctgcaaaatcgtactaatggtgtgctaattttgaaaaaaaaaacaaattatttttgttttttttttagagagcaatgtggctggaccaagtacggcgagtaatggtggtgacgatgaacgtgaaaacggtgagatgaacccttaataatttgaatcaaataaatgaatttttgacaggccccgttctaagcgctgtgattgaaggccacatgaaccgttcgcggatgcgtctaattcgggacgagatggttcatcgtgctgtgcagcagcaacttgagcaccagcaccatctgttgcttcagcaagcgcagcagcagcagcaacgggaagaacgcgaaagacaacagcactttgatcaacaaatggaagaagcagagcttcttcacgaacaactgcaggcagcagagcaggaaaacgacgagaacatcgaaccacagccccctcagcagcagccgcaacctcaaccgctgattcgtcatccgcagctgcagttcgaacgtaatgttcgactgcagctgcgcgagtcgcagcgatttgaaaggggagttgcctcgttagtgctcgttccgccagcccagctctattgggagaccgaatgcatcatctgcaccagcaaccgcgcacacttctacagccgtaattgcggacacatctacctgtgctcgacatgtgcggtgaacgcggtgatccacaagatcgcgacttgtatgctgtgccgtgtccgaattgatggaatttatccatttgtacgatgattgattgatgtatttgataactctcgaacaccctttatcattttgtccatcctatcattatcctattatcacaatttttaaacgatcattgattgccacttggcatttgcaattctcactcattatttaaactcatccaaccaatcca

SEQ ID NO: 82754 - DNA, 409 bp, Heterodera glycines
  Genomic contig location: Contig_ID=SeqID_18171; Location=3104..3512; Strand=+
  SCN-specific regions: Sequence locations=1-216,260-409
atgttgtgcaaatgcggcgaatgcttcgagtgcgaagatgaaaagcgccgcctcaagcgcaatcgggagctcaatacccgcaaagagcaaattaagaactgcacaggcaatcatctagcaccggctatgatggacctcaaacgccggaatatggaactgtttaaaaaggcttataggccggtgaagggcgtcatcaataaaataaccgggggtgagtttaaaaaagaaattgaaaaaaaaaaacaaaaaaaattttttaggcccttggaatgtagaatgtgaggtctgccatgagaccttcacatacttcatggtggagtgggaaaactcccggaccgacttctcgtggggtcccgggaggaccatggtcgaagcggataacatagtaaaaatttttgaaattttataa

SEQ ID NO: 82755 - DNA, 868 bp, Heterodera glycines
  Genomic contig location: Contig_ID=SeqID_18172; Location=217..1084; Strand=+
  SCN-specific regions: Sequence locations=1-600,639-773,802-868
atgcagtggattaaatttaactgcacgctttgtccgatcggtctgcattgtttttatccgcgcaagtacgcaaagcctgtgctttgtgcgcatcccagcgtccgtaacatcacggactttttgagcaccggtcagcttgacgaagctgcaacgacaacaacaacaacaaccgcacttccgacaactgcggaggtgtcggcagcggcagaatgcgcacctccgcccgcgcatttgaccgcgtggatcgcggtgtgcacagcgctggtggcgcttttggtgattgcggaggtctgttattaattttggtcatttatccgctaaacccctattcctcaattaagcttgtgcgcgccggattcaaagtgcgcaaatttttgaaggaccgcgccttcaaaaaggggatgctgcgccgacatcgccagcgtgagtttctcgctattacattttagcaaattgtaattaacaatttgtacaggaatgagcgccgcaaggcgcaaccgccagccggcaagcgcgccgactccgctgattttgccggctatgttggccggcgtttctctgcgcccgacgggcgtcaatttgactgtggaccgggtgggcaattttaattaaattaaaatctttatatattttaatttctcactcattaaaattacaatttaaatttaaaggcagcggggcagcgccgcgcggatggtacggacgaagagcccgtgtacgatgaggtgccgcttgacagcgacatcgcggtcgagatgcgcgatggagaaaatggggaggaggatgaggaagatgatgacagtgatttttagtgattcggcaagcgatcactcaccatttaactaatcgatcgatttttcactttaaa

SEQ ID NO: 82756 - DNA, 579 bp, Heterodera glycines
  Genomic contig location: Contig_ID=SeqID_18172; Location=1474..2052; Strand=+
  SCN-specific regions: Sequence locations=1-179,205-420,441-447,472-579
atggtcaccaaggagggaatcaccttatggtgcacacgcatagaaaaagcgcagtttgtcccttttgatgttgtctacgagctccccggtcattgttttttccgcgtaaagaataaggcaagggtgttcagcgttccatacagcgaactgtcgtcctcagacaggtgcgcccagcctctaccaccaccaccaccaccaccaccaatgacaacagcaaaacatcaacggacaccggacgacgaggaggagaaaaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgatcaacaacaacaacaacaacagctatcgtcaaaagaggaggagaaggaggaatgcacaaacagcagcagtgctgcagtaacaactgaatctgcttccgatgctgatgtaatggacgatttcgtcaatagcattcaagcggcgacaagcaatatgcaatag

SEQ ID NO: 82757 - DNA, 151 bp, Heterodera glycines
  Genomic contig location: Contig_ID=SeqID_18174; Location=186..336; Strand=-
  SCN-specific regions: Sequence locations=1-151
atgggaaaagaacggaatgccaacggggtattcacgggccaatcgaagggcattctcaccaccgcgggaatggcctacaaagatcaactcagttggagaggggaggagctgatcgatcaaagagcgagcaaaggcggttctctcggaattg

SEQ ID NO: 82758 - DNA, 547 bp, Heterodera glycines
  Genomic contig location: Contig_ID=SeqID_18174; Location=389..935; Strand=+
  SCN-specific regions: Sequence locations=1-547
atgcggctttcgacctcacaaaggcgttcgtccccatctgatgatcaaaatcgcagcttggctgtgggctttggattcgcgattacagcattgtttagcgccgatatttcacaaaagtgataaattcaatcgatcggaaagcattggctgatcattgcttttcagtttacagcttttcctccggactgaaaacggataacggattcattgcgggcatttcgacgatcactcactgcacttatgattttgacaaattgaaattgttgactgatgacctgcagaaggagcagccacagctgaaggtgttgttcgcctattcgggaaaggatcatctgatcgagacagaaatcagcgaggaattctcgcgggcactcggaggaccaattttggtgacaatggcaaaaagtgattaaatggcacatttaacgatgttcagatatcaacgaccaatcctaaggaagaggacagtgaactgttagcaaagtttaaccaattaactgctggagagcatggacaaaatcgactttcaatattatttaccaaagag

SEQ ID NO: 82759 - DNA, 834 bp, Heterodera glycines
  Genomic contig location: Contig_ID=SeqID_18175; Location=147..980; Strand=-
  SCN-specific regions: Sequence locations=1-313,335-585,608-834
atgtttaatttaattgttctcctaacgatagccagtcaagtgattgcagaaagagttactattctttctgatacacaactttttgacgacaagtatctcactatgccaaagagttcggtcaatgaaagacagttcgggttcgatcgctcgagattatgtacgataaataggaatctgatttcagggtggagcctatcaatccaagaaattaattcaatagaaaagagcggacccactaatgttaagctttaccaggattttcgacaattaaagccccgagcgtgcttttattacaacgatcatagttatttaattttccaaaacgaaaagacaaatgaaacttctataacaagagggagtcaagaaatggttgtcaggaattttcccggtggggaccttagatttgatcatattgatggtcgacttttcgtaatcagagacgatcgaatagacgagattgaccttagaacaatagagaatttatggacaaaacacaatgaaaccgaaattattagtaaaccgatcggatcaatgccatcggcatacaccgatttcctaataaatgaggggcaaatttatctaattaaggaaaagaaaatatacaaagaccgatttgactcaaacgagatacttcccaaatatgtttcagacacagatagtgaattttttaattttgtcgtgttcaaagaatttgagaaaattagagtttcaagttcaaatccttgggtgtattttttgtcaattttagatttggtagtggtcgtcatctgtatttcagttctcagaattttaaaaataaagagaaaaggcaaaaattcatcatacggcggtgag

SEQ ID NO: 82760 - DNA, 549 bp, Heterodera glycines
  Genomic contig location: Contig_ID=SeqID_18176; Location=631..1179; Strand=-
  SCN-specific regions: Sequence locations=1-549
atgacaactctcaagaaaatcgacacggcgagtgaggacggtctcgagggaggcctttcacttttcgacatccctccgacgaacgttgcaattaataaatccagtattcgggaattactccctctttcagcaataaatcaatctggaccgtatatctttagacttttttcagataatcagttttgtgatttcaataaaacttttctttatttgtcaacttcaattgagagaaaagataaaagcaattggattccgattaccaaggacagtgaagctgaccaacacgtcggtgtcattcaaaattttgggcacagctttgtcaaaaccttaaaggtgtcaatttcaggtgtcgaatcttatgattccggcatttactatgcgtttagggcatatatgatgaatgaattgggattttcagaagatgtcaaaaagggtctctgtgaagcgtcctgctattatgtcgacgatgtcgaccaggatgattatacaaacagtggctttaaaaacagagcgtcacgttttgctgatggtgcaaaatgtgaaacaatg

SEQ ID NO: 82761 - DNA, 775 bp, Heterodera glycines
  Genomic contig location: Contig_ID=SeqID_18177; Location=1182..1956; Strand=-
  SCN-specific regions: Sequence locations=1-282,304-452,474-632,655-775
atgggcgccgagctggagcgactggccgcccagtcggccggcggggtcgacttgttcggcggcacagtgctgttccgcatcagtgctgtttggcccctggatgccagcggtgggtgaaagggggggggcggagggtggcggggtgggtgcaggatacagtgagggatgtgccgaattttccaaaaggaaaaaaatggggccataatttaggccaaagtggggcgggggcgtgtgccgtggatgagcaggaggcgcgcggcaccgttcgctgccgctccttcttcccggtggtgaacccgggcgaccgatggtgcctggcgcgcgccatcgtcctcgggctggccgaccgccgcgcccagctgcaatacggggccggaagcgtacaggcggcggcccaattccgcgccttctggctggcacagcatgggcctggcggtgcgcaggcggcccggcagctgctccacatggccacactgccgctcgacaaaccagactacggcgttgctgatgcgcagcgtctacagcaggcgctggacacgcggctgggcgcacagcaggtgcgcctcgtgatcttcgagcgggagcacggatgccgcgtgctgtggaaaggcgcactgcgtgcgcacttcaacatctgcttgttgctgcagcagggcgcacaaaataataatgaaaagccaaaaaaaacactaaattatcgaaaaatttacgcaaattcatctaaaaaatatttttcatttaaagcaaagaaaaaaacataaaaagaaaaaataaa

SEQ ID NO: 82762 - DNA, 1253 bp, Heterodera glycines
  Genomic contig location: Contig_ID=SeqID_18178; Location=812..2064; Strand=-
  SCN-specific regions: Sequence locations=1-10,32-244,266-303,348 -514,567-642,664-832,855-883,908-1078,1137-1193,1216-1253
atgtcgggtaaatcactatttttaattgagcacctctaagcaacccctaaactcgagaatgcaactactgctgctgcccatctcaaagtgccattcgttttaggctggtgacaaagtgcaggccatcggcgcccggggcgaacaaacgctggccaatttcgacgccaattttgccgccattcaaagcgatgtgcaacacgttgtcgtaattaaaaaccaatttaatgataattttcggacaaaaattacaaccaaacaatcaatgcagaaagtgggcactcaaataggagcataatgaaaggcaaaaaaaaattaaaacaatttttattttaactaaaaatatttttctcaaaattttgcattttttaaattcccgccccgttcacggccccgattgaaaatcattgtgctatggacataatttcccgtacggaaaatttcgacgtcgtccaagtagtgtaaaaatgcaaattcacgctgatctaagataattagcaactcaaattttttaaaagggttaattgagaaaaacaaattatggaaaatgcaaaggaaaaatataataaatttcaggcattttcttaaattcaaactttcaattctttattactttgttttgcttctaaaatatttggggtcacaaaaaagttttttgccaaaattagaatccacaaattcgcctgttgttagttaatctcagtgaattagtatcaataaaattgaagactcattttaacctttttcaggtttttcggcaaaaaaggagttaaaccgatttcaaaatcaattaaaaatggcatttccgttggcaattcccattctattgaaattcacaaaaatttgggatcaagccaggtccataattccaaacaagcaacatcaagtcttcatccccccatattttgtaaagcaaaatgccagcgctcgggtggaacaagcggtgcccatgtcagcactggtcactgtcggcatttgcttggctgtgttgctggcactgctcggactttggctgctgatcagtgccatcacggaattgagcagcatcagaaggagacggagaagacggagaagcagtgatcagcgacaacaacaacaacaacaacaacaacaacaacaacaacaacaacaacaacaacgaacacaacggcaaaatgatgaagaaattatcggcagaggaaaagcattggaggaggaataatttaaaaataataattagatgctaatgggacgaccaccagcagagggacaataaa

SEQ ID NO: 82763 - DNA, 603 bp, Heterodera glycines
  Genomic contig location: Contig_ID=SeqID_18179; Location=386..988; Strand=-
  SCN-specific regions: Sequence locations=1-33,59-96,118-177,245-603
  Gene Ontology: Mol. function=dihydropyrimidine dehydrogenase activity; Cellular component=cytoplasm; Biological process =pyrimidine base catabolism
atgacttatgcattaattgtggaaaatggtgggaaaatttaaatttaaaaaatattatctttagtctttagatgaatctaaaaggtaaacgataatagtaattgtatagttatttaattactagtaatatgcttagtatttttatagtttttatagtatattttagtttatctttaaaacattatccttccagataatgtttcagattatcttttaaataatcttttagattatcttaaaaattctgttaataataaaaacaaatcatttagctatatgacatgcaatgattcgggctaccaggcaatttcatttgacaaacatacacatttggccaaagttaatgaagagaattgtacgggttgcacgttgtgccacagcgtttgtccaatccctggtaagacgcaggattccggcgcagctttttaaattttaagaattttcttcagttaaaacaacttttaaaaatttttggtcgtttttcaaaaaactttaaaaatttttatctttatgaatttaccttaaatgccaaaaaggtcctttttaatcaatttttaaagattgcattaaaatggtgcctaaaacgataccgcacaaaataaa

SEQ ID NO: 82764 - DNA, 1288 bp, Heterodera glycines
  Genomic contig location: Contig_ID=SeqID_18180; Location=144..1431; Strand=-
  SCN-specific regions: Sequence locations=1-20,53-178,200-347,398 -428,460-558,606-738,761-791,817-905,928-1132,1155-1288
  Gene Ontology: Mol. function=dihydropyrimidine dehydrogenase activity; Cellular component=cytoplasm; Biological process=uracil catabolism
ttgcagaacaggaaaatccgaaattaatataaaatatatttaaaaattatttcttggtaaggacttggtgacaaatgtttcgcctcgaattgttcgtgggacgaccagtgggccaatattcggcccagggcagggctcttttctcaacattgaattgatttcggagaaatcagctgaggtgagattttaaactagaaaaaaggtcattatttaatattctcaaaatggaaaaatattcattaaatttgtgcaaaaatgccaaaatttcaaaccaaaaaatgtacaaaaaatcgacctcaaatttttttttgttttgttaatttaatttctagatttttcaccaaaacaatttttttaaaaattttataataaaacaattaactatttttaattttatctaattacttttgtcaagtcccataaataccaaaatttaaattttcaaaaaataaatattttccattgctttagtattggttgacttgcgtgaaggaattaaaacgtgatttttcacaaaaaattgtaattgcatcaatcatggcatcgtttaaccaagtgaaattaaattattatttggaaataaaataaaatatttttaaattatagcaagattgggaatttttggcatcccgttctgaagaagcaggcgctgatgctttggaacttaatttgtcgtgtcctcatgggatgggcgaacgtggcatgggccttgcctgtggccaagtaattcaaatttcaatttttaaatatatttctttttcattctgaacaaaagtagaaaatatttcaacttattttattatttaaatattaaaagtcagtaatagaatttaaaattattaagtaagttattttctagacaattaagaccaaaaagattgaaaaatttttgataaatattttggaaatttacaattataattctatttacatacctatttacactttggtgtgcgatcagttaaaataaatttttgtttaagaatcccgagatggtcaaacaaatttcggaatgggtccgttcagcagtcaaggtgatgattgatccgctatttgtaaatttaaataattttgtgccgtttttattttttgttaaattttcctaatttttacccaattagatcccattctttgtcaaaatgacaccaaatataacggatgtacgcgttctggcacaagcggcaagggatggcggagcggatggcgtaaccgcaacgaacactgtgtccggactgatgggactgggctcagatggcactgcatggccaaatgtcggcaaagcaaaatt

SEQ ID NO: 82765 - DNA, 547 bp, Heterodera glycines
  Genomic contig location: Contig_ID=SeqID_18184; Location=802..1348; Strand=+
  SCN-specific regions: Sequence locations=1-39,66-89,171-264,300 -317,346-547
atgataaatccttctaatatttctgtaagtaaaatacaattcttataaataaatacatttaaagacttaagtttaaaataagggaaatcaaataattttaaaaatatttaaatttataatagaatatttaactaatctaacaaaaattttaaattaattattaatttaatcaaaatctagctgcagacctacatttaaggaaaatgatcaaaaaaaggcgccattaatggacttttgaatttaggtattatcaaaattaataaaaattatcccattttaaaataatttatccattaaatacattccttaataatcgcttaattttaaatttagaaataaaatattcagaaccacgaaagaacatttatgagcgaaattagaaaatatcaatattgcttttaatgtaatttagaagattctgggttcatctaataacgaaaagcagtcaaatttatattggaaattttctcacaagatcataagaattaatgtcagatttgaaatatcaaaatatgaaatttttttatcaaaaaatctttaatgaaaa

SEQ ID NO: 82766 - DNA, 672 bp, Heterodera glycines
  Genomic contig location: Contig_ID=SeqID_3012; Location=228..899; Strand=+
  SCN-specific regions: Sequence locations=1-253,275-354,400-532,572-672
atgaaaaagtcgtccgacgattcagaagtggcggagtcgtcgagcaacgaagcgatttggaaacaacaaattgcgcaatatgttaaaattgctgacagcgatgaaaattatgaatataaagaactacttaatgaagccttaattgaaaaaggtaaagaacgcgaaggaaacagagccaaaattgagttggcccgaaaagcatttgacaatttgctgaaatcgatgacggaaacggcgaaaatgcaatcgggtgaaggatttggcaaaaacaaaccagttttgcgttggctattcctttgaaaactgagttattctctagcgtttgaagcagaattcaccattgacgaaatccagaaaataattagtataatataaaactttttttcataatttatttttcccttttccttggtgtaagcccgggtcccggccatgggtctgaaaatcaggtcgggcccgggtcagcaattaaaatataaaactatacctgtatcttctctgttttgcttttcattggatatccttttgtttttgttgctgtagttcatcctttctttctcttttttggtataaatttttaattatgaatttacaaaaagttcgctgaaatttagtgatattactaggtcgttgcataaaaaagggcgcttttttagaaaaaaaattttataa

SEQ ID NO: 82767 - DNA, 1029 bp, Heterodera glycines
  Genomic contig location: Contig_ID=SeqID_3012; Location=947..1975; Strand=-
  SCN-specific regions: Sequence locations=1-512,536-717,881-1029
  Gene Ontology: Mol. function=transposase activity; Biological process= DNA transposition
atgaacgctaataaggagcacgcacataagctattacaccagcaatttaaaaaaggcgaaaaagcggcgcctgcggcgcgaaaagtgaatgaatttctcggcgcggatgtgatctctcctcgtcaagcgcaaaaatggttccaacaattccgggcggggagaaacagcaccaaacgcaaacttgggtctggaaggccgtcgacagtggacaaaaacgttttggcacaacggttgcgacgacacccggaaagttcctgcgcagaattgtcggtgggacattgccataaaacaacaacatggcgctggcttcggaaatctggtcgtcggccgatgaggagcaaatgggtggcacaccgtctgactgatcagcagaaacagcggcggctaaacctgtgtctttcgaacatcgcaagacaccggagaggttatgtgctgaaccggctggtgacatgcgacgaaagctacatctgttacgatggcacagcacagaaaattgtttggagaaagaaggaggaagacccaattttggtcccccgacccaacctgcaccaaaaaaagcgcatgttgtgtatcttttggtcagtacatggcccactgtactgggaactgctggcacctggcactattttggacagtaatagatacataaaccaactgcgggcggtggatatcgcttaccgcatccggcgccagcagggccaatttgacggtcccctactctttcaccatgacaatgctccgccacaccgttctcatttgacaacccagtacatttcccagacattgaattggaatgtgttgccccacccgccttatagccctgacctagccccctcggattaccacctttttctttctctcaaaaactttttacggggtaggcgcttcactgaagacgccgaggtcgaggaggcggtggggcagtacctgacctcaaagatcggcacagattttttccgtcgcggcattaggaaacttccttctcgttggagaaaggttgttagggtccagggaaactattttgttgag

SEQ ID NO: 82768 - DNA, 281 bp, Heterodera glycines
  Genomic contig location: Contig_ID=SeqID_3012; Location=4561..4841; Strand=-
  SCN-specific regions: Sequence locations=1-104,126-155,188-281
aaatttttaaaaattttccagcaaataatggaaatttttttcgaattcccccccaaacgaaaattaaaaagtttaataggcaaatttcgtaacaagtagcactcaaatttccaaaaatttttcccggcggcgcctatcggcaccgccggacctacattttccactatttttacaagttttttgccttaaaacggccaaaatttggtcatttttagtgaaaaagtgcagttgttacccagcagtggaaaaaaagttattggttaatagcaaaaaaaaaaaag

SEQ ID NO: 82769 - DNA, 2787 bp, Heterodera glycines
  Genomic contig location: Contig_ID=SeqID_3012; Location=2080..4866; Strand=+
  SCN-specific regions: Sequence locations=1-201,223-350,372-698,724 -758,785-920,943-1368,1390-1520,1543-2575,2608-2637,2659-2742,2767 -2787
  Gene Ontology: Biological process=response to stress
atgttaacaacaaaattttttataagccattataaaaaagcgcccttttttatgcaacgacctagtatttgttttggtccgcaccatttgcgccatctaattcaagaaattttttaagggcaaaataaaaaattggcgttgtgttacagtcccagtgatttaaaacatcagtcaaaggccattgttatattacaatacagtaacaaaaaggaaggggaagagcatgtgatatgcatactctcctcctcctccccccatcccccggcggtttttaacccatccctcggatttttcttccttcgttcgctttcttttcccttcttttgatttggcctcattttctccttttgttatttgaggaaaatcaatggcaacggacgaattgtcacgctttttcgcttctctcttacgcactcagaatgtcggtttgccattctgattttgtcagaaatgttaatcgggcgtgttaacccaaaacatgcgggttttttggaattatatttttctatttttacgggcattcccttactatgttttttgactatcaccaggaaggccattttttacaaattcgttcaaaatttttgctcaacagctgatcgatgatcactgtctgtatgcgttcctcaacagacagtccccccacagaattgtctcccccttctgatgctgtccccggttttggttgttatcatttatcaatcactcattcattcattcgactcgcacccattggaacaattcactcaaaaaaattaaaggaagaaattattcaaaatgatatgaatggtttaacattcgtaggattttttatcagtgtataattgcacttgttaaattcgtttgatttccttatatttaatcgccattgattatttatgattttagctttttttcttcatgttttcggatgtttccgttcaaaaggttaaattattgtcccattgaagaggaggaaggagagaattcgcagtcaattcatggccggattgatggcacatgccaagttgggacggactgttgcgacacgcgagagtgtgcaggagttcatgcaacccaaagcggactcggcgtgtctttcaaatgcgagaaggacccggaaatgtcgtcgatgagagaggaccgggcccggtgggaccacgtgggggacgtggaccaggcaagcagccaatgctaattgattattggctcattatcgtcgttttgttgtccagttcttctcctacatttacgagtattaccaacaaaagggcctccggtgcatcgcccttcgttactttttctctcttttccgtttcgctttcgtcgtctttttctccacctttttgttacaatgtgtcgattacggggtcattttcaacacgagaaatgccacttttgatggcattccgttgccggagaagaaacaaattcaggttttgcggtccatcatcggctcttttcggcttacgcttctttcttaggatgtgttcatttctcagtgccaccgtcacttcaatccgctagtcaaaattgcgcttttgctggcccttctcttttgggtcggtcaattcgctcgcatttgctgtcgtctcgtccacctttgtgagaccaggaatttcttcgccactcaacttcaaatcaatgacagcgacttgcaaaacctttcttggaacgacgtcgtgcataatttgtgtcgagctcaggaacgaattcatttaatgcaagtgattttgagacattttgagtaataagcgacagagaaatacgaacagaaaaaaaggttttgtttaagaaaaataacatttaataatatcacttcgagtggtctcattatcgcaaatatcccatttatccgcacattcgatcatttttaccaattttatgtgttcagtgttaatcgcgactccatctcttcgctcgacatttaccagcgcattctccgccatcgcaattatttcgttgccttagtgcacaaagtgagtcgccctttttcactgtccaattgtccgccactttttccttaccctttccccccccccttttcagtcgcttttaccgcctcaaattcggctgcccttcgttggctctgtgcattacctttcgtccggccttcgctttaacatcgaatggcttctcttctggggtccgtggtccccgtggaagtcgtcgtacgcattaaaagacgaatttaaggaaagggacaatttggaaaggattggtaggggaaaggcggcgacgaaattgcaattgctcacccgccaaattcagctcgaaatatgcaaatgaatctgctggtgatgagtgtcgtcaacttggtctttcttccgtttgtcgtcgtttaccaagtgttgttcagctttttctcttactccgaacattttcaacgggatcgccacattttgggcatgcgcaaatactccaattacggacggtataatttacttttcccaggggcgtatctagaaagatttttcgggggggggggacccgacctgaagacttttttttttttgctattaaccaataactttttttccactgctgggtaacaactgcactttttcactaaaaatgaccaaattttggccgttttaaggcaaaaaacttgtaaaaatagtggaaaatgtaggtccggcggtgccgataggcgccgccgggaaaaatttttggaaatttgagtgctacttgttacgaaatttgcctattaaactttttaattttcgtttgggggggaattcgaaaaaaatttccattatttgctggaaaatttttaaaaattttcattttcggggggggggggggggg

SEQ ID NO: 82770 - DNA, 660 bp, Heterodera glycines
  Genomic contig location: Contig_ID=SeqID_3013; Location=737..1396; Strand=-
  SCN-specific regions: Sequence locations=1-118,140-660
atggtcgccttgggccgtggacatcgccatgttctgagagggagaaggacggaggcaatcggaagacaaaatggcggaggacgggacagcgcattgctgcagagactgttccatttggtggagggacgcgtgggtcgacgcctggagcaacgcgagggtttgcgcgtccaaaacggacgaagtgttggcattggcaccgtcgccgccattttcgtacgaccgactggcgatgtaaatctcatgcgaaaccttcaaacaaaacaatggcattaccaatggggagaaaagccaaatgaaagaaaggactgaccaatgccttcacattgtcaatgaattcggcacattctttgggcggtgtccagtcggggtgttgaacggcgaagttcagcagcgacagctccactttgccgtacgaattgccgcttcgcttttgctttgctgctgcgaatggtaaattgtgtgtacttttattggaacttttcatgtcacggaaaagtgtatacattttgtctatgattttgtttttgtcttaccgttatttgaactgtcgtggacaaccaccgactcattgttaagtgacatcagccgaatttcgccatcgcggcaaatgtccatttgagcgaatgaacaaacgtcgccgagccctcaaaaagaaataaa

SEQ ID NO: 82771 - DNA, 1883 bp, Heterodera glycines
  Genomic contig location: Contig_ID=SeqID_3013; Location=96..1978; Strand=+
  SCN-specific regions: Sequence locations=1-1162,1184-1883
  Gene Ontology: Cellular component=integral to membrane; Biological process=autophagic vacuole formation
atggacagcgaattggacgcccgcctaaatcgcagttacgaattcgccgttcgttacaccgaccaattcgtttcgacacagtccaaaatcattgccaaaaacattgcttttgttgccgctgccgttttcgtcgtcctttgctctctcacggcttacgacgaagacactttgaaggtgtaaatgggttgtaattatgatttctcatttgttactcatcccatctcattcagattgagcatgtcaccactctgatcaccatctccggcgccatcgttttggcctgtcgcgtgttcattcccaacgaacatttggttttttgccagcaccaactgatgcgccaaattgtggccaacattcattacgcgccgaagtcgtggctccaaaaggcccattccatggaaatttacacggaattcacgcaaatattccgactaaaggccgaacttctggtggaggaattgctcagtccgctgtttactcctttcattctctatttttagtgagtttttcgcctcacttatcacaatttactcctcttctttaaagcattcgtcctcggatgatggaaatcgtcgaattcttccacaaatgtacagtccgagtcgatggtatttaattctttacttaaaacccaccaaatttttatttctttttgagggctcggcgacgtttgttcattcgctcaaatggacatttgccgcgatggcgaaattcggctgatgtcacttaacaatgagtcggtggttgtccacgacagttcaaataacggtaagacaaaaacaaaatcatagacaaaatgtatacacttttccgtgacatgaaaagttccaataaaagtacacacaatttaccattcgcagcagcaaagcaaaagcgaagcggcaattcgtacggcaaagtggagctgtcgctgctgaacttcgccgttcaacaccccgactggacaccgcccaaagaatgtgccgaattcattgacaatgtgaaggcattggtcagtcctttctttcatttggcttttctccccattggtaatgccattgttttgtttgaaggtttcgcatgagatttacatcgccagtcggtcgtacgaaaatggcggcgacggtgccaatgccaacacttcgtccgttttggacgcgcaaaccctcgcgttgctccaggcgtcgacccacgcgtccctccaccaaatggaacagtctctgcagcaatgcgctgtcccgtcctccgccattttgtcttccgattgcctccgtccttctccctctcagaacatggcgatgtccacggcccaaggcgaccatgacgaggtggatgagctttatcaaaacggtcaattgttattgtcgctcctcttaagagaagggacgcgtcgtcgcctccccctccgccgctcgcggcttcgatccgtccaaatgcgatggcggcgtcgtcctcgcgcattggccattctctgctgggcgagggcgcgctccgtccgtcgcccttctcccaattggccacttcctccttcattcagccgtcccctttggcggccattgttcagccgcgcaccatccaaggtgatcaacacattcattcactcttcgttttatgtgttggccatttcagagagtaatttccgtgccttggaaatgtcaatgcatgcccttctcatcaaccaaatgctcttcgccaattcgttcgcttctccggcccttcgttcctcccggcatcacccctttggctacggttccatcccttttggcagtgtttcccgtcgcggacccgtggacagtatcgtggacagcaacatttttggagtgcccgccggggccagtcaaatccaactgatggacgaattggaaaatgaatttgacccattgtcaaataatcgtagggtgtga

SEQ ID NO: 82772 - DNA, 960 bp, Heterodera glycines
  Genomic contig location: Contig_ID=SeqID_3013; Location=2394..3353; Strand=-
  SCN-specific regions: Sequence locations=1-277,299-626,648-877,903-960
ttgtgccattgcaacatccgatgacgtggagattgttcgtctcgctttgctttggactgtttctctttttcttctccgtcccgcctttttccgttcttccgtttgcgtcaacgaatttttctgtcgtttagccgagatttatttgattggtttcttttcctcaattttttcctttctcaatttatttattttttctcaggccccgaagtttttctctacgatgatcaaattcgcaattgcgtttccattttggtcaatgattttcttatcgatgcccgaaaaagggggccattggccctccgtctccgtcagccaattgccttccttgaccaatttatgccattgtattatttttgtttcagtttttattttgtcattttgccaattaccattttaagctttgaggaccttctccaacgctatgaaaatttctccgccggtgacgacaatttcgcccttttgcttctgatcggcacttatttgaactcctcccgactcgacggacttttgatggcccaaacgctttggtcccccaaaagggacgtcgtccgacaaatgattctttcggaggagaaagcggtgcttttgtttgcacactttcaatgttaatcattacgcctattttcaattcagggcccatttcttccttttggctttgccaatgctttttcggttgagtcgcaagggaatggcgacgacacccggcaaaagacgcttataaatgaggaaattgtcaaactgatggcgaattacgcccgcgcattaaaagagggagcggtggtcaaagaaaggaacgaggcaacccgggcaattgcaattgcggaaatcaaagaattcattggacggaacgaagcggtaaaaagttgggactcagcaaacaaaataattttaaaaattaagaacggggacaatgctgaattgttaaatgacttgcgagagacaatttcaaagatctcataa

SEQ ID NO: 82773 - DNA, 877 bp, Heterodera glycines
  Genomic contig location: Contig_ID=SeqID_18185; Location=122..998; Strand=-
  SCN-specific regions: Sequence locations=1-106,128-168,314-353,375 -376,413-451,484-539,562-769,793-877
atggaattaattaaccgaaaattgatttgcccttattcaaaggacattgaattaggtgaattgacgatttcaacaaaaatatgacaaattaaggtacttatcaagcataaataaacaaatatttaaatgagccttttttttgcactgacgtcttttattacttttagaaaaataaaaattcaatataaaataaaatcaaataaataaaaataacaatattatgtttgggcgaaaagaaataaaagaacaatacaatattcaatatgttgttgaaaatgggatgaagtggaacaataaataaaataaaataaaaatccaatcaaaaagttttcgttagtcattgcaccttaatgaaaggaattaaaattttttatcctaattaataattaattagtaatattaattaattaatgctttctcatgcaaaatatcacagaaaaggacaaatttattgtatgtttgttgtttgttttattttgcaaagaaattcagttaagggatccttggccaacaattaaaatcgataaacattagacatattaaattttaaattcttattttggtaatttcatcaaatttacagccatacacggggctgctctttttaaaggcggactaggaaaactcgtcgccagccgaaacgtcgccgggcgaattttggaccatagctttttgccttctcaaccatattaaacattcttggtattgttaaaaacttataaaaaactgtataaacctgcaaattttcaaaattttttattcatgtaaaaagaaatcagggcaaaaagttcaaaaaactaagtttttgagttccttctggtcataacttttttgaaacttaactaaaatttttgaaattttgcctattaataataaa

SEQ ID NO: 82774 - DNA, 1681 bp, Heterodera glycines
  Genomic contig location: Contig_ID=SeqID_18187; Location=292..1972; Strand=-
  SCN-specific regions: Sequence locations=1-20,75-147,208-349,371 -388,411-579,648-833,862-877,924-936,958-1059,1083-1455,1492-1681
atgacggtgacatttttttcaatgacggtgacttctttttcaatgacggtgacatttttttcaatgacggtggcttttttttcaacgacggcgacgtttttttcaatgatcggcgacgcttttttcaatcgacggcgactttttcacggagggcctttaccatttcaagaagttgcttttggaagccggtattttcactcattatctaaataagaaatgcaataaaaaatgcaagaatatgtaacgttggtgccagcccgaatttttagattctaacttttttcattgtcgaccaaatctaacaatcttgatatcattggaaagcccttcttcacgtgctctattagccttacaaaaagcgaaaatattttgatattttctaccatctaagaaatttattaagaaaaaaccccaaaaattttgcatattataaattttttggtaattgtctatcgcgaagcaatagcttagaaacatgtagcgttcgaatgataccaagattgttagatttggtaaacaatgaaaaaagaaaaactaactactagatactatgtagtaattgcacaaacgaataatccgaaaattgtttccatcatttacaaaaatttttaaattatttataaaaacaaaatggcaatttttaaatgttatttttctgccagcattcccttccggctacatttgtcggtacttatcaggggtggagcgcgcacaaaaaaatcccgtggtcgtggatcgcgcatcgcgaattcaatttgccgcggtcgcggatcgtgcaaaaaattgccgcggatcgtgcattttttccagttttttaaaaccattttttaccctttttttaaatttttttcttataaaattgtttggtagattgtcttttaaagtcatctcttctccaaaaatggttttacccaaaatctgtcgtaagggcagccgaaaattttttggcaaaattttgtgataaaagttgcttgaaaaatcgataaatcacttcgcgattagacaattaccaaaaaagttatacttgcgaaaaggtcgaaattagtcgaaattttgaagattttcttaaaaaattttttccaggctagaaaatcatttcggtgctaatagagcatctgaagagctttcgaatgataccaacaatcttggaaacaagaagactatgttttcttaattttaaagctgtttaagctatcagggattgaaaaaactttatgtttgaccccgattttagacctaggcgcaaatgtgtggggcgcaaatgtctggacacgatttattggtacatatctcgttttttcggacggtgtgtatactcatagtgtatactcataattttgaaactttatggcagaatgtcactttttcaagaaaatataagattgtggcaaaataacctggaaagtgatatcaaccaagagaaaaacacccgttttatggttgtttaaattcttcgaactttgttatttattttttaaattttctggtaaactaatcatcaaaattggggacggatgatcattgatcatgatcaataatatttaccagaaaaaaaacaaaaaaaaagactaatttcagagattttaaacaatcacaaaaacggatgtttttcacttggttggcaattagagtgccatgggaccgggaatttttgacaaaaccgggacttgccgggacctga

SEQ ID NO: 82775 - DNA, 81 bp, Heterodera glycines
  Genomic contig location: Contig_ID=SeqID_18187; Location=1768..1848; Strand=+
  SCN-specific regions: Sequence locations=59-81
ataatgagtgaaaataccggcttccaaaagcaacttcttgaaatggtaaaggccctccgtgaaaaagtcgccgtcgattga

SEQ ID NO: 82776 - DNA, 2600 bp, Heterodera glycines
  misc_feature (2236)..(2236): n is a, c, g, or t
  misc_feature (2275)..(2275): n is a, c, g, or t
  Genomic contig location: Contig_ID=SeqID_18188; Location=433..3032; Strand=-
  SCN-specific regions: Sequence locations=1-671,704-1500,1523 -1657,1725-1860,1911-1988,2010-2035,2117-2128,2152-2165,2217 -2389,2413-2425,2448-2508,2530-2600
atgggcccaaatgtgccaccgtttggtggccacgtgtacctgaagggctttttcttcactgaccactgccatttggactacacaaagcaacccattgatcagcccttctattttcacattccgtttcgaagcgattgccaggcaagcgtgccacaaataactgtcgaaaaatatatttatatcgtaggaaaatttaaatgtaccgtaattttgacaaaattgtgccaagaaaaactcatttttagtttgtttcccgagaaaataaaaaaggccgtttctttaattttttttttttagttttttgaattagaaatacttctttcttatttatgcttctcaaactgcgaatttagtgccaaaattctccagttttccggcaaatttaaaccttaaaaaattatgttgtctcggccattttttaaatatcataacacatttcttattccttttatcaatttttaataatcattagaagttttttttatccaatttctgtcgtaacacaatttgaccaaatcagcagaccgatatgacgtcagcagatcaataaaaacagctgataacggatcgaagggaaccgaattttaggtgaaaagagagcggtccattgagggggaaaacggcagaaatgtgagcggactcagctacagtaccattgtgattgtccaggtaataaattaatcattaattaacttatttcaatacccattcttaaatggactgtgttcatatgaatcaataatcaattaagcaccaccgtttgtttgtgactaatcgggacaaggcgtacgcggtcaactgtttttaccatgaggcaaagggactgtttgaacgcaagctggaagttgggtgagtaaaagttggcacccacacactaatctgagtgatgagaattggggaacagtgttccatgtggggagcggagccgtgacggtgcacaccgaaacgtgggtggacgaatttttttggggcataattttgatcaattcattgaccaaattgagtattctcggcattcgctagcctagtgttttttatgttaattgagtttgttggttgcttccgaaagtacaaagaatgttgaatttggttgacaatgttatggtccaaaaatcgtccggcacctttttggtcgccgacgttttgtcgccagtgaaccaacgagtttgacaaatattaaattattttgaagggatttgtcgctatttgatgtgaacggcaccaaagaagcgccgttatgcacttatgaggtgctcaaagatggcgaacccattcgatatgcaaatgttggcgatgtgttggtccatcgttggagttgcgacacgggtgagggagcggcgacttaaaatggccaaaaccaaaataacaattaaaagccattgactcaattagtgcagaaatttatagatggtaaaatgccatattaattcttcgtcctttgctttaaaaccaagagttcagcgacaaaaaggcgaaaatacgccaaaattaaaaaacaaacgatttttatattttaaataatcgcattaatattgatcgattggtttttgaaattaatcaattagtttttagtggagcttggaatgctggtccattcgtgtattatccgtgacggacttggccacagtttttccctgttggaccaacgcgggctgggtaaaaattaaaaaaaatgcaaattaatatgttaatttaaagaaaattaaaataacttttaaaattttgtagctctctttattaaaaatagttcgaatttattttttggtcctgcacagatgtgtcaccgattcatcattgttggccccactgacttacaccagccaactgaattcctcctctacaccaataaagtaaaaacactttttaaaaaaatatttaattatcaattaattagttaattgttttttattgcatttttgtagcacctttaaatatgccgaccaaatgattgtctattttgcgtgccaaattacactgtgcgacaagcgtgagaatgggtgtgaggggatcaccgttcgtaaaaagaaattaaacgaaataataaatttttaaaacttgtcttaaaaataataaaaagaaaaatcttagaaagttttaaaatatttattttaataatggtaaaagcgctaaaaagcaaacaaaatcataaaaataatgtcaaagactaataattttaagttttatagttttattttgttttttaatactaattatttgccgtttaaattacagcccncaatttgtgaattgactccgctcccctcggaaggcggcncagcaatgcccgttgttgaggcttctcgtgaccatccgccaacaatggcacgggtcagtgctttttaaaaaggcttatttaagtacaataataagaatgacttgtcaaagagacagaaaatgtttattaaatgaaatcacattctattactattttaataatatatttttaagctgatcttattaaatgacccgcttagagtatcaaactgttagctaaaaaattaatctaattttaagtgccattttagtcattctaaattcggttttgttttcagatcataattttattattcatttcgtaaatccgccatttttcaaataaa

SEQ ID NO: 82777 - DNA, 695 bp, Heterodera glycines
  Genomic contig location: Contig_ID=SeqID_18189; Location=157..851; Strand=-
  SCN-specific regions: Sequence locations=1-8,35-175,211-238,260 -344,391-413,437-579,601-695
atgacaaaggaagcagcagcaacagcaacagatggccaaataaaatttttaaggtgggaaatattttaaattatcacaagtgacttccgcaaccaacggaaaataccaattcttttcgttagaataacaaaaacccctaatatgtttaaaattagtatttttagagaaaaactacatattattaaagtaaatataaaaaaatcaaaatttcccggtgtcaataccaattgaccctcaatctttcaaataattttaaaaatcgcttttaaaatatttctagacaaagaacaacaaaattcagaaatttgattgtttcgagcggaaaatttaatagtcaaatcttcaattatttttataattatttccaattttttaatttaacaaattatagggaagaaaatcgttggactctacaaatataaaaccaaaatatattccaaatgagaatgaaactgaagaccgatctctgaatttattaacagcatcaacgaatgcgaaatccaagcaacaaataaaaccaaataatgatggcaaaggaagcagcagtagcaaaagatggccaaataatttcattaaggtggaaaaatttttcaaaattttatctaaaatgatagccgccacaaccagaaaatatcagttctttgacgtcaaagtcttcaagattaggcaataaaaaaattgcacatattaataaa

SEQ ID NO: 82778 - DNA, 1369 bp, Heterodera glycines
  Genomic contig location: Contig_ID=SeqID_18190; Location=1999..3367; Strand=+
  SCN-specific regions: Sequence locations=1-80,103-378,407-653,700 -907,944-1050,1105-1272,1306-1369
atggaaacttttgaatttcaatcttgttagaataatttaggttaaaattgagtggatatccattaaaaaattttcgattcctaacttgattaaaatttaatatgcttttaattagatttttgcaatttatagacaattaaaaacatttgtattttttaaatccttaacctcccgattcaacaccatattaaattataggtcataaattgcttttgaacggatcgtttttggttggatctgaattggaagggtccgatttggacttgatttgtgttgtgtccaacaaaataattgttcaaaatttttatggatcagacgacggaacattatttacaatcctaaaaaaggttagaaatgaaaataataaatagggccgagatttatatgaaaaataaaatataaaaatgctaatatgaaaaacttacttagtgaaattgttaagtgttgtttcaacctaaaaattgactttttgatttaaattacgaaattttattatttttttgaacaaatactttgtaagaaatagaacaggaaaaattttttataacaaataacctaaaattggtatttttgattttaattttcccattttattgtgtattttttgatcgaaattacgcttaagtaagtgcttttttctattaatttaggcctataaaatattttttaattatctaaataataaacattaatttaaatggacagaaattggcaaatgccaaagtcaattgcatttcgggaaggattcagctgcttagaattgagcttgaaagtttcgaaattgatctgtcttttgtgccagtgccagaaaaatatttagaacaaaatgacggcggtgatttatcacgggaaaaaatcattgaggaaattaaatacgaatctggcatttattcgttggcgggtgaacaaaaaataataattttaaatgaaaattcaaaatttaggttatcaatcggcacattttcaactctcaattttgccggacaaaaatgcatttgtgaatttattgaaaatcgtcaaagtttgggcaaaaagtcggttaaatactactaaaattattagttcaatttaaataataattttataaaaaataataatttttatgcgaaatttgataattttttttcagctcgcctcatttattcgggcatttttggttattttaatggcatttcttgttcaattatggcatccaaaatttgtctgctctttccaaatgcgcctttgtcatatttattgtaccaatttttctcgatttactcaaaatggtactaaaattaaaatttgaaatattaaattaaaattgcctaatttagggattgggcgcgtgttccgattatgcttaatgaattaactccaatcacaaaga

SEQ ID NO: 82779 - DNA, 418 bp, Heterodera glycines
  Genomic contig location: Contig_ID=SeqID_18193; Location=177..594; Strand=+
  SCN-specific regions: Sequence locations=1-418
atgatcagattatcattggacggcccaaaaaaaggatacggtatgagtgattacggtataagtgattagaaattcgatttgggaagaaaaaaaaataatgccatttgatctgggccctgacccaattttggaataattatttttggaaaatcgcccaaaatcgaggagaaaattaaatgtgaaaaaaataaaataaaaatagtgatcagaaatgtgaaaaaatgtaattatttctgattaaaaatgcatgaaaataaattgggtataatgaatgcataaattaacacattttaggccaaagcccatttaaggaagggactttaactcaataggcaaattaaattgaattattagcaatgcgcgcaaactgatcagaaatttttgagggagataatttcaaactgggccataacccaaa

SEQ ID NO: 82780 - DNA, 370 bp, Heterodera glycines
  Genomic contig location: Contig_ID=SeqID_18194; Location=338..707; Strand=-
  SCN-specific regions: Sequence locations=1-148,170-306,329-370
gatcagccaatcggagggaagggccgcccctcccgttcactcccggggcccctccttataagcccgggaattccttcccaggcagttgagtcgcgacgatcagctatatcctattcaattccccatccatcgatctcgtcccccttctccagcccagggagagctcagcgcgcgggctacggcccgggatggacaagaggggatccgtgggaccggcacaactctaactggtagcaccggatggttctgaccaaatcctgggcccaaggatttggttcggagtggaattgaaagggtgctgatcaccccggggagggctttggccctgagctcaatattccggccgatgccggccaacaaacacaaaaaa

SEQ ID NO: 82781 - DNA, 382 bp, Heterodera glycines
  Genomic contig location: Contig_ID=SeqID_18196; Location=90..471; Strand=-
  SCN-specific regions: Sequence locations=1-103,137-160,182-242,264 -306,328-382
atgccggacggacactttgagaatgccaaacagagatgggaacggcgatttctgatcttcaagggggccaacctgtgcttgttcgagtcacctcccgtaggcctaaaaaattttaaaaatttaaaaatttaaatttcagttaaatgccgacgaattagaaaagtgtttgtccatgtacaaagtgtacgagacggcactgcgcacggcaatcaaacggttcgaccgtcgtgagcacgtgttcatgctggccacagtcagaggtgtgccaacaaacgatggcattgcggtgccagggatttcatatgcatttttggcatcttcctggcattaaaaaacttgggcatgatcctgtcacaaaaatgattagttccacataattaaa

SEQ ID NO: 82782 - DNA, 421 bp, Heterodera glycines
  misc_feature (45)..(45): n is a, c, g, or t
  Genomic contig location: Contig_ID=SeqID_18198; Location=28..448; Strand=+
  SCN-specific regions: Sequence locations=1-52,89-158,181-205,227-421
atgagcagatctcatgcattatacgactttacagtacacccgtgnggacaggtaaaaaataataattaaaaaaattatatgtttttaaggattaaccctatgggattattgtgaaattaaagaattggggagaattaacgttaaaaagtcggataatttttgtaagttaaacaaaataatattttaacaacaaaatttttaggtttattttatgcattaattttgagccagttttaccaactgatcgatacgaaagaagatgtgtcaatttctagggaccaattcaaaaaaataattaaaaatgagaaaagacaaagggaagcagtgaaaaaactaataatcgatgcaaaaatttctatggatgagaaaaattatggtcttaaacatttacaaatagttcaggattattgggtatgtcaaa

SEQ ID NO: 82783 - DNA, 324 bp, Heterodera glycines
  Genomic contig location: Contig_ID=SeqID_18198; Location=1134..1457; Strand=+
  SCN-specific regions: Sequence locations=1-260,300-324
atggctccatataggattgttgcttatgatttggagtgcacggtaattaaaatgctggtcaataaataatatatttagtttagacgaatacaattttggatgaaaattcacggagaaaagaaacgattcataagccgaattttgttagcgtgagatttacttgttcattatgcgacggagaaacaaaaaattgtgaaatttgtgggaccggaccgcggcatttaaaatggtgtagcaaggatggagttaagccgctaaactgttttattaaatggattattaattttgaaaaatatgatacttatgcatacgcacattttagcg

SEQ ID NO: 82784 - DNA, 595 bp, Heterodera glycines
  misc_feature (553)..(553): n is a, c, g, or t
  Genomic contig location: Contig_ID=SeqID_18199; Location=301..895; Strand=+
  SCN-specific regions: Sequence locations=1-384,430-595
atggccaaagaggcggaacggacggtcccatactttgtgatgggtacggttttggcaccgtttccccaggcattttgggcctcggacatttctttcgcccgtgcccaaaatcggttaaaaatgtcacattttttaattcgagtcaacaacaatcagcaagaaattaattagctgacagaaaaatgtccggggacaaaatgttgggtaaccaaacgattttggcactgcattttatagacaaattgggaaattagggtccataaaagccccccccctctccaccttttccaccgtggtttttgctttacaaattgtttttttaaagttttttgcggctttttcgggtcttttaagagacaattcctcattttttcaaatggtgacttttttttattattttcaaattttatttttttaaattaattttttccaatattgcttttgttgctgttacaggctttttcttcatgttcggctttgcggtttacacgctgctttgcggcgcgttcatctacggcgtcatggactgggctaaaccactgctcgcccttgngatatcaaaaaatgtttgcctgacatgagcaatttcaattaa

SEQ ID NO: 82785 - DNA, 863 bp, Heterodera glycines
  misc_feature (665)..(665): n is a, c, g, or t
  misc_feature (689)..(689): n is a, c, g, or t
  misc_feature (697)..(697): n is a, c, g, or t
  Genomic contig location: Contig_ID=SeqID_18199; Location=1092..1954; Strand=+
  SCN-specific regions: Sequence locations=1-510,532-532,554-569,592 -609,636-724,746-863
aatttgtggaattggtgtcaatgatgtgagtttctaaaatttgagttacacggaatttgggatttcatttgggattgacattcggggacccaataatgcttttccccctagggcaaaatcggtgtaaattttcaactaatttcacgacaaatttgcataaaaatatgcaaattttcttaaaaattgtgccaaaatttgattgttttggcccaacaatcgctctttccacccccgaaaatttgtagaaagctgaaaatttttagttttttaactgaaaaaatgccaaagtttacgggaggaagtaatgtttcaattatttattactaaaaaaaattgtgagttttataaatcgtcaacattttccaggcctttctgatggcccattcctggaatcggttggcccatcaaaaattggcagcccccaaacggattggacttgtctttgaagaggtcggcccttccatcaccatcaccacggtgcggactcgttcgactatatttttgatttcgtttattgaaattgaatactttccaaaaataaaacaaaacttttgttcgattatattttttagttgccgtatttcttaaaatagagcgccggagggtttattcaagcccctttagtgggggataaagctgggtggggggagggctcaatttttcanacccctggggctctatttcacggngactctanatttagggggtcggctctattttaggaaatatgctatttaaaatttactcatttttcatttttgcagttgactaacgtggtcaccttcgccatcggcgccttaacaccaaccccgggtttgtcttgtgattgtccgccgaagagaagaaggatgtgcgaggaataa

SEQ ID NO: 82786 - DNA, 225 bp, Heterodera glycines
  Genomic contig location: Contig_ID=SeqID_332; Location=252..476; Strand=+
  SCN-specific regions: Sequence locations=1-225
aacgtaggcatcaagaatacgtatgtgttgatggacgtacgcatttctggagcgttgaatatcgtgagtatgtggatgcgtacgcacacatctaccgtataacattaatctaccatagtcatgtagacaacgtaggcatcaagaataaatatgtgttgatggacgtacgcatttcaggagcgttgaatatcgtgagtaagttgatgcgtacgcacgcatctaccg

SEQ ID NO: 82787 - DNA, 557 bp, Heterodera glycines
  Genomic contig location: Contig_ID=SeqID_332; Location=9992..10548; Strand=-
  SCN-specific regions: Sequence locations=1-557
aaatgacagtacagttagaaattttcatctaaattaaaatgaaaaaaaattttacgcaacaattttattaaaaaaaaaaacaacaacaattaaataatggaaaacatttaaaacataatagtgagcatttcaagcgggaaaaaggttttgtgatctccgcctccaaattcgacgacacacggcaagttgggatgatgcaaacggattccatgttttatgtagtaatgcattcgtacctaaaatctttaattatgtccaccaaatttccaaaaaaaaagtaccgtaattcccaagaagccgcggtaggccggggctgagtgtgcgtcgagaatggagaggtcgttacagcgcaccgggaaatttcgaacaaaagggcgcaagtgggcggttcgcagctgagcagagcgcaagtgctcgacaatgtctcggcgcttctccaagtttcggaacaacacgtgcagctcatgcgcgctacagttgaaccgcttgcatagatgctcgacgagcggaatcgggcgaggtcgttcggcacaagcacaagtctttggggtacctaa

SEQ ID NO: 82788 - DNA, 4079 bp, Heterodera glycines
  Genomic contig location: Contig_ID=SeqID_332; Location=5551..9629; Strand=-
  SCN-specific regions: Sequence locations=1-44,68-173,196-347,369 -437,459-630,652-1283,1305-1385,1419-1462,1488-1626,1650-2845,2878 -4079
atggattcgtttccaatcattgatcacgtggacttgcaatttcgtcatccattcacaatgattgtgtctgggagtacaggcagtgggaagtcagagtgggtaatgcgtctgctacacaatttagagaaaatgatctctaccccaattgagcgcgttatttatggttacggagagttgaacactaatattttgaatttacaacgcactggtaaaattggcaatgtgccagtcactgtgcacagcggcgtcccatctgcggaacaggtgcgcgattgcgccaaaaaagaaaaactcttgctaatattggatgatttggtggtggggatgagtcaacagtatttggacgcgctcttcacacgcggctcacacaattggggcgtgagcgtaattttggtgacccaacacctgttcaacaaagagttgcgcgtctctcgtacaaactcacattatttggtgttaatgagaaatccagcgggcgcccttcagattcgcacaatagccacccacctcttcccgtcaaggaccgcatactttatggaagcctatcgtgacgcatgcgctaaaaattttggctaccttttggttgacatgcacccggagagttcggaagagattcgccttagaacaaatatatatgaacaaaaacaaatagtttatatgccaaaatgaaagggtcgcaattgattgcaagaaatgaatcctttttggagacactgtctaattccaaaaaggcgaaaattgttattagagacgcatccgatgaacaaatattatgcatggtcgaaatttgtctgaacattctaaagggccgagttccattgcgtccacgtcatttaaagaagctgaaagctcacgcacagatgcttcgtcgtctcgcccgcacacgttgttctcgctctgccaaaaacgttttgctacagcacggagacggcctcccagccattgtagggctcattgcatcgattgcccttccgcttattgcgaacgtcattgaaaattatacatagtgcttgataaagttttaaaaaaagtaaaatgcaacatacaaagcgctatttgttggtccccgaagagatttatcagagtttggcaacactgtcaccgtctgacggttcaccaattgggctggtccgtgccagaattaaacaaataaaaaatgatgacgccataaatgaggcggaaagagcagtcaaatatgagcaggaaattaagcgtctcaacaagctcaaaaaggacgaggatgaacgtcccgtcggtgttaaattagaaaatttgagtgatgttgttgacgccatgccaaaaccattcaacattaaaagaccgattgttgtagctactcgtcgccatctcaaggttgggcgtgcgcgaaaagaaaatgttgaacaattagaagatgatgatgatgaagatgattatgaaactccacgcgcgtcgagtacaaataaacgtcccacacaaatggaaattttaaatttaatttataaaaacgctcaatctctgggggtgtcggaggaaggacaggtcttgagagcgggtggacggccatttataaccagcagtgtcgatgatattgttagtcacctgctgaataaggacaagcgtggccaaaaagagccaacagcattcaaagaatttattgaaagggcaaagcagaatcgacaattgagtaggtatttattttccgaaggccaatccggcaaaggaatttataaaaacactttacttaagtttaaaccatccatatggatttgaaaaactttcgtttgctcgagttcttgtacaaggacttaagttcgcctgtctcattcacgagcgttgagccgcttctgaaagaggcgcggaaaagtcaaccaaaaattaatcgaattgatgttcaaaattatttagctacccaacgtacatacacactgcatcgccaggcaaagcggcgctaccgccgtttgccaaccttggcacccggcttgcatactgaatggcaggccgatttggctatttttgaccgaattgctaaacaaaatcgtggctacaagtacttgctagtctgtattgatacccttagccgacaggtgtttgtcgaacccgtaaagaccaagacgagcgctaacatgatcaatgcctttgaacaaatattcaaaaggtctaaatatattccttggaaggtgctaacggatcagggaaaggaattcactgcccgcgcagtgcaacagtttttccgcacaaaagacgttgaacacttttgtatgctcacttctccccaatttcatgccggaatggctgagcgtgcgaatcggagcatcaaagagcgactttatcgctactttacggagcataacacgtacaagtggataggtgttgtgcaagaccttgtttacgcaattaaccactcgcaaaattcgagcattggaatgtgcccagcagacgtgaactttaaaaacgcagaagcattgagacaaaaattacatgatgcagcttcaaatgttctacgacaccagccaaaataccgtgtgggggatcgtgtgcgcattgaaaagtataagcacgtgttccaaaagggttacctcccacgcttcagcaatgaactcttcacggtggtagaggtacactctgagcgttcaccagttgtctatcggttgcgtgatgacaataatgaaattattagtggttggttttacgcaaatgatttatgcaaaacgctagaaaacaaacagcaaaaaatgtatgaaattgaaaaaatattaaagaaaaagaggcagaacggtgtaaaatatgcacttgtgaaatggaaaggttacgatactcgcttcaatagttggattacagcacactcaattagcgagaaatctatataaaaagcagtttttaataaattttaacaaaaaatgccttcaaattctttttatgttgtccttccgtctaacaccaatatagaagggaataggacaaattctttccgagtgcgtttacctcgcaagttgcaattcaattcggaatgggaggtgggtcttgccgttattgtgtatccccactcttggccctccataggcactgtggagcaacaatttgttcagattgagtggcagacagggaatatggtgcggattgagcttccatcatcaaatgtcaccaacccccacgagcttagcaaaaatttatacaggctcttggctgacggaagtgatcccttggcaaaaaaggttcgctcaacacagaattctttcatgcttgcaacaaacaaggctcgccgctgggccagagaagagtacattaggcgaaaaacgaaagaaaaactgggcgtccgtgacgaagagctgctcctacaggccctaatgacagatactggaccattggttggtctcaacaccgtgacgcaaggccttctggcacgcgaaaagcatgctgaaacaagcaatatcgcgttgagaacgccaactgacgataacgattcgtaccagaaaaaattggatgactacttttctaaattaagtgagaaaaacttgagcattgttgatgaattgggtatgataaaattgaatgccgaaatcaaaaatttgacagaagaggaacgtgtgatcctcgaagccacaaaggaaatgggaacggaagcatggattcaagcctaccgtgagatacgtctagtctgccaatttaattatgacatcagtaggaatcgttttgttctgaacactgacccacggtacgttaaaaaggttgaaatctcgcctcaacttgcttacattctcggcttcaacaacacagagtttacacagcccaaaaaggaggcaagattcatgccagacatgagcggcggtgtgtcatcctttcacgtttacactccagaccttattgaaccaatgatgattggcgacgtcacggccccagtgttacgcattgtaaccatacggggagaccccgaccaagtggttgaagaacaattttttgccatacagtatcacaaaattttattaaaggaagtttctgaaattctgattgagatccgtaccaatagcggaagcttgatgccattccaatacggaacatgtacattaacactgaactttagaaaaatgtcctatttttaa

SEQ ID NO: 82789 - DNA, 1334 bp, Heterodera glycines
  Genomic contig location: Contig_ID=SeqID_332; Location=9721..11054; Strand=+
  SCN-specific regions: Sequence locations=1-123,151-810,832-1252,1274 -1334
  Gene Ontology: Mol. function=general RNA polymerase II transcription factor activity; Cellular component=transcription factor complex; Biological process=transcription from Pol I promoter
atggatttaattcttgctaccgattggatacataacgcttatcccgaaatggaccaacaggaccataacaaggaaccgccaaaaagggaccagcaggaccataacaaagaaacgccaaaaaacgaccaggaggatgaggaggagacgaaggagcctagctggatcagcctcattgacgaagagcagaagcaggaccagttcaccccaatttatgatgagccgccaagagcaagtattcagttttcttttttttttaaacaaattgattaatttaggtaccccaaagacttgtgcttgtgccgaacgacctcgcccgattccgctcgtcgagcatctatgcaagcggttcaactgtagcgcgcatgagctgcacgtgttgttccgaaacttggagaagcgccgagacattgtcgagcacttgcgctctgctcagctgcgaaccgcccacttgcgcccttttgttcgaaatttcccggtgcgctgtaacgacctctccattctcgacgcacactcagccccggcctaccgcggcttcttgggaattacggtactttttttttggaaatttggtggacataattaaagattttaggtacgaatgcattactacataaaacatggaatccgtttgcatcatcccaacttgccgtgtgtcgtcgaatttggaggcggagatcacaaaacctttttcccgcttgaaatgctcactattatgttttaaatgttttccattatttaattgttgttgtttttttttttaataaaattgttgcgtaaaattttttttcattttaatttagatgaaaatttctaactgtactgtcatttttaaaattaattcattgaacacgcaacagtttttgactattgcacaacgtggaattaatacagaatataatccacgccgtttccacgcaatcatcatgcgaatccggtatggagcaaaaactgtggctgcactcatatttcaatcggcacgtgtcgtcctcactggagttccacaccctgatcaagcccaaaagtttgcagcaagggttctacgacgaattcaatacactcaatgcagaacaatgacaatctatgagctgcgtgtggtcaacattgttggagttttaacgtttgaccaaagaattcgagtggagaaactacaacaatctctgggtggcatctatgaccctacgatattcccagcccttcggtgcaaattagataatggagccacgtgtctcatttacatttccggaaaagttattctcactggggtgaaagatgtagaaaatttaaaaaattcatttgattacttgtctaaaattgttcctaattattttcgataa

SEQ ID NO: 82790 - DNA, 912 bp, Heterodera glycines
  Genomic contig location: Contig_ID=SeqID_332; Location=11061..11972; Strand=-
  SCN-specific regions: Sequence locations=1-501,523-761,793-912
atggaccgtgtcgtcgtccggaagcgacccgagttcgccaaagcaccattgaccaactgccttccagtggccatcttcgtcacttcgtacgcacgcctccatctgtacggatatatggagcaagtgttggcattgaacaacgctgaggttctctactgtggtttgtcttctaccgtttaatgttatcagtgacggtaattcagacacggactcaatctattacgtcaacaagattggagctccgtgcgtaccggagggcgaagcgttgggacaaatgaagcgggaactcgtggacaggcgcatcgtggagttcgtcgcaggaggcccaaagaactacggcatccgacacacagcccgagatagagcggatgaacgtgcgaatctgaagatacggagcttccgtctctcctacgcaacgcagcagcttatcaatttcgatgcaatgaaggagctgacgctgtctacgtacaacattgatggacccatgtaaaaagtttccactttaattttttaataataatacaaattcaatttagtgatgatgtcattgacaacgacgacttgttcgtctacggtggtggagcacatcgcgccatccgcgtctcctttccacagattgaccgtaatgtccaggccgacctcttcacccgggaggcccacaaggactatcggcccttctacgcaaagggacgtgtgcgccctgggatgcaaacgcgcccatttggttatgtggaagacgctccacagccaatggatgtcgaacagcagcccccgcccccgccaccagtacgccgaaagaggactttgattgaagcggatcccacccaacccgggtcattcgcgatggttttaacttatttttcaatgtattttttttttgtttttttttttgtaagcatttatttgtattaa

SEQ ID NO: 82791 - DNA, 426 bp, Heterodera glycines
  Genomic contig location: Contig_ID=SeqID_333; Location=303..728; Strand=+
  SCN-specific regions: Sequence locations=1-329,351-426
atgcgaatccgatatggaacaaaaactgtggctgcactcatatttcaatcggcacgtgtcgtcctcactggagttccacaccctgatcaagcccaaaagtttgcagcaagggttctacgacgaattgaatacacacaatgcagaacgatgacaatctatgagctacgtgtggtcaacattgttggagttttaacgtttgaacaaagaattcgagtggagaaattacaacaatctctgggtggcatctatgatcctacgatcttcccagcccttcgatgcaaattagataatggagccacgtgtctcatttacatttccggaaaagttattctcactggggtgaaagatgtagaaaatttaaaaaattcatttgattacttgtctaaaattgttcctaattattttcgataattttatttaatacaa

SEQ ID NO: 82792 - DNA, 207 bp, Heterodera glycines
  Genomic contig location: Contig_ID=SeqID_333; Location=1..207; Strand=-
  SCN-specific regions: Sequence locations=1-207
aaataacagtacagtttgaaattttcatctaaattaaaatggacaaaaattttacgcaacaaatttattttaaaaacaacaaaaattaaataatgaaaaacatctaaaacataatagtgagaatttcaagcgggaaaaaggttttgtgatcaccgcctccaaattagaagacacacggcaagttgggatgatgcaaacggattccat

SEQ ID NO: 82793 - DNA, 1889 bp, Heterodera glycines
  Genomic contig location: Contig_ID=SeqID_333; Location=775..2663; Strand=-
  SCN-specific regions: Sequence locations=1-1535,1560-1889
atgtggggctgtcagtggaaggagcgcctccgccgtgaccacgagctgaagcaacggtacgaggccgtcttcacgccatgcccactggacccccgcaatgacgcattgaggggaggccgcacggagcccttcaagctccaccacgtgtgcgccgacgacgaagaggtgctgtgcatcgacattgtcagcctctatccctacgttatggtttgcattttttttatgggttcgtttcaacaattaaattttagaaggtgaatccctttcccgtggggaacccgatggtgctgacgcgtgaagtgctcctccatccaccgacggcacctcttccgtggacatgcccagaaaacaacaccttccgtggccttctccttgtacgggttctggcgccacgaaacatccgtgtgccacttctcggctaccgtaccaaagacgagcgcttcacatttccactgtgtggcttatgtgcggaccgtcggcaacaacgaccgtgtcggcatgatgacgacaaacgatcgtgggtgtgcgcgtacacccacgtggagctgaacaaagcacttcaactcggctacgtcgtcacagacctctttgaggttgtttttttaaagcattttttttgaaccaatttcaataggtgtgggactacgctgagtgggacgacacgctattcagtagctacgtcaacagcttcgtcggtctcaaagtgcaggcgagtggatggccggagggatgcgacgccgaagagcaacgtcaggccttcgtcgcagagtttctgcgtacggaagggattcatctggacccgacgaagatggccttgaacccgggtctccgtctgatcgccaagactttggcgaactctctatggtattttattttttctacgatatattaaaaaaaaaatgatttgaaggggaaagctcgcgcagcgcgtcggtcacactgagatacaatacacgcgcacgcctgccgaattccacaagctgctcgacgacccgacttacgacaaactggactttgtccatgtctcggaccacatggaccgtgtcgtcgtccggaagcgacccgagttcgccaaagcaccattgaccaactgccttccagtggccatcttcgtcacttcgtacgcacgcctccatctgtacggatatatggagcaagtgttggcattgaacaacgctgagcttctctactgtggtttgtcttctaccgtttaatgttatcagtgacggtaatttagacacggactcaatctattacgtcaacaagattggagctccgtgcgtaccggagggcgaagcgttgggacaaatgaagcgggaactcgtggacaggcgcatcgtggagttcgtcgcaggaggcccaaagaactacggcatccgacacacagcccgtgatggagcggatgaacgtgcgaatctgaagatacggagcttccgtctctcctacgcaacgcagcagcttatcaatttcgatgcaatgaaggagctgacgctgtctacgtacaacattgatggacccatgtaaaaagtttccactttaattttttaataataataatacaaattcaatttagtgatgatgtcattgacaacgacgacttgttcgtctacggtggtggggcacatcgcgccatccgcgtctcctttccacagattgaccgtaacgtccaggccgacctcttcacccgggaggcccacaaggactatcggcccttctacgcaaagggacgcgtgcgccctgggatgcaaacgcgcccatttggttatgtggaagacgctccacagccaatggatgtcgaacagcaccccccgccaccgccaccagtacgccgaaagaggactttgattgaagcggatcccacccaaccgggtcattcgcgatggttttaa

SEQ ID NO: 82794 - DNA, 651 bp, Heterodera glycines
  Genomic contig location: Contig_ID=SeqID_3015; Location=1103..1753; Strand=+
  SCN-specific regions: Sequence locations=1-239,261-269,291-435,472 -507,529-651
atgtacactgacccaaaacattatcattacaattcgactcaaattcatgttaattgctttgtgagttgggtcttaattaatacatcatttctaaaaccctgtctaataattgactaattttacagaaggcccaaggaggtaccgtaagcttttggggctacagtaacccggagaccagagaaatcattcgggtggacgaagtccactgtttgactgataaagctgctggagtgccaaaacagttcaaaagtttgcaagccgaagaacagccgccgatgaaattgagtccaacgcgtccatttttggccaataatgcttcatcacttatgcatgtgttcgtgccatttggtgaccatccatgagagaaaaggggagatcagtgatcagtgggcgatctttattctgcacctgatcagttggccaattccaatcagcaaatttttattttatttttatttttttgaatttttaggggtgtcattcttttgaatccatttctattcagtactatatgcattttgagatttgaattgcgaggatttgtgtgaaattccgagagaattgatggccaattattcagcagtgttattgaaggcggaggcaaaatgtggcgggaattggccgtgccgatgccattggcgaattaaggca

SEQ ID NO: 82795 - DNA, 474 bp, Heterodera glycines
  Genomic contig location: Contig_ID=SeqID_3015; Location=2032..2505; Strand=-
  SCN-specific regions: Sequence locations=1-80,159-303,327-398,430 -433,455-474
atgccgtcccagcgtaacatggcgttggtggacgaagacaacaatggcacggctaattacggcacacacattagcgcaacggatgaggaggagcgggaagaagaggaggtggaggaggaggagaggaggagcgggatgaagaagaagatgaagaagagccacgtgtgcaaattgttgagcaaaagaagtctacatgaacgacccaccacaagtgatcagatgaatagtgattgatcactttttaagacaatcaaaatcctggtcagtccagtttttgtcgatttaaaccaaatatttgaaatatttttgaaaaagctgatcactttgcctcgcttttaccaacaaacgattggccaacgcgaacgaatctctttcaaaggtgcggccataattaaccgaatttattgcaaaggcaaatcaattaaatataattaagtgactttccatttgttcagactcatgcaaaggccatga

SEQ ID NO: 82796 - DNA, 547 bp, Heterodera glycines
  Genomic contig location: Contig_ID=SeqID_3015; Location=2954..3500; Strand=+
  SCN-specific regions: Sequence locations=1-361,383-547
atggtcaaccaactggtcaacaatgccgtgttggactcggaggagattatcgcaaaatcgaagagagcagtgttggagaaagttccagaacaaatcggttccgttgaacttgtgcgaaaggtcgctaccgaatatggaatgatggacgaggtgatttttgaagagatccatcgacatccaaaattacaattgccttcgggcgaaaaccgaattgtcaaggttccatttgtagacaaaaaaaccgaaagattttccttaaaaactttcggaaaaccctcacaaaattcaatcaattcccaaaaaatgtctcgttcaggcgggatatcacccggcctgaactcaatttgctttatgagcttcgccgtaaggcctatgccatgaaccaaagtgaaaatatgtttaaatatgtcgtcgttgacctctccattattactttgaaaactccgcaccctcttcgcccaaaagaactcaataatgttacccgagcaaaccaaactataaaaatggaaaatccttagacaaaaatccatgggtttcctgcctatta

SEQ ID NO: 82797 - DNA, 547 bp, Heterodera glycines
  Genomic contig location: Contig_ID=SeqID_3016; Location=606..1152; Strand=+
  SCN-specific regions: Sequence locations=1-361,383-547
atggtcaaccaactggtcaacaatgccgtgttggactcggaggagattatcgcaaaatcgaagagagcagtgttggagaaagttccagaacaaatcggttccgttgaacttgtgcgaaaggtcgctaccgaatatggaatgatggacgaggtgatttttgaagagatccatcgacatccaaaattacaattgccttcgggcaaaaaccgaattgtcaaggttccatttgtagacaaaaaaaccgaaagattttccttaaaaactttcggaaaaccctcacaaaattcaatcaattcccaaaaaatgtctcgttcaggcgggatatcacccggcctgaactcaatttgctttatgagcttcgccgtaaggcctatgccatgaaccaaagtgaaaatatgtttaaatatgtcgtcgttgacctctccattattactttgaaaactccgcaccctcttcgcccaaaagaactcaataatgttacccgagcaaaccaaactataaaaatggaaaatccttagacaaaaatccatgggtttcctgcctatta

SEQ ID NO: 82798 - DNA, 954 bp, Heterodera glycines
  Genomic contig location: Contig_ID=SeqID_18201; Location=1060..2013; Strand=+
  SCN-specific regions: Sequence locations=1-254,307-336,358-430,452 -653,675-932
atgccaaaagtatcgcaaatatttgcacattttctactaatatttattccgattatatgccgaaggtttgtttttgagttaacatttcttttttctatttaaatggttttttcgcagattttgccgaaaaataccaaaatttttcattttatgccagttttttaagaaaattagccggcgttgccgatagtcccctccgggaaaaactgagttttttgtacgatttgataacagattttgcaccaaataatgccattaattaataaaaaaaatatttgtataaatttcaaaaaattgtaaaaatttgaatgtttttttctaatgccgatttccaaggacatcttggaaatcggcactctttcaattttccaagaccctatgcccaaatccaaggacgtccttggatgccaaggacgatggcagccctggatttattcaattaatgcttgcttgctaattgattaagctaaaaatggtgaggaatcgaaacaattggcaacggtgaagccaatattttttcacgtaacaacaaaaatttgtttaattgatgttgtcagaaaattgaatgaaatttcaaaatgtttatgggaaaaatatcaaagcaaatctttgaatatcgatgctattcgcaatatcaatttggaaaatgaggaggaattaaattttgaaattaaagaggataaagatgggattaacgaaaatgtacaaaagaggagaaaacaaattaattttgaaaggaccaacggacaacggaaaacttcggaaagaatttgagaaaaaaatggaaaaattatttgaaaatgcaaaaaaaaatgccaaagatgaaaaggcctaaattggaaaaagcaaaagcaaatgcggcaaatgatgaagaaaaagtaaatctagaaaaaagaatttaatcgcaaattttgcatttttaattcgtcgccatttttataaaaattaatttta

SEQ ID NO: 82799 - DNA, 135 bp, Heterodera glycines
  Genomic contig location: Contig_ID=SeqID_18203; Location=281..415; Strand=-
  SCN-specific regions: Sequence locations=1-135
aattgttttgaagaaaggagctcaaaaaacgcatttctgcattcattaaaaattttcgattctaatgtcattatcgttcactagaaatcactattttggcgagttcgtcactaaaatagttaaaatcactatttt

SEQ ID NO: 82800 - DNA, 307 bp, Heterodera glycines
  Genomic contig location: Contig_ID=SeqID_18205; Location=141..447; Strand=+
  SCN-specific regions: Sequence locations=1-171,193-307
atgtcgtgccattggttgcgtgatgtcgtgaaagatttcccgttaatgagaccaattagtgagtcgcatgaaaaaatgttaagcaatttaaaatttacctaaatattttgttttattaggaaaaaacccgtgaaattggactcatttctttttaatgataaacaaatataaaaacgaacattttaatgaattacaaagatttttgtaaaatttaagcaaaaagcttgcacttttattttatggagtttggatacagattagcaaagaagattttataattggtaattaaaacaaatttatcgaaaaa

SEQ ID NO: 82801 - DNA, 990 bp, Heterodera glycines
  Genomic contig location: Contig_ID=SeqID_18205; Location=591..1580; Strand=-
  SCN-specific regions: Sequence locations=1-21,50-56,105-341,378 -457,480-510,538-811,844-990
atgacaagtgttgtttatttgattgttggatttgtgataaaaaagaaaacagcaggtaattttttatttcaaatttacagaattttatttattaataattaatagtgaagatcggaaagttctaatttgcagatccctaaattttgcgggaccgggtcccggggtgatttatccgcaaaatcccgcaacttcctaaaaatacagagattagtactcaaaatttttgcgggatgggatcttgcgcgactaaactcgcaactattaaaaaatgcgggatttcggactgggaccccgcaatcccgtgctgctctctaattaattggggactgatttatatggacaaaaattttaaatatgaattaattagttaaaatataggaaaaaaatttcattgtattcaaattctaaaaaagtttattcaaacaattaaatctatgactaaaaacaaaaaaaaagcattaataaaattaaaattcacgattttatggatacgtttacatattgcatacgaaataaattttaaaaaaaaaattaaaacccgcaaaaattcattctctaatgatcaaattttcgtcacattaggtttgccatcagctggtcagatcaatcatcgcgcttttcgggcacttatttgcattgtcagtgtcaattttggcggctattgtatctatttgttctacaccgttctgatcaatccgacaatttcgtctccgatcactgcttggttcctgcaattaattgccgcaattcctttgaacattggcgccgcatcgaacggaccaattttatattttacgaggtggcatttttgaaaattaaattgaattttttaattatattttagtacggaatatcgacaggcattccaagcggagttctcatttgttttaaaaggaatttcaaaccaaaatcaagtcgaaccacagccaaatgtagttgctccaaaccattaattagtcaaacaaatcctgaaattattggcaaattaaa

SEQ ID NO: 82802 - DNA, 652 bp, Heterodera glycines
  Genomic contig location: Contig_ID=SeqID_18205; Location=2231..2882; Strand=+
  SCN-specific regions: Sequence locations=1-17,39-107,137-309,332 -522,544-551,592-652
atgcggtgtacacaaacaaaaaatgtccttgttggtgaagcaattcaaaaagagagcaaagcgccaacaggtaattaacggtgccgcgaagtgccctaacaaaaaagtaatttaaaatttcaataattattaattaggctgtgaattttagtcacgaaattacgaaaagtcattaaaaacgattaaaaagtcagaaaataatgcaaaaaagttataaaaaattaaaggcactaaaagtcataaaaagcgctaaaaaggcacaaaaaatacagaaaaaatgttctcaaaaaattagcaaaaagtaaccattaagcaaagtataaaatatttttaactcattttaagcacatttaaagtcagtaaaaaaaagttatttgacataaattcacagccctaattactataaataaatttaagaatttccacaatactttgtcctaatggttacataaatgacagaaaaattcaaaatgattccaaacagagcaataattccaacaattgaagcgcatccaatgagtgaccagctgggattttcatttttgaatgtcaaataaaactaaatatttattaaaagtttaaaaatatattgaccatttaccgtattgttaattgttgtgtcagtcattagagccaattatttaatttaata

SEQ ID NO: 82803 - DNA, 577 bp, Heterodera glycines
  Genomic contig location: Contig_ID=SeqID_18207; Location=548..1124; Strand=+
  SCN-specific regions: Sequence locations=1-54,196-312,334-577
atgataaaacaaaaattgtcctcgaaattattaagtaagtaattgaacaaagtctaatatttaaaaaatttatctaataattataattaaaatatataaatattcttaaaacttattttcttaatagaataaaaattgcctattaattatgacaattaaaaaaatattttttttgaaaaaattttctttatttttgctttaggccttgatgtccccccaaatgctttcatcgcagccgatgactttgacacagtggaagaattggctgattacttaacgaaacttcgaaatgacaccgaacgatatttaaagtaaaaatgaaaatttataaaaatgctaattacctaatttaaaagccaaatttttagattttttgaatggacaaaaacttaccaaaagaatcatttcgccattatgcattcgccgttttgcaaattgtgtgaattcgcccaccgacagtatgacgaagacctgaaaagtacggtggattttagcaaacattggacgacgagagactgtataaaaggatttgtgcagaaatttttaatcgaaaagaaacgataaaatgtttttttta

SEQ ID NO: 82804 - DNA, 689 bp, Heterodera glycines
  Genomic contig location: Contig_ID=SeqID_18207; Location=941..1629; Strand=-
  SCN-specific regions: Sequence locations=1-485,523-689
atggctaataattttatttcaatcattgaacgatgccttaaaaatgaagaagaaattgaaatcgttgaagatctcgcatttgatgaaaatgcagataaaaagtttaaatttagtatgtggaaagaatttacaaggaaagtcactcaatttgttattgtttgtgaaattgatttaaatttgcacactcgggacaatatcattaaattgcaatcactgatacacaaccagctccaagcaagccggtttaatgcttggataaatttcgcatggcgaaaagctggattttatgggaatgactccttcccaatttttacgcacccagttaaatattgttttgatgcaaaaaagcagccacatcaatgccaaaagaatgaatgtgccaatgttgttttaatccggtgcgctcattgcgaaattttcctatgttttgaacatttttttgtcaattaccatatgtgtactgattaaatgattttgatttagagaaaattaaaataaaatttattaaaaaaaacattttatcgtttcttttcgattaaaaatttctgcacaaatccttttatacagtctctcgtcgtccaatgtttgctaaaatccaccgtacttttcaggtcttcgtcatactgtcggtgggcgaattcacacaatttgcaaaacggcgaatgcataatggcgaaatgattcttttg

SEQ ID NO: 82805 - DNA, 542 bp, Heterodera glycines
  Genomic contig location: Contig_ID=SeqID_18207; Location=1750..2291; Strand=-
  SCN-specific regions: Sequence locations=1-128,152-391,430-542
atggctattcctcgcgataaaatggttcaaataaaagtcagttatcacttcccaaggccaggccctattcagaaaggaaaaaatcaaaggtgggcgcaaaatcctaaggctttttttggctcttcgcctaaaaattaaaatttattattttccaaattaggggccaccaaaaagaggcaatttttgtccatttattactattaacctcaaatatccgatttgatacttgttgttcaaactttatgaaatttgaggtccctaacaaaggagagtgttcgggttatggtggaacttccaaatgaaactttgtaggtgggtagaccacccctgggttgtattgccaaattttttttctagctgcggaataagcttctgtgccgagatatgaggctttaaatatttaataattatattatattaaatttaaaaggagaagcaacaagcgaccggttggcagggtggttgtgtgtcacgatttcatttttgtaatggaaagttcgagtcccccctacgcaaacattttttttattgtttttaataaa

SEQ ID NO: 82806 - DNA, 1243 bp, Heterodera glycines
  misc_feature (60)..(60): n is a, c, g, or t
  Genomic contig location: Contig_ID=SeqID_18208; Location=1..1243; Strand=-
  SCN-specific regions: Sequence locations=1-204,226-500,572-640,886 -1176,1202-1243
tatccgtccgtccgttcagctgcttcttcttcctcttcttctctctcctcctccctttcncatggtccaacagacaaatattccgcttgaacctcggaaactctctttcgtcctcctttttctcgtcgttgctgctctctccaattgggcagctctttcctatgtgcatgacttcatcggtcggttagtttttgctcgattattccaatttcatcaattaaataaccacaaaattattactttttaagcggggaaatttgtcctctttttgagggaatttttccgagattatcgatcgcggcttttttaaactaattaaatgggccgaatgatcctttggcatttgcttctcaaaaagctttgaatgttttcagatcacctcttccggacattgtgttcactttcattgatgaacagccgtgggcacaccccgtgggcgattttatggttggcaaagcaattaaaatttgaattcaatttaaatctgactgacatttcagatttattttaaactatttaattacatattaatgaatctaattaataaaattttattttttttttattaattcaccagtttaagttttgtttgacttattttatttatttccattcgaccattgccatttattgcttttacaattaattttaattggtaattaattttaattatttttaaaataaatttattttataattatttaattatttattttaattatttattttttaatttagatttatttttgtattattttaattctgtccaatttttgctttgttgattattttattattttcattattatttaatgcttataaattgttttaatccatttgttgattttataattgaatttaattgataattattttaatttatttaaaattaattatccctccccttttttgccaggtcagtctttcctccgcgtcgctgattttccttttcgtcctgcacaaacaccgcgtgttggtcatccgtcgtacgctgttcatcaccgcctgtctgtactcgctgcgcactttgatgatgctaatcacccaattgccctccggctacagcgacaacggcgccaaatgccgcgcggaattggcacccgaacagcggacattgcgcgtttacattcagaggacgttggagcagacaattcatgtcggatttcaggtgaaagagccgtgggggaaaagaaaatggggtactaacgcgttttgtcgtacccttttaaaaatgccatgaccc

SEQ ID NO: 82807 - DNA, 267 bp, Heterodera glycines
  Genomic contig location: Contig_ID=SeqID_18210; Location=94..360; Strand=-
  SCN-specific regions: Sequence locations=1-36,58-267
atgggccatttgctccgcttctgctcattgcttctcctccctttgctgctgctcattccgttctctgtccgcccacatggtcaccaacatttgcgtgaatcggcgccacaccagcagtttcaactcgcgttcgtgaacatcgaattcgatcggatgggcgaatacgacggaatggaactcggtgttgagcagttcgccaaggcgtgccaaccggtcgttgtccacgcagcacacgcagcgacctgtgcgacggtcgcgcacctttaa

SEQ ID NO: 82808 - DNA, 1728 bp, Heterodera glycines
  Genomic contig location: Contig_ID=SeqID_18210; Location=444..2171; Strand=-
  SCN-specific regions: Sequence locations=1-107,133-259,282-607,629 -666,688-728,780-934,977-1086,1109-1647,1703-1728
  Gene Ontology: Cellular component=extracellular space
atgggccaaggcgcgtacacctgcgagcccatcaatgtcaagggccgcgtgttggccactcccgactgcatcgtgcgcattgtgtccattcccgcgccgcagacgccccaacctccgccgccaccaccgccagagccacaacgattggcttgcaattcacagggcgcgtacagcccgtacagcgacgcgcgggggcaatgccaatgcaaagtatgccgtgggaaaattccaaaaatgcattcgcaataattaaatttccataattgattttgattgaaaattcccacggctttcagccgcttacttccggcccgacatgtgcccaatgtgtgccgggcgcttaccatttgagcgaccgcgccccccaggggtgtctgaagtgtttctgtttcggtgtcaccgaccaatgctattcgagcggattgttccgcacaaaggtggacaattacaatttataattccccccccccccccaaaaaaaacattttgaatttcctcaaaagcttttctttagttaattaattacaattttatttctttcccaattttcttttcgtttttctttcgtttatttttagttcatttaacttttgggcttatttaacgctttcgcttcttccttttcaggacattgcttgtgtaagttgcttgctaatcggaataagtttactttttgtttggtttttggccatttccctccgcctttctcacttttttaacatttttggttttataattattttaaattatgttttaaaataaaaaaaacaattaaattagcgatttccaattagtgctgcctaaatgcttattgttaaatgagtcgctttccttcacctctttcatccattaatcacttcacaaattcacccgaatcacttttgtttgctttttcctcattttgctgataacatttttcagtttttttaaaaccattaattaattaaataataaattaattgtttttgcttaattactctcttcagcaaaagctcttcttcgccgacgatgcacaaggcgttgaactgtcaaatgtgcagggacagactcagcccggtgttcagttcgaattcgaaaagtacggctatctgacgcacacggagccgcacttttcacaaacgctctattggaaattgccgaaacgtttcctcgggaataaagtaaataattttgagcctatcaatgtaaacaactaattaattgcaggtgaccgcctacgggggcgatttcactgttcagttgcaatacgatgggcaagcccaaattcgggaagagccgcttgtcgtgatccaagtaggcagcaagccatacgtcgatcagtgccgatcgatcaatgcgttaattgcgtccattaagggcaatggggtaacactcgtgcacaaaccgaccgaccaacaggcgcagttcgtgccgggacagccctttaccatttccgtcaacacttacgaggcaattaaccacaatgcaaacgcatcattaataaatgcggcttttgtgcagcaaaactttgaacatcagaacggatcaccggccagccgggaggatttgatgatggcattggccggactgaaccttgtcctgatcagagccacgcacacggacgaccaaaccagcacaaggtgggaatttgagaaaaagaaccaattctatatatattaaattattattctataaataatgtatatgcaaataataataatatgtcggggattgaaatggacaattaaa

SEQ ID NO: 82809 - DNA, 743 bp, Heterodera glycines
  misc_feature (5)..(5): n is a, c, g, or t
  misc_feature (15)..(15): n is a, c, g, or t
  misc_feature (70)..(70): n is a, c, g, or t
  Genomic contig location: Contig_ID=SeqID_18213; Location=218..960; Strand=+
  SCN-specific regions: Sequence locations=1-134,163-500,522-545,656-743
  Gene Ontology: Mol. function=transcription factor activity; Cellular component=nucleus; Biological process=regulation of protein activity, epigenetic
caccnagccaaaggnaacaactgcaccccgcagcaacagaaccatccagcagatgctgcaacaacaacanccagtcacagcaacagaacgcggcggtggccgcactgatgggccaattgttcggggcggcgacattccaacagcagcagcagcaacaggtggggaaaggggggggatagcccatttatcttgtaattaatcctcattaggcggctatatttgccctccagcaacgtgcggctgctccgcccgctgttcagcaacaacaggcacctccaccagcccatcccccgtcggcactgccgtcaaacactgctcagcacattggcaccgcacaaaacggaccgaacgtggctcaacaacagcagcaggcgatgatgcttttggagatggccgcagcggcggcaatgaacccgcagcaattgatggcactgatggccgggagcggactcgatgcgaggatacttgacgaattaagaggtcgagcgggaaacgaaacatattacacacaaattcaatttgacgcttaaggacatctgctaaaccagcagcagcaacaacagctgacagcgaatgctgctgcagcacagcaccaacaacagcagcaagcattggcagcacagcagcagcaagctgtacatcagcagcagcagcaaatgttggcaatgttagcaacttcaggtgctttgacgcctgaacatctacaaatggctgtcattggccaacaacagcaggtgacataa

SEQ ID NO: 82810 - DNA, 220 bp, Heterodera glycines
  Genomic contig location: Contig_ID=SeqID_3020; Location=648..867; Strand=+
  SCN-specific regions: Sequence locations=1-131,153-220
atggacggcaacggaagtcaaaattcggcagaaaacatttggccattggcacatgtcgacaatgccgaattggatgatggcacatcgtcaaaggcgaattcgactgaattttgtgaggaaacaacggaagagggaggcgaggaaaaaggggaggacaattcttcggatgggccaaacgaagaaccccagtcagaagatggatctggcaatgaggacgaag

SEQ ID NO: 82811 - DNA, 1263 bp, Heterodera glycines
  Genomic contig location: Contig_ID=SeqID_3021; Location=1523..2785; Strand=+
  SCN-specific regions: Sequence locations=1-291,360-729,751-970,992 -1037,1059-1222,1244-1263
atgccccgtgctctgatcaatcgtcaaccgccggtgatcagtgcttcgacgaaaaaaacgggccgcaaacgcatgtcagcttcgtcgagtgcctttgttcccgaagacgaggaagacgcaccggccgcctatcgcttgccatcgaatgcgatgggtgacgcacggggacagaagcggaaaaggtggggaaatgaatgatcgagtcgcactgtgtagggctttgtgtttcttctttctgtccatatgccgtgcttctcccacctgtccaggtccgtctcttcatccagcagttcttcctccgtctcctcctccgattcttcttcttcctccggctcttccagctcgtcatccgcttcatcacatactccactgaaaaacgcaaaaccaaatgcatcagaacatccatcaaaaaggacgccgaatgagagggagaaaagcaacgacatgagcggaagtggtggcacgaccattagctgctcaactgtggaccaattggcgctcaaagtgacaaaggcggagcaacaggaagtaaatgcgcaaaatgtggcgcaaatggatgacgaaagtggacacaaagtggcacaaaaggcagaaatgcatttgaataacaaaaattttagcaattgagcaaaaatattgcgacaggagaaagaaaaaacgtcaaaactgaaaaagctccctgcaattcttcccgtttggccgatggggacaaaaagacgagcaaaacgaaagatgaaagaaaaggttggggcggaaaatgaaagcaaaatgaatgccacaaaaaacacacatttatcgatgcagatgaaccaatggatgaaaagagtggtgccgcgccgtcctccgtcgatcatagcaaaaagcgtagggaacagttgctgagacagctccaatcggtggaagaagccattgcccggaaaaggtgggcagcgaggaccaattagaattttctgtgatttttgtcgtttaaggcagcgcggggaggggacgagttgaagtgaattggtcccatggaaaatcgactaattattcgaatttgttaaaactgatatttatttgggttttctatttgaagggattttgtgatattagtttcgtctcattgacttcaattttgatgtcgtacgtagtgtttgttggtggtctgtcattcatggcaagccaattttggctcgccaaatgtctttaatatttggcaatttctatgttttgttcccaacttataacaataatatgtttaattaagtatacatttttgcttga

SEQ ID NO: 82812 - DNA, 2219 bp, Heterodera glycines
  Genomic contig location: Contig_ID=SeqID_3022; Location=741..2959; Strand=-
  SCN-specific regions: Sequence locations=1-125,179-442,464-1295,1317 -1475,1497-2219
  Gene Ontology: Mol. function=transcription factor activity; Cellular component=DNA-directed RNA polymerase II, holoenzyme; Biological process=negative regulation of transcription
atgaaaatttacaaactctcccaattcaaagccgtcgcagccgctgaacttcaaaagtcggcctttgttttggtggtttcgtacgaggaattgaagtcgaacaggtacaacacaaagagtagagcattttaagaataattgaaacttttcccatatttttcatttttctcaggctttccacggtcacttccgaagggcaccgttggaattatttggtgttggacgaaggccattgcatccgcaaccccaactcgcaactgttcgacttttgctgctctgtccgtgccgcgcatcgcctcattctatcgggcactcccgtgcaaaattcgccggctgatttatgggcacttttccagtcattaaacaatttcgctggccatctttttaatttggtttctagctttttgatgcccggttatctgtccacccgtgccgttttccaagcgaaatttatgcggcacattttggcatgtcgaaatgcacgcgccacggagcagcagtgcaaagtgacgaactggtcaatgggggaaggaattgcgtttatttgcaggatggggaaaaagcacttcaactgctccatcgccaatgccttccctttgtgatgcgccgacttaaagtgatcagaaaatggccaaacatccggtgaattgccattgtacgctcgctttttcagactgatgttctgacggaactgcctgaaaagattgtgcaagaccaacagtgcgagttgagcgacttgcaaaaggcactttatcagttggtggtggacaattgtgccgttggacaacagccaaattgtgggtgaatttgccaacgaaaagcatttgatcaattaatcgttaatttggggatttccttccctcatttggaagggtaaacccaaaatatacagtcaattagaaaacagattcttcacattcagcagcttccgatcgcaatcgttggttttcgcctcttcaagcattgcacatgctgcgcaaaattgtggaccatccctcactgatcaatgccaatttgattgatcaaatttgtgccggaaactccgaggcggcagaaatggaaaaacgccaacgaattatggaagaaatgaaaaaattagtgagcagagactaaccgataaataataattcgcaatttaattctgttccaagagtgttgatcagtcgggaaaaatggtggccttccgtgatttgcttatccaatgccaaattggcgatcggacagtggcaatgggaggcgataccgaggacaatgcaaatgatcaaaaaagtgattgatcggggaaggggggggcggtggtttctttcaatggcccactttttcagaagcgccttcgacttcctttgccgttcctccgcccgttgcccctccgcttctctttccgtccgtttccggcggtgcccatcgtgcgttggtcttctgccaatggcgtgcaactctcgaggcgtgttgcattttttgcatggcaatcagttaaacatgtcccttttctccacttttagttgatcattcactttttggaccgcggcgctttcggagcggagatttcttggcttcgcctcgactcgaccgttccggcaaaggacagacaaagtgtcgtcgaccgattcaacaccgacccgtccattgacctgctgttgctcaccactcatgtgaggacgaaaaatatttattcaaatacgttaagtctggttggttatgttttccacaacattttgtccccttcagatcggcggagtcggactgaacttgaccggtgcggacgtggtcatcttcgtcgaccatgactggaacccctttcgcgacttgcaggccatcgatcgggcgcaccgattgggccaaaaacgaacagtgaatgtataccgactgatcactcgaggcactgtcgaggagaaagtgatgcgactgcaacggttcaaaagcgacacggcaaatgtgagagctgactatgatggatttcttagattaatttactcaatttaacaggcccttgttggcgctgacaaccgatcattggccggcatggcaaccgacgaactgttggaactgttcagtttgggcgatggcgccgatgacagtgccggaaagcgaaggcgggaacagcccaaagcgaaacggccgagaatggacgcagacgaagccattgcagccgcgggacagtgggcgatggaggagttgtggacggtggcgggcgatgaggacgacgagaagacagagca

SEQ ID NO: 82813 - DNA, 808 bp, Heterodera glycines
  Genomic contig location: Contig_ID=SeqID_3023; Location=385..1192; Strand=-
  SCN-specific regions: Sequence locations=1-19,41-166,203-808
atggatgcccttcgtgtcattttccccgctttgcgttcgtccgttctccgacgtcgaatcattcgcgaaaggattgccccgcacattcagaattgcttcgtccttttgtcctccgcgaatcccgctgttcgcttccgagtgcccttttttctttttgcaataatcgtttttaaaaatcatatattaattgttaaaatattatccacaagaatcgccagccattgaaatttggtcctttcccaaaggtttctcgctttttgtctgaatttgcatccgccgaactctgtccaatcctcaaactttgttaccagcgtttttccgactttatctcaggtttcttctttttggttttgctatttttctctcttttaggccccctctccaattccaattttgctcgttgcggtgtcattgagcttttggtccgtttggcagccattggcgcgccaaaacttttaggcattttttttaattcgtaaatttaaattcgttttttgctttcggtgtcgtttctctgctgactccgatcgcactttgtgcaataagcgaccaaattgtcgaggttttggtttcttttttttccgttttcatttccatctcattttttcggttcgcaattctgccgcttttgccctccgtcagctgattacgcttttgccattggaaaatgtttgtttccctccctcctccccctaaatattcatttcgattttaaatggtttctctctttttcagcgttactcccatttcttggctgaactcgccgatccttccgatggcaattcacagttggccaatgcctacgccg

SEQ ID NO: 82814 - DNA, 2361 bp, Heterodera glycines
  Genomic contig location: Contig_ID=SeqID_18214; Location=37..2397; Strand=-
  SCN-specific regions: Sequence locations=1-203,225-355,377-496,518 -650,672-882,904-942,964-1237,1259-1562,1585-1715,1738-2276,2299-2361
  Gene Ontology: Mol. function=sulfotransferase activity; Cellular component=integral to membrane; Biological process=heparin metabolism
atgaaaattctacgcaaaaatgcgttattcgtcgccatatttttcctttttgcctgggttttcctttggttttttctttccccacaaaacaaaggtccgaatggactttctcttcgaccgcttctccttttttacaacagagtaagtttttcaagcgttaaaacattaaaaacagttaaacgcttgtattttgttattttggatttaccagaggatttaaatttctaaatttcgttatgtttcgcttttcctttctgttcagatacccaaaacgggttcgacaacatttgtaaatgcaattgcctacgatttgagtactgtcaatggtttccatgtcgcccatttgaacttgacgaaaaaccgttaccaaatgaacgcaattgaccaggcgcggctggtccaaaacctcacaaattggcaacggatgcatccgcttttcctccacggacacttcgctttctttgattttgagaggtcggccaatgtccaaaatcactaatttatgcaaattgcctctgtccgtcctcgcctttgggtcccttctcattaatacattttccccatattttctgcattcctcattattttcagattcggccttccccctcccatttggattaatttgcttcgcgagcccttcgatcgctttgtctcttatttttattttcttcgctacggcgacaattttcgggtcggacttcgcagaagcaaagcggggaacaacgaggtaaattgtgaacatttagtgagttgaattggccaaattttgaagggttcacttagacttttgacgaatgctttcggcgcggcggcagagagtgcgacccaagcgcaatttggctacaaattccgtacttttgcggcactgcccatttctgcaggtcaaagaaaacccaaccatttggccgccattgaatgaatccacccactaaaactagaacaatttttaataaattcacaaaattaggctttttctccggccctaaatcctttctattttcgaaattatcgccgtattgtccaaaagcaaaattttctaatgggttttctcaaaaaatgagcaattaggtttttacaaggcacaaaatttgatttttattttttacattattgaaaaatgctgaactttgggctttttcacccaaaatacggaatttacccccccccccttttccattatttgtcactcactaactaattgtttaattggtaggctttacgacttctttttttctgatttcctcacttttcttccctttttaagcattcccggcaatgcgcaggcccttcagttggcaaagcgcaatttgctggaccattttctgttggttgggctgacggaacgcatcgaagagaccgtccttttgctggagcaacttttgcccgcctttttccttggcgccggcgaacatttccgcttgctaaatggtgtctttttttacatattccctcataatatttgttggaccaattccattgttaattattccgttaatttgtaagatacgaaaatttatggttaaatgtgaattattttttcctacgggcactgaaagtaactgatttaaatttatttttaaaattgaaatagcttcgctattaaacactgtctctagagggcgctacgcgccaaaaacctttataagatggcaatggattttttggcatggaattcaattaattttttcattaaactctaacttttaatatgaccacttaaaaactcttccctttctcttcctcttccactttctattcatttattaaacaacccaataaaataacccgtaaaacccgtatcgtaattgtacggataagggttacgggtttgacatcgatacgggttacgggctaaaaacccttaacccgtaaaaacccgtatcagccgaaaaaaatacgggttacgggcccgtaaaaatccgtatacgggcccgggcccgtacacgctctctattgaaaattatggccaataaaaatctacttaaatttcgacaaaaaatgccaaaaatgttttatgattttgagacatagaaaagtaaggtgtctcaggacgacaattatttattattcccggattctctgcctcattagcgcaattaaacattaaatttttaagaggacagaaaatctttgcggcacactcttcggaagtttccgccaaccattgaaacattgcgcaaattcaagcagcataaagtttatcggatggaacgcgaattttacgattttggaaaagcggaatttgaattggcgtggaaaaggtcaattggggaaaaagaaaacgacgaggagagaaagggacggaggaagcaacaaaagtttatgagtggacaattccattttgagaagataaaaagagga

SEQ ID NO: 82815 - DNA, 154 bp, Heterodera glycines
  Genomic contig location: Contig_ID=SeqID_18218; Location=757..910; Strand=+
  SCN-specific regions: Sequence locations=1-154
atggattatggcaaaggctatttccgatcagaaggcagagactattgcaaattcatttgtcgagatggtgatgatccaaatttggaacaggaggaggcagaagaaagtgaagaagaaggattcgagattgtcttgagtaaagagaaagaaatga

SEQ ID NO: 82816 - DNA, 2162 bp, Heterodera glycines
  Genomic contig location: Contig_ID=SeqID_18219; Location=1..2162; Strand=+
  SCN-specific regions: Sequence locations=1-814,836-1449,1471-2162
tcattggtgccaaagacaaatggcaagctgcggttgtcctttgactacaaagtcacggtaaatccttggttggatatacataaataccaacttccacgccccgaggagctgttcagcatcttgaatggaggcgaaaaattcacgaaaatcgatttgaaggacgcatatttacaacttttgcttgacgaaaaagccaaaagttgtctcacaatttgcacgcacaaaggacttttccacttcgctcgattgccattcggagttgcttcggcacccgcaatttttcagctagtaatggaagaagttctgcagggcattgatggcgtggcagtttatctggatgatattctgatcacagcagccactgatcagcaacatgtcaaaagaatcgaccaggttcttaaacggttgtcagagaacggacttcgagtcaagcgtgaaaaatgtgaattcctcaaaccggaaatcgaatatttgggacacattgtggacaaaaaaggtcttcatgcgtcacctggcaaaatcgaggcaattttgaaaatgccgaagccgaaaaatctgaaagaattgcagtcatttctgggaatggtgaactactatggaaaatttgtgccatccctggcaacgctttcagaaccgctcaatgaattaaggcgaaatgacgccaaatggacatggacaaagagccaacaaaaggcattcgatgggatcaaaaaggttttgacatcaaccgaagttttggtccattatgacccgcaaaaaccactttttctggccgctgacgcatccgactatggagttggagcggtcatttttcacatagatgaaaaaggaaaagttggtgattgcgtatgcctcccgaacgctaaattcttcggagcgcaattactcgcagattgaaaaagaagcgagggcaatcatttttggagtcgacaaattcaagcagtacttgtacggtcgaaagttcgtacttcaaaccgaccacgagccactaaaaaagatttttgggccaaaaggagagctcccgattgtggcggcaaaacgacttcatcgatggtcactgacattgatgaacttcgactttgcagttgtgtactgctctacaaagaatttggcaatgcagacggtctgtcgcgattgccgtgtccggaagagacaaccatcgactgtgttggactggaacttcagcaagttcaggccgaaaatatttcatgcttgccggtcacagtcagtgccatcgcaaaataagtcaaaacggatgaaattcttcgaaaagtgaaagaattcatcgaaaaaggatggccacaaaaagtcgaagaaggactaaaaagttttcatgtcctccgaaatgagttcgccttaatggaagggtgcatcatgtttggaaatcggacaattaaccggaaagaccgtggaaacgaatacacatcgatttctgcggaccattttggggataaatgtggctgatcatcatggatgccaaaagcaaatggcctgaagtggtcagaatgcgaacaacaacggcattggccacgattgaggcgctaagggttgtcttcacagcgcatagacttcccgagcaaattgtatccgataacggaccgcaatttagttcaaaagaattcggtgattattgccaatcacggggaattgtccacacattgatcgcgccatataatccaaaatcgaatggagccgctgagagatttgttcaaaccttcaagcaaggcatgaacaagctcaaaaaggaggagatgaagcaagaaattgcattgtctcaatttctcctgaagtaccgtatcacgccgcacgcagcaacggaattggcaccttcagaaattctcttcggccgcaggcttcgaaccttgttggatttggttaaaccaacagcggcgaatgaagttgaagcggccaaaatgcaaaaaagttcctacacggaacgaatgaaaaggaatttcgaccgtgagacaaatgcgcgaaaaaatttcaaggtgaaccaaagagtttacgcgagaaattatcgcgacggatcaaaatggatccaaggacaaatcacccgacaaattggcacggcaatgttcctcgttcgaacggcgagaggaatttggaagagacactttgatcagttgaaagaaaatggaccgaagagccttcggacaattctg

SEQ ID NO: 82817 - DNA, 373 bp, Heterodera glycines
  Genomic contig location: Contig_ID=SeqID_18221; Location=398..770; Strand=-
  SCN-specific regions: Sequence locations=1-60,82-160,184-207,229-373
atgcctattaataaatttgaaggtgaaattgcaaaaaaattgggcactaatcgctacaaaatttataaattgaagaaaaaattaggacaaacccggaattacaacgaatatatggacataaataaggacacaaaaagcgaattgatcggaaaatttgatcaaatgagaaaagaaaaaatttatggatttaaatatgacaagaaaataataaatgtaattgaaagaagaattgctaaagatttagaaattaatcgggatataatttacaaatggaagagggaatttggtaagaaacgaatggcataaatgaattttacttattctaaggtagagagaaaatattttcaacccaacagaaaattgaaaaaataaa

SEQ ID NO: 82818 - DNA, 198 bp, Heterodera glycines
  Genomic contig location: Contig_ID=SeqID_18222; Location=409..606; Strand=-
  SCN-specific regions: Sequence locations=1-198
atgattttggaacaaatgttgtctgcccttgaaatattggaggaacaaaatgataatttaaaaataaaagtgccaaaaattgaaatgaaacaattgaacgaagaacaatttaggaatgagtttgatgagcaagctgatcagaatgtttcttctattgatcatagcaattctgcagatgatgaggattacaataataag

SEQ ID NO: 82819 - DNA, 532 bp, Heterodera glycines
  Genomic contig location: Contig_ID=SeqID_18224; Location=563..1094; Strand=+
  SCN-specific regions: Sequence locations=1-335,357-366,388-498
atgtggcgaagtgacaaaagtatcaatgtggataagaagccaatggtttcgagagcagtgctgcgtgagggggaaaagctagttatcacacagtcccaacataacccggaatgtaaagcagaaacaatggtaataataaaagctgaacaagtagatagaaaacaaaaaaaaagaaaatcttcaagtgtaatacggatgttaagacaatctggagacaaggtcttgaaaaagttagggaagaagatgctacaagcacaaggatcagaagcagcagacccctttgatgtgccgccaagactccagctaacaaagtttggcgctataaagctcataatgggaaaaacaattgctggaagtgaatggatgatttataaaaataaacaaattggtgttactattcgcttccaaaactcaattggaagcagcaaaaaactgtcggaaatgtcgccgacgcgacattcgaactcacaccaaaaggtttcagacagatttggctcatccatggcttggtatatatttattatttaaacga

SEQ ID NO: 82820 - DNA, 89 bp, Heterodera glycines
  Genomic contig location: Contig_ID=SeqID_18224; Location=1271..1359; Strand=-
  SCN-specific regions: Sequence locations=1-28,50-89
tgataatcgctggaacgccaaattatgaccaggatgtgatggcggtagtcaatgacccaatcaaagagcacaatataatgtaataaata

SEQ ID NO: 82821 - DNA, 378 bp, Heterodera glycines
  Genomic contig location: Contig_ID=SeqID_18225; Location=416..793; Strand=-
  SCN-specific regions: Sequence locations=1-6,147-157,343-378
  Gene Ontology: Mol. function=snRNA binding; Cellular component=small nuclear ribonucleoprotein complex; Biological process=snRNP protein -nucleus import
atgggtgaaaaggagaaaaagaaaaaggaaaaacgggaaaaaggagaaaaaggtgtgagaaggaaaagaaaaaaatagcaaaaagagaaggggaaaggaagaaaaagaaaaaaggttagggaaaagagagaaagaaaaaggaaaagggggaggacaaaaaggaaaagaaaaaaagggaaaaagaaaagttgaaaaggaaaaatgtaagggaaagggagaaaggacaaagaaaaagggggaaaagagaaaaagagaaaaggagagaagggagaaaaagagaaaaaggaaaaatgtaagggaaaagagagaaaggaaaaggaaaaggaaaaagaaaaaaaggaacaggaaaagagtatgagaaaagtgttgaccgaatga

SEQ ID NO: 82822 - DNA, 873 bp, Heterodera glycines
  Genomic contig location: Contig_ID=SeqID_18227; Location=1502..2374; Strand=-
  SCN-specific regions: Sequence locations=1-29,66-292,314-332,354 -410,433-456,478-509,531-537,560-873
atgcggtaatttgcagaattgcggtcccgattaaaaataaatttaaaaattttaagaaaattaatcgggcataaaaacttatcgatagatgtgtagagctcaacaagagctttggaattagctattgaatgttaagaaaagttaagttttttgttttttacgagcctattttacataccttaattaaacaattttctatcaattgatatttcttttttacagtggcctcacaaacggactatttgtattactgtcaactttccatttctcctttattttttgtgcatgcactcccggattcagtaaatggaagttcgatttccctcataagataatatacacattgtatgtgagtcccctccatccatcggaaacagaaaaatttcacacagtccactcaatgtgagtccgctgctagactgactgactgaccgacctctcatcagccactcactcccacactcacttccatttcttacattctcgtgcccattcaaacaacaaactccttcaattgtgtcttattctctcgccatttctcctcacactctccctcacatcagtaacgtccatttgccaaaatggtgaggaccaatccattgctcttcgagcttgtcttcgataatggctaactggtcgaatgcttgttgtgacagcttttcttccttgtgcttagctatcggaggaactctccatttattacattcttttcttgtcggcccttttgaggtttctgatcaattattaatcagaaatagattttatgttcaaaaaatgttctagcaaaaagtcgggtcggtcaagttactgattgtccgagcgatgatttagttggttggacttatgaagtgaaaaaaaccaaatgaaaataaa

SEQ ID NO: 82823 - DNA, 829 bp, Heterodera glycines
  Genomic contig location: Contig_ID=SeqID_18227; Location=2729..3557; Strand=+
  SCN-specific regions: Sequence locations=1-740,762-829
  Gene Ontology: Cellular component=mitochondrion; Biological process =proteolysis and peptidolysis
atgatggctgctcaaaggattttaggcgctcttggacaaattggtgttggacttactgccgctggagttcttgctcaagctgcactttacaatggttgttttcgagaaatctaaacttctaatttgtacaatgtgtgttcagttgacgctgggcaacgcgctgttattttcgaccgttttaccggagttaaaccgaatgttactggcgaaggaacgcattttttgatcccatgggttcaacgtcctatcatgttcgacattcgctcgacaccaagggctgttaatactatcactgggagcaaaggtaaagcggcacgtcttacttattttacttggtgcaaaatttagacttgcagaacgtgtcgatcactttgcgtatcctccatcgtccagacccatcaaaattgccacaaatctaccttaacattggcacagattatgctgaaagagttctgccatcaattacaaacgaaattctgaaagcggttgtggtaagtgtttttaattgaacgaggctctcagctacatttggatgtaaagtacaaactttgatattaaactccaattttagctataatatataaaatttagagtactcattcgttttttaccgtctatataggcacaatttgatgctcacgaaatgattactcaacgtgaatcagttagccaccgtgtgtccgtcgaactcgcagagagggccaaacaatttggattcattcttgatgacatttctatcgtattcttttgattttacctttctttttgcagaattagtctgattctgcaaaacttttttggggtctcaatccttcgcccgggtcgacta

SEQ ID NO: 82824 - DNA, 621 bp, Heterodera glycines
  Genomic contig location: Contig_ID=SeqID_18228; Location=918..1538; Strand=+
  SCN-specific regions: Sequence locations=1-206,228-232,265-461,497-621
atgctaaacggcagacaacttgaagacatgcaaaatgtgttgaacactcagccaaattgggcttcaaaagaggttgcggaaggaagtgccgactttccccgttttgcacccatcgccaaaaaggcggctgccacgggggtactgaacaaattcggaggaagtggggcacggaactgttactttagcccagtgagctgcatgcttcttcatgtaagcatttatttgcaaattgaaaaaatagtaatatttataaataatattttaggatgtgccgaagtacaaaaagctaatcgaaagcactcccaacggatgggctccgcttcatttcatttgaattttgaagccaaaaagaatgccaaaatttttttctctcacaaaacaatttgcgaactgtttttgaagataaaattaatggtttaaatgttaaatttcgatgtaatggcaattataattttggatgcaaatttatattttaaatagaatttaatgaaatattgtggaattattggattgcttgatcccctttcaatttaattagatgtaattccgttaattccttaattatttgcaattttctttttggtttctaatttagtaattttttggataatttcaaaaata

SEQ ID NO: 82825 - DNA, 198 bp, Heterodera glycines
  Genomic contig location: Contig_ID=SeqID_3024; Location=1934..2131; Strand=-
  SCN-specific regions: Sequence locations=36-198
tttggttttattgcatttttgttaaggaattttccaaaaaatgtcgaaatagtgacaaaacgccaaaaatagtgatttttaactattttagtgacaaaaccccaaaaatagtgatttctagtgacgaaaagtgacgtccaaatgaaaaaattttaacgcagaaatgcgttttttgagctcctttcttcaaaacaattg

SEQ ID NO: 82826 - DNA, 755 bp, Heterodera glycines
  Genomic contig location: Contig_ID=SeqID_3025; Location=129..883; Strand=+
  SCN-specific regions: Sequence locations=1-47,75-253,275-375,434 -543,575-729,752-755
gccgaactggcgcggtggttgaagtgcatgagctgcagcagaaggatgcggcccagcaacagcagcagcccaacgaatgtgtgaatgtgtcacaaccgatcacacaatatgatgtgcactttcgaaaacatggcacggacaaacaccaacaggtgggcatttatttatttcaaatttcgtgaaaactgtacaggaagtttgacagaatgccaaagaatttcctttaaagtttttcaacataattgaaaaagactaaattaaatttaaaattaaagaatcattttaacaacggacattcgtgaaaatgaaaaatattagatttacaaataatccaaatttgtagaggaaggttggcagaatgccaacaaattttcctttaatattttaaatataattaagaaaaatttaaaaaataataaattttattttattactctaaaaattgtctgcacttttaaaggagaagatcaagaatgcccattcgagcagcaatcgtattgtggtggacaacggtgtgctggaaaagtacacagagtaagtttcaaaaaaaataaattaaaaatttcaaaaaataccgtacttttattgattagctacgatgttacggtaagctggctgaaccattactgtccagcgcaaggccaatcggaggccaaaccgttgcacaccggttttggctatccgtccgcgcccaaggacccaaaagcgttggcactgacgccggacacggtgctgctcagctggaccttgcctga

SEQ ID NO: 82827 - DNA, 771 bp, Heterodera glycines
  Genomic contig location: Contig_ID=SeqID_3026; Location=1081..1851; Strand=+
  SCN-specific regions: Sequence locations=1-120,176-324,351-353,379 -400,422-438,461-495,520-691,713-771
gtgattcaatgttcctccgctggaatacattgatggccggtgtggatgtctcatcatcccaattagtccaaatttccatccaatatcgtcaggttcttatgaaatttatgaatttaccacttttttaatttaaatgatttttaaattattaatatttattttaaattatttttttcagagcggtgtggacgcctcgtggacggatgtgcgcaattcgaccttttcgctcacggatttgccccaacgttttgtgtatgttgatcaacttcatccggccactgcctatgactatcgatatgccgctgaatacaccacaatatttggtataaattttttttaaattaaaaaatggataatttatttaatttaatttaatttttaaaaattaaaataccaaccgttttatttttatggaaaaaatctagagctcgacattttgatggaatttttcaaaaatttctctgggaaggtggccatggtctccgctgtacccgcattaattaattagttaattaattattggttacacagatggcattggcactatgccaaccgctggaagtggtgccgtagatggtgcacagcagcaacagcagccgacagtcccttccggcgacgccaaagagtctcagcaacaacagcaatgggacggcaagaagtcaatgcttgccgaaacgttctatcagcagagtcaacaagcacgtacaaaagcgggcacaccgtccgcaccgttggaagtcaaactgaacaatgagcaatgctacagtaacg

SEQ ID NO: 82828 - DNA, 1446 bp, Heterodera glycines
  Genomic contig location: Contig_ID=SeqID_3027; Location=226..1671; Strand=-
  SCN-specific regions: Sequence locations=1-121,422-446,468-478,500 -530,581-770,849-890,981-1226,1255-1319,1341-1446
atggcctccttgagaaatttgactctattttcctcacaattgtccttcaaatatttgattgccacccgtacggatgttggtgggatattatttgtgagcataagaccctaaattaaaaggttataaaatattatgtatttaatttaattgttttaatattttaataaataataattacaattaattaattgaaaaatcaaaattttgaggaaatttacaatatttttttctttgaacttaaattatctttattaattaataaatatttaaacaaacaaattatttctgtataataaaaattaatgcatttaaatattttttaatttttgaattataatttttttttttagttttaaaataaataaataatacaaattttaaaaatttatttaaagtaaatattcaattttctttaaatattcatgaaaaataatgccatcacctcgcaaactctgccaaaactgcccatgcccaactctttggttgccttcacactttccggtttaagccgaggcagtgctaataatgcgaatttttttttaaattttaaaaaattccttttattttttactttttaattcgtttagcacttcctgtgagaatttgtgtgatgattgtgggaattggatttgttgtccaatgctttccaaacagattggtttatgcaatttttcacgtatacgtctgcgttcggccaccttccaacgcactaaaatggtgaaagaaattgtataaaaattagtaattaatgcatcaaaatttaattggtgttttaattaaattttaatccaaaaattagctaattaattaatcattagtttattttgtatattttgaaaaaattatatgattagatggcgggacagatcattagtgactaattgaccgagaaaaattattattttttttttaataaaataggtgaatttttacgaaaatttataaaatttcttataaatttgttaattaaaattaaaaatgcagaaaatcaggcataacgcgcttaggtaaatgttgccgaattttaattacagtattttgtttattcttacagtatccgcacgcgatacagcatgagaacaacatcagcgagaacagtatcatcagtataagcaaccaaaagctgatgccgccggggccattgcctgaagcgcttttgtcgctcaacggtgtgtagccaaagtcgccgaagccttccgcgttggcggcacgcacacggaactgtctaaaaattaaaaaaaaaaagaattttttgactacatgaaaatatgcaaaaatatcttcgttttttacgaaaaaaaattctcatttttacgctatgtaaaaaattctaaagagttctttttcaaatttccagatttttttgaaaatcgtaaaaaaatgcaattggacttgaacctacccctggacaagctcttcatcacttggcgttttgccacgccgtga

SEQ ID NO: 82829 - DNA, 1650 bp, Heterodera glycines
  Genomic contig location: Contig_ID=SeqID_3027; Location=3031..4680; Strand=+
  SCN-specific regions: Sequence locations=1-223,271-272,302-324,346 -598,690-753,808-1108,1132-1190,1404-1650
atggcattggaccgaccgccggattgtccaaatgaactgtacgatgtgatgaagcaggcatggacagtctgtaccgaaaagaggccacagtttgcggacatacagccccggcttgagacaatgcggggcctaccagcatttcaagtgggtttaattagctgataaatcacggctatatggatcaagcaaaaacaaacttcgtttagctaattgatcgatcaagaaattttcaaaaaaaaaattcaaaaaatttttataaaatgaatttaaggaaaaaagaatgaaaaataaattcagagattttttcaaaaatattatgaattactaaattttctctaaaatttttcaataatcgatggaaaaaatattaatgattttctgatttgatcatcaactaaatccattttaaatgttcagtctcgagacccattcccgccatcatcattatgcggcgacaatagcttttttgacgcttcacaaaattcgagcacctcaaaaggagaacagtcgtctaccacgacaacaacaaacggtgatggtgaagagtcgtacacaacagcatgccaatttgacaaaagtggaggtgattcaaaatgtcaaaattaaaaaaaatatatattttggaaaaatctattaaattaataatattttaaataatttcatcaattaattcttattcattttttattgtttgattttttgtgcttgatcattttttgatttgattctgtattaaaccgagctgattagatgataattttttaagttatgaattaaattgaaaaaataaataaaataaaatattttctcaaaaagattagttagttctccttttcctaaaagaattacatttttttaattttggcgttttacagaaagtttctccgttcgacggaatgccaaacgatcgcgccgcaaaatgccaagtcggtccagcgttgaagcaagtactggcgccgctggcacggctggtggtggtggtccatccgcttcatattcatttgggacaacaagcaccggtgtggattcatcagagtatgaattgccgaggtcaggggctcagcttatgttgacgttgccaggatcacggtgaaaatgaaaatcatagattaataaaaaaaaattaaaattcttgagccaggaaataataaaattgccgatttcgttacaaagaattttctaaattagccaaattatttttaaaaatatatttctagattattaatttttttatattgattttaattgcattataagtatggaaaaaaaattctataaaatatttcattttgtatattttttttattaattaatttaccaaagtattttgaaatattttattcttaaaatttttttagcatttagattattttaaattgtttattttattatcaaatttaaatgtgcaattcaattaaatttaggccaacaaatcaccgacgatccgcaaccacaggatttcatcaaaatgacgcatttgtggccgattcatccgtggatgaaagcgccaacggtagcaccggcggggaccaacaacgcttcacccggtccatctctttggctggcacttcacgtgccgccgctgatgagccactgacgacgccattccgacaatttggggcctcatcttctcggatcagtcgagtctaa

SEQ ID NO: 82830 - DNA, 598 bp, Heterodera glycines
  Genomic contig location: Contig_ID=SeqID_18231; Location=85..682; Strand=+
  SCN-specific regions: Sequence locations=1-149,172-598
  Gene Ontology: Mol. function=androgen binding; Cellular component =cytosol; Biological process=retinal metabolism
atgctctcctggaagatggccgcctgcctcgccgcggggaataccgttgttcacaagccggcccaagtgtcaccgttgacggcgttaaaatttgccgaactcagccatcgagcagggttccccccgggggtaattaacggagggaatacaaaaattgaaaaattaattaggtaattaacattgtgaccggcaccggctcggagattggccaggcaatttctgaccatcctcggatcagaaagttgggcttcaccggctcaacagaaattggggcgcatattatgtcctggtaattaattagtcgctgtttatttaatgggttttcccattttccttttctctgcttacatttcgctttttcagttgtgccaagtcaaacgtgaagaaagtgtcgctggagcttggcgggaaatcgccactgatcattttcagtgacgtcgacgtggacaaagcggcgcgaaaagcaatggacgcggtgtttttcaacaaaggcgaaaattgcatcgccgcgggccgactatttgtggaggagcgaatccatgacgaatttgtgcgaaaagttgtcgaaagtgggctaatgggcaagcaattaaaataa

SEQ ID NO: 82831 - DNA, 392 bp, Heterodera glycines
  Genomic contig location: Contig_ID=SeqID_18232; Location=21..412; Strand=+
  SCN-specific regions: Sequence locations=1-3,26-256,278-289,329-392
  Gene Ontology: Mol. function=oxidoreductase activity, acting on the aldehyde or oxo group of donors, NAD or NADP as acceptor; Cellular component=mitochondrion; Biological process=carnitine metabolism
atggttatttccaagttcgacgaaaggtgcgatggcaataccaagtgctgccaatctttagtgccagcttttgttcagagacaccgaattggtcgtcgagcgggcaaatcgcaccgaattcggcttggccggcggagtgttcaggtaagcgtagttaatatgtgccgaatctccccccatttgatgacatatgctaattcagcagtgatattccccgtgcgcttcgtgtggcgcgtcaactccgttgcggaacagtgtttctgaacacttatcagaagactgacgtcgccgcgccgttcggcggcttcaaacagtccgggttcggcaaggacttgggggaagaagcattgaacgaatatttgcaaacaaaaacgatcacaatggaatattag

SEQ ID NO: 82832 - DNA, 534 bp, Heterodera glycines
  Genomic contig location: Contig_ID=SeqID_18232; Location=674..1207; Strand=-
  SCN-specific regions: Sequence locations=1-534
atggtggccaataaaattgcagcggaaagtgcaaaattgaccctttcttcgaccaaattcaacacattgctagaactaggcaactcaattgaggaaggaggaggagcgaggagatgggaaaattcgaagaaagtccaaaagacgttggacaattgttgggactctgaggatggcggtgaattcgctcactaaggcattagcatttccgccttttgcagcaggtcatgttaaattgacaccatcggacagtggcgacccgggcttcatgcgcattgagttgagctcaaaacttcgactcgtcggccaaacatcgaaagatgccgaggaaaaggaagacgaagtggtaaaaaggaggcgatgaattcaaaaccgtttaactgctaattacagccgagaagtgtttctgagcccaaaattgggaccggcaatgaaggaattgccaactcggccgccttctcctgctctaagtttagcacattggccgaactcgcaaattccctcgcgaaggaggacaaagatggaaatacgcattga

SEQ ID NO: 82833 - DNA, 64 bp, Heterodera glycines
  Genomic contig location: Contig_ID=SeqID_18232; Location=1398..1461; Strand=+
  SCN-specific regions: Sequence locations=1-64
atgtccgggggcggaatgacttttgatcgctttggctcttcttttttcgtccgcaattgctcgg

SEQ ID NO: 82834 - DNA, 1639 bp, Heterodera glycines; identical to SEQ ID NO: 18236
  misc_feature (13)..(13): n is a, c, g, or t
  misc_feature (37)..(37): n is a, c, g, or t
  misc_feature (51)..(51): n is a, c, g, or t
  Genomic contig location: Contig_ID=SeqID_18236; Location=1..1639; Strand=+
  SCN-specific regions: Sequence locations=1-586,608-1522,1560-1639

SEQ ID NO: 82835 - DNA, 531 bp, Heterodera glycines
  Genomic contig location: Contig_ID=SeqID_18238; Location=342..872; Strand=-
  SCN-specific regions: Sequence locations=1-26,48-498,522-531
atggtttaattaaaaaaaggtactggaaaaaacaacagaaaaatggacatcgaaactttggcactgaaaattgaacaccgccaaatattaaactattaaaggaaatttcatttacgtctttaactaatattaacaaatcctatattcgaaaataaaccgcttattgataaaattggccaaatattttcttcggctattgcagttcacaggaccataaaaaacacaaccataaatattttggcaactttaataaaatttggtagctactttttagtgttcttaaatacccaatttaccctttttagtagagaccgagatttccaaattctccgggccggaccggactggtattttaaaaaatgaccggatcccggatccggtctctcataatccggtcaacccggattttcatattgccggatccggaaccggattggtaaacatttaattttcttgtgttaatttggaaaaaaacccgcaaaattttcatcaattatatgtacaaatactaaatattataagtttaataaa

SEQ ID NO: 82836 - DNA, 1056 bp, Heterodera glycines
  Genomic contig location: Contig_ID=SeqID_18239; Location=483..1538; Strand=+
  SCN-specific regions: Sequence locations=1-103,147-244,266-369,470 -504,535-737,765-1056
atgtacttacaaaaagttagggctaaaatacgcaaaactgaactgactttttctgactatctttgtcatagaattttagttgaaatttaaaaaatcgtccagcaataatttttgatttttaaaagttttaatattattatttttttcaattccacaggaaatttcaaaagtacgccgacccaatgctggactgctggcgacagtgttttggagcggcttaaccggcactgacaaagcaaacgaattggcaaatgcaatgaatcagttcaacgaaataaatcgtacacaactttttgtggtctcacttaatgcaaaagccaatttgacaaggcttaaggtgattattattgatactgattataattgatcaaaaaaatatttttaaattttgattatttttgagtaaaaaaacattaaattatttaaatttatgttaaattgttaataataaaattagttaaaattaattgcataaataaatttgattagtcagtgtaagattggaataaaaaatttaaaaaaaatatattttaaggaattggccggagatcaatggcacgtttttgtggagggacgcgccagccaatttattggagagggtaattttttttgtttcttaatttttgatcatttgttttatttatattcttaagttattctttgaaattttatcatgaaatttcctaaaaattttttagtgtttgatagagatgccattttttgtcatgataatttcataaatcaggattttttaaaaagttcttaatgtatgagattttatgaaattttccaagctgataccttcatgcaaagttaaaaaaaaacccttttttcaatattttttaacattttttgtttgaagcttcacaacatcttctcgactgtgtgctgcctcccagcggtgcccaaatgcactcatcaaacaacaatgacgagccggaactgctggacacccatgagccattgaccagcgttgaacgtgttgagcatctgcaagcggctgctcgtgcattccaaaaacatccgcttggcaattgcaaagatggtaataattag

SEQ ID NO: 82837 - DNA, 2122 bp, Heterodera glycines
  Genomic contig location: Contig_ID=SeqID_18241; Location=126..2247; Strand=-
  SCN-specific regions: Sequence locations=1-161,207-249,313-416,439 -484,558-765,876-879,910-1108,1234-1337,1379-1567,1590-2122
  Gene Ontology: Cellular component=synaptic vesicle; Biological process=synaptic vesicle priming
atggtgcaaaaagattttgtcaaatttgtgagcagtgaaaaattggcatgcattttgatgaacaatgtgcagcaattgaggtaaaaacaaaaaatgggcgcaattcatttttcctcaaaaaaaatttctccaaacttagaaatttttcaaaaaaatccatgaatttttttacaatataagaaaattaagaaaaaaaaaatttttttgagaaattttcagcaattttttggaaaagcttagcaattcatcataaaattttagaaaaattttcaaaaattttttttttcttgaaattttcttataaaattttttcttacaattagtttttttgaaaattttctttttgacattttgctgaaattttagggtaaattttgaaatttttagggtacaacttgagaaaatttacgagaatatgggtggaacaaatttggatgcggattcaaacaaagtgttgaacaatttgcagaaaaaggtgaatcccaaataattttaaattatttaaaaaaatttaaaaaaatataatttttacaataattttttataattaaaaatttgattaagcttaacaatgtgttggacaaactgtcagcccaatttgtggtcagccttgagcatggcattcaggagcagatcaacaaactcggcattttgctcaccaaaatcaaaggcccacaattgcagaagagtcaaatggccggggtaattaattattccaccgcattaattgcccttaattaggcttaattaacctttgtttttgccaaaaaattatattcaatatatttttgttttttgctcatattaaaatttatttattttggttttaagcaaattttattaatttttttaaattaatttttcatttattttttgtgccttaaaatttttcaaaatttgtttttattatcttcgagatttattaaattgcaaattaataatattaggaggttgatctcgtgttggaaccgttgatggatttgttggagggttcgctgcaacgttacgccaaacaatgcgaaaaaactgtgctcaaatatattttgaaggtgccgtcctccatcaatttaattttatatctcgataattatgcaaaaaaattaaaacctaattcattaattaactaattgcccctaattaaaaatatagaattattaactaattgtcaataattagacagttattaaaattttaattatttaactaattacccctaattaaatgatttcttaaacatttcttcatatttttatgcaggaactttggaaaatcaccattgttagcatggaaaaatttgttgtgcttcccccgttgggttcatccgaaaaagcggtatcattttaaaatttaaatttaattaaaattttatttaattattgcaaaaaattggcataatttcagttgctcaaacagttgccaaatgcgaagattggcggcgtcaccaagctgatgtccacccatctgaaggagggcgtgaagagcatgagctccgtcaaagatatgatggtaagctcgacagggttcggttcgtcgatcaaataatgaaacaatttgtggttgagatgccaaagtttaattgaaaactcaaatttaaatttagaaaatggaccgaaattcaaataaaaattccaaaactgaattaaaaatttggaaataaaatgcccaaatttcatttgaaagtaccaaaaagttgtagtctgatccacagatcgaattaagaaaatgccgaaaccgaattcaaatggcaatgattgtattgtattcctaacgaagaaatgccaaaacccaaaattaaaactaaaaacgaaaacgaaaaactgatcaaagttgttgccaccagagttctaagtcattttcccaaaaacttcctcccacgagatttacagaccgatgaacagagagagccctgttcaaaaattttatacaatattctctgatcaaaggattacaataacaataattccatcaaaaggccaaaattatttgtgtttaacccaaatttaattttggaaaaaaaatttaggaagttgcccgggacagcgaacgttcactgacgcccaaacagtgcgcggtgctcgacgccgcattggatgcaatcaaagaggtccgggcaattaattaa

SEQ ID NO: 82838 - DNA, 699 bp, Heterodera glycines
  Genomic contig location: Contig_ID=SeqID_3028; Location=3743..4441; Strand=+
  SCN-specific regions: Sequence locations=1-155,179-193,217-699
atggatttaattctcgccactgattggatgaataacgcttacccggaaatggaacaggacaaggctaacatgtcaccaaaggaagaccctagttggattagtctcattgatgaagaggaaaagcgggagcctatagctattgtgcaaatcgatgaggaagaggagaaacaaagaaaaagtttgtcttttagtgttattttttttaattaaaatttagatcctcccggaaattgcgactgtcgagagaagcgtcgttgctttattccgcttgttgaccacttgtgcaagaaatttgagtgttccgcccacgagttacacgtactcttcaaagacttggggaagcgtcgcgccatcgttgaacacctacgctcttctcaattgtgcacctcccacctgcgtccatcgatacggaatttcccagttcgctgcaacgatctctccattttggatgctcactcagtccctgcataccgtggttacctcggaatcacggtgtttattctttttatttttttatttctcaaaatattttaggttcgaatgcactattacatcaaacacggtattcgattgcgtcattcaaatttgccttgtgttgttgaatttggcggtggagatcataagactttcttcccattagaagctttgaatattgttatttagatgttttctgtatcaaattgtactgttgtttttaaa

SEQ ID NO: 82839 - DNA, 2796 bp, Heterodera glycines
  Genomic contig location: Contig_ID=SeqID_3028; Location=884..3679; Strand=-
  SCN-specific regions: Sequence locations=1-38,62-74,96-261,283 -550,572-710,733-1011,1033-1347,1380-1404,1429-2375,2397-2424,2447 -2796
atggaggaaacttttgatcatacggatgtacagtttcgtcatccattcacaatgattgtgtcaggaagtacgggaagtggaaagtcggaatggataatgagattattacgtaacttggacaaaattatttcagtaccaattgagcgtgtattgtattgttacggggagctgaatccgaatattttaaatttacaacgcaatgggagaattgacaatataacagtcactgttcacaatggagttcctgctgaagactacattaaaggaaatgccaaaaaggaaaaattgttgctggtgttggacgatttattggttggtatgagacagcaatatttagacacactctttactcgcggttcacataattggggagttagcataattctagttactcaacacctctttaataaagagttgcgtgtcgcgcgtggaaattcacattatttggtgttaatgcggaacccaaccggtgagcttcaaattcgtactttagccacacatctttttccttcaaggacagctcattttatggagtcataccgtaacgcatgttcaaaaaattttggttatctcctagttgacatgcatccagaaagtcttgaaattttacggttgagaacacatatatatgatgaaaagataattgtttacgttcaaaaatgaatgtttccaatttaattacaaagaatacaaattttttagagagtatttgtaatgcaaaaaattccaaacaacttatacagagagcatcagatgaacagcttttatgtatcgtagagatttgtcttaatattttaaaaggacgggttcctctaaagcctgaacatttaaaaaaattgaaaacacatgctcagattttgcgtcatctagccagaacacgttgttctcgttccgcaaaacgaatattattgcaacacggtgcgggaattccagccatagctggattgctctcttcaattgttttgcccttggtttcaaatttaattgcaaattataaataacgccacaaaaaacaataaataattttaaaaatgcaatacacaaagcggtatttgctcgttccttaggagatttatcagagtctgacgtcacctcaagatggaagtcctcttggattagttagatcacgaattaagcaaattaaaaatgatgatgaaattaacgatgatgagagggcatttaaatatgaacaagaatttaaacgcctcaaaaaattaaataaagatgaggaggaacgccctgttgatgttaaattgcaaaacctacaggaaatgacagaggctatgccaaaaccttttaatctggtaagaagaccggttgctcgtagacgtcgtaatatcaaacttggtaaaacaagaaaagatgaagaaaatgaagtttttgaagatgcagaaacatttgaccaaggggatattataaattacatttataaaaactctgaggccttgggaatcaatgaggatggacagattatcaaaacaaatggccatgttcttagaacgagtaatatagaagatattgttgcgcatttgttaaacaaagacaagcgtgcaaatgccaaagaaccaacagcactcaaagagtttgttgctagagccaaacaaaatccgcttttgagtaaacgtctcttttctgaaggtcaaattggcacgggagtttataaaaaggctatgataaaatttaagcctttgttatggatttgaagaaacagcgattactcgagtttttgtataaagacataaattcaccagtcgcattcacgagccttgaaccattgttgagagaggcgaaaaaacggcaaagaaaaatcacgagagcagatgttcaaaatttcttgtacacacaacgaacttatacgttacatcggcaagccaagcgtcgctacagacacttaccaacattagctcctggattacataccgaatggcaggcagatttggccattcttgatagacttgcaaaacataatcgtggattcaaatatttgttagtttgcattaacactctaagtagacaaatatttgttgagcctgtaaagtcaaaaacaagtataaacataattaaagcatttgataatatctttatgagaagcaagtacattccatggaaaattttgactgatcaagggaaagaatttacagctcattcagtaaaaaaatattttgatacaaaagatgttaaacatttttgcatgctgacttcccctcgattccacgctggtatggctgagcgtgccaatcgtagtataaaagaacgtttatatcgttacttcaccgaaagagacacttacaaatggattgagatagttcaggacattgttaagggcattaatcagtctataaactcctccattggaatgcgacctgctgacgtaaattttgaaaatgcagaggaactgagacaaaagttatataatgaagcgaaaaaatttccaaaaaagagtcctaaattcaaagtgggcgaccgtgtgagaatagaaaaatacaaacatgtattccaaaagggttatttaccacgatttgccgatgaaatatttacggtagcagaagtacatacagaacgctcgcccgttgtttacagattaagtgacgatagcaacgaaattataaagggatggttttattccaatgatttatgcaaaattctcaaaaacaaagaatcactatatgatattgaacaattttgaagaagaaaaaacaaaatggtattgaatacgttctggtaaaatggaaaggatacagtattaaattcaatagctgggttccattgagttctatctccgagaaaaatatataa

SEQ ID NO: 82840 - DNA, 952 bp, Heterodera glycines
  Genomic contig location: Contig_ID=SeqID_3028; Location=4985..5936; Strand=-
  SCN-specific regions: Sequence locations=1-459,481-607,651-952
atggcacagcgcgtgggtttcacgcagataaagtacacgcgcactccagcggaattccatcaactcttggacgatccaacattagacaaactggactttgtccacgtctccgagcatatggaccgagttgttgtcaggaagcgtcccgagtttgcaaaggcacccctcacaaactgtcttccagtcgcaatatacgtcacatcgtacgcgagacttcatctctattcatacatggaaaaagtgattgcactggaaggggctgagcttctttattgtggtttgcgaatacaatagaaaaaaaaatgttagataattttagacactgactcaatctactacgtgaacaagatgggtgggcggtgtgttccggaaggcgaggcacttggacaaatgaagcgtgagcatgttgatcgtcgaattgtggaatttgtagctggtggtccaaaaaattatggaattcggcacacagcacgagacggaactgatgagcgggccaacctaaaaatacgaagcttcagattatcgtacgccactcaacaattactgaattttgaagcaatgaaggatctgacactggctacatataacattgacggacctatgtcagtttttttttttttaattttcacaactaataattttaaattttagtgatgacgtcatcgacaacgatgatctctacgtgtacggaggaggtggagcccatcgttgcatccgagtaacttttccgcaaattgaccgaaatgtccgttctgacgtatacacctgcgaggcccacaaagactacagacctttctacgccaagggccgtgttcgaccgggaatgcaaacacgaccatttggatatgtggaggatgtatcacatccaccaatacaacctacagctgaacgaagaaagagaacattgattgaccctgacccaactcgaccgggttattctggatggttttga

SEQ ID NO: 82841 - DNA, 224 bp, Heterodera glycines
  Genomic contig location: Contig_ID=SeqID_18246; Location=159..382; Strand=+
  SCN-specific regions: Sequence locations=1-13,38-224
atgctaacattggagaaagaagaaaacaatgatgaaaatgtggatgaatacgacgaagatgatgaatatactaattgcgattggctgttcaagcgatggcagattgggaagacaattcaatgggaggacaaaaagacggacaatttgaacaatgtcaacatttcgatttgtcggtttgggtgagtggcaacaacttttaccattgttaaactgtttccagctga

SEQ ID NO: 82842 - DNA, 623 bp, Heterodera glycines
  Genomic contig location: Contig_ID=SeqID_18246; Location=576..1198; Strand=-
  SCN-specific regions: Sequence locations=1-217,256-623
atgtccatttttggctgtccaattccgcaaattgtattgggtggtgagcaatgaaaagcatttatttttttaatcgaattttgaataatttgcgcttaatttaggccattgtatccgccaccaaagaagaagcggtacaaagcagcgaaaatggcgcctaattatatggaaattaattaattgggttggagaaattggctatcaatttgaattattcaatgaaaattgttgcttttataattttttcttttaaagtgtttattttgttggctgaatattttctattcgaaacatttataattccgtatttacttttaaatttggatgagatttcggatccactttttgaaagggacacttcattctttataggtttaccgattttgagctatatcagttgtgccattttttctggggccttgattaaagttcacccaaacaatgcataaaccttcatttttttcaacaaaatcaattggtttacattttatttgtcgcctctggcaaattctacacaatttgattttaggatcaatgaaaatttaaacattagtaccgaataatcatttcggttgtaaaagtcccaaaacccaaacgaattaaactgcattcaaaggaataaa

SEQ ID NO: 82843 - DNA, 1962 bp, Heterodera glycines
  Genomic contig location: Contig_ID=SeqID_18248; Location=141..2102; Strand=-
  SCN-specific regions: Sequence locations=1-134,156-173,208-338,394 -547,570-981,1013-1037,1059-1105,1134-1246,1268-1450,1499-1675,1697 -1718,1741-1794,1816-1962
  Gene Ontology: Mol. function=structural constituent of muscle; Cellular component=cytoskeleton; Biological process=regulation of striated muscle contraction
atgaagaatttggttgtgcgcgctggtcaaactgccaaatgggtggtgaagtttggcggcaaaccggcgccagaagtgacatggtcaaagaatcaacagccaatcactgatctgagcggatcaatacaagtgggctaattttaaaataattcttcaaattaatgatacatttcttaattttttggcaatttttgtttcaaacaatttgcacttattttaaaccttcatcattttttcatcgaatttcttaatggtttcaattttttaaaacatttttaatttcaacgcctactttcaaacaaaaacaaaattttgagcaattaatatttagaattccgattaaaattaatcaaaaattatttatttaaataaacaaaaaaatttttttttttaccgctaatttgtgattttgtcatcaaagtattgtcgccattcttaattttaattgaaaatttactttaaattgaaaattttttcaatcaatgcctcccattagctattctctgaccattcaacattttttccgatcaatgttagccattccctgatcattcattcatttatccatttgttcccaggtggacaccaaaaagaatgatcacaccattctgtgcatcccggctgctgtacgtgctgatcgcggtgcatacgcattgttggtgaagaacagcagcggcacggacaccgtaacggctgatctgaccgtgctggacaagccgagcaagccgcgcggcccgctggaagtcagcgacgttacggaggacggctgcgcgttgagttggaagccgcccgaggatgacggtggactgccgattgatcactacgaggtaaaagtgatcgggaataagggggggacacgataacatatccaagaaaggcactttttcattctcgtcataagactttttttgattggttgtttgagaccgtcagataggcgaaaacgcaaaatttattattaaaattagtcctatttgacagaattttaaattaaaaaataaaataaaatttaggatggacgaattactaatttacaaaggattacaaatttataaaaagtcaattttttgatgaaaacccacccgaaaaaataatggtttgaatgaaaattaattttatgaaattttttatatcatttatgtttctaatttgtcttaattttggtcttttttcctttttataattaggtcttttatagtaatttccactccgatttatctttgcaaatcgcatttttttgaattttaggtggagaaattggagggtggcaaatgggtgccatgcgcaaaagtgccggactgcgcggcacaagtcaaagggctgaagaagggccagcaataccaattccgtgtcaaagcggtgaacaaggaaggcaaatcggagccactgagcacagagcaggaaattgttgccaaaaatccatacgacgagcccggcaaaccgggtagagaaaaaataattttttaaaataattttaattaattgattaaattaaattcataaggtgtgccggatattgtcgattgggatgccaaccgtgccgatctggtgtgggagccgccaaagaatgacggaggagcaccgattgaggactacatcattgaacggaagagcaagcatgatcggaactggaaagagtgcgcccgtgttggtggaccgacaacgaaagcgaccgtgcagggactgaaggagggagaaggttagataaattattgattttttaatagaatttgggaagattcgagaaaaatatagatttattcaagagtgattttctgacatttcagaatatgaattccgtgtgaaagcagtgaacaaagctggaccaggcgaggccagtgatccgagccgaaaattgttggccaaagctcgtcaccaaaagccgaagattgaccgaagtgccatgcaaacagtgaccataaaggtgtttagggagaattgaacttacctggacataataaa

SEQ ID NO: 82844 - DNA, 1289 bp, Heterodera glycines
  Genomic contig location: Contig_ID=SeqID_18250; Location=528..1816; Strand=+
  SCN-specific regions: Sequence locations=1-110,147-380,404-433,456 -501,523-830,852-1033,1055-1208,1230-1289
atgccaatgtcttttgttcctttagcgacttctgccaattcctacgagcgcaaagcgaaaagggaaacgaacgaagcgaaagacgacgcaaatgcgagggtttctttttcaatttaaaaaactattttttgtaaatttttaattttcatagaatccccaaaggcattaaattcgcgattatgaaaattatcgtttccggaagcaaccaaattcgaaatattcttagtggcgttcgacaaccgtacaattaaatttccgtcagcaaaatttaatttatttcgtttttcaaaaaaaaagtactaatgaaaaatcagtttcttaaattttggccataatttttggagtagtgaatgataccaagaaaagttgctttcgcttctttttatgtgaaaatttttgtctacccctcaaagaccaatcaataattgtccctttttctctgtcttccctgttgtcggttttttgcgtgtctgtcccaaactcaatcaataattctgccattaatttctctccctttctctgctcagattgaggatgccatagcgtcggcgatcaatggcggcggaagtgcaacggtggcggacattgcgctgctgcgcaacgggcgactgagcggcgcgtcgtccgtcgtcgccgcgggcgccaacgacgactttgtgcggcgactggtggacctcgtccgacgcgagccggcactgtacgacccgagccacgagcactacgggaacagacacgccagcgcacactttcgaaccgcaatttggcaacggttgtgcaaggagttggactacccaggtgaaaagcggattttatgggagtggggaaatggataaaaatgaaaggattaaaacggagggactgaaatggtcgaaaaacaggggccaaagcgaacggaaggggtcaaatgcgtcccagggaactttaaaaggcttaactttttttctcatttggccaaattttccaattttggcagcatttgaaagctctatatgtttagaagctgctttgaaaagctattttctaagcgattggacaattttaaaaaattgttacatgaataatgaatgattgggggactaaaaacagtgccattttcagatgatccgcaggcactgcaaaagcaatggaaaagcattagggacaaatacatcaaagagaaggagcggagaaaagggggcacaacaacaatgatggtaagcatttgagaggtttttaaattttgtagaaattttactgacattttcaggaccattccgaatcgatgacaaatggcacacgaaatttcaacg

SEQ ID NO: 82845 - DNA, 1123 bp, Heterodera glycines
  Genomic contig location: Contig_ID=SeqID_18251; Location=616..1738; Strand=-
  SCN-specific regions: Sequence locations=1-165,187-458,480-498,520 -716,738-1123
aaatatgctttggaagctgtcaagggcagttctctggagaggatggttaaacgccttggacaaattgcgcattcggctcatcgacaattgtctgaccttagccccaatgaagtgagcaataatgcataaataaagcataacgcgtgcagaaatgccaaaaccacaaaattgacagtttatctccttccatgctctctcttccctttttcagttccatgattttgctttcaaattgtctgaagcactttattctgctggagaatttgaagaaatgcttcacgtcgttagctacgcttttctgcaccccaaaaccaaaaactttaggttgggtatttgttattctttttttcattttatattttccattaagttcacatactttcaacaatttgctgtttttcgccagtctgaaggccaattaccatcaactcgctttcgaatttcttcgatttcatatgacttacattttggtatttcagaaacctttgactgccaataaatttgtattttacagcctaaattaacacctgcaaataaagaaaagggcaaaagaaccgatgagtcatggcaattagggcgtatttattcggcaatgaattacattttttgccagcaccaaagtcacatttctccattcccatcatttttcgtttattttaggtgtcaattaccatcgttttattatgcgacaattggcaaaacagtcggactcacaaattctgcacataatttctggcaacaattctttggtcaccggcgcttatcgacacgccctcggcaagaaattacacgcaaaaaaagttaaccaaaattaaaaccctcaaaaaacaggcgagttttttactgtgtatttgcgtgataaaagcaatccgcttgtcgcttttctcatcgccctcacattcactcacatttcctgcaaaaaggacatttcttcccgtcacatggtcgccctgagggtttggtcactgtctccgtcggcaaataattttctcttcaggcattgacctttatgaagaaatacgccgactttcgttcgtccgtgccaactcaagagattcaatacaatatggggccggatgttccatcagatgggtcttttcgcgaatgctctcaaatgttatga

SEQ ID NO: 82846 - DNA, 620 bp, Heterodera glycines
  Genomic contig location: Contig_ID=SeqID_18255; Location=507..1126; Strand=+
  SCN-specific regions: Sequence locations=1-57,106-489,511-552,574-620
atgtgtgtaaatgaaaatcataaaaaatgtaaagcaatattatcattgaattggtcgataaaagtaataaaatgacaataataataataattattattattataaatttgtgtatcacaggtgacagtttgcgggatattccggggtgagaataaaactgggatttgcgacatacctaaacattatcatctttcactcatcaaacgaagaaaagttatggcctaagaaactgatgatgaacatcgattggacgattaaacctcaaaaccatttttcaatgaaaatctgttaaaaaacggttaaaatttctattttttctcccgcgacgcctatcggcacagccgagcccccaaaaactcttattttttcataaaaaattggctcaaaattataaaaaactagtcattttggtgaaaatatgttaacaaattgcactcaaatgttcaaaaaaaaagtgatcacatttgttcgtcacaattctgatttctccataaataattgtgttttgtagcataaattatttaaagatttacttcaatggatcgaaatagaaaatcataagcaaaatgtaaagaaatatgaaaatgctcttttataaattggattggtcgataaaagta

SEQ ID NO: 82847 - DNA, 450 bp, Heterodera glycines
  Genomic contig location: Contig_ID=SeqID_18255; Location=1696..2145; Strand=+
  SCN-specific regions: Sequence locations=1-450
atgttgacaaaaggtcggttaacataatggtgatcatcgttgttgggaatgtcggcgtaatagttctgaacctttgcaaaattctggcatcggcatgatacggtattttttcgttttttgaggcgaggcggctcaattccttattgacttgtttatgattgcaaaaaactaccaatccagcatcggttacattccggtaaatttcggaactcaatccaatgcattgactgcctttgtgagctcgccaatcgaaacaaaagtaatcgatgtcagcatttttgctgactcagcaagaattggcttaatattaaaacgtttaaaatgaataaaggttgagaatattgaatttcaaaattgattacaacctgaatcaaattttgctctcccaactttttcttcatgttacgcacaaaatgaaaaaaacaaaagttatggcgcaattcccattga

SEQ ID NO: 82848 - DNA, 1741 bp, Heterodera glycines
  Genomic contig location: Contig_ID=SeqID_18257; Location=241..1981; Strand=-
  SCN-specific regions: Sequence locations=1-561,583-1026,1048 -1061,1083-1093,1130-1291,1313-1741
atgtcctccactgtccttcaaaatgccctccgtctgttgttcattactctgatcgttttcaactgttgccatgggtaaacaaaaagcacagcccaacggcggatgttctattgcaatttccacgaccttaaaactttcggttttctccaagttttaaaaaaaagaaacaaatgtgaaaaaaacgagtttttaaattccgtttaatttatttcccgtgcaattttttaaaggtcgagaaaaatgcaatagagccgcctcaattccgttttctgattttcctatttttccagcgcttcgactcgtgttaagcacaagaaaccaaccgatgagacgacttcgacaaatgaatttgctggcctcagtgtcaagttatggatcatcattggtgtctctgttttgctcgtgtgagttttccagggctttcattttgccaatgccatcatcaatcacaatcattctcctgtttccccctcttttcagcctcgttgttgtgtgtgccattgttgtgatttgctgtttgtgccgtaaacgccgtgccggccagcaggacaacgatgagctttcgacatcagtgccaagcagttactacaaatcgcggcagggaccaacggattcgatggactggccgccgccctcagctgctggccatggtcgtggaggaagaagcggtggtggtgcgatgacggcggtgccgagcggaatgatgtccaagatgccaacaatgaagacgaagcagccgttcttatttcgaatgctgatgccggaaagcttacgctcaattggaccatcacgaccagcgccatcaacagcaacaatggaacgaggcggggcccagacaaaagtgaagacgacgacaatgctcggaggagaccagacaaaagtgaaggcgtcgtcgacagtgccgtcgggaggagaacattacacaacgtggtgatgcgcaatgaatgaaagcgacggacggcaatggcattcgataataatggatgaagaatcgagtggttgttgcttcaaatgactaatatgggaaatttatgtttaattatgctgccgtaaagaaccaaaattatataattaaatttgtgcattttatcaaatttaattttcctaattaaaattacctattaaataatatctttgtactcgtttttcagttgggcatggcccgaccgactgggctcggatgttgggagagggaatatttttattttttcaaaaatggcaccacaataacagtgaatgccgtcccagtccattcaactttaaaaaggactctataaagtcaaaaacaatcgaaaaatctcatctgtcagtccgctttaaaagcatggcttacgctttccttttcattgcgtccgttgcatctgttcccatcacaagaattgtgctccgtcggcccattcatcgcttggcattcatttagtccaaattcattaaatggcagtctaacagtccacaatgttttcatggtaacacatcctttggtgtggaaaagcgtcgaattgtccgtcccaacgcaacgcactgagaagcattgcgcatcttcacaccttaatttgccctctttgaatttacataattagtataattaatgctaatatggttccctcaacctcccacaaaatttcttcacattatttcggtgaatgcttcgtcattttcctcgccatgattcactgttccattcaaacacacaacaatctctttaaatccaaaattttcaaatgaaatgcctcaaaataaa

SEQ ID NO: 82849 - DNA, 819 bp, Heterodera glycines
  Genomic contig location: Contig_ID=SeqID_18258; Location=791..1609; Strand=-
  SCN-specific regions: Sequence locations=1-819
  Gene Ontology: Mol. function=adenylate cyclase activity; Cellular component=plasma membrane; Biological process=G-protein signaling, coupled to cAMP nucleotide second messenger
atgtacgaggagaacttcgaggggggccgcgagtttctgagagttctcaacgaagtgatcggcgactttgacgaattgctggacagagcggactttgcccatgtggagaagatcaaggtgggcgtcgttctgctggtgcttctacggttcggcctcccttcagaccattggcccctgttacatggccgcttccgggctgaaccccgaacggcgtcgcctttccctgcacccctacgaacatttgtaccaattgatggaatttgccattgcgctgcaaaatgcattggccttcttcaaccaaggtgttgttgtgccttctccacccatccatcggcattaatttaaatttgccttgtctttctgttttaatttcatcataaattgcccccccccccttcagaccttctcaacttcgaattcgaggccaaaatcggctttaacattggccctgtcactgtgggtgttttcttttttttgcccctttgtaatttcattccaataaataaacatttttaaggtgtcatcggaactacaaaactttactatgacatttgggtgcgtttgaaatggcaatgttttgcaaatattcaccatttgacagggggacactgtgaacattgcgagtcgaatgtacagtacgggcgtaaaaaaccgtatccaagttcgctttgggtgcgcttttgtccgaattcgtcgtctttaggtctcttcgtacactcgcgatttgctcatcgaccgatacgacttcgaataccgcgataggatacaggtaaaagccataatcactgctcatttcgccattaagctgcttttgctcag

SEQ ID NO: 82850 - DNA, 300 bp, Heterodera glycines
  Genomic contig location: Contig_ID=SeqID_3029; Location=199..498; Strand=+
  SCN-specific regions: Sequence locations=1-300
atgttggatttggacgagaaagaaaaaagtatagtggaaaaacatgtgctggcgcccaaccgtgcgcgcccaactgaggtagaccgggcgtttgttgtgcattagttaaattgtttttgattttccatgatcaaatcgttatgtagtttaaccctccgaatacaaacaaacaaatttaatttgcaggaggacaacctgttcgagcagttcatcctgtccactcaaattagctactgttactatgccgactcgcatcgcattctgggcaacacctttggcatggctcgtgctgcaaggtga

SEQ ID NO: 82851 - DNA, 630 bp, Heterodera glycines
  Genomic contig location: Contig_ID=SeqID_3029; Location=571..1200; Strand=-
  SCN-specific regions: Sequence locations=1-130,237-284,307-630
atgattaagggtttttcgcacgctcgccaacttgagagtgaaatcgcaagtttacgcgagcagaatagaatgctgatggcagaacgagtcgaggtaagtacaattttgggggtccgggttcgaatccaacataaaaataaataaatttaattaaatttttaacaaattaaagattttaaaaatacatttttaaatatgaaaaatgcattaaaattatttctttgtttaaaataaatgtgtactgtcattgtaaagtggagaaaaatcgatataaagtgaaaaaagttgaaaatgagcacagaagcacgaattttcgagtttcgaggccctgtaacttttgaagcaggcggaatgcaccgctaaaattaaaaattcacaatacaagtcgaccccgctctatccaatggtatatagcttatatgcattttcccactcacagctcggaatgttcccttgttaacataaacatgcttggtttccaaaaaaaaattttccaggcgcggcaacgcccgaaccccgctcttactaccccttttttttgaaaattctgacaccaaaaagacaaaaattattcatttttcgtgaaaaagaagactacaaattcctgccttttttcatacggagaataaa

SEQ ID NO: 82852 - DNA, 77 bp, Heterodera glycines; identical to SEQ ID NO: 69776
  Genomic contig location: Contig_ID=SeqID_3029; Location=744..820; Strand=+
  SCN-specific regions: Sequence locations=1-77

SEQ ID NO: 82853 - DNA, 918 bp, Heterodera glycines
  Genomic contig location: Contig_ID=SeqID_3030; Location=3008..3925; Strand=-
  SCN-specific regions: Sequence locations=1-918
atgtatgaggaggacttgcccagacatggtcacggggagccgttcaaagtgccgtaagtcacccatttaactgattctaagacattggccttcgtattggtagtgttccgaaaaattgttcatttttggtgattcccaatgatttaggatttccgtggcttggcgggtattcaaaagaaaaacaattttcagattcgggtttcttgtctgtttagaaattttaccccttctacggggaggggcacggggcattgagccaattctttttgatgggcacaaatttggtcaaaaagcaaacgaattttgcgcaacgggttcaaaaaatcgaaaatggtgtgtttcatcggtattgttttcgctttatcaatggcattccacgaaattgttgttgttttaggcactggtcgatatacaacgattggcagcggagtcctcatttggtggcatatgccaaacgattggagcgcatgggtctcaaggacccgtggattcggtaaatggacattattgagcattctttggtcggaattatgggacaaaaattgaaataacaaaaaaatgtagtttttgttcagtaacatctactggatgtacaacccggacaacccgtgctcgaatgtgacaaaacaatacaccaaagttggctatgcgtggaaggtataacacgacgggagaggagggaaaagtggtcatttaagggccaattaacatcatttaaaggctaattaataagatatttttgcaattacggtgtatgaatttcttaattctttgtttcatgctttaattcaatgtgcctaattgggcctggcgccctcgtgcaaaatttcgaaaaaaaattttttttggggaggggaagggaatttgacaaccacaaagcacacatattctgttagtaccatccagaatcccattaaa

SEQ ID NO: 82854 - DNA, 1085 bp, Heterodera glycines
  Genomic contig location: Contig_ID=SeqID_3030; Location=612..1696; Strand=+
  SCN-specific regions: Sequence locations=1-507,530-1085
  Gene Ontology: Cellular component=nucleus; Biological process =locomotory behavior
atggccaatttgccgcccgtcgtcgcccagcaaaaagtctgtcttattttatcttaccttgaaaatatgccgggttttgagaggagtcagtgccggttttttttttgccaggttttgagagtccgtgacaggttttttgccggctttttcaacacatgtgtcggatttttgggctttgagtcttacgtttcaaatatacccatttgcacttatagaattcaatggcggatttctgtccatcgattcctctagaattatccatagtaaaaaatattaaatcgcttcttttcatacataaaaaaggggggtgggtcggaaaattttttgcgaaggggggtcgggccgcccgatgacctttttttgtttttcaaaaaccgtttttttcggcgcaagtttttccaaaaaattttcgggaacaggggggccggcggtgccgttaggcgccgccggagaaaatttttaagttttgggtgtgctttgttaacagattttcaccaaaaattgccaattttttaagaaaaatttggattttggggtccggcggtgccgctaggtgccgccggagaaattttttttccgatttttaatgaatttgttaagaaaattttcaaaatttgcgagctgcgaaccctctcctcccacctcttttacacggaccccccccccctaaaaaatgtgcttctttttgcatcccttactaaattaggtaagtaagttcataacggcaatcaaacccaaaaaattcacagagtgccgcgggcggcgatgtgtcgtcggagttggcacggctccaacagtcgctggccgacacaaaacccatcggcccgttgctgcaccggtgccgcacactgtgccaggccaaggcgctgctccgcctactcgacctggtcaccgacaaaatgtccaactcaatgtgcgcaatcaccgcggcgcgtgggcgcggcaaatcagcggccatgggcctggcggttgcgggcgcggtcggctgcaatttgacgaatatttttgtgacgagtccaacaccggagaatgtgcgcacactgttcgaatttgtgttgcgcggctttgacgccatcggataccaa

SEQ ID NO: 82855 - DNA, 1774 bp, Heterodera glycines
  Genomic contig location: Contig_ID=SeqID_3031; Location=331..2104; Strand=-
  SCN-specific regions: Sequence locations=1-225,259-643,677-783,825 -932,971-1133,1244-1271,1300-1327,1453-1551,1614-1633,1742-1774
atggcggcacagcaaattctcagtgctgcggctgaacggagcaagtgcaatagcaaagaccaacaacaaaaaagggaaaacgatgccgacgaacattgctgttcccagcggcacaacgccgtcgacatcgacgagcgcacaatggtggttggcatggcacgcgttggatgggccgaccagcgggtgaacacaaagcatttgcacaattttttgttttttgtgtcgttttctatgaatttaaattttattttagattttgcactgtcccctcggtcaaatggcatccgccgatttgggtaagttttttggctgattgtgacatttcattttctatttacatacaattttcaattttatgtgccattgctatttatctcgtaccctttggttttttaccatacccaattcattgcctcacttccaaaataaagacaaaattttctttttttgatttaaagatttgttttagggaataaaacgatttttttttgttgttgaaggtttgccattgcatgtgctcattgtgccggccactgatgagaaattgcatccaattgagcgcgaaatgcttcagctcttctcacaatcagtctaataaaaatggggcaccaacggaacacacttttttattgttattgttaacattaattttaaatttataattttactataaattcgctctcttttgctaattgtttatttgaatcactcggatttattccgtttatcttattttccacactttttttttattaatgccatttaaatattcagctgtttacacgaattgtgacctctccgatgctacaacgagcttatgttggtgagtgatgaatgggtgccaccaaaaaaatatatttaaatggtcaaaaatgtaaaaaaatttcagcgaatttttagaaaaactaattcaccataaaaatattgaaatcgctaggaaaaaatttccattttttgttttataaaaaatgctacgattttgaaaaatttctaaatttgtactttctcaaaaattggggggtggggctgatatagcaacaacaaaatcaaacattgaccccttttcaggcatgcaatgcttctgggtgattaaattgcccatctttttggcaccaatttcgttgctgcttttagggcgtggagtcgtcttttgccagcatggccggtgttctgcatacgcgggtcggctacgcgggtggcacttccccggcgccaacttatgccaacatcggcgaccacaccggtccctccgtttaatattactgattgtgaatttttatttaattatttataaattttcgactcaaatcagttattagtgtttttagaggtcaccgaactccagttcgacccctcctgttgctcttatgagctaattttggattggtttttcgaccaccacgacccaactcaacggcataaaaaacagtacgcttcggccatcctttgggtatggtaaataaatgcggcggcaactcgtcagaccccccccccacgaaaaaagttttttacgaaaattttaactttcttggaggtttttttaccattaagtttttttattataatttccaatgaaaatttttttttttcattttttgaattaaaaaaaaattcaacgtttttcttttttgcaggtggacgaatcgcagcaccaaacggcggagaaggcaatggaaaaagcgaacgcaaaatacggaggacgagtgcagacttacctgaagaaattggaccagtttcatcaggctgaggattatcaccaggtgaaaaaaataaa

SEQ ID NO: 82856 - DNA, 733 bp, Heterodera glycines
  Genomic contig location: Contig_ID=SeqID_18259; Location=292..1024; Strand=+
  SCN-specific regions: Sequence locations=1-113,200-305,328-351,373 -428,471-508,551-593,669-733
atgtgcaaaatttcctcatttttaatgatttttttcgctgtttttttgtccgttgcaaaagttgacggaatgagtgatgcgtttaaatctaccaaagaatgggtgaagaaaaaattatcatcaaattcatcacaaccattatcatcatcatcctttcatagaccattattagatacatcagattcttcttcatcatcattttcctttaatcctccaatatataaaagtaataaattcataaataaaaaggtcgaaaaagattaataaattagaaacaattactataatatagataatttagaggacaactcatcttcgtcatccgtatttggaactcatccatttcgtaataaaattaaaaaggaatattttcaaaatttgttaatttaagaagctaaatcttccacttcggcgtttggaaaaaacagtaaaatttaaaaatattaaacaattaattcaaatttaaatttgaagttaaatcttccacttcggcgtttggaaaaaacagtaaaatttaaaaatattaaacaattaattcaaatttaaatttgaagttaaatcttccacttcggcgtttggaaaaaacagtaaactttaaaaataataattttaattccgtcaatttaaatttaaaaaatatttgaaaataataattaaattaaataattgcttttatctaaggtggcaattctgactcgtcatctacatttagaactcagaacatcaatagtaa

SEQ ID NO: 82857 - DNA, 282 bp, Heterodera glycines
  Genomic contig location: Contig_ID=SeqID_18261; Location=630..911; Strand=+
  SCN-specific regions: Sequence locations=1-191,214-282
atgctgttgaccgtcaaaagtgatctgatcggctccatcgcggtcaccatcgtttgcatggcggtcgtctgttccctgttcatctacagtcgacttggcgtcggtgccattgcgctgtgcatcacctcaatttgcttcagtcagtagtcgtcaatgttttttattttacggcattttatgccattttgcgctttttgtctgtcattcatttcaaaaatcgctttttcagcgctcgtcggtgtactcagttggtgcggcgctgacttggacccggtgacaatg

SEQ ID NO: 82858 - DNA, 56 bp, Heterodera glycines
  Genomic contig location: Contig_ID=SeqID_18263; Location=1798..1853; Strand=+
  SCN-specific regions: Sequence locations=1-56
tttagaactaaccctgtcaaaatcaattttttcctgctgtgcgctacattatcgat

SEQ ID NO: 82859 - DNA, 88 bp, Heterodera glycines
  Genomic contig location: Contig_ID=SeqID_18264; Location=623..710; Strand=+
  SCN-specific regions: Sequence locations=1-88
atgatcgattggatcggaatcctcggctgttctctgatcgtcgctttgctatttgacaccgctctgacccgttcattccgttggattt

SEQ ID NO: 82860 - DNA, 912 bp, Heterodera glycines
  Genomic contig location: Contig_ID=SeqID_18266; Location=17..928; Strand=-
  SCN-specific regions: Sequence locations=1-75,133-252,274-353,412 -603,626-813,855-912
atgagtttcatgtttgctttgggcatatggactgaggcactttttggtgccgcaacagaactcacaattatgacgttaatttaatttaaatttaattttttttcaacatttaaattatttttttgattttttgtagcattagtttcaagtttttatatctagagcagtcaccaaattgttagttgttccgatttgagtgcctcatttttcagcatttaccttattgtttttgtctatttgttacgttatttttgtttaaaaacttttaaaaacggcccaaaaaaaaatttcttagggcacttgatttgttctttcacagcatgattctgcttttttttaattgaatcctatcctattttttaaatttcaatattcaatataaaaattttaaatttctttaattttaaatttcttttcttatttaggcaccacccattattgaaacggcgactgatcattcttctcaagaaaatatttcatttgaatcaaaatcaaattggcgatgtgccaacaaataccatggaattggcccctaccgttgcaaatccaacaaacggaggagatgaaatggctgctcatttcaaaatgcttcaacaattatggaacaaatgaaatgttcatgaattaattaagttgaattcataaatatgactttagaattaattaaatataaagcattggtttcaaaattgtgtcgaataattattattttccatattttttcaatggattctttacttttcttaatttttgttgccataagtaaatcaaaaagtaagaaaaatcatttaatttataacaaagatattcctgtttatttatttttaattctatttgttttttaattataatttggccgttatttttcccagtaggtgccgaagaaccacatttatgcaaaattaaaataaa

SEQ ID NO: 82861 - DNA, 747 bp, Heterodera glycines
  Genomic contig location: Contig_ID=SeqID_18268; Location=335..1081; Strand=-
  SCN-specific regions: Sequence locations=1-39,62-170,193-416,445 -472,494-503,539-747
atgacaagggaatccccaaataagaaagcgatttttgttagtaaaaaagaaaatgtaattcagcgactccatgttcgtaactatttcgttgtgaattccgtcaagttcaatcagaagtacttgtgtgagttcacactcatgccattaaattcactggtaaagaaagaatgattaaaaataaaattaaataatcttttggggttaataattgtttattaaactaaacacttaaggactgggatgttcttcagattaaaaccttcgttaattcgatgaataagtggcgcaagatgatggaaaaaatagagcggattcttttgagtgattgaattttttgaaatttaaaaattttgaaaaaatcagtttatggttttgctaagcttaagctcagatcgtgttcagcttttttagcctcgaaaattttataaaatttaaaattattttcgcagaaaccacaaactaccatttttcaaaattgtagaaataaacacaaccatcttttctaattattattattattattacaaatattttaatagattcaacacaatcaagatcctagtccaattccgagcccaacacctcaggcgtcgtcgtctgcctcgagtaattcttccggcgaaaacaaattgccgtcgattgatggaaatcctgaggagggaaattgaatgggacaatcgattgaatgttgtgtaaaaatatttgttgtttctttcacatattcgaaattttatataattgaataaa

SEQ ID NO: 82862 - DNA, 189 bp, Heterodera glycines
  Genomic contig location: Contig_ID=SeqID_18271; Location=554..742; Strand=-
  SCN-specific regions: Sequence locations=1-102,124-189
ttgcttttcagttggtttcaccctcattaaacatatgttcaagcagaggaggaaaaaaatggacgaattgtacagggaagaagcggcgatgaagagaagtcggcaaaagaagcaccaatgatgaaaaacagaataatttgccgcaatattacataattacatcccatggaattaaatttgcacaatttc

SEQ ID NO: 82863 - DNA, 1570 bp, Heterodera glycines
  Genomic contig location: Contig_ID=SeqID_18274; Location=672..2241; Strand=-
  SCN-specific regions: Sequence locations=1-380,402-1169,1195-1570
gtctgttgcttttgcaacaaacccacgtctggtgctcaccgatgtcgaaaatgctccaggccttgtcacgccattccaccatgctcactctcaagcgatggtgaaaaaggatacggatcaaaagtcatctgtggcggatgcgacctcattggtgacagtgacatcgacggaaatgcaaatgccgttagctcggcacaatctaccagcaaagcaacaaccgaggatatggtgttttcacaactttcgcgaaagcgtcgaggatttaccatcaaggaaaaattggacatcattgaacacgcaaaaaagacatcaattcacgctgccagcagacatttcaaagtcagccgagacaacattcgctgttggaagaaagaagaagcaaatttgagaaaaatgtaaaactatgatacctaactacttttttaaattgattgtaattaaggacagaatcgtgtaagcgtaagcgcctctttggtgccggaaggaaattgacagacgccaatttcgatgatgctctagcgaattgggtgcgcgaacttcgacagaagaagttacgcgtgacgcgcaccatggttttttcaagggcacaacaaaccagccccaactacaaaaatttggaaaatttttctgtaagaattcgagtaatttaaatcatattttaagtttttaggcaagtcatggatggttggaaagctttatgagccgccacagcttttcgttgcgaaaaccaacaacacttgcacaaaaaccacccgatgattatgccaaagcaattgtcaattttattgtctatgttcaaaaattatggcacgaaaaaaagtaatgataagcggaaaaagtgttaagcagattataattttagttactctggtgtctttgcgtgcgatgagacagcagtttggcttgacccaacaggcgcaaattgtgtttcagagaagggtgccaagtccgttacggtgctaacaacaggccatgaaaaggcaagggtgacggtgatgttgacggcaagatctgacgggacgaagctgcgtccctttgttttactgcataagaagagacctgtgcctgacattgccaaacgttttaagaacgatttagtgttgtgttggtgtggccgtacatggatggacaacgaactaacaacaaagtttttagaggaagtgcgaatgtttatttatatttttaaataaattaggtatgtaattaaggtgcttggcaattttgcgttcgggagacggcttcttatttgggacagctttcgttgtcatatcagtgacgatacaaagcagacactcaggcggttatctattgaatctgctgtcattcccggtggtactacgaaatacattcaagtactagacaattcaatttaaatcaaggaaaattattttagcccccagacgtgtgttggaacgcaccgtttaaaaacaaaatcaggcaaatttacgatgaatggatggtgaatggagagaaagaaacaacggcgtccggaaatatgaaggctcctccgccaatggagacgtatctgcatggattgtcaccgcctggaactcactctcgaaggaactga

SEQ ID NO: 82864 - DNA, 68 bp, Heterodera glycines; identical to SEQ ID NO: 64422
  Genomic contig location: Contig_ID=SeqID_18275; Location=587..654; Strand=+
  SCN-specific regions: Sequence locations=1-68

SEQ ID NO: 82865 - DNA, 239 bp, Heterodera glycines
  Genomic contig location: Contig_ID=SeqID_18275; Location=1530..1768; Strand=+
  SCN-specific regions: Sequence locations=1-239
caattgtttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactattttttcactatttcgacattttttggaaaattctttaacaaaaatgcaataaaatcaaaaaatacacccctaagaatcgacctaaaaaaat

SEQ ID NO: 82866 - DNA, 793 bp, Heterodera glycines
  Genomic contig location: Contig_ID=SeqID_3032; Location=1042..1834; Strand=+
  SCN-specific regions: Sequence locations=1-793
atggtcctcgtcatcgaattttgtgcccaaattctcggctgttccccgaaatcactccgcgataagctcaatcatcctgaggaccgagtgaaggcactgaaggagctggtcggaaaaaaggttcggacgacataccaggaccggaatggaatgcagaaaacattttttgtcgacggaatatcggaccatggagcggctttgaccccagcatacggcagactcagacaaccgtacaacattaacattgctgcccatttctacgctcgccaccgtatcaagctgcatttcccatacgtgccgtgtgttgtggagaaatactccgggtgtggcgaagacagatactacccaatggagctactcgaaattgtggatgaagactacaccaacaaagagcgatggcttggcaaattgtttaccgaaattgaggacgacttcattcctgtcaaacgccgtggtcgagttgacgaaaacgaagaaattgacgctggtcgttttgaatgcagtcaaccgtcttacgtttattggtaaacacatgtatgttaccttaattatgcacttttctacctaaaaacgacaaattcgtttttaagtttatacaaattgcaacttccgctccttaataatttacaaattgtgtcttctttctcttaattctgcacttttctacctaaaaatgacattcccaaatgcttaataatttacaaattgtaacttccattgcttaattctgcatgcatgttaatgtccttaattatgcacttttctacctaaaaatgacaagttcgtgcacata

SEQ ID NO: 82867 - DNA, 4162 bp, Heterodera glycines
  Genomic contig location: Contig_ID=SeqID_3033; Location=657..4818; Strand=-
  SCN-specific regions: Sequence locations=1-370,394-570,592-748,770 -3758,3780-3958,3980-4162
atggacaatcatccccgaaagcgcttcactaacttttccattgaccatattctctccgcgcccaaaaagccccgtcaaggcttcctgatcaatgaacttggcgtattccatttccatgaatcagttcaacaagccgatggaacatcgaatgtagtcaaagactacgttaaaaaattggagaacaacatcgagcacatggccaaattccattacgtcaaagtcaagtcaaagttcaccattacggatttgccgagcacgcctgaggcattgttggctgggattttccaacactgcatcgacgaagcaattgttgaaagccgtgagcgaaacatcgaacctacacacctcggctgtatgatcagcagtcctctgctggaaggcggagatatcccaatcccgatacgacaaatgacaaacaacactctcgacaccattctcaaccagttcaaaaaagtggcgcagtccaaacaacagaaaaatgtatcgttatggggtgagccgtttaccgtcaccatcacgactctggaccgtaatggactaccatccaaacgtcgagtcaacgggggagctcgtcgccctgtcaaaacggccgttcaccaccgaattaatgaccaatgcctgatcaaaatccgcaataacgacaatcacttctgccttttctacgcactgcaggcaacaatggtcgccaaaacatgcaattggcctcgctggaagtttttcgactatgtgaacgacagaaaaggacaacagggacaactttatcatgatgcggttgagctcatgcagcaggttaatgcaccaatggacttggatggctacgacgcgaacacttttgtgcctcacgtcgttgactactggaacaacgcgcagcgacaacaccgctttgctgtgttcatctttggatcgttgggacagtataaaccgatctacaagtacattgacaccacttacgacactccgctgctgttgtacttcaatgaggaccatttcgatggtgtgcagaagcagggcggtttgttcggcaggccttattgtctggagtgtgagcgcccgtaccgaagaatgtcagagcacagcaaaacatgtaaagcgcgctgtgtgctatgctcacgtgttggaccgctgtttccgtgtcagccaacggatggattcatcaaaaagtgtaaagaatgcaacaaaaaattcaccaacaacggctgctaccagcatcatctgcagtcaggctactgcaagcggtcgaaaaaatgcaaggattgtggtgctgtttgggacgtagcggttaacaacagaaatggcagaaaagggcatgtttgtggtgaacgcttctgtaagatgtgcaacaactaccacaacaccgagcggggatgctacatccaacccatcgagcccaaggaacgcgacccctatcgaattgtggcatttgacttggagactatgcagcacatgccatctgaaaagcccgaaaagcgtgaacatttgcccaactttatcgctgcgcgtgtcgcctgccccgactgcattgaaaatgagagctggcgagaggcatcgggagggtgtgaagtgtgcggtcctaatcgtacggtcgcgttctgccagcgccgcttcaccgaaacaacagtcgacaagcaagtggtggcggaaaaccctttggaagcgcttgtcagctggttgataaacgacttaccgctcgcctacgacacctatgccttctctcactttggcggtcggttcgatatggtgctggtgttccgcgaattgttcaaacgcggatataacccggacatgttgcgcaaagtaataattgactatttttcaaatttgaataattttcaattttaaggggaataaaatgtacgaaatgcggattcgaaggcagaaaaagcgcaaccccaacattgtgttccgcgactccttcaaccttatgccaatgtccctcgcttctttggtcccatcatttggcttggacgtggaggacaagccgttcttcccgcacatggccaaccacccggacaactacggaaagcagatccacccaatgccggacgactatttggtcagcggaatgatgccagataaacgacaaaaattcgacgagtggtatgaacaacaccgtcaggagccatttttcctcgacgaagcattgacaagctactgcacaaacgacgttgagatactgatggctgcgctggtagcttttcgtcatgagttcctggatgtgacgaaacggaatgaaggaatcgttgcggagcgtgcggccttctatgagcatcacgacggcattgatgtgcttagggagtgcatgacgatcgccggcgcatgtatgaagcattttcgcaccaaccatctgccgaagaagcatttggctatcgtcccggaacgcggctacgacaacgcccaaaaccagtcgttgctggcacttcgcttctttcattggtatgcggaggagcatggtgttgtggtgcagacggcgcattcggcaggcggagagaagaaaattggccaatattccgtggatggctgggtggaggaagaaagaagagcaatcgaagtcaacggatgtgtatggcacggctgcaaggaatgcttccccagtgacaacatgctaatgccgaacggaaagacggctggagaggtgcgggagcgggaccagaagcggctggaattcatcgaaagccaagtttctcgtgtggacgtgtactgggagtgtcaaattgaaagaatgctgcaccgtgacccggacatgcgcgaaagttttgctgattacgtggatgacgggccattggacattcgcgaggcgttcatgggcggaagaactgggccgctgaagctgtaccacaaggcgggagagggagaaaaaatctcgtactttgacttcacttccctctacccgtatgtcaagtgagttgttatacaacactaattttcccacattaaatttttttattttcagtttctccaccacttatccaattgagcatccaaaagtgctcatcttgaatgaaaatgtggaatggacaactgcacgggacaacccatacaaattgtctctgctcaaggtgtgggtgatcccgccacggaagtgcgatgtgccagtgttgccggttaaagtcaacgaacgactctgcttcccgctttgtatgcagtgtgctcttgactacccaaagggaggcgtggattttgactaccaatgtgaacacgacgaccaacaacgcggatgggtcacaacatgtacatccattgaattggatgctgcgcttgaagagggctaccgtgtgaccaaagtgttccgactgttgaagtacaagcatggcgacgacaaactgtttaggccctacatcgccgagttcatgtcgcagaaaattgaagcgagcgggtttgacgccagcatcaagggaaatacagagttggagcagcagttcatcagagagtgtgctgaaaaattcggcatttcaatcgacaaagacaacatgaaagtcaacaagggcaagcggtcgttggccaaactatgtcttaacaacttgtggggccgcttctcattgcgaaactttggcctcgcgcaaacgctgatcaccgacgatcctgtggtgctggccgaatacttggacaaccgctcagttgacgtcacttccatcgacgagttggatgcagaccatattttgatcagttacgtccagaagaaggagtgggtggaggagcacgagtgctccaacactggtgagacttttaaagaatttttgtataattttttgggatttttcagtcatctcactctggacaacatcaaaggcccgccttctacttttgaaagcgatgcagaaggtgatgagaacacctggatgccgactgttgtacacggacaccgactcgctgatttttgtccacccaatcggcttgaatccgctggagacagggccacacttgggacaattcaccgatgagtatcctaaccatgagattgtggagtactgtagtggcggagcgaagcaggtaaatttatccttttaatgattcataattgcaatttatgatttcagtatgggcttaaacttcggcgtaatggacaggaagaatttgtgctgaagctgaggggcatcacactcaactacgacgtgatgcagaaccaatccctctgctacgacacattcaaagaagaggtgttgcg

SEQ ID NO: 82868 - DNA, 1348 bp, Heterodera glycines
  Genomic contig location: Contig_ID=SeqID_3034; Location=539..1886; Strand=+
  SCN-specific regions: Sequence locations=1-218,249-298,322-450,475 -760,782-1348
atgaaacgccctaatcctttgaaccttccaatgagtgagaaaaagcccaaacttcgtcgacgcctgccggctgaattgaacaacgaattggtcagctttattccattggtctgcctttttgccaatgtgaagcgggctccaattggtcctgtttgttaccaattcgagtgtttccgtagtcaacgccaaaagtgctttgaatatttggtattttcaccatttttattttattacataaattatttatagaagggtgttattgcattattcgatgtgatgtttgaggagaaaaggacaccgaagaagaagaaagtggggagactgcttctacaggaagaactgccgcatgacctcagccgaaatgagctcctgcactacctgtgctacggacgactgggaacgaatttgttcgagacttattttgtgatgacccatgcaacaaatgtaagcgaaaagttttaaatttttaataacaacacaaaatttttagtcaattgccattgggaatttgtttgggcttctgctcgattttgcaatgagctcaccaactccttggctcatgaagcgacccatttgctgtggaattttcttccgacaacatttgccgtggattctgcaacaaccgatgaacgtaatgctttctcatggcttttttccggaggtccgaagtgatggttttgaatttttttggctgttcaacccacacttgaaaaagtatgctgggtatgtcagaattctccctgagcttagtcagcctgacaatttgcattttttccttagcattttctaagcattttacttgaccaatttattcatcattatcattacatacagatcggaatttgtcgatttttccattttctcaataaattgttgaaatgaatgaccttgtgacatatgatacacaaaaacaatacagtgtggggcacatgttgacactaattgggattgataggaacgaatattttttcttaggcccatcggaaacttattcaggaatgatgacacaatgacagatgggattttttgggctaagctgtcataataaatcactggttcttccattcccttcgcataaattgcacaccaatgagaccctcccttgtaatgtgggtcccggttaacaattagagctgcgggatactgtagagtgaccggaggcggtaattgatcactggcgaagcagccccgaaaaagctcgtgcggtcccccggttttcgttcaagattgatgtgatttgcacgctgtccattcttcagccaaaaaatagagcaaagttgatggagaaccaggctgacaataagcatcaagtacaatgcgaacaccgcccagcaaacggcttgttgga

SEQ ID NO: 82869 - DNA, 973 bp, Heterodera glycines
  misc_feature (25)..(25): n is a, c, g, or t
  misc_feature (39)..(39): n is a, c, g, or t
  Genomic contig location: Contig_ID=SeqID_18276; Location=1..973; Strand=-
  SCN-specific regions: Sequence locations=1-318,340-405,427-973
caaagggaagaaatcaatttataantatatccaaaattnaatgtcatccctttgaaatacctaatctgatttatgaagataaatgctatcataatagtgctgagaaatgtgaaatatttgccaagttatttgctaattcgtttaataattgtcaaacagacccaagcaatacatgattgggtaatattatagaaatttatcaatgctttatatcggatataaattttaacatcatcgagacccaaaatcttatgaaaaaacttccgaacaaaaatggcacttctccagataatattagctataaaattttaaaaattgccattcttctctgtcaactgttattacagacttgtttaggatctcattagacactggttcacttccagacatctggaaggaatcaattgtttttccgctttttaaaaagggtgacaaaaataatcccgaaaactataggccaatttcattaacctgctcactttgcagggtaatggaaagatttcaagcagacatatttacaattttctactaaaaaacaaaaaaatttcggaatatcaatttggttttgttagaaataggtctacaacaagtcaattaataacagttgtggaagattggtatgaggcaattataaatggaaaaatgttgactgtatttatattgactttcaaaaagcatttgactcagtgccccatgaattacttttatacaaattggaaaaaattggtataaggggcaaacttttaatttggataaaggattttttgagtaataggacttttcgtgttaaaattgaggatgctttatcctcaaataaaaaagtgctatggcgtcccccagggctctgtcctgggccctttattatttttggtctatattaacgatcttcctgatgctttgccatcaggagtaagaattaaattatatgctgatgatgttaaattgtatatttgttataaagcgagagctgaca

SEQ ID NO: 82870 - DNA, 679 bp, Heterodera glycines
  Genomic contig location: Contig_ID=SeqID_18277; Location=1280..1958; Strand=+
  SCN-specific regions: Sequence locations=1-18,40-283,305-361,384 -406,428-679
atgactgaaaacggaacatcaaagcaaattgctgatttggaaatgcacgaagttgagcaggggtcgcgcagcttaccggaaaaccaagaggcgtacaaaaagtgagtttgtaaattggtggcggtggtggttatatttgcatgtcatgaataattattttgcctttgctttagtttcgattgttatttatattttgcttattaaacattgtaaaattaaatgtaatgtttgaattttaactacattatctctaaacagaaacatggacaaaggacataaattgatgttggctcagtcattttacgatgcgtccgttgtgcttcgtaaggcggccaaattttcgtaaggctttgcacgtcaattattttaattttgatatattagttcaaaagaggtggttttggaagcagacgatggggaggccgagcaagacggagacgaggatgacggtcaaatcgcatgggaaaacctcgaagtggcgcgaaaaatttgcgaaaagtgtcgatattttcatttttttatatttaaatgcaaattcagtcaaatgaaaagctaccacgcgaagttatggacggagcgaaaatcggatgtgttggtggctctaggcgattgtatgaccgtttcggagaactttccgcttgcgttggaagaattcacgagcgcactggagattcggaag

SEQ ID NO: 82871 - DNA, 767 bp, Heterodera glycines
  Genomic contig location: Contig_ID=SeqID_18278; Location=1112..1878; Strand=-
  SCN-specific regions: Sequence locations=1-111,133-199,221-383,628 -660,682-689
atgattaaaagaggtacaaaagtgattcaaagaggtatatcagtgattaaaaaacgtacaaaagtgattagaagaggtgcaaaagtgattagaagaggtacaaaagtgattcaaaaacgtacaaaagtgattcaaagaggtacatcagtgattaaaaaacgtacaaaagtgattaaaggaggtacaaaagtgattaaaagaggtacaaaaataattaaaagaggtagaaaagtgattcaaagaggtatatcagtgattaaaggaggtacaaaagtgattaaaagaggtataaaagtaattaaaagaggtacaacagtgattaggagaggtacaccatggttaggagaggtactaccattggggaagaggtacaacatggtttgaaattaaataaataaggtaaaagttttattaaaattaaaaatacaatgcattttaattttaaaaaatttttataataaaaactctttttattaattaaaaacaacgttggaaattattaattgaatatttatttaatttgaaattaattaatttttttacaaattcaaaaataaataatgaaatcctttaatttaaaaaaaataaatttaaataatttaaaagaaatcttcaaattaattatttgttgaccttacagagattagaagaggtacaactgtgattaaaaaattagtaaatggtttatgaaaaatagaattaaaaaatgtattaatattttttaaaaaattattaaaaaatgctttcttttattaattaaaaataaa

SEQ ID NO: 82872 - DNA, 502 bp, Heterodera glycines
  Genomic contig location: Contig_ID=SeqID_18280; Location=539..1040; Strand=+
  SCN-specific regions: Sequence locations=1-433,463-502
atgcaagagtggcacagtccatggccggaaaatggaccagtggataataaatacgtcagtgaatcagaatttcttgaaaaacgatatacggaagttgcgccaaatactgtatatattactgacgtattttcagcgatttaaaagattagatacggtcgtctcggtgtggacaaattcaattgaatccaaccaaaataagtataaaaaggttccgttaaaaaatcacccaaaaccaatttcaattaatctcatcatttttgttgagattcatccaagtagaataagaaccgtaaaactcaagataatcagggtttcaaaggacatcaaattgactcaaaatgggatgtcaaaatccaaggactgataggaaaactttaatttaatgattttaatttgtaagcgagggttatttgttgtctctccatcactgtcgttaattttatttaatttcttttttataatctacgccgacagaaactgggaatcagcagaggctcccaaa

SEQ ID NO: 82873 - DNA, 2214 bp, Heterodera glycines
  Genomic contig location: Contig_ID=SeqID_18285; Location=17..2230; Strand=-
  SCN-specific regions: Sequence locations=1-130,154-882,904-1078,1121 -1151,1173-1190,1212-1568,1590-1675,1711-2078,2101-2214
  Gene Ontology: Mol. function=structural constituent of cytoskeleton; Cellular component=cell-cell adherens junction; Biological process =microtubule-based process
atgcaattcagcgagacgctggaagtgttggagcaaatctttgaacagcacaagctggacaaccgggatattcaggactttcgacaaacggtggacgaatgcattgccagacaagtaaaaaaaattgccaaaaataatttaataaaacaattggagtgatcttacaatccattttttgatcgggggaaggtgagacaccaaattaatgtgataaaaatattttgaattgtttctggcctacaaaattccaaattgttagagtcaaaatattggaatattttaaatctctgatattgaaccggtggttctaccgtatatttcatataataatctcgaccaagatgactatgatcaagaatcatttcctcattccttccaatgtctgcgttctctgatcacttttcactttctcaggctgaagtatcagcagaagattcatacgattattgtgagctgttgaaaatgatggagtcggagtaccaacagttgcgcgaactgtctgccgggcgcatggtcgatttggtgggttgggctttataccatgcttaattaggtcctttaatagggcaattaaattatgcgttagccatttccttaattttgccatggtctcttaatttgatcatattttctgtcctgtttactactgatcagcccaatgctctctctctgatcacaggactcgctgatcgccttcatccgtgctgctcagcttgaattgctttggatccatcagcgtgaggaattggaagtgacacgcaactggagcgacttggagcgcctggacataccgatgctgcaaaactacttcaagcaggtggttgcgcaaattacagctaataggcgcgaatggcgcatgactaattaggtttaattggccggaaaataaaatgtttaaaaaatgttttttttgttagattcaggatctagcttttaaaaattattgacaatttcgtcgattagtcatcaaattttcgaaatttaagttttatttcgtttgtcgtcggcattatcaatggagaacaacaacttatcatcggatgcaaaatgaaaaaatttattttatagtcaaacctactaaaatttcataaattttcaataaatttaattttttttaattgcaaaattaagttttcctaaagttttgattaattttcaaaattcttataaatatgtttagaatgatattattttatagaggaataaaatgatttgagggaaggaataatggtttaaatcccattatggaaaaattcaaagtagaaaattacaaagttcactcggatttaaatgccgagaacctcactcatgcaactattaatatttaatgatttatgatcatgaaccatttagctgctccatgagattgagctgcacgagaagcagttcaacgacgtgcacaaccagggcgccgcgctgatcaaccaacgccacccggcgggcgaagtgatcgaggtgtacctgcgcaccatgcagaaccaatgggattggatgctgaacctgagcaagtgcctggagggccacctgcgcgacgcgtacaatgccaaggcatttgtggaggagtcggagcaggtggagcagcagatgcagcaacagttggtcagttttgcgtgatgtatgtcagcgggggggggggggtttccggctcagaaaattttggaatttcgggattctgaaaaaaatttaaattttttaaattaaaaaaataaagagtatgattatgattgaattcaattctctcattaaaccataattttgtcaaaatctccttttttaaaaacatggtttctgctttaatcctctttaagctgaatatatgaaaaagtgccaaaatccaaaccgttaaaatttatttaaatgattgggcccctaaattatcgcaattgactccattccaggaccatcttgatcgtgaatattctcgtactgatttttcgctggacgatggtgaacagatgttgcgacagcttgactctgtccgtgaatacatccaacaattgcatgcgcgactcctttcactgaccgacaggtgagcaaaagcctaacattttttggcacgttttttgcatggcattttcattttttaaatttattttttttcaaggtgtgcccaaatttcaccgctttggcaacgtggcgaacccatttcaaaaccgctgccggtgatggcactttgcgagtacaagagcaaggacaaaattcacatcagacaag

SEQ ID NO: 82874 - DNA, 1363 bp, Heterodera glycines
  Genomic contig location: Contig_ID=SeqID_18286; Location=657..2019; Strand=+
  SCN-specific regions: Sequence locations=1-346,378-610,633-668,701 -926,951-1363
  Gene Ontology: Mol. function=ubiquitin-protein ligase activity; Cellular component=proteasome complex (sensu Eukarya); Biological process=ubiquitin-dependent protein catabolism
atggatgacggcaaagacatgttccactggaaggccaccatcaaaggaccgcccgagtcgccgtacgagggaggcaccttccatttggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaaggtgaaagcgacgcgggaaagagcagacaaaacgccgacaaaatattgagacgacaaaacgatccaattcgaaacgaccaccaaaaccggactttttggaaaagtgtcgatattttgtcgtgtgaataggatttttcaaattcggaaatgccgttttaattcattgtctcccctccatttcagtgctgctctccatctcttcgcttctctgcgacccgaatccggacagtgcgctggagatggacatcgcgattatctaccgcaacgaccgcgagcagtacaaccgaaatgcccgtgaatggacgcagaagcacgcgatgaaatgagacgacaaacgaccgatggatgggagaggatacagaagacaaccgccgaagagggaggaggaggaggatacattcaactgaccctattcccatatatgccaactgtatagattgtattattgtatctcactgtatgtacagtatttgtcgcccggttatcgtttaagcgaccataattgtctgttgttggttgatcaccattatcaatgtgttgtatctctgtgttatcatttcaaccaatttgtgatcaattgttgcgcctaatgtgtgtaaataatgtgaagaatccaaagatttgtttgtgtttttgctccctttttcgtgccttttcatgacttattcaattttttggtgcctattatagtgccttttttcccaggcttttccatgctctaaataagtgttcggaccccgaccccgaaccctactgattttatttatttttttaaactgaggaaattctcaagcaattagtgagttttcaagaaaatatacccttaagaatggcatttcttgggataaaaggcaaacaattatacttgtatttttttaactttttaaaccacttttgataaaattttatgtgataaatagggatgccaaaaatatgcacataaaatcgtaaaatatgcacataaaaagtgaaaaatatgcacaaaaaattttccaattgagggtgtaatttctcaaaattactccccttttaagcaaagcaaattgagagaaacaatcaattaatgtgagaaaaaaggaaaaacgacgacgaatgggtcgaataatcaaatgaaaggaatgaatga

SEQ ID NO: 82875 - DNA, 1230 bp, Heterodera glycines
  Genomic contig location: Contig_ID=SeqID_18288; Location=1585..2814; Strand=-
  SCN-specific regions: Sequence locations=1-89,115-135,179-213,236 -363,386-406,431-502,524-590,642-784,806-968,990-1230
atgaccatatttgggcattcggttactgtaggaggaaaaatcttccggcacaattttcggtgaaaatttgaaaccatttaaaagcattggaagaaaataaataaacaacaaaaccttcgaaatttctttcctttgttttatttatttatttatttttaatgaatataaattaaaaattgaaggtcatttgatttgctgtgtttttataggaagtggaattaattaaatgaaaaaagccaacccaaacaaatgaagcagttcctggagaggaaccaaagcccgccatgaaaatgtttcttaaacattcaaagccggcttcgataactgactttcttaaatcgaagttgagtttaatttgtaatcattaaaataatttgacaaacaattaaaaaggtaaacaattaccttattttttattcaaataaatttcacacattcactagttggccaactgacgaatttataacatattaagctatagatccataagaaatataatttgtatatcatattttaggactattcggccaatgatttaatttctctaatgcaaagaattgggcagcaattttccaaggattttgatagagtaataaatatataaatacattttatataatattttttcaaaataattttttcttcatgcttaggtcgattctgtgttggaagcccaaagcgaacagttaagccgttttgaacgtcacattgagcagttggaaagtgcccaaaatggactgctgtcaacactttcggacacaattaaagtaaaaaaaataaaatttgcataaataattaaaagagaccggaattcaaatttgcggatttggttgggggggggggacttgaattcaaaattctttgctagaccggatttgtgggattaatctcaaatattgggatcatcgcccgggctcaagtgataaatcatttagcatgccatttaatttgttattttatgtattgtattttaggttgcttttctgttgactttgctcattggcggcttcatccttctgcttttggccaataaattgctgaaaggctataagcaaaaagttgctcacgtgccattggctacctcagcaatttaactgagcaaaatttcttcaaattaggtcccccaatttagtaatttccaaattttctgtacctctttcaattgctacctcaccattcggtgtctcattggttatttctattgttatactgtagttctttcttaataaa

SEQ ID NO: 82876 - DNA, 146 bp, Heterodera glycines
  Genomic contig location: Contig_ID=SeqID_3035; Location=1715..1860; Strand=+
  SCN-specific regions: Sequence locations=1-146
agggttgcaaccccgaccccgccccgaccccgaaccccgacatttttggccattttcggggaaaaccccgatcccgaaccccgacgcttcataccccgacaaccccgaaccccgacccttaaccccgatcggggtcggggttaaat

SEQ ID NO: 82877 - DNA, 863 bp, Heterodera glycines
  Genomic contig location: Contig_ID=SeqID_3036; Location=650..1512; Strand=+
  SCN-specific regions: Sequence locations=1-69,95-744,766-830,852-863
atgcatctttatagcaatatttataatataaaagatgaaaatttgactccacgccgtctcaagccgaaacaaggagcagtatttaaaaacaaaacgccaaagcggggaaaagcagtggagaaaggtgtcaaggaattgcatgtgagcgaaagtgcgaaggtgtgaaacgacaaaaggacgagaaagtttagaagaaagttgaacgaaaagtttttttcatcgatgcccctccccaagttccatggttagccgaaaccatccggtttttagggtccaaaatccgacattttccgaatcgaaatccgacccgagcattctgaggtgacctaaaacacgacctaactttttttttctcaaccctagccaacagaacctaagcatggcaatgccgccaaccttggaaaaatgacacgacactcttaaaaagtgaaatgttatgtctattgttttcaattgccttttcctctttgggctttatcagaaagtgcgagaacaggctttgtaactgagaatgaccgcggaaacaaaaaaaaacgagaaattttcaaaaaccaaggctctttctcgcacaccccctaaagaaatttcctatctccactccatctgtcactatttttcttgttgaaattcttttgtaaaactctgttatgtaaggggataaagtgtgattctatcagaaggatatttcttatttatttaaatgtaagtcataattagtgtccagatttatatggacaaaaaaatccaaaattttaattataatatggacgaaaaaaagcaaaatctttaggggtgtatttttagattttctagtgaaaatgccaaaatatgggtgtaaaatatggacaaaaatctggatggaa

SEQ ID NO: 82878 - DNA, 3830 bp, Heterodera glycines
  Genomic contig location: Contig_ID=SeqID_3037; Location=1175..5004; Strand=-
  SCN-specific regions: Sequence locations=1-130,153-354,376-407,430 -511,539-704,737-872,895-1014,1037-1257,1280-1309,1331-1404,1426 -1624,1684-1830,1852-2265,2287-2427,2449-2495,2517-2567,2589 -2732,2755-2768,2790-2835,...
  SCN-specific regions: Sequence locations=...2879-2929,2952-3349,3372 -3565,3587-3592,3614-3830
atgtcatcatttggccctgttttatcgtcgttcgtaaattcaatgctgtcggaatcgtcctcaattgtcgacatcccttctccatctcccagcaatggcactcaaacccttggcactgctgtcaatggcattggcacttcccactcatccacccgtcatgacacttcttcgcctttggtcgcctccgaaacgttcgtcgacgacgcgccggacgactccgactcatcgtcggcggtgttttatgtgcgcaacaacggcaccgatggcggcaaacaaaaggccaacaaaaaacaaaaggacacattcaaatgcgcaaattgcaacatcaatttcaagtcggatgaaatggtgggctttgttgaaaaattaattttgagggtttttggtctgaaattcttcactaatttgttttgtttttgtaagatttatggcccccattaattttatttgattgtttgtttttttattgtcaattttaataagtaagaattttttagccaatgtttgtggctttaattttaaaatattatattttaatgatttctgattcaaaaagagtttgtagcatcaaattaagagaaaataacaaaggttttacttgcattgaaaaagaaaataagaaagtttgctgcttctccgtcggggattgaaccattgcgaaaaaaccttctcttttttcaatatttttttttacaaaaacaaattattttgtttttatcttcctttcctttcctcaatttccatctgagaaaacgagaaaaccctggggttaaaaagtgacattgaacaattacatttcaaaagcttaattatgcaatatctttccctaattgcccaaaaggacagatttttaagaaattaataatttcacttttttcaaaaaatcagttggaattacatcaaaataattgtcgccgctccgttctctctgcccccgccaatttttgctcatcactgtcattttgcgacatttgtaaccgaaaattcatctctccacgcggggtggcacttcacaaaggcaaggcacacaaaggggagagcagcagcaaattggtcaagccgaagaatatggcgaagtgcccgtaagttttaatttggaaaaatattacaaaaaaaaatatttttcatttgttagagagttcttttcttttctaattttcttttaaatccacaattggtgccattttccaattttatgcgaaaatttaaaaaaccaaattccaatttaggttctagcaaaataccttaaataatttcatggaattcatgcttttttaattgttaattactatggttataaattatatggattaaacatattttttctgcgcatatgctataaagaaaggggctcaaaaataacatttctgcgttaaaaatttttgatttggagaaacttcgaccatataaatatatatatatattgggggttttcgcgaataaatccatgtttcgacattttgcgtttttagtcaatatttacttctaaaaagagaatttttttcgaaatttggaaattttttttaggtattttgttcgtttccgaaaattttcgctgacaacagaatgagattattaaaaaattttgaaatgtgttttgtttgcaattgtgaagctagaatttaataaaaattggtatttttaaggttaaatccatttttggcagtttttaaacgtatttttagttctgtttaagcaaatattgaatataatcaccttttcggaattttttatggtttaaaagatatattttgacagtttttagtccatattttactatattttcgggctttttagtccatatttttgttcaatttggtgttttttagtccatataatttataatcctactaattaatctttttttacgcccattcacaatgcaatttgattcattttttgcttcataaacatatcatctttctgtttgacagcatcgccacccgcgcagtcaaacggggccgtccccgtaaggttggcgtagtgccgccgacgtcggttgacactgccaaaaaaggacgagcccattccattgccgccgtgccgccgattggccatcaaaacgtaatactctcagcgcttcttttacatttgaaactgatcacatttgggcattccgtcttttgacgaattgatcaaaatcaaatcaccggtccctagcaataattcttacacagcaaaaatttttggcccgggattcgggacataaatgagaggaagggagtaacgaccgcctttttaagatttttataatttgggacctgaaaatatgatagtttggaatttgccggaacattcttttctgccactaaactttgtgagatttaaattttttttagcatttcttttcctaaatttttggtcaattcttctccctttttaatttatatatttcaaaattcttttgaacattttttctaacataaaacttttgtagcgaaaaataattttcccaaaaagcttttgagtggccgtcaccgcaccaaacccacaaacgctgccactgctcagcagcaaccaaatggcaatgtgcaaattccgaagttgcgcaggcacggacatccggtgaaaatggaaggtacaaaaaagcaaggggtagacactaggggtggcatctaaggcccctaaaattctggaaatggaaatcggaatcaatgccatccttgatgcacaatttgttttgtgacccgaaaaagcgtcaatgatactgtatatttatggataaacaaatggacaatttaaaatgagttttctttaatgcgagtcatagagaaaagaaaatattttttagaataactgacaaattttatttcaaatctctaaaattacgcatggaaaaaatttgaaaaattatattctttttttaatatttttaaaaccttatgggaatatttcacaaaaaacgatggaaatatttaattaatgtcttaaatttatatggtttctttcaattctttataaataaatttctatgattctatcgattacttttgccatcatttttaagtcggctcatctttggcagatcaaagctacaacaaacgaaggactaatggcgcaggaggagaacagcgtcgcgcaccgaatggcgatggcggagacagaccaaacggcggcggaacgcaaatggacgacgacgacggatttggaggagaagcggaggaagacgacattgtgattttggagccagaagtaggaatattaccattaaattaataattaatccttaattaattatgtgaagctaatgaaagtgtaaaaagtgccgcttgttgatttaatccgaataattaaccaagggaaatggtgaattatttttatgagctttccccccccccctcgaaacctgtatatttttttaaattaaaaaacgggatgaaaatttacattaacaaatctcataaaaaattacaaaaatcctccgacgggccgtctgtcggcgccgcggcacacccccaaattccttaaattttaaatttcggcccaaaaacctacgaaaatggtcctcagttagcgaatatgcctaaattttctaaaatttctctgcgcttcctctccctttaatccctcccactccaccccaaaaatagcgaatttaaattttaaaaaaaaagtcgtcagtcgccccgcccctgaagccaagatattggctatgccctttgcttcagactaaacacggaattgtcccgcgtaacacttttggcactgtggggccccagcaacagcagcagaattgtgccgcttcagggatggccgttccgtcgtcttcttcgtcgatgatctcgcattatgccgggatggtgatcagtgcttgtgcgcaaagcaatatg

SEQ ID NO: 82879 - DNA, 72 bp, Heterodera glycines
  Genomic contig location: Contig_ID=SeqID_18290; Location=113..184; Strand=-
  SCN-specific regions: Sequence locations=1-72
atgcattcaatttggagtagagcgaacacaatttttgccttctcactcactgtgctcagcacagtcacattg

SEQ ID NO: 82880 - DNA, 516 bp, Heterodera glycines
  Genomic contig location: Contig_ID=SeqID_18291; Location=226..741; Strand=-
  SCN-specific regions: Sequence locations=1-183,205-356,379-516
atgccatgcaaaacgtacgttttttcaattttatcggatttttaaaacggttactgtttctgtttttttcatccctcaaaaaaatttcatttacagcaattctccaccgcgcgttcagtgtgttcatgttcgatgcggacaaccgactcattttgcagcagaggtcgcagacaaaaatcacattccccggcctgtggacgaacacatgttgcaggtttggtactgaaaatcgtaaacattggccaacaatttaacccagatggattgtgtgtttttaaaattttttttacccttgcctcgaaaaatcaatgcataatccagtggaaattttttggaacaaaaagtgtcagaaaatctcccattttgctgtttttattctctctttatcgtggccgtgcggaaatttaatgcccttttcaagtctcgattttgggtatcgcaatgcccttgctcaaaattcgacaaatgcacatggttttcttggaattgtttccaaaatcttaagaaaacaataaa

SEQ ID NO: 82881 - DNA, 842 bp, Heterodera glycines
  misc_feature (76)..(76): n is a, c, g, or t
  Genomic contig location: Contig_ID=SeqID_18292; Location=213..1054; Strand=-
  SCN-specific regions: Sequence locations=1-185,207-406,429-842
atgccattccgacgaacgtgccaagtgggacatttgacaaaccatttagtccatttggacaaatgtggacatttgntcaaccaatttcattagccaatcccattttggtttatttttttgtgatttgagctatataggcaatttgcttaaagattaaactaaaaatttgtatgcaattgacccgattaaagcggaagaattcaatttggcaaatttttctttttaaatcaagagacattttgccaaaatttttttgaattttatacaacaaacttttgtacatttctcctattttcaggtgattctgctgatttggacagtctctggccttctgtcattgcccgaaccgttcactttgcgcatttatccggctgaatatgcgcgaaatttgactacgacggtaaaattgttggaaatatttttaaattcaaaatgccaatttttagtggggcacccgttgcaaagagagttggtcccccgaattccaacaaaagtatcagttgatccaaacgttggcactttttttggcaccgctcacaatcatttcggcattgtgcgttcacatgagcattgtattgcgcaacaaagccatgcaggtggtcaattagtgggaccaattagtcacgggttttccaattatgaaagcaattagtgtttggcacttttaactttcagttattaggtttatcagtcgtcatttgaatgaaaaattatttaattgatcattatctaattaactttgattgtcttgtgaaacaattagccagctgataggttaatgaattcgaattagtctttaatgatttggtgcggctattaattaattaatcccaaaaaataaa

SEQ ID NO: 82882 - DNA, 577 bp, Heterodera glycines
  Genomic contig location: Contig_ID=SeqID_18293; Location=871..1447; Strand=-
  SCN-specific regions: Sequence locations=1-436,546-577
atgacatttcgccaacaattcaaattcaaaacggcaggaggttacagcagcgaagaggaattggacaggtgggtgattttctcaatttattttttgaatttttcgcattttttgtgatttttccatttttggcatttacggcattttatttttgttaaaacgaaaaattaaaaatttcgctaaaaatttccgcaattcaaatgaattttttaggctaaatgacgacgaatacgtggactttgtggccgattttctgaagcccaccccaattgaatgggttttcgtcgcaatttttgccattttaatggctgtcggagtctgcggaaattgtagggattcgaaattttcaaaaattccattttttcggaaatttaggcctcgtggtttacgtcgtctcaagaaataggcacatggtgagaatttgctgaatttcgtcttttattttttaaatttaataatttaatcataaaattttttaaaattttggtaaaataataatttatttattttaaatattaaaaaaaatttaatttttaaattaatttctttgactttttctgacaaatgggcaaataaa

SEQ ID NO: 82883 - DNA, 777 bp, Heterodera glycines
  Genomic contig location: Contig_ID=SeqID_18295; Location=972..1748; Strand=-
  SCN-specific regions: Sequence locations=22-261,318-777
atggaattgaccccaacccagtttttgaatattgttgaattcggatttattttcctcgacctacctaataaaaacttaagccgtaaagtgagcagtgagattacgatcggacagcgtacattatgaatagggcttatatttatagttttttcactattttttcctgagctctctatagcctgaaacgcacgaaaaacatgttttttaggggagttgttaagctagttttgagttattagaattattttctagttttgcgccaatattatttattttagttaaaatttaaattttatagataatcaaaaattaaatttctttaacttttcctatttctatttgaatttaagcctttatttgaggtgaaaatggacgaatcacttggaaataaacggcgaagacacagcacagtcaaagaggatgattcagtttcattgtgcggaagtgtcgcaacaacggccgccggggatggctctctgttggactttgggcttgacgaagaaacattggcggtcgaatccgacacggaattcgagcgaaaattcttcgtaatgaaaggttgacgaaaatgataaaatcataacaaataaacgaacaatcctttgtttcagagggctcttttccggggaaggtttttgctttgcctcaccccgcctcgagggaacgcgcgttgtatttggtcagtcagcgaaaacggacaaggaaaagtcagagaaaagcgaacgaataataagcggagggaatggccattttggcaaaaaaatttatacaaataaa

SEQ ID NO: 82884 - DNA, 1123 bp, Heterodera glycines
  Genomic contig location: Contig_ID=SeqID_18296; Location=1..1123; Strand=-
  SCN-specific regions: Sequence locations=1-59,92-722,744-858,880 -1011,1038-1123
tgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaa

SEQ ID NO: 82885 - DNA, 293 bp, Heterodera glycines
  Genomic contig location: Contig_ID=SeqID_18298; Location=517..809; Strand=+
  SCN-specific regions: Sequence locations=1-272
atggatttcacgaaacccgtaattactgatgtaatttttgttaaaccacccgcagatgacagtccgggctttgtattgagtgcatggcgttgctcttatcacaacgatgaaacatatttatgccaaagaccagaaggtgattatagtaaatttcttctcactcaataatcaaatataatcgatgccgcaccgattagctaaaaattagaattttctaggctcggtaccaatatttgtcgcgcatccctaataagcaaatcctctcttaattctttaattttttaatttttaaa

SEQ ID NO: 82886 - DNA, 494 bp, Heterodera glycines
  Genomic contig location: Contig_ID=SeqID_18298; Location=1287..1780; Strand=+
  SCN-specific regions: Sequence locations=1-169,200-239,262-267,335-494
atgcgtggtacttatgacgaagatggatacggttcgcttgaggacaaagaatgcgacaaaggccaacagttttgctacttggcaaactgtaaaaccggtaatgacattggaatgcgttatttgacctgcttaagaaccccaaatttggtactaaatacaaatgattgtcaataatttttaaaatatttttataaattttgctcaaaaaactaaactcaaaatttaagttaatgaaagattttctagaaatgactttttattcttttcaaaaaaaatttttaattaaaataattaatttattaaaatattatttaaaaaattcattaaaattaatgcatttcttgttcaaataacttgtagacatggtcagctatttgtcttgggattgtgcgaaagacacggattgtgccaaaatttcggctgattggaccatgaacagaggcggcggcaattactcgtgcgagtgcacatttggcgcccctggattaacttga

SEQ ID NO: 82887 - DNA, 563 bp, Heterodera glycines
  Genomic contig location: Contig_ID=SeqID_18300; Location=107..669; Strand=+
  SCN-specific regions: Sequence locations=1-276,301-535
atgttctacagaatcgtcggtcatttgtcgcttttcgaatggtcgcaaagaaacgcgcactttcgtcgacccggccgaattcttcgcgcgtcagtctctgaacgcctcgcgaatggcacggcgcacaaacacacgacaccgttttcagcagcaaaacgcactgttcgaggatttgctgttagcggaagcggaaagggacgcggtgccgacggcgcttaccattcgcgggacgacggcacccgcggggacaacggaaagatgaagcaaagcgcagggataaatgaaaataaagatattaaaacaaaaactatgacactgccgaaagcattcattggacatccaaattgaacagctgcggggaatttcaatttctgatcaaaacttaaaaaatatgaaaattttggtttttaattggtcaaaaagagaagacatccaatttatataaatcggagattgatttatccaaagctttcaagttttgttaaattttttgacttccctctcctaacatttcactcattcaaaatttaattggaattttaattattttttattttaaatta

SEQ ID NO: 82888 - DNA, 1657 bp, Heterodera glycines
  misc_feature (17)..(18): n is a, c, g, or t
  Genomic contig location: Contig_ID=SeqID_18300; Location=1031..2687; Strand=-
  SCN-specific regions: Sequence locations=1-209,231-279,301-444,466 -487,540-571,593-1192,1234-1236,1259-1474,1496-1657
cttgcatgggcctgcannggtcagggtaaatatgggccaaagcattcatctttgggggacccattcgaccggggccaagaggacccactgattagccgattgttggccaagaggaggcaattccgcaccttgctcacctcttcctccacgccaattttcgaaacaattgaccatgcgtttcagcagcgcaccgtttttgacgggcccatgaaaatttttgaaaattttaagttgagacctggtgagaagtcaaaaagggtaatatttcatttaaaatttaattatccaacaaagaaaaggttaaatcttcggccgaaaagcaaagcaaacgaaccaattattacattaattaagtgataaatcaaaaggcaaaatctgttaataagtccaaaaattatcaagtttttctcactgccgcctataggcatcgtcggaatattattgttttaaattgagttttaagatgaaattcgcggaaccgttagacaattatttatttatttttaatattgataatttttttgattaattttttttttgaatcaaaatcttatatttcacctgtttctccgcaaaatgtattaaaaatagtcaaaaatccaattaaagttaatgagagccaaagctgcaaaaaaaagttaaaaaattgaaaattcgagccttagtaattcaaaagtcatttcgccatttgccaaggcattcaattggacttttacgattggcgtgcgcgcattttatcagtcgctgtcaatgggtaaaatcgttctccgaactccaggtaccgtaaattgccactgcttttaccgtaactcgttcataccgtatgcccaccaaaggaaattccactttctgacctccagtcgttaatcgtccactgctccttcgctttgctcgtcttttgcgaagcctttgaaacacccgaacggttttctgatcgtttggtttaccctgacggacttcaagtgaccaggaacttttccaaaggcatttgtatcccgcaaaacggactgatcagaggcatagtggcggtgatcaaccacattttggtaacaaatgggaagcaattagggacaatttccaaaaaaggagtcttaattactctaaggcaccaatacgacgaatccaactgaacgaagtggaatacgtattcatacagtcactgcttctgtttgattcaggtcgaaaaggattgttaattttattttaaaataattgttaatttttaatatttttgtgcattttcagattgtctttcattgggcgaaaaaactcagcaaattgtaaacgaaaagcaacaaaaacttttggagagtttgcagagatatttgaatagaaaaaaggacggaaatgcaatggaaagtgtcaagcgaatggccgaacttttgcttcggattccgaatattcaagtaaagaacgcaatttttggcagaatattatgtaattgaaaatttattcccattaattacaattaaatctttttaattaaaaacattttcaattttcgtgcatttgttttatcaaaatccttcagaaagttgctgccttcaaaaggcaatttttcttggatgagaatggcctgaggattttgggcccaaattgtgccaaatgcagcttcgccattcaaattgccagcctctacctgaacacttctttcttc

SEQ ID NO: 82889 - DNA, 586 bp, Heterodera glycines
  Genomic contig location: Contig_ID=SeqID_3038; Location=333..918; Strand=+
  SCN-specific regions: Sequence locations=1-136,216-240,289-586
atgaaagtgggtgtgtgattgattgtatgggcttattaatcgttcaatttgcgctttgtccctttttttcttccactgcaaaatcaatgactaatgtgactttgtcctcattttggtcatacactcctattgctactttaatttgaatttttttttataactttttgaattttttaaaattttttagtcaaaaatttttcttaaaaaaattaaatcgatttagcaacatagcgagcgatctttaaatattaatggattttatttttaaaattaaaaaaacataattttgccagacaatcgctttgtgcagcaggacagcacacggcaaatgatgcgcaaccggcgggaatgggctgtccaacggttgttcaggcattatgccaatgtcggtgtgccgaactcaaccgtacggttgggcgaaattctgctgttgctgcctgagttggaggtgttacaatatggggactcaatgtgggaattacgatcaaatatcgacccaaaaaatcctggggataggccaaatcagtaccaatcagcggggatcaatggacttttttgatcagatccccaccaaggatgttcgaca

SEQ ID NO: 82890 - DNA, 794 bp, Heterodera glycines
  Genomic contig location: Contig_ID=SeqID_3038; Location=3231..4024; Strand=-
  SCN-specific regions: Sequence locations=1-393,416-460,496-529,558 -689,719-794
atggcacggaattccgacttccgatatttttggggtcggaatccgacttccgaaatttttcataaaaagtccgaatttttcggaaaaaatttgctaaaaatcgctaaatttattttggagttttgcatgataatagaaaatacttttttgggtaagtcatagcactttcttatcactattttttcattttaaaattttttagtaaggagtctcaggttcaagagtttttgaattgttctgatcagtgattacgaatatgatggccgttttggctgctcaaattcaaatatttatgcttcgtttgactcgaaaattcgaaatccgacaaatttagcctagtttttcaaaaaaacccagcggcgcctgtcggcaatcaaaccaaatgcaacaacgaattaaataatatttataaattgcaaaattaaattcaacaacattgtcaggaattactgaacaaaatacacaaaaatctaacaaatattttggtcaaaagagcaagacgcttatgaatagggctcgaaaaaataagcatatgtatatattttttccatgggctcgaaacagccagaaactcacgaaaaatataacagaaaaatttttaaaaaaaagtcaagcagcaacatcatcacaagcagcagaagatgaattgtcaattaaccaaaacaatttggaagaaagcattttaaatgcaaaaggaaaacaaaataaaattgaaattgagccacctaattctccagacaatccatcacagttaccgtttgaatcatctgtcttataaaacgattattaataaa

SEQ ID NO: 82891 - DNA, 1436 bp, Heterodera glycines
  Genomic contig location: Contig_ID=SeqID_3038; Location=5266..6701; Strand=-
  SCN-specific regions: Sequence locations=1-163,208-328,366-684,708 -861,895-1414
atgtttttttttcatcatttttttgcctctgccgactgtcctcacgtaattgaagtgaccgatgttgaagcagaagcgttcaaagtgatgttgagcttcatttacgcggaagatttaagcgaattgaacggacaaaatgccatggcagtgctttacgccggtgaaaaatttaaaaaataaataaataattatatttaaacatttttagccaataaatataacgtttctctgctggtcaaagccttgttggcttttccaattaatgaattgtcaaatgttttccttgcctttgacgaagctcgtcttctcaacgaaaatgtacaaatcgaaatttatacaaaatatttttaattgttttattttaaggatttctctcgtcgctgcttggattacattgaccaaaatgccaaaactttatttgaatcagaagaatttttgcaaattgatcaaaatttgttgtgcgaaattatcgaacgtgaccaattgaaaatcgccgacgaactcatcatttggaatgctgtactaattaattaattattcgattaaaaataactaatttcatttgttttttcaggccattcgttgggccgacgatcgctgtgctcaaatgctcattgaatgttccgctgaaaatcgtcgtgccgtgcttggtccggcactgtccagaattcgtttcccactgatcacaaaaagggaattttcgctaaatattggtagttttttgtattaattaatgcggaatctccggtcaattattgattgggattaggaccccgaccgatgctgactgaacccgaagtctcggtttttattccgattttttaaaagaccccatttgcaggccggcactactctcactccaattaaaaaaatatatataataataatattttactagaaaattatttggtaccggccaaccaccttaacaccccttctccacccaccttcaagttttttaaattttataacgtggccattactaatttgccaattttgggtctttaaaagaatttatgtgcgaatttctaaaggttgaagatccagcaggttttgccaaaatatttgttatttaaattctagtaaattcaccaaaaatatatatgtttttttaaatttcatttttcttacagtatcctcctgccttttgacagtggaagaagtgatcggcgtcttccaataccattgccacccgaatctccgcggtgcgcccggacaatacccaatggcatttccgtgccatggacgcttttccgatcagaaagaagggacactttcgatggaaattgagaaattgtcggaatttgcgcgagagagagtgaacagcagccgttacagcaaatgcatttacataaaaggattgccgtggaaaatttgggcacaaataaatacgaagaaagacagcacggagaaattcataatttaattaaaataaa

SEQ ID NO: 82892 - DNA, 696 bp, Heterodera glycines
  Genomic contig location: Contig_ID=SeqID_3038; Location=7826..8521; Strand=-
  SCN-specific regions: Sequence locations=1-168,190-203,230-238,331-696
atgtacaaaaattggtcaaaatatgtacataaatatgtaaaaaaaatccctaaatatgtaagaaatatgtataaaaacccaaaatatgtacgaaaatatgtaaataaaatttgtttaaatggttattttttgggaaaaaaccttcgtaaagtgttaaataggcgtaaaatggcataaaaatgacctaaatatgtttaatcaccttgtaacatttaaaaaattatttttggaggggtacatttaaaaaaagtttttttttaaattttttcactagaaatttctaaaaattttcaaaaattctcaaaatatgtataaaaaaataaaaaatttgccaaaattttggattttttacggcattttgtacttcaaaaaattaaatttaggtccatatccatccatatctcgatggcaatggcagagtggcaagactggtcgaaaattgggtcttgatccagcgtgttttgccaatgtttatccccgcagaggaagcgcgcgacgaatacaatgccaacattgccttggccgtccgtggaagaaatgaagggcatgcgactggccttgatctggagctgaatagaaatggcgacacagattggcttaagccattcattaatatgttttatgtctttttgcagaatgccacggaaaatggtgccgaaaaggctgcagataatgagtaattttttccagaataaa

SEQ ID NO: 82893 - DNA, 573 bp, Heterodera glycines
  Genomic contig location: Contig_ID=SeqID_18301; Location=267..839; Strand=-
  SCN-specific regions: Sequence locations=1-19,158-251,323-323,372-445
atgaatataatttctgatagaactcgttcggctgtcgccaccgcaacgcccggtggaacgcgaggcaaacgcaaagttatgcgctttgacaattccgaggatgacccaatcgtgcagttttgggatgtgcaggacaggcggtataagctgatcaaggtgggattcattgccacggttgataagaaaatgaaatggttaagtctcggtattaattttcatggatttttttattcaaaaatgtcccctttgtcaggcactgtacaatttaatctcgatgagtgttaccgcggaggacaacgatgcggccgttggcgacgaaccctctcggactcagtcgtccgccctccggtacctttggacaaatcggcaaagtgaggacaacctaaaaatgtgtgtctgttattctttggcgaatcagtttttacatatttcttaacatttttagttgcattctctcaattgtgtgtaaatttctggaaaacccggaagtgtgtaaagctggcggtcgtaccaacatgttcaacgtgttcacgctgctccgtctcatttgcatctgttgggacatgaacaaag

SEQ ID NO: 82894 - DNA, 1658 bp, Heterodera glycines
  misc_feature (1568)..(1568): n is a, c, g, or t
  Genomic contig location: Contig_ID=SeqID_18302; Location=14..1671; Strand=-
  SCN-specific regions: Sequence locations=1-278,300-348,370-1064,1098 -1123,1151-1303,1325-1438,1460-1658
aagcgctgaagcatgccgtcgacatcaccaatcgcccaccgaacaatggaagcaatcggaaatgggcctggccgttgacgccattacttactctgggcttgctggtgatggtcccctggtggctgcggtcatggtttgttttctgctgcctctctattataatcaccttctcgcagagaatctcatgttccatagtttgtaatagacagtgtttcgagattttcttccccttgcgtgaaaaaagtggaccttggataattctgctttctctcttcaaaatttttatacaacaatatgaaatgcttctctgcttttaagccaaaggattaaatcaattccgctaaaaaagttttcttcccctagtttctggagcgttgcccggcgctcaactgcggtctcggctcaaatctgaccgttgccggctcggtggagtgtgaggcggcctacatgtgttcccggcagatggcctacggcgctgtcgctattgtcggtttgccgatttaaacaattccgatgaatcatcttgtccatccttctcgcgagtgcaggtcaccaactgtgtgaatccaatttgtgcatccaaagcgttggccgaaccgtacgccagcagcaacagttgctttgattcgtctgctgctgcggttggattggtccaaccgatggttttggctgggcccggggccgacaaactgtgcgcttcgctcggcattggaacagtgccatcgaatgatcagttgaggacacgcagtgccgtcaaagagcatcgtagagccaaacaaatgatggcattggctgcgcctgacaatggggacaagtcggcagcaccggcaatggctttgggcacggacaatgccatccgacgaatggacactgtcgggggagtggcaattcatgtgagaaatgctgttgataatagtaaattgcctgattgattgacttaattagcccgatggaatgtgtgaggcgtgcgttagcagtggcggcattcttttgaagcgggaagggcgcatggggcattcaggtcaaattgtattaacatgaaaatttatcttttgttgttgccgttccactttttatttccattttcagcccaattcggtgccgcaatttgggctgaacaatgcgctgcttcttcttcttctgctgctgccaactctgactttggcctttcggtagccgtttcagtgtccggctgtggcgaggcgttaacgcgcacacatttcgctgaagcgttggcccagcaaattctgtcaatgtatgaggggaattgaaaatgtcaaattgcatttgacagtcaattgccttgccattttgtacttttttcaaattcacacttgatttgtttgagttttggcccgggcatttgaaaattccatgcaaaccgtacactttctaatcacattggttgaatgtcttttcctttagtctgtcattttcctttcatttttgcccccttttcagggatgtcgacgacttggcctttgtgcagtgcatcacccactttttagaccaccattttatccgttcgcgtcgcctttgctcttttccgtccgatcgtttgctgttgngcggactcgcagtcattcagcaacaaatccaaaaatgccctggcgacgaaagcgatggcaatgaaagtgccaaactttgtcatcgaaatc

SEQ ID NO: 82895 - DNA, 1182 bp, Heterodera glycines
  Genomic contig location: Contig_ID=SeqID_18303; Location=270..1451; Strand=-
  SCN-specific regions: Sequence locations=1-589,625-958,987-1182
atgtgtcggtgaaaatgggcgatacgagcgtttcgcaacgtgttgcggtggtctctgatagtttttttcttgacgatggcgcgcaagtgctcgggtggtgcgtgttcatatttcgtttcgaaaaatacgtgaaaagtcgtggagcaaaaaattttatggcttccgttttttgctaatttctaaatcccctaacccgaattggagtcgaattttttaaacaattgccgaacttttaatggattttgagggcccgaataatttggattttgcaggatcgacaatgttcgagtgcacatggaagaaatcaatctgaccttctcccatcgttttgcggtgatgcccgacaagtctctctccatgtaagtttggcgttttgtcagttttcaacggattcaaaattgtgtttcacggatttgaaatcattatttaaggtactgcttgaagaagttcgacatgctgtaagttgaatagttgaacgaaaaagtggttttttgatatgtagtcagagcacttacgaattagggggatactaatgacccaaccgaactcgaactaattacttttttcccctttcctaaagcctcggcttggatctgctgggtggtgttggctttatccttagcttgcccgaaggtttgggcattcgcgcggacatatgcaaagcaaagtgggcttaaaccgtctgcaaattttggagcctatgcgctttttaaaatttttcatttgcagggtcagcaaaactgctcgaaagccgtccatttcgttttcgcaaaaaaagtgagttgagagtggcattttgtttcaaatttcattgcttgcgcgttttttcatttgaagactcgacgtctttatgagtgatgctggtgttagcggctcggggattaagccccaaatgatgtaagttcaaataattccggataaaattgtcgagtgcattccattcggatgatatttggtcaccttcaaaaacccccaaaaataattcattgaattcaaaattctgcaaagaaactcattctttcgccgcggcagagttcttatttttagaaacaatagatcagaaaaaactaaaaagttatttaacgaagtatcagaaaaaaaaaaaaattttttcaagttttactttaaaaaagagtaaatgatttttaaaacttttatttcgtttttattagaattaataaa

SEQ ID NO: 82896 - DNA, 301 bp, Heterodera glycines
  Genomic contig location: Contig_ID=SeqID_18304; Location=229..529; Strand=+
  SCN-specific regions: Sequence locations=1-179,245-301
gcaatctttttggagatattatccccagctacatttcaagcaaatttgctgaatccgtatatgctcgatttgcttattttgtcgccacaagcacttgttgctgatctgctatcaccacaattgattcaaccaaagattttaagtcctcaatcattctcagccggcgtgcttagtcctcgtaattattaaattaaaattttaattacaataattaaacatttataaaaaaaaacaaaatttttaagggcatcataaaattcaagaaaaacaatgcaaaagtgataccaaacattttaaatta

SEQ ID NO: 82897 - DNA, 850 bp, Heterodera glycines
  Genomic contig location: Contig_ID=SeqID_18305; Location=131..980; Strand=+
  SCN-specific regions: Sequence locations=1-45,67-194,217-273,295 -428,461-472,499-568,590-690,725-850
attttgtcacccgaaattggcggtggccacgatgaaagtgaatttgagacagagggtgaaaatgtgtttatttggcccaaaactgacgagcccgacgaggaggcttatctgggcgaaaattcggcacatccggacaccagtgcgcacattcacccgaacatccttcatcccgatgggtcatgaaaagtgcctaaaactatttgaaatttttaatttatgtgccattgtggtaattgagctttttccaagtgttgtaagctattaatttacattttataattgttaaaatgataaaaatcgtgctgagacgaagtacgaaaagtgcaaggttgggcgaagcacgaaaaagtgcaaagtgtgctaagtacgaaaagtgcaaggttggacgatgcacgaaaaagttcaaatgatcaaattaaaagcaaaataattctgttagttatatttgtataacatatttaaatttcgctacataattaaatatatttttatattaatggtgagccgaagcggggcatcgttttcgtacgggccgttttcgtacgagcacaagtttttggctataacttttttatttgtttaccaaatccaacattgttggtgtcattcgatagccctatgtatcctctattttttgaaggtttgtctaatttagaggtggctaaaaaacgcttagactttaaactttattttattgttgaaattttcaaaatttaatttccaatcgataaatagataattcaaaaatgaaccagtcaacaatgggtaatactataaattatgaacattgtaaattttctatctaaatttttgcgaaatttcaatattttttatgaaaatttatttgaaa

SEQ ID NO: 82898 - DNA, 2057 bp, Heterodera glycines
  misc_feature (2047)..(2047): n is a, c, g, or t
  Genomic contig location: Contig_ID=SeqID_18306; Location=19..2075; Strand=-
  SCN-specific regions: Sequence locations=1-51,73-151,179-196,229 -322,353-665,702-815,868-875,897-982,1010-1057,1079-1169,1192 -1203,1227-1340,1373-1422,1444-1576,1642-1705,1746-1980,2004-2057
atgcgtttcatttataatcaaattggcggctctcagcatattttgctggacagattctacaaaaaatattttaccgctgaaaatgaaagcgaacgaaaaaaagcggcacaaaaaattgaaatttacattcatatttattttttatcgtacaaaattgagcaaaacaaagaaaaattggcgaatattttggtggcttatttggaagaggaggaggaggaaaagcagaacaaaaaagggacaaaagcgatgaaaaagggaccaaaaccgacaatcacagcaaaagcattctatcaaaggcgaatgttacggtaataattgctaataattattaattaattaattaaccaattaaatagtctgatgttcaacaaccgtctgcaattggattttaatgttatggaattatttgacacgcattttcaaaagcccaaattgttctgcgaattgttaaggcttaaagccgaacttttgacaacaataaatgccaatggcactcaaagggttacaatggcacgccaaaaagagtggccgaattgcaaaaatgacgaggaaattaaggtaggaagcaattcagtgtttccatgccgggctgccgagccctaagggttcagcccgctccgactcttgtgacaaaggcagacacaaatatttgtgccatttttgagaaattaattatttttatttgtatttaaaaaaaaattcaggagaccattgtcgcaaatgaagagaacattaaggaatggatcttcagtgacatttttcactttttaccaacgcggaaaaaacttttgcaatactttgagtagggaattatgaaaaattatattattaaatattagttaacaaataataaaaaaataaataaatctttagtgaaattaaattgaaaaaaggggatttgagaagtgcgagaatcggatttattaacttaattggattttcgaggatgtcaattctttgcaaaaaatactccgaccaattgtcatttttgggtttgttttttaggaataaaattcgttaatcttttcaattcagtccctctattttataacggtttttaccttaaattatatgaaaattatttaattgagaccaattggcgaaataaaattactttggccaaattcctttatgacgaatgggccacaaaaacattcagcacagaaaggaaaagaacaagcaaacaaaaaggtaccaattgtgtttttaatttaaattatttaaatgattcagcgaattttgtggccatacaattcgaagcgatgtttttaagtgaactgaaatacctttggcaattatacacacaaaacttttggtcaaacgaaaaaataattcgtataaaaaatgagagttttttaaaagaaacaatgaaaggaaaagcattgaaaaatgcaagtgaatcactttcggcacatcaaaagcaattggaggaattggcacagtctatcaatgaaatggtctttattttatttccagattttttttgtttgaaaaaatattaatggaaaatatacactggggtgttcgggagtctcaaaaacagtggaaccctggctaaaaaagctccggaatttggaattaaaataataaatcaaattgaaatatttcatttcataattattaaataataaaaattaatatcactttggtcaaaaaaaatgaattcgaattcatctcacagtaatagaattacagaataagcaccaatttttataaaataaaaataaaaaataataataaatattgtttttaggaccaatttctttggtgggacaatggtccgaccgacactttccttttgcgtgccctcgcaatttgtgccaatggagcgatcgacgaatttggaaaaaaatttccaaattcgtcggccaaaaatggagaattggaagaattcactagggaatgtcaatgcaattttttgatttgtgtgggcaaaacattgcgaaaaaatacacgaagggacgaatttttgtcggaattgcattttcagaaaatggacaatttgctcaatgatgggagagaaagtgaaacattcagaggggatgtnatcgatcaca

SEQ ID NO: 82899 - DNA, 79 bp, Heterodera glycines
  Genomic contig location: Contig_ID=SeqID_18307; Location=56..134; Strand=-
  SCN-specific regions: Sequence locations=1-79
atgttgaaattgtcgcttttgattatttttgtgttacttcttcactttgccctttccaatgacgaggaaataaatgaat

SEQ ID NO: 82900 - DNA, 1062 bp, Heterodera glycines
  Genomic contig location: Contig_ID=SeqID_18308; Location=1528..2589; Strand=+
  SCN-specific regions: Sequence locations=1-811,837-982,1052-1062
atggtcatcacacgcagtccaattttgacacggcaacgagcgttgaatttggagattgccgttgacagaagtggacatcagattaatgtcggtggaaatcagcagaactcgctgcaacgccaaaatcacagtgctggagaaagttttccccaaaatcagcaaattgaaaactcgccaatctcacccactgaactcgcgggctttaatggggaaaatggtgatgacagttctcttgttttagaaccaaatatgaccgaagaggaattgcgcaggcgcttgttggtggtcagcattgaacgtagccagccgccatccaacggaaatgccggaaatggagaaaacgccgaaggtttgcgaaacgcaatcagggaaaatgatggacgaccgaattttggagtaaatggtcaaacatttgcccaccaaaggaggccgcatgacactttcttatcaaatttgatgaataatggaataggaaactttcctcaaaatttggtccatgtaccgcgtacttcaaccccaactcgaaatgttgaatttgaacagcaaataggaccattcccgtttgttgttgaccgcaacaacagagcaccaaccccacctttaaacatacggcaacaaattttccaccccatcccactgaatgcacaccgcattaaccaagtgtcggttaacgcgcaacgcaacattgacgttcagtacgtaccaaataattgcgttaatgtcccgccaaacgtacagcgtcattgcgacattcagtacaccgctcctaaccttgtcgccgcgccaattcctgtttcatctatcatgaacgtatttttattaaattaaataaaaatgatatcaaaattcatttattcagctggctgttacaattagttgaataacaataactgctaaaattgtttgattttttttttgcaaaatttaagaatttttttaaaatagggttgggttttatttatgagattcgttattatacatctatttatatatatatggttttgtttaatttcattttatatgtgaatttataaaattaaaatattaaaaagtataccgaaa

SEQ ID NO: 82901 - DNA, 934 bp, Heterodera glycines
  misc_feature (883)..(883): n is a, c, g, or t
  misc_feature (928)..(928): n is a, c, g, or t
  misc_feature (931)..(931): n is a, c, g, or t
  Genomic contig location: Contig_ID=SeqID_18309; Location=1540..2473; Strand=+
  SCN-specific regions: Sequence locations=1-393,418-583,605-934
atgtcttcagctcgatgccggatggctttggggcccgcgctgttccgacttcggcaacatgtcactacggccgaaaatttgctggacgagcccgtgatcaatgccgagacgaccgaaaaccttgaacaggaacgggggcacatcacccgtatcctgtcaaggatggaggtcgagctggacgcgtggggtgccatcatgaacggactgcaaggcccagcgagagaggcggaggaagcgcttttcactgcctttattcgagatgaccggcacttgacggagtggttggaagatgcgcgagaaatgctggctcacatagcagcagaactcgcagatgagcacaaccagccaatcgcggcgggaggacagcaaccagctgttgctgtgaatccacccgtgccagccgtgccattcgtcaacaatgccgtatttccaggcggtgccaatgctcaacagccagctgctgttgccaatgttgcaaatcaaccaccaccgatgccaatcaatgccggtggtgtccattatcaacagccatttgctgttgccaaccctgccaatctggcactaccagtgccaatcaatgccgcacctgtgccattagctactgcacgccttccacagctcagtcttcccattttttcgggcgaaccaatggaatggccagcattttggcagagtttcgagagtgccgtcgaccgtgccgcccttgagcccgtcgacaaactcaactatcttcacggttgcctacgcggtaaggctgctcgtgccgtaaccgcctaccgtggaggggacaattatgcccatgccgttgccgcactcaggcgactcttcggagatccacggaaaattgccgaagcacttcagtccgaactgatcaatctccggnctgtggacgatagcgttggatcactgcaacacttcctcgagactntgnagc

SEQ ID NO: 82902 - DNA, 154 bp, Heterodera glycines
  Genomic contig location: Contig_ID=SeqID_18310; Location=1425..1578; Strand=-
  SCN-specific regions: Sequence locations=1-106,130-154
ttcgacctgctgttttctcgcaattcattgagcagtggctcaatgtctccgcttgccaaattcgccccattgaaagcatagcaatgcaaagccaacgtaaaaagaagtggaaaagcaagaaaaagaagcattttggtaaaaattataaatgatt

SEQ ID NO: 82903 - DNA, 1340 bp, Heterodera glycines
  Genomic contig location: Contig_ID=SeqID_18311; Location=909..2248; Strand=-
  SCN-specific regions: Sequence locations=1-311,350-366,388-491,514 -1340
aatttcgtacggtccgtcgcgggggcggcacacgtcgacaatcggcagaatatgaggacggaaaggagacgaagcaaaaggaagaaggggacgaacaccgacaccaaagttcattttcatccgccaatttcggccgctcttccgactccgagcaaatcctacgcgaattcaacaaagaattcagcggatttatgcgccaattcgttatgtcccgtgacaaaaagccgggcgaattcgacgagcgaatgaaagcattcatccgcgacttcaacaagaaaatgccgcccgaattcgaagttgaaaggagtgcgttttaattaatttttttcgattttttaaatttaattatccgcttggctgcggtttattttttaatgatattcaaagaaaaatcatcataaacagaaagtgaacaaaacacgagtttctccgaaaaacaaaggaaatgcaaaaattttcggcacgatcggaaaaaatggtaaaattgccaaaaaacgttttaccgtggaaaaaatgcgctgatcacgagctctgatttttcaagaaccttcattttgcaaaaatattccggcccccttcataattttctctttcattttcactttttttcagctgcggaatccgttcgctttatgcccaacatatttttgggtggcatcggattggcctttctcggtgcgttcattgcctaccgtttgctctctcgaaatgccattttgcccgaacaccgcgccattgtcgctcagcaacattcggccgtttcttacgatgaatttgtgcagcatttcttggcggctggggaggtcaaaaagaatggggcggctcaatttgggccgaattttcaaataataatgtgattttgactttaggttcgcatgatttacttctacccgagtaagtccgtcgccgtggccgttctccaccccggcgctgtcatccggggacaaccggtcggttggcaaatgaccacttaaataccacattttcatttttgttcgttttcagtaccatgggtccgctgttctcatccgtttggactcttacgccgcttcgggctcccattttctgcagggcgttgaggacgcgcagaaccgacttggcattgaccctcgtgaacacgtgcccgtggccattcatttcccctcagttttgccgtaagaaatcaactgactaattccgaatttatttgtccaaattgtttcagtgcgttcatgctcatcctcggctggtccattctgttcgcaatgttcttcaaatacgcacggacatcgctacgccaatcgctgttcaaagtgaagagaaaggacggcggaagcaaagaaggaaaagcgggggaatga

SEQ ID NO: 82904 - DNA, 773 bp, Heterodera glycines
  Genomic contig location: Contig_ID=SeqID_18312; Location=1534..2306; Strand=+
  SCN-specific regions: Sequence locations=1-24,47-773
atggattgtggtgtagtggttagtgcatcaacacttacattcctttctgtcattagttcgataccgtttgacgtttgctttttaattaatttttttttgaatagctaataggattttttaaacaaaaatgcccataaaaacgatcatccttggaataatttgttgacaaattgaatttcaaaaaattttcttttcgttttcctcgacgaaattatgaaatgtttagacaggccaccttttttgcgggcgtcgcgctttcacctaaaaatatcgaagaaatttttttatcggaattcataaatattgaaaaaaatactccaaattttcaaaaaaattttcccggcggtgcctatcggcacccaccgccggaccccgtattcctaaaaaactcgagaccgagaccaaaaaaacccgagacttttctcgagtcgagactcgagaccaagactctcgagcatcactactacttaccctgaaatattcgtttgaacgccccaaagtcacttgggtaacctatcctttgttaggaacaccttttcggtgactttgaaaattaaaatttttcagaaaccatctgcagaattacccaaaaaaaaatttcatttcaattgcggtgagtgccaattcaaataaataatggccaattaaataaaagaatcataattaagcaattgatggacccgagcaaaaaagctttctacaacaaaaatgaggacaaagtgacgttggccatcgatttcactgtaaatgaagtaaaaacggacccaatatga

SEQ ID NO: 82905 - DNA, 958 bp, Heterodera glycines
  Genomic contig location: Contig_ID=SeqID_3039; Location=123..1080; Strand=-
  SCN-specific regions: Sequence locations=1-811,835-918,940-958
  Gene Ontology: Mol. function=translation initiation factor activity; Biological process=gametogenesis
atggcctacaccatctcaaaacacatgctgaagttgaatggcacgtactggatgcagcagccgcgggtcaccaccgtacaaatggcagcgccgatggtcagcgctatcaaagaggctttgcttactttcaatgtccaaaatggtttcttcccggaacacatcttcgtgttcagggccggtgcctcggaaggcgaatacaaaaaggtgggcaagacgagaacgtaaagagttgcaaaacggaagaccaattgaaggttgcgtattgggagggcggggcgtttaccactgcctttgacgaactgatcaatgaacgcaaaatgccaaaaaaacccgcgttgacgcttatcgtgtgtcaacgcaactccaactaccgcatcattcctaagaatgtacagccgggcggtcgcgcgcccgaccaaaactgtcagccgggcactgtgctggacaaaagggtcggaatcgctcagaactgattgatggataattgctgttctttcaggccatgcactcttcgttgactgaattccttttggtcggccatcggaccatccaagtccgttgttactgcaattgacaccccttggactgacacttccatttcttccacaggggactgcccagccgttgcgctgcaccgttgtggtggacaccgccgaacctcgagtcaagctcagcgagctggaacagatcagctacgcgctgtgctaccagcacgggatctgctgcagtccgactgctgtgccgggcgttctctactcggccggggacttggcgacgcgtgggcgcaacaattggcgcacgtccacgtgagcccctccccccccccccccccccggaaaactttcctaacattgccctccctttcacagcgctgacggtgacaccatccaggaattcgacttgccgccccagggccagcctgaggaagtccgggcccaagcgcaggctcagttggacg

SEQ ID NO: 82906 - DNA, 1094 bp, Heterodera glycines
  Genomic contig location: Contig_ID=SeqID_3039; Location=3015..4108; Strand=-
  SCN-specific regions: Sequence locations=1-633,658-1094
atggcagcccaagaagaaaatgaaattcaattgccacgtaagttcaaggaaatatcctttagtttgaataacacagtttatgtttagagaaaatcagcaacgaccatgaagttcgtggcatcgcaccggttggagtgctcatcaacgcatttgaactgaatctgaggggatcgcctgacaaagtgtatcagcatgagcttcgtttcacggcagaatacccaaagtcgagcaaaaagggcaaagaaggaccagcggaaccgcgcgaattggcacgagggccacgcaatgagtgagtcattggaagccatggctttttgagtagcagcagttgggaaagtcggggtgagtgggttgtgattttggttggtcctgtcctaccaaacagcgtttgctttgtgtttttctactcgacgattcgtttcagtgagagcaaagagacgcgtcgcgagttgcattggtcgctttggcggattctgctcgatcagaacgccgatttctttggaagcgaaaagaacaaattcagctacgactgcgctttgctcctttattccgtgcgtcgtctgatgaaaaacggagagacgcgcgaatttgtgatcgctgccgaaagtttggtgggtaatcttcacaaataggcatttcaaaattttttggttctctttccctacgctttccgtcgcttagtttggcctttaaattccgtaggattcgttgaccgaccgtagccgtgcgtatctgcgcagatgcgaacgcgtgaaggcctttctgacggccaccgaggaagtggaggttcgcaatgtgcgcgtgactgagccgggcggcgaccgatcggtgtgccaatttttggagttgctgagcacgcagcgaatgcacgaaaggcgagtgaatgccctcgctagcatttccttctttccgttttcagaaatgagcatttcgtcttcgggaacagaatgttcgagaagaacagcgtcctccaactgcagggcgacccgcgcatttgcaaggagggcatgcagaagaatgtgcgcttcgtcggcgacaatccccagcaaagcatggccatcattcagttggatggtccgttatgccgccattag

SEQ ID NO: 82907 - DNA, 249 bp, Heterodera glycines
  Genomic contig location: Contig_ID=SeqID_3040; Location=1..249; Strand=+
  SCN-specific regions: Sequence locations=1-103,127-249
acggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattacccgttgcctaaccttaggcccatccgaataataaaaaactcaaattcgagacttggacatttcgtggcctggacattttgtgggtcagcg

SEQ ID NO: 82908 - DNA, 1034 bp, Heterodera glycines
  Genomic contig location: Contig_ID=SeqID_18314; Location=437..1470; Strand=+
  SCN-specific regions: Sequence locations=1-4,26-30,75-932,954-959,995- 1034
atgcttacaaaaattgactttttctctcactttaaaaataatttttacggaatttttaataatttaaaaaataaggaccaaatacctaataaaacaactaaatttattgatattcaacaaaatttagcacttgttttcaattatgtgccaactgatgaaggcgtgtccagcggtaatgagcaactattcttgccacttcatcaacaggtagcaaattgagacatttctttttgtctctattcaatttttactgatcactgatcactagtgatcagaaaaatctcggaattttttttttgcaaatatccatttaaaaaattgttaaaaatcccaattctggcataatgtttttaaatcaaccgaaatgttcctctctcactaattgtactgatttctactgctgttcgagaatctcgatttaaaattctaaatttatcaggtttttgggtcgctcagggtaactcctccgtcttgagtctttctggttcaattctcgacggagcctaggaaaatttgggttctagaacagcccactaattaaccttattagttaactaccacccttttcacgcgtattatcaacgcagattgattatgtgccacttttgcgactcgctgccgatgctcgacttcggcagcaacaaaacggcaccactctttggtggaccgacagatgtggcggtggtgccgatttggtcattgatccgacactttgggagaataattcgacgaattggggacgtatttttctgatggacagaagcaacaacgaaggacttttcaatgaacaaattttttcgttgtttggaaacagtgagtaaatgattgactgaatgactctgacagactaataatggcataattaacattttaatcggctaaaattgtcattttcattgagaataatttccattaatccggtcaaatagcactaattaattaattaattaattctggccaataattaaattttagacaataaaattatttatttgtcgcagactccgtgtgggccgcacgcttgtctctgctga

SEQ ID NO: 82909 - DNA, 619 bp, Heterodera glycines
  Genomic contig location: Contig_ID=SeqID_18315; Location=1880..2498; Strand=-
  SCN-specific regions: Sequence locations=1-619
atgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcctaatatacgacaactcacatgtcgtgccgtataatccttatattctgctacgttaccgagtacaccataatgtactgtttgcatatggtaacaaagcaaatattaaatacgcactcaagtacccttttaaagggccaggacattgttatgtcgagtgcaaagaagagtccg

SEQ ID NO: 82910 - DNA, 93 bp, Heterodera glycines; identical to SEQ ID NO: 53399
  Genomic contig location: Contig_ID=SeqID_18315; Location=1141..1233; Strand=-
  SCN-specific regions: Sequence locations=1-93

SEQ ID NO: 82911 - DNA, 1294 bp, Heterodera glycines
  Genomic contig location: Contig_ID=SeqID_18316; Location=215..1508; Strand=-
  SCN-specific regions: Sequence locations=1-216,239-300,323-384,408 -1115,1141-1294
atgggcatccaattcactgatcatgcgaaaagtcttcttgcggtcacagacttctcgcggcaattcgttgatcaaatactgggccaacttcttcaggtccctgtccttcagtgcggtgatcgagtcccaaatggccacgcggtactgaacggagtcgggccggtgaatgcgttggaggcacgcggcgacgacatgttgacaccaataggaagagttggagcaggaacaggaacaggagacgacccgacacctgcaaagaaaaacacgatgaaaaagcacaacggacaatagggattcaccagtcaacagctaaacaaaattctaacaataagccgctttacctgtccactcgaatgctcacatcgaaaagtgccgtccttcgtcgccccgccgccgctgctccgccggtgctcccacaaacatcgccaaaccgttggtggtcattgacgacggccgacaagtgatagccttcaattgttggcattttcttttgcaaaatttggtctaaaaacgaaccgatttggaagagttcggaaacagcgccattttggaaaagctgaaaatgcatttaattaattagacaataccccgattttctcatttttttcacctgttctccgatcacaaatggcccttcactgcaatttgttagacagcttaaaagggagaaaatggtgaaattcgttggaattcgcctccatttgcctgtaaagcctaatgttgtctgccgagttgggaaagcattggcgaaggatgggcagcaccaaatgctcaggcaaatgctcgccccgatgtgcccgctgttcgctgggcaaccccgcgtaggtggcctcgatcagctcaaaggaaagtgccgaggcgacccttcgcgcggccaattcgaccaaaggcggaatcaccggcggtgcggctgaagcaaaacgaggattttttttcttaatttgcttctcacctgttgtgtttgaacgcttgatcaactcgcgcaaaagcgtatgatcaccatcgggcaagaaatctgaacgccgtaaaaagtccatccgcaaataacagccaagaaagtgtacaatacaataagaattaattccaaaaaatgccatttccatgccttcgtttcaaaatgccacccgcccgccccccaccgttcctcgccccccaccacaccgtgcattccgatggcggctctttcgtccgtaagtgtccaaccccgccagcaattgtggtcaagtgagctcgcactaagctgcatgtttctggctacagatatgttgcaacttacgtcgtacgtctaaataaa

SEQ ID NO: 82912 - DNA, 1370 bp, Heterodera glycines
  Genomic contig location: Contig_ID=SeqID_18316; Location=548..1917; Strand=+
  SCN-specific regions: Sequence locations=1-554,578-639,662-723,746 -1370
  Gene Ontology: Biological process=regulation of protein activity, epigenetic
acacaacaggtgagaagcaaattaagaaaaaaaatcctcgttttgcttcagccgcaccgccggtgattccgcctttggtcgaattggccgcgcgaagggtcgcctcggcactttcctttgagctgatcgaggccacctacgcggggttgcccagcgaacagcgggcacatcggggcgagcatttgcctgagcatttggtgctgcccatccttcgccaatgctttcccaactcggcagacaacattaggctttacaggcaaatggaggcgaattccaacgaatttcaccattttctcccttttaagctgtctaacaaattgcagtgaagggccatttgtgatcggagaacaggtgaaaaaaatgagaaaatcggggtattgtctaattaattaaatgcattttcagcttttccaaaatggcgctgtttccgaactcttccaaatcggttcgtttttagaccaaattttgcaaaagaaaatgccaacaattgaaggctatcacttgtcggccgtcgtcaatgaccaccaacggtttggcgatgtttgtgggagcaccggcggagcagcggcggcggggcgacgaaggacggcacttttcgatgtgagcattcgagtggacaggtaaagcggcttattgttagaattttgtttagctgttgactggtgaatccctattgtccgttgtgctttttcatcgtgtttttctttgcaggtgtcgggtcgtctcctgttcctgttcctgctccaactcttcctattggtgtcaacatgtcgtcgccgcgtgcctccaacgcattcaccggcccgactccgttcagtaccgcgtggccatttgggactcgatcaccgcactgaaggacagggacctgaagaagttggcccagtatttgatcaacgaattgccgcgagaagtctgtgaccgcaagaagacttttcgcatgatcagtgaattggatgcccattttcagtacattccggtcgcgcagaaactgatcgacgctttgcgagaccccacttcagcgatcaattgcacacatggagcaccaggtgatcaaagggaggggggagcagcttattttgattatacaaataaaaattcaattccactgggaaacacccggttaaaaaccgataaattttataaaaaagccattcgtttttgaattttcgaattaagattcaaaaagtttgtctaaaaatgttcggtatcgccccttacaattagccccatccgccggtctttcgcatgcgcagcccgccgtttggtacatggacgagaccgcgttgcgcgacgaagtgcacaaaattctgctggactttctgcgcaagtcgtgctcactgagcgtggtctgcgagttccaatcgctgctc

SEQ ID NO: 82913 - DNA, 296 bp, Heterodera glycines
  Genomic contig location: Contig_ID=SeqID_18317; Location=1339..1634; Strand=+
  SCN-specific regions: Sequence locations=1-190,246-296
atgcgacagagcgtgaccaaaaccacaacaaaacggcaggcgggagaaggagcttatgcgggcgaaaaagtggtcggttatgtgcagcagcaaagagtttactgcaaaagcaaagggcgaaaaaaggggggaaaagtccgtcccaaaaagggaaggacggtgcggctcccggtaaattggacactattggataaaaaataaataagttaaaaataaataaacaaaaattttaattgaataaataatgttattattatttgtagcatcagctgcagaaagtcatcatacattcataa

SEQ ID NO: 82914 - DNA, 137 bp, Heterodera glycines
  Genomic contig location: Contig_ID=SeqID_18317; Location=2142..2278; Strand=-
  SCN-specific regions: Sequence locations=1-137
aaaattccctcaaaaataaaaggtcgattgcgcaccgccctccctatcatgctcgagagcatttgtatgtgtataaaatttatcaaaaaaagagatagccatttttctgggatagagtataaatttaaaaattccct

SEQ ID NO: 82915 - DNA, 950 bp, Heterodera glycines
  Genomic contig location: Contig_ID=SeqID_18318; Location=799..1748; Strand=-
  SCN-specific regions: Sequence locations=1-16,38-54,76-397,419 -485,507-546,578-683,705-950
atgaatttggaaaaattagaaaaagctaattccattttgttggaagctgctaaaagagagacagagagagcatggcgagatgtcgttgtgctatcggatgatgtaagcgattttgccaagtcttctcgagaaactcttaatcgtgcaataaaatcaagagaaaaagctccttacgctaatggtgttcgggaattgtaccttaaaatgtccgattcaatttgggaaatttttaaaatcctggaccaaatcaatttggagtcagaaaaagctgaatctgcgtggcgtgagttcgaaagatgcaaaacttttgaccaggcaacaaagcttgaggaacaatctcaaaattctttaacagaagcccgaagattacatttcgagtcccgaagggtgcaaagccaaatgttaaattatgaaaataggctccaaacaattgtttgggagcatatgggtatataagaacataaaaactaaaagggcaacactcaaaatggaagggtgttctttaattgagtcatttcgtcatgaagacttaaaatttggttttacaaaatataaaactaaattttattttaaaaatcctttcataattaatgctgaggaaaattttaaagatatcctcacatcgttaattgaagaaaattataaaaatgagcaagggaaattcagaagcattttgaagctttcttttggttttgaatcattttattgccctcttcgataccctaacgaaaacacggccgaggctttgttccaacacgtcttattaaaagaagaacaatattcgcttttttatcctttggatggtgttataacgctagaagtaactataatcccagatgtctacagtaattcaagaaattgattttattaagaataatgtaacaaaaaattggaaaatagccgggaatatacttaaacgatcaaataatcttgaaatctttgcaaataaa

SEQ ID NO: 82916 - DNA, 283 bp, Heterodera glycines
  Genomic contig location: Contig_ID=SeqID_18318; Location=1466..1748; Strand=-
  SCN-specific regions: Sequence locations=1-16,38-54,76-283
atgaatttggaaaaattagaaaaagctaattccattttgttggaagctgctaaaagagagacagagagagcatggcgagatgtcgttgtgctatcggatgatgtaagcgattttgccaagtcttctcgagaaactcttaatcgtgcaataaaatcaagagaaaaagctccttacgctaatggtgttcgggaattgtaccttaaaatgtccgattcaatttgggaaatttttaaaatcctggaccaaatcaatttggagtcagaaaaagctgaatctgcgtggc

SEQ ID NO: 82917 - DNA, 1664 bp, Heterodera glycines
  Genomic contig location: Contig_ID=SeqID_18319; Location=455..2118; Strand=+
  SCN-specific regions: Sequence locations=22-118,146-406,446-608,657 -781,803-888,910-937,966-973,995-1294,1316-1467,1489-1664
atgggaaatcaatggaaaaaagtgaggtgacggagaattatttttgtgtattgtacccatggaaagtgagcacaaaagaagagaattatggtggtgtaaatttttccaattgtgaatgaaatttaaattaatttaaatttaaattcattccagctttgatcggttgttttaattgtttgatcgaatttcggccgatttattccgtgctgtgttttaattttaatgattagccatccctttaaaatgtccgccgatcaaaggaacaaaaattcaaaaaaaagagatttgcttcatttgcccattgacatctttcgcattttatttttccgattttacccccgccaaatttggccaaagaaagcgaacagcaaaaaaaggccaaaggattttgtgtttttatcgcccgttgaaatggcctaataaaaaatatttgtgagttttgcgattgtttcgcctttcctttgccttttgcgcttttcctccatcgctttttgcttctcccccaattttcactttttattcgtcatccttttttcttataaagaaaaaatttctattttttaatcaaaaagtgttattcaatcgaatttctttaacactttttgaccattaaaataatttatttattagatttatggtttttattttattttattccgatttatgtcaaaaaacgagaaaaacaacagaagaaagacaaagaaagaggacaaaagggtttgatcatttgataaacgaattattattacagtatctgaatttaattttttcaagaaaaccaagaattcaaacagtccatcaagtccgagcagtccaccgacttcgcctgcactttcactgcctttgcccgcccatccgttgcaaattgcgcacttttcgctaacgacggagacaaattggaaggaggagaaaaagcgaagaaaagcagcagaatcacttaaataaaaaaattattatttaatattggctaaatatatttcttctattttaaattcaaaaatcatcaaatatattgggcgagaatgagggtcccgttctctcgcttttgcttgaatgtacagttttgttcggaaacgaataatgcgggatttccgcaggggattcccttaccgcgatttcttaattccattttccgcttctgcatacgtttttaatttattccagcttcttttcttgaaaagtagtcaatgaatttgcgcaagaagactaaggtttaaggatgttctttttatttaaatagcttacaatttgttatccaatttttaggtcgaaccaatagaagatgagattcctgagaatgagcagcaaataaacatctctacccgttcacataactcttcttataacgcaagttacatctttttaactttacgatttaatatttacagtctgatcgtgtcaatgaaaatgatttggttaaatcgctgtctcaatgtcttctggcaaagtatgagttgcttaaacgcacttcatttaaaaaagaattcagcgtttctaaacgagggtttgttcgtgatgccgacattggagaaatgttctcagaccgaagagaacgcgagttgcgagcgaatgttctgaagaagagtgagaaattgctgatggatgttcttggataccgagtcagaggaggaatttctgaccgttttttattcttttttagttag

SEQ ID NO: 82918 - DNA, 475 bp, Heterodera glycines
  misc_feature (3)..(3): n is a, c, g, or t
  Genomic contig location: Contig_ID=SeqID_18320; Location=1450..1924; Strand=-
  SCN-specific regions: Sequence locations=1-315,337-385,408-438,467-475
atnaaatcaaaaactgatgaagaaaaattagaaattgtgcaaaaattcattgaaatgacagaagaatataagcaaaaaagaaaacattcacgaaaagaatggaaccaaaattatgcggaaatttgtaagaaaattggagttggttatgacacaattaggaaatggaagaaacaatttggaattagcaagaaaagactaatggaggaagaaaaaatggaaaaaatgaaaatttattgggaaattaaaaaagaaaatccaaaaatgaatgaaaaggaaattgcaaaaattgtgaaaatttcccaaacgaatattcataattggaagaaacaatttggggaagaaattttgaaggattgaaaaaacggaaaaatttatgaaaatttggataaatttatttaaaaaattatctgcgctctaaaaaatagatttgttatataaattttcaaaaagattgtatttgtatttgataaataaa

SEQ ID NO: 82919 - DNA, 1198 bp, Heterodera glycines
  Genomic contig location: Contig_ID=SeqID_18321; Location=62..1259; Strand=+
  SCN-specific regions: Sequence locations=1-321,344-441,464-916,950 -994,1038-1177
catttcaatctctgggactcaaatctccggcatttcaatcactgggactctattctcctgcgtttcaatcactgggacaacccaccaacatttcaatcactgggactcaacccaccagcatttcaatcactgggactcaacccaccaacattccaatcactggcactcaacccaccaacatttcaatcactgggactcaacccaccaacatttcaatcaccgggactcaacccaccaacatttcaatcactgggactcaacccaacagcatttcaatcaatgggactcaacccaccaacatttcaatcactgggactcaacccaccagcattccaatcactgggactcaaccctactgcatttcaatcactgggactcaacccaacagcatttcaatcaatgggactcaacccaccagcatttcaatcactgggactcaacccaccagcattccaatcactgggactcaattctcctgcatttcaatcactgggactcaacccaacagcatttcaatcactgggactcaacccaccagcatttcaatcactgggactcaattctactgcatttcaatcactgggactcaacccaacagcatttcaatcaatgggactccccaccaacgggtcaatcacttcgaccccactcaccaaatttttgcgtcaaaggtactcactcggccgcttcgcggcctcgtaactggggccttcggctccattccagtcactcaaaattcaatctcaccaattcttcaaaacccaataaccggaaatgaatgataaaaccgacagcggctcgaccgcttagcggcctcgcattcttcttttggcattttcttatggcataacagttcttccttgtttcttgactttttcttacgcacaacatttttcttctatacaaatttttcaaacaaattctcattcattcatttaaaatttcattaccatttacataagcaaaacaatatctttcatatcaaaaccaaatcaatttataacacaaacaacaaagaaagaaaaagaaacatttttaagactgttttttacacaaaatgacaaaagaaaaaaatgtaaaacaaaaacatttcatttttcaaagcatttatacaacacaacacaatgttaatattataggattttcttagtgaacaaactaaggagtgtcctctttcttttgttaaatattttataca

SEQ ID NO: 82920 - DNA, 372 bp, Heterodera glycines
  Genomic contig location: Contig_ID=SeqID_18322; Location=1068..1439; Strand=+
  SCN-specific regions: Sequence locations=1-14,45-83,105-193,224 -340,362-372
atggttagataaacttttgtacaaattaaatatttatattttgacaaataaagctattactaaaagaggttataggttaatctgagtaaaacaatttttattatcaatcttgggttttatttcaacctgaggatttgcaattacacttgttttaatttattttttcttagtcatttatttttataatcaggtcttttttatatttaaatattatttattttatgtgttgcatatttttggaatatttttcattatatactataagttttcaaaataattcaagccttttatggatgatttgttttttttcgagccagtctttttataagacggtttatccgttgacccaaatctattaagtgtcctattcaa

SEQ ID NO: 82921 - DNA, 1077 bp, Heterodera glycines
  Genomic contig location: Contig_ID=SeqID_18323; Location=417..1493; Strand=+
  SCN-specific regions: Sequence locations=1-152,176-329,366-537,570 -593,666-959,981-1077
atgtcaaccgtgcatgagttcccaattgatgagcacggagaaattgcgacaaaaattttcaaaatattagggaaacggcttgtaactcaaatactccgcgcaatggactactgtgaacaggcatgtgatgaaagtaaagccaaagaatttttgtataatttttagataaaaatattcgaaaatatcgggtcagtctcgctctcgagaaaaaagcgtcgttcgactggacatacatataaataatataaagtctaaaaatgaaaataagctctccaaaatttgcagggaatacttttcagtacaggacaaattcgttttaatttgaatccttaaattattctaaaaaattaaaaaaaaaattaaatcgatatttttcattaattttcctatttttttaagtttagtcccccataaacattcgaaaagtgataaaccacacaaaagggaataatgctgagaacagttcgaatttaaagaaaatttatgtatgagtgggtgataaaattttacaaaacaactaactaattaatggggaagaattattattctaaaataattaattttaaaaacacaaaaaaagcaatgggatttcctatatttttaatttaataaataaaattgacttggaattgtaaaaaaaatcattataattaaatttaatttttggacagttgcggcaaagtgttgacaattttggacgagttgcaaatgagcaatatttggccactttaattgccaaaaagcgaactatcattttgggattaagcacagaatttaatacatttcttgtcgaagttgaacatgaaaagttcgcaaacaatggatggacaacagaaaaattgacacttttaattgaaaaaatggacaaattttttcacaaaaataaaatttattgtgccaatgccggctttgaacatgccaaaaatgaacacaatagactggttcgtggtaaaaaagcgatggaaaaccatcaccaagatggacaaataatggatgaaaatggtaaagattatagatgcacatacaaatttgctaagattttaagttcattcaagaaaagcttgggttaggttttaa

SEQ ID NO: 82922 - DNA, 753 bp, Heterodera glycines
  Genomic contig location: Contig_ID=SeqID_18323; Location=1910..2662; Strand=+
  SCN-specific regions: Sequence locations=1-441,463-603,687-753
atggaaggtgaaatggaagccaaaattcacgtttattcaacacagccaattgatggcgacggatttatggcatttgcacgcgattttctcaatgaatccaaggaacttcttaaaatcattgaaaatttgtcgaacccaattcaagaaaatgttcgtaaaaatttgaaaaatttggccagtgttgcgcaacaaaagtccaaacagttgcgccagagcattgcgcaacaattggaacaattggtggcaaatgccgcaaacgaacttgccaatttgcagagccagacaggcaagttcggggacaacacggcatccgaatatttacgcatttttaggtgtaagtttggggaatattatgaatatttttgctaattaattaacaagggcttagattaatgtaagataaataaaatctcaaaaaaaatgtttgacataggaaactggaaaattaaagttttaaaaggtcttataaaaatagaaaaatgactgtatttttccaaaaaatcattaatttgcttgataatttcgtaaatttatcagtatttttatgaattttaatcaatttttttgattgattattagatgcaaatcaacggcagaaaattgaaaaattttgaaatttaaaaattctgttttttatattttatgttttacattcatttaataaaatatttttaataataattttagtcacctgttttggaaaaactctttaatttacgttatttaattttaattctaaattttttcataaaa

SEQ ID NO: 82923 - DNA, 1709 bp, Heterodera glycines
  Genomic contig location: Contig_ID=SeqID_3041; Location=50..1758; Strand=+
  SCN-specific regions: Sequence locations=1-101,123-1093,1116 -1311,1333-1580,1605-1613,1635-1709
atgcattccaatcactgggactcattctcctgcatttcaatcactgggactcaaccctccagcagttcaatcactgggactcaatccaccagcattccagtcactgggattctgttctcctgcattccaatcactgggactcaattctcctgcatttcaatcactgggactcaaccctccagcatttcaatcactggtactcaattctcttgcatttcaatcactgggactcaacacaccagcatttcaatcaccgggactcaattctccaggacttcaatcaatgggactcagtttttatgcattccaatcactgggactcattctcctgcatttcaatcactgggactcaacacaccagcatttcaatcaccgggactcaattctccaggacttcaatcactgggactctactctattctcgtgcatttcaatcactgggactcaacacaccagcatttcaatcaccgggactcaattctccaggacttcaatcactgggactctactctattctcctgcgtttcaatcactgggactcagtttttatgcattcaaatcactgggactcattctcctgcatttcaatcactgggactcaaccctccagcatttcaatcactgggactcaatccaccagcattccagtcactgggactcaacacaccagcatttcaatcaccgggactcaattctccaggacttcaatcactgggactctattctcctgcgtttcaatcacccggactcagtttttatgcattccaatcaccgggactcattctcctgcatttcaatcactgggactcaaccctccagcatttcaatcactgggactcaattctcttgcatttcaatcaccgggactcaattctccaggacttcaatcactgggactcaattctcttgcattccaatcactgggacctaacctcacctggtccttcggcatcgcaatcatcgagactcaattctgcgatattccaatcaccgggactcaattctgcgacattccaataactgggactcaactaaccagcattccaatcactgggactcaattctccatcattcctattcccgggactcaatcccaccagcattccaatcactgggactcaatccttcacttttcacggattcttcggcatcgtaataaccgaggactcagttctccgacattccaatcactgggactcaattctccgccattccaatcaccgaggattcaatccttcactattccaaacaatgaactcaattttacggattcatcggcatgtcaatcacgggacttaattcagacctgttcagcataattttggaattttaaaaacgtatttctattatgaaatacaatttgcgtagaaaatccttttcattataaatacttgttctcttacatttaaatccatccaattaaaaccgtatccattaaaagaggcataattgacatccgctttaattacaaaaacaaaaaaactccatttcaaggtcaaacaatttctcgaaccaaaactttttcaatacaatatcaaaactaagtgtaagatcatttccattgactttgcatatacaaaaacaattctttttctttacaaaagtgttaagagcattcatttccaaacgctttttgataataacaaaacaaaaactttttctcttaagaaatgcaatagaaagcattcattgcgatttcattatcatta

SEQ ID NO: 82924 - DNA, 88 bp, Heterodera glycines
  Genomic contig location: Contig_ID=SeqID_3041; Location=1965..2052; Strand=-
  SCN-specific regions: Sequence locations=1-88
ggccgagccagtcgattttatcaaacataatcttacaatacaatcgtactacctagcggggaatgcgccgaaggcgctgaccccgcta

SEQ ID NO: 82925 - DNA, 1056 bp, Heterodera glycines
  Genomic contig location: Contig_ID=SeqID_3042; Location=324..1379; Strand=+
  SCN-specific regions: Sequence locations=1-60,90-1056
atgggatttcagagaaaatttaaaatgccggatacaacaaatttccggacatgtgattctcctttagaaaaataaaataattttttgtcagtagagtcggtgcggctagagacttccccgtcctccaaggtgccgatcgcgacttcaccggttccgtcaactgccgttacgcggttatgcacaacattcccggcgacaatcttctataattatcaacatcaatggtcctattatacctcttggaatcgtgaacacttggggaggggtctatctcatccagtctttgtacagtggccttcaaccccccaacaattttttgcgccaaaggtactcgctcggccgcttcgcggcctcgtactggggccttcggcccccccacaattttctgcgccaatccaccatcatttaatcgctgggactcaacccaccaacattccaatcgccaacacttcaacgggactcaatccaccagcatttcaatcactgggactcaacccaccaacattccaattactgggactcaattctcctgcattccaatcactgggactcaattctcctgcatttcaatcactgggactcactcccccaacattccaatcaacgggactcaaaccaccagcatttcaatcgccaacacttcaacgggactcaatccaccagcatttcaatcgccaacacttcaacgggactcaatccaccagcatttcaatcactgggactcaacccaccaacattccaattactgggactcaattctcctgcattccaatcactgggactcaattctcctgcatttcaatcactgggactcaacccaccaacattccaatcaacgggactcaatccaccagcatttcaatcgccaacacttcaacgggactcaatccaccagcatttcaatcactgggactcaatccaccagcattccaattactgggactcaattctcctgcatttcaatcactgggactcaacccaccagcattccaatcaacgggactcaatccaccagcatttcaatcactgggactcaacctcagcaaatttctttag

SEQ ID NO: 82926 - DNA, 466 bp, Heterodera glycines
  Genomic contig location: Contig_ID=SeqID_3042; Location=896..1361; Strand=-
  SCN-specific regions: Sequence locations=1-466
gttgagtcccagtgattgaaatgctggtggattgagtcccgttgattggaatgctggtgggttgagtcccagtgattgaaatgcaggagaattgagtcccagtaattggaatgctggtggattgagtcccagtgattgaaatgctggtggattgagtcccgttgaagtgttggcgattgaaatgctggtggattgagtcccgttgattggaatgttggtgggttgagtcccagtgattgaaatgcaggagaattgagtcccagtgattggaatgcaggagaattgagtcccagtaattggaatgttggtgggttgagtcccagtgattgaaatgctggtggattgagtcccgttgaagtgttggcgattgaaatgctggtggattgagtcccgttgaagtgttggcgattgaaatgctggtggtttgagtcccgttgattggaatgttgggggagtgagtcccagt

SEQ ID NO: 82927 - DNA, 1147 bp, Heterodera glycines
  Genomic contig location: Contig_ID=SeqID_3043; Location=774..1920; Strand=+
  SCN-specific regions: Sequence locations=1-158,180-1147
gacttcaatcactgggactctattctcctgcgtttcaatcacctggactcagtttttatgcattccaatcactgggactcattctcctgcatttcaatcactgggactcaaccctccagcagttcaatcactgggactcaatccaccagcattccagtcactgggattctgttctcctgcattccaatcactgggactcaattctcctgcatttcaatcactgggactcaaccctccagcatttcaatcactggtactcaattctcttgcatttcaatcactgggactcaacacaccagcatttcaatcaccgggactcaattctccaggacttcaatcaatgggattcagtttttatgcattccaatcactgggactcattctcctgcatttcaatcactgggactcaaccctccagcatttcaatcactggtactcaattctcttgcatttcaatcactgggactcaacacaccagcatttcaatcaccgggactcaaccctccagcatttcaatcactggtactcaattctcgtgcatttcaatcactgggactcaacacaccagcatttcaatcaccgggactcaattctccaggacttcaatcactgggactctactctattctcctgcgtttcaatcactgggactcagtttttatgcattcaaatcactgggactcattctcctgcatttcaatcactgggactcaaccctccagcatttcaatcactgggactcaatccaccagcattccagtcactgggactcaacacaccagcatttcaatcaccgggactcaattctccaggacttcaatcactgggactctattctcctgcgtttcaatcacccggactcagtttttattcattccaatcaccgggactcattctcctgcatttcaatcactgggactcaaccctccagcatttcaatcactgggactcaattctcttgcatttcaatcaccgggactcaattctccaggacttcaatcactgggactcaattctcttgcattccaatcactgggacctaacctcacctggtccttcggcatcgcaatcatcgagactcaattctgcgatattccaatcaccgggactcaattctgcgacattccaaaaaatgggactcaactaa

SEQ ID NO: 82928 - DNA, 91 bp, Heterodera glycines
  Genomic contig location: Contig_ID=SeqID_3043; Location=284..374; Strand=+
  SCN-specific regions: Sequence locations=1-91
actagcggggtcagcgccttcggcgcattccccgcttaggtagtacgattgtattgtaagattatgtttgataaaatcgactggctcggcc

SEQ ID NO: 82929 - DNA, 1045 bp, Heterodera glycines
  Genomic contig location: Contig_ID=SeqID_18324; Location=307..1351; Strand=+
  SCN-specific regions: Sequence locations=1-1045
atgggccttctcccttctaatttaagcatttctccactttgcaactcgttctccaattgccacggcttcgctccgtttccattggctttattcgtgaaattagcagcaaaaagtcagctgcgctatgtgcccacattctgtcaatgtttcgagaattggtttcccgaggagaattggaagtccgtgcgttgtcgccgctgtcattttaaccttttcttttagtatttgcaaatttcgcgcgaatttcccttgccaatgtcatttgttgctgaattgtgtcgaaggaattccgtttgtctcgttttgttcatttttttattgttaaccaaaataaacaattttagaaaatctccaaaatttcgtgtcgaattagcagggaatacactcaaatcgatctgggtgagtttaacactgttttgagcaaattagcagacagcacacatcggttgatcacattgaatttctttggcttttgcccggctttaattgagcgaaataatctcaaagttcgtttggtcaaatttcgcgaggacattgaccagtcgttgcttcatcacttttgcgcacattctatgaattcatttccgtatgtttagtattataaatttccggagcaggggggggggtcaggcggtgctctcgggaaaaaacttgaatgtagtttgttaacagattgtccaaaaattacaaaatcaagttttctctttttccccgatggaatatttgagttttagatcaatttggaatatggacgaatgaaaaacgaagaagaaaatttaattttattctatttgttaatatttcttagaattaaataatgaaaggagcctggattaaaaaaattccactacagtttaggtcctatttttagttgcattccaaaaaaattatcttttaagaatttgcattttctggacaaatccgggaaggaaattttaggtcaaaaaaccagcttctttttgcacgttaaatctccttcaaatttatgtactttttcaattcattttttacttttgttatatgtatttttcaaaggaataattaa

SEQ ID NO: 82930 - DNA, 362 bp, Heterodera glycines
  Genomic contig location: Contig_ID=SeqID_18324; Location=1749..2110; Strand=-
  SCN-specific regions: Sequence locations=1-362
tccaactgtcttccgcttcatcaacacaatttgatatgagataagtcaatcgatgcagacattgcacgatgcgtcgctggtgaagtccctcctcaaaaaacgcgcaaatatcgtgccgtcgatgcgagaattctcgactcttacagggttacaataccatcaacaacatcaaccctgcttaccaaaatgatcaaaattaccatacaatgttaatcctgataatatcttcaattttctcgttgaatttctcaaaaattatgaaatacgcccgtagtcattcttcaatgttttgttattttttcgttgaaaacacactgataaatatgttatggtgttaattttaaacatttttcgaaaaaaaa

SEQ ID NO: 82931 - DNA, 1641 bp, Heterodera glycines
  Genomic contig location: Contig_ID=SeqID_18325; Location=133..1773; Strand=+
  SCN-specific regions: Sequence locations=1-419,441-453,477-1270,1299 -1456,1478-1641
  Gene Ontology: Cellular component=nucleus; Biological process=cell proliferation
aacctatgaccacgtgactgtgaagccgggaccgcacattaatgttgtaattggcccgaacggaacaggtcggaagaggaaaagcccccgacttttcctacattttcacttggatttagagactttggaattttactgaatttagtataaattctccgcaattctttgcttcttcattgcccattcattcaggcaaaagttcaatcatttgcggcatttgtttggccgtcggcggctccccgaaattgttgggccgttcggatttgatcggcgattttgtaaagcacggcaaatgcgagggaagcgtcgacctttttctgtatgtgttaaattcattattacttttactatctgacagacggtcgaattagatttatttatttttagctttttcttttgggaaattccatgtaatttggttttaaatttcccccttttttcatcaattcaatatatttatctgttgtttttcattctgcaattgtgtttagtgcatcttccgttggtttccaataagtgagcattttcagttgggacagtcgacgaagacgcgaacgctgtttcagcgtgcacataaaattgccaaactcggcctccttttttgtggacaatcagtcgatgaagctgacccaattgcgcgagctggtcaaggagtacaacatccaggtgacttcgtttttttttgagtgttccaatttttagaaatatcaaaacgacaaaaaaagtcggacttgggtaaaaagtgcgatactaaaaaaaaagtaaaatataaaacgataatttattttcattgaaatttgcttcgctcgtcgtttaattttgctccttttgtcaggtggacaatccttgcacctttttggctcaggacaaagtgaagagttttgcagaacaaggcccgcaaatactgctgaagaacactgagaaggttcaataaaatggaatttaggaatttctgttcaattagaaaaatataaaaacgctcatttttcaatggaaatcaatttttgtgactcggaatttcgtttctttatttttgggttttaaaatttctttgcttaattcccattttaattgtttaggctgggcccactgaactggtccaacttcacgaatcgctgcttgaaaagtccgaagagggcaatgaattgcaggcacaatttgaccggggcaaaaaacgcatggaccaattggagttggagctgaagacgaagaaggcccgggtggacagctacaaagaatggtccaatgtctgttttaaatattaccgacgaaaaaataggaattttttgggccctaaaacaaaattaataaatctaaattcctccccctccgacagaattttccgtcggatttttttccaccccattaattttttaacccatttagcgacacaaagtgatcgttctgttacggctcaagaaagcattattggttggaacatttattacttttttcgttagaaaacttagaaaattttaggaatacgaaagcgaattggacgtgcagcgacagcaactggtcgaattggacgaaatcagcacgcagctgaaaaatgtggagaaggtggagaaaaagcgcaaaaaagcggtggaaaacattgggagaacagccgctgaactcactgaagagttggaacaaatg

SEQ ID NO: 82932 - DNA, 1192 bp, Heterodera glycines
  Genomic contig location: Contig_ID=SeqID_18328; Location=484..1675; Strand=+
  SCN-specific regions: Sequence locations=1-78,103-154,176-601,623 -809,831-1143,1177-1192
atgtgctttttactttttgctcgtcaaggaaatatggcgtcaaaagcttgtccaaacaaaatcatcgcaaaagtgaggaaaaaagaagggacagaggaaaagcctttctaacaaatagggattaagccatcaaaatgattaaatgagtcattgaaaaataaacattaaataaacactttcatcaatttgtccatcagaatgaagcgacatgccactcgaatggttttcgttgtcattctcaccttcggcgcttgttggctcccgcagaatttgcgtttctttttgcaaggccttaattacccggaggcgagcttttgggagcgcgacgagaaaacgtaaagccaaatttgaccgggggcgggggaaattcgtacaaagtggcattttggggggttatccagctgccgttcagcagcaattcccaatgtttcagcctcctcttcgtccagtccattgctcaaacgttggcctacgctaacagttgtgtcaatcccatcctttacggtacggtaccatccctttttttaccgtataatttgtcattccttccccattcacaggtttactgtcagaacgcttccgcatggcattccgtcgcactttgggccgtttctgctgctgtgaagcgattcctctttccgcgtctctcccgcaacaattgatctccgggattcaaacgccaaacggcgaagggccaaaaaggcgatcagcatcggggattacggtgtacagctggcgggaatacggtaaaccgcaccactcggaacacattgctgggacgacgaaggcgaaactcagtggcagaggcagtgacacagtggtgacagagtggaggagcacagcaacgagacggtaggaagtgggacgggtgggctacggtagatactgtaacattagcaaaagcgaattgtaaattcaattttgtagtgcatttaggtcgaccatctgtcaccctttggatgctcaaattcattttgatcagcagagcgattacgttcaacaacaaaatgccaacaacagtgatttgggagacaacaaaaatggcaatgccaatgccattctcgtgatgagaatgccaaggacgagaagccaacaacggagggtttggctggagaccctcggcgaagagaataaaatgagcggggaagaggaagaagaggaggaggaagaagaggacgtcattctgttgtga

SEQ ID NO: 82933 - DNA, 421 bp, Heterodera glycines
  Genomic contig location: Contig_ID=SeqID_18331; Location=1875..2295; Strand=+
  SCN-specific regions: Sequence locations=1-71,105-146,176-421
atgttttatcgacgaatattcgctttattcttgtgcattttcgtcattctcttcacattacaagtaaacaaactatttcattttttaatttaaaaaagaattaagtttatcaattgaatgatttttgagtaggaattaaaattcacaatttattaaatttaattttacattttttgccagtttctccccgtcatcgatggcatgcaatttgatgtggtccaatgtggccattcaaaacggtgcgaattcggcggttgtgcaccaggcaaagcgcaaaacgcggcatcatgtgcctatttgttctcaatggagccggaggggccggacagtgttcgaatgggtcagacaaaaatcaaaaattcgtacaaagaaaatttttcgttaacctgatttttatacaaaaaaaaagcgggagttaaaa

SEQ ID NO: 82934 - DNA, 569 bp, Heterodera glycines
  misc_feature (33)..(33): n is a, c, g, or t
  misc_feature (52)..(52): n is a, c, g, or t
  misc_feature (73)..(73): n is a, c, g, or t
  Genomic contig location: Contig_ID=SeqID_18332; Location=1478..2046; Strand=-
  SCN-specific regions: Sequence locations=1-226,267-569
atgagctcggatttgcagtcaacagcagaacanatgatgggacaattcgacngcgcaatggcacttatgcatntgatagtgatgggaagatttggattaacggaaaagaaaaaagaacaaatgccaaatattcctacggtgttggcgataccgtaggaatcggcgtcaattctgttattcggcagatcgttttcaccaaaaatggaaaacaattgggttaacaaacaaattattaaatgttttttaaaattataatttatttaattgcctaatttatgcagatttaactcctttctcttttccacagattcctccggtcttttcgtttcgccattttttgctgacgattcttttcatccattcgtttctttgcgctcatttggtgacaaaattgaggcaaatttcggggccaattttaaatttgatttggatgctctctaaatggtgaaatattcacaaaatctgatcacgtttatagatcactctcatttgtggtttttgttaattttccattgacttttataaatttttaagaaaacgattgaattttatttattgaacataataaa

SEQ ID NO: 82935 - DNA, 294 bp, Heterodera glycines
  Genomic contig location: Contig_ID=SeqID_18333; Location=6..299; Strand=-
  SCN-specific regions: Sequence locations=1-294
atgctctatttgaatgcccactttctaatcactgttgtacctcttctaatcactcttgtacctcttctaatctctgttgtacctcttctaatctctgttgtacctcttctaatcactgttgaacctcttctaatcactcttctaatctctgttgtacctcttctaatcactgttgaacctcttctaatcactcttctaatctctgttgtacctattctaatcactgttgaacctcttctaatcactcttctaatctctgtaggacctcttctaatcactgtgaacctcttctaa

SEQ ID NO: 82936 - DNA, 215 bp, Heterodera glycines
  Genomic contig location: Contig_ID=SeqID_18335; Location=877..1091; Strand=-
  SCN-specific regions: Sequence locations=1-215
ttggcttataccgaatggagcgaacgttctttggaggcgattattcgtcatgcgcaagacttcgtgatgttcctcagtaaaaaccatgccgatttctacgatgttgaaaaggtgaaaattcagggaaaacgggaagcgaaacacaattgcatttccaggattatatgttggcgccggctgaatatcataagcgtgtttggggcaaccattcttga

SEQ ID NO: 82937 - DNA, 724 bp, Heterodera glycines
  Genomic contig location: Contig_ID=SeqID_18336; Location=628..1351; Strand=-
  SCN-specific regions: Sequence locations=1-10,32-724
atgccgtcgcgaaatttgtcagcaaagaaaaagcaacagaattcgttagttcgggatgagtcgacctcttcacccagcagaacgcccaaatcggtgtcgaaagcgagtaacagcagcagtagccaacagaaacttcagaagaagcagaattcatcagaactgtccacgattagcagtggaagtgtcgagtacgacttcttttgttttttgagaaaatacagctaatggttagaaaggatctcagctcttcaatgtctaccaatccgcacggacatccgacggacaaaaaatggaccattggggagaaagtgttatgccgttatctgaactcggagcacatttattatgaggctaaagtgatgtttctgaaagacttgtctggcggagatgtcggctatggcattcattatccggtcattttaatttaattcattttatcgcattgaagattttagggttggagcaaccgtcacgacgaagttgtaccacaacatgaagcactaattcgcttcaagaattactccgatgaagaggcaaccaaggcaaaggttatttttcgagtattttacgatgagtgttaagaaaaacaaattttaggaagacgtgaaaagggctcagcagatgctaaatgccaaaaaaagaaagcaatcggaactgaagaaccgctcgcaagcgcatgatgaaagtagtcgctccagcacaccaggaagcgccgacaacgcat

SEQ ID NO: 82938 - DNA, 676 bp, Heterodera glycines
  Genomic contig location: Contig_ID=SeqID_18337; Location=53..728; Strand=+
  SCN-specific regions: Sequence locations=1-118,140-543,568-676
atgtcggctacaaagtatcccgaccctctctgggttttcatgcctcctcccccaaccgtaaattgtcattatcttttattaaccaatttttccctattttaggcttttgccaatgcttcatctccagtcaatctcattgccatcattcgctttccgccgatttttggtttctacgttgtgccatttgatctgatcaacgaattgacccgggagcaattgacgatgaagaagatgaacgatatcaaccgtgttcttctgatccgttgtccgattgtgcgcgacgaaagcaaatgggccaaatgggtggaggaagcgattggatggaactttatggaccagtggaatcggatcgacatttgagatgggttagtgaatgaataatggttattcaaatacccaaatttattgcttttcgatttttaggctcttgacgcaatgatcgatccaagtgatcagaagcagaaatgattgaacgatttgttgagaaatgatcatctatttaattgatgtggagttggataatgaatttgagcccatctgatatatataaaattgttgttttgttgcgatgatcactaattgtattatatgtatatatgcccttaggataaattgactgaaattccaggcgcattcttttgacctaatgataaagtcggtggtcactttccctcca

SEQ ID NO: 82939 - DNA, 3450 bp, Heterodera glycines
  Genomic contig location: Contig_ID=SeqID_334; Location=1026..4475; Strand=+
  SCN-specific regions: Sequence locations=1-28,50-321,352-1394,1417 -3000,3023-3068,3092-3450
  Gene Ontology: Mol. function=DNA helicase activity; Cellular component=alpha DNA polymerase:primase complex; Biological process =lagging strand elongation
atgagaaccaaaaatctgccttccaagctttccaatcccgaagttttaacaagtgatgagagttcagcaagttttgaaagccctgcggggaccatttatgaatcattcgaggcgttgagcattgatagctcaaaagtagcttcaagccctgaggggtacactaatgttggggctgaaatcgttattgaagagactgaatccaatgaaaaccctgaggggtccggatatgatgaagtgagaaacgagggtagtagcgtcacgtttaaagcgatggaagtggcccttgaccaggtcgatgcagagggttttgcgaataatggctttgatgatgaggagcctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagacaagctgattgagtcggcccctggctttcagcgtaaacttgaagttggtgattttgtggcggtttcatcatttgagtggaaccagaagctgcgatatttggctgaacatcgccaagatgccacacagtcctgcaaattttggttcaacgaaaacacgcaactgttgccaaagcaggctgatgccactgacgtggttcaactcatgtacatgaacatcggacgcaagcagatcaccggggtcgtttactggataaagaggaagatccaaagcgttccatccagcttcgttcacgcaaacatcgcgtgctgtggtctagcggtttcggcacgcataaatcggcgtcatcttgatggcatcaatccggaagacctcaagctgggctcacttgtgacggtggttgttgccaacattccacaggactcacttgtatcaatgggatacattctgcctgatgcttcaccgtacaaactgggaacggaaagaagagccgaaacacctgaatttttcggtgcagttgcgtgcattcgtcctcatctgttggagtggccaaatctgaatgcaaacatgacgcccaaggtttatccatgctccgcggatactaaacatcatgttgtggcgatggagcatgttgttggagcagctctccagattgagatggagcgagaggttgacatgatgattgaagcacgctttgaaggaagggctcggaagttcgatggtgctgattgtctgattgtctttggttcgagatcgaagaaagaagtgaatgagttggccaaggtctgggagccggagtcccaagtgaaggtcttcaaagaattgggtgagaagcattttgctctgggagtggtcaaggatgttgaggtgctccacgcagaatacgaaaagttggaactccacatcgtcatcttcttgaacaacatccaggaaaggaagaatgtcgacatcgcaagaaaagtggatgagttcatccagggtggcagtgttgtcatacacccggtccctgccactgcggttgaagacagactgttctgcttccgctgcaacgtgccttcgataattgctgatgaagactctccaaggggaaggataatggcagtcctactgggccgtccagccatggagggcattcgtatggagaaggaaagcgttgatgactcaacggattcgtggatggaagaagagggaccactccaccctgcaattcttgctctaaactcaagacagagagtgactgcacgcctaatgttgggaggaggtctggtgcaacaacaggcgccgccaggcaccggcaaaaccaaagtcgctgcggcgatcattaaggcaatgatggactccaatcccgggttccggattgtggtgatggcttgtgccaacattccagtcgcaaagctggtacaagaagcggaaggaacgtgtgctgcaaatgatttggatggagcgcgagcaattgccttattttccggttttgccagatgcaaatacacggatcaaataaaagatgttcaacggcatacgctgccgaacaaagtaaactctgaggagttcgtcaagcagttatcgcccaatgtacagaagcaagtgaaggagtaccttgctcattgtgagaagaacccgcgcttggcgcctgagagagcgattggaaaagtattcaactcatgtatggcaccgaaaatagtcttctcaacagctgccatggctgcgaatttacttcatggtgaaggaaacatcactgatgcagacgttttgctctttgatgaaagcactcaagctcagtgggcagtggtggttcacttggttgcgcggatgcccaagctcaaggcattgcttttgacgggcgatcgtcatcagctcggagtgcatctgcaagaactgcctgacatcttccactcaggatatggattggaaagcgtcatccttcaagcagaggcttcgatagggacgaactatacattcctcacaaagatgtacagaagccatccatttttggcaaagctcatcagctatgcctcatatgaattgcacaatgagcaactcattccagcaagaagcgctgaagaacgctcactcatcacgggctcagatttccttctgccggttcaagaatgtcctgtgggactaattaatgctttctcgtcatttcgtgtggacccaaaaagcgattcgctcacagatgaccatcaaacagaagtggcatcgttcttggtacaagcacttttggaacattttggcaacgctttttcgtccagaattatcgttctgtgtatgtacacgtaccaaacttcggaaattgaacgaaagctgaagcactgcggtgttcgtgcactcacagttgatgcctatcaggcacaggagtgcgatgtcatcataatagtgacaacaagatcaaaatactccgaggtgggatccggaaggacggacaacatgcacttctttgaagacgatcaacgggctactgttgctctttcaagagctcgccacgctgtcttcatcattggagacttggtctcaataagtgcaggacaagtgtggaaacgtttcatcgaaatggcgataacaagaacaagcgtagtccgagccgagtatgttttggcacttttgggacgaacactcgtgaggtcgtcgacatgcctatttgattcggccaaaagagaatcggtggaggatgaaggctttcttgaaagttgggcattgaagcatgggttgcgcctggaccgaacgaattcctttggacaacaacaatcacagcagccgcgagctccctcattccaattccagaatcgccactttcctgcactacagacgacagggccctcagatcaagccggtccatctggcagcggtggtcaacaaagaggtgcgcctactttggcaccacagtatggaagaggtcaaggaagacgtggcccggacaaccagtggatgcactacggcggaaacccgaaacgacagaagggtggcagacgctga

SEQ ID NO: 82940 - DNA, 487 bp, Heterodera glycines
  Genomic contig location: Contig_ID=SeqID_334; Location=12046..12532; Strand=-
  SCN-specific regions: Sequence locations=1-317,339-487
ctaacttgtcatattgtacttttgaccgtaactgagcttctttaatgaccgccgcagcggattcccaagcttttctaagagacttaactaatttctgcttgacattgtcaacttcactggtgttttcgggttcggtgttgggattcagaatttgctcaatgcaaaatatcgggtctcgcccaaagaccaaaaagaagggggtctcctttgtggaagagtgaattgatgtgttatagcagaagttggcacattcaagaaattcatcaaaatctggttcttcacttgaaatatatttcgcaagtatattgtgaaatgtcctaaaagatcgctcaactactgcattgccttggctccaatggggaatagcataacatttattaatatagagaagcgaacagaaggacttaaaaaaatcagaggtaaatgccgtggcattatcagttaaaagactcgtacagcctccaaactttaaatagcagtgtttaaa

SEQ ID NO: 82941 - DNA, 8299 bp, Heterodera glycines
  Genomic contig location: Contig_ID=SeqID_334; Location=4961..13259; Strand=+
  SCN-specific regions: Sequence locations=1-1264,1286-1721,1743 -2035,2057-2486,2510-2844,2866-2956,2984-3817,3839-4208,4230 -4501,4524-4562,4584-5430,5453-6762,6784-6853,6875-7067,7089 -7234,7256-7808,7830-7903,7925-7980,8002-8104,8126-8299
atgtttcctttctctgatggggatccacctaatcgaagcgctgcggcgtcaaacaatgcactgacagaccctgaggggctctccaatgatttgcctgagttatcagtagttgataaattaatgtttgctggaaagattttaagcacaccagcacgtttgtctgatgtggacaagctccatacggacttagttcggactgaggatggtgtcaatcgcatgacacgtcaccttaacaggacgataaatcaaaccaatagggacttgactgaactcaaggatgatactcaaaccctgataactcaagtaaatactctcgcaaatagttatggtacagttcaagtgttgcaaaaccaaaatcagtcaccattagtcaacaaccctccggtcttaaattgggcaactccctctccactcaggaatccgaacaatagctttggcaatgctaatacttcggtgattgaagccatacatagtgaggaagaggatgaggaatttgaattaaatccttcgggattccatcatgttaacatgcttttcgctgaaagcagtccctctttcacgatcttctctggaaattctccattagaatttgatcgatgggcaagaaagttcatggatctgcttgactgcaatggcagaaagtgggatgattctgaaaaggtggcacgcctcaaggcatgccttgatggtgaaccaagacgaatctttgataatttaatgcctgcccacaaagcaacttcttcggaagccattcaaagaatcaaggaaaaccttgacactccacaaaataaagaactcacctatcaggcactaagcatgtgtaaacaaagggaaggagaatctgtagatgagtttagtgcacgactgattcctctaattgaggccaccacggcagaccttacaactaatgctagtgaggaggtactctgtcgagcatttttggaaaaattgaatccaaatctcaaatttctcactcgaaccctgagtgggcccgtcagaagggatttccaaatattgagaatgaatgcacgggaagcagaaatgatgcatagagagattcctaaatctattccagcacctcttttcccaatttcggaacaacaaaatccgagattcaacaacaccgagccgccgaaccacccggaaggcaactttagaacatgggctcccacaggctctaacagagagcctataagtcccagacagaggaaccggaacaattgggataacaatgcccaagcctcaagaggctcttttaacagatcaaataatcatcctcaaaatgacagaagatggaacaatcgcacttccagaaatgatagacgatggaataatcaaacccctcaaaatgaccgacgctggaatgctcggccagtttgcaactactgtgggaaggttggtcacctcgcgtttaaatgttttaaacgtcgtgaggaatttacccaagcatccaagaatttgaatttcatcagagcaattgatgaacaaaacagattgataaacgatctttcaactaaagtcaatagtttaacttttagaaacgaccaatccgctgaggcggcctctcaaaatataaacactattcaaaaactcaccaaatctagtacagacaaaagtccatctatgatgaatgatactctcaaagcaccctccaaaataagtaattgggaaacgagtaaaatggttcaaccgaaattttttcctgtgctaatgggtttgactcttatttcatctctctcttcgactttagttaaagatttcaatacaatcccagctagtccaatgatttgtcaaactcgcgttcaaccaatgacatggtctcttcccaaatttccacgatgccccaggatgtcaattgacacaagcaaaccactaaccaaacaaagacgcaccatctattttcccaattcacttgaattttctaccaaagcctgggcctgtcgcagaattatcaaaagtattcagaaatatactacaatcagtggtgtatctgtagaacaacatcttgactctgaacaaatagtgatgagtcatgatgaatgtctacgaatggcaaacaataagcactgcagcttaggatatctcaaaaatgattcagggttgtggcacacagataggaaaattgaccagacacctcgtccttggttattaggctctttttcctggaagaaagtccagagtgagaattgctttgcctttgaaactgaagtatattcgcacattggtgctacttcaattataactcctgcgggaaccgctcaagcttgtccatatgagaaaggaaactgtgtcctctttgacaaaactgtcttagtctgggtccctcaaaaggacaaaatgtgcaaatacagtcccatcggaatcatggatggacataatcttggaaatgtttggctttccactttaggagatttaggtttaaccagctcgattgtcagaaatatttctgattgcggtcgaaatctcactgtttctgaccaagggccagcttttacaatcaactcacaaaccccacgtcataaaaggggtatttttggattagattcagaaggtgtagtcacctcctctcagttagcatcacaactttcttatttacacactaacatatctcgttctgttaacattgcttttgctcaagcatttaactctttttgtgatttaatgcttgacacacaacgttgggtacagtcatcctatctcaatgatcccacaagccttacgaggtttattcaccaaaataatttcttaattgccaagcgagttggagtctctcttctgagaacatggccatgtgtccctctcagtcagtctgactttgaatttcgtccaacccataccaattcatcctgttttgaatttcttccaataatagtcaaattaaatggtaaggaacatattgctttcttgaaccctacgtatttgacagtctctcttcattctaaaacagctccttgcgaggaccagagaaatattttaattcaaatggctgatcgcacaattgaagttgaccaagtagacggaacaatcaacaatgttcatgtccatgaaatcagggaggttgagcttgactttggtaagccaacgcgcattccaaagctctcaccacatgccttccatcatctggtcattcttaatcttaccgatctcgccacacatgcctttgcttcaaacttggtacaagtaagtcaattcacataccgagctgataaaactcattcctctgaaattaaaactacgctctctgatgaatggtcagcactagaagaatctatagttcaaaaagctatgggaaattattccctggcatggcaaattggtatcaccatttgtcttttattgtgcatggtagatctcctgacacgccttttctttgcatacattggtatcagacttcaagatcccgtagagacattaggtcgaccaatgatcaccactatagctaatctttttggcaggaagaaacaaaatctagactgcgataacaagaaccatcctaattcgccaaccaaaaccattggtcacattacttcctcacatcttcgaagcgttgctgcaacgcccataaatgaggctacaggtcagtccttttttcgagatacgctgaatggtaactcatgtaactttattgaggcataccctcaatcatcaaactccaaggagttcaaaaaaatatggtttacaaaagaaactaatttctctgcttggttgaataattatctctcaaaaccagttaatcacgaaattcctctcctacttccgcggaactcaggcgaattagcacaattcctcgatgttgcaacacactttggaaaagaaattccaaatttcaattcaaaaattggtcccattagcagaatctcgggagatgaacatcttaaatgggacaagcaacgagtcgctgcttatcaggtaattttggggcatatacacatgctgattcatggtagaacccaaaacattccacaacaacgatttcataggcctcgctttgtaataagagagttaccaatgttcttggtattgtgcatgatattgcttccagcaacccttgctgccccaattacctcaaaaggtcctcctccgaacttaaaaaactcaacctttgagtcagcaaattttatatcagcattaccaaccattgtagccataattatattgagtgccttagtgtattcaaggaatcgttcgccaatcagtgctattatacgtgcaaaaattaatggtttagaaattagggcactagctgatacgggagcaacgataagtgtagctcctctctccttagcaaagaagataggatgcgagctttatgagtcaaaagtggaagctattagcgtctcctcacatgtaataagcatatgtgtcgtgggtgaagtaataataaaacttggtgatatatctctgcggagttcaattaattttatacctgatgaccaagcaggagccatgaaaaattatgaaataatcataggatgtgatatctttgttaacctgccaccaataacatttgacttcacaaaaaaggaagttatgataggtaagtcaaaactaaacatggaaacaagtcatagtaccctctcaaacctaaaagttcgagctctagagcactaccgaattcctcctggtactcaaatactggccaaagccaggatagatactatcttgccaatagacaaggacattcttgtagaaaatttggacccaagattgtctgatgaacacctaagcacaccagccacattttcaaggcctaaggacaatttattgaacattgtaatttgcaatccaaccaattttcctaaaaatataacaaaaaaaatatgtgcattgcgactgcatgtgaattaaacaaatctgatcatcctaatctcgtaatgaaatgcacctcgggtgagatcaatctcctgagggagtcacaaaaaataattcacgcagatccgtcatttaaagttgatttttcaaaatcatcagtctcaggtgaaaatcttaacaaattaaaggaattgtgtgaagaattccaagatatttttagcaaaagtcaatatgacttaggctcttgcactgcaggagagcatgatatagtaaccacgtcggatactcctgtgtcgtcgaagccacaccgaacaccattcaaatatcgtgatgaactccaaaaacacattgatcaacttttggcatccggagtcatggttgagtcggacactccgtgggtctcaaatatcgtcctagtgcagaagaaggacggtgggttaagaccatgtatcgacttccgtaaacttaacgaagtgactgttccggaccattatccacttcctagattggaaacaattatggaacgaataggtaattgccgttactattcaagtttggacctgtcaagtggatacctccaaataaggctaacagaaagggcttccagaaaatgtggcttgattactgaaaataaaattttccagatggttaatcttccttttggtctaagaaatgcaaccagtgcgtttgccagatgcatggcgcatgtcctcacaggtttggacgattgtgtaatcgcatatgttgatgatatactggtatacaccagggatgataattttgatgagcatctcaatgctttgagaagtgtttttgaaagatttaggagattcaacttaaaattaagccctaagaaatgcacattcgctgcggcgaccatgaattttctcggatacttagtcaatgctgttggctacactcctagtcttagcaaagtggaaataattaaaaatcttccagacccaaaaaccattcgagaagtgaaacacgtagtaggaatggcttcattctttcgtaaacatgtccctaatttttctacaatcgtagaaccattgaccagactaactaaaaaggagagcaatttcgagtggggtacagaacaggctgcggccttcaatgaagtaaaaagaattttgagtgagaaaccaatattggtgtttcccaattatgataaaccctttcacatcttcacagatgcctctaatgttggccaaggtggcgcactcatgcagtggaatgagttggcggaggcatatgaagttattgcttattgcagcagaacgctgtcagcgtctgaacgcaaatggcctgctgtacaagcggaattgggagcaataatttttgctctgcgaaatttcaaaccctatatttttctgacagaaattgaattacattgtgatcataaacccctcgccttcctacttaaaaaggcagaagcgcatccacaccttgcgcgttggttaattgagttacagaattacaatattaaaataattcatgtagcggggaagcagaatcttttagctgacggtttgtcacggtacccacatgaaagaacccaagagattgccattagagatttggctgaattagaagacatagcaaattttcccgtctgtcttgcgctgaatatgaagccaagaatggttcatgagcattttcttttaaccatcactgctcgtgatatagaaggaaaaacattcgccattgatgttcggaaagaacaaaatgacgattctgaggttaggaaattaattgaatttgtaaattttggttcattccctgaggggaccacagaagttgaaaaggaagatattgcatcaagagcggaaaatttgagtctttcctcaggcatattataccaacacttaccagatcaaaatgctcgaatgtacattccgctttctcttcgaccactaatttttgaagcttttcatacttcacaaataaatggtggtcacatgaatatcaaaaagacattagggaaatgtagaaagttttattggccgattatgcaccgtgatataaccaattggaccagacaatgcatcacatgtcaactaagacattcacccaatccttcatatcgtgcataaatgcaaatgccaccaaaaaatactctcttcgctcaaattgcacttgatttggcaggtcctcttcccctcacgcagaaaggtaacaaacatatccttaacataatttgcacatttaccaaatatgtaatctctgtacctgtccctgatgctaaatctcaaacaatagcactagcattttttaaacactgctatttaaagtttggaggctgtacgagtcttttaactgataatgccacggcatttacctctgatttttttaagtccttctgttcgcttctctatattaataaatgttatgctattccccattggagccaaggcaatgcagtagttgagcgatcttttaggacatttcacaatatacttgcgaaatatatttcaagtgaagaaccagattttgatgaatttcttgaatgtgccaacttctgctataacacatcaattcactcttccacaaaggagacccccttctttttggtctttgggcgagacccgatattttgcattgagcaaattctgaatcccaacaccgaacccgaaaacaccagtgaagttgacaatgtcaagcagaaattagttaagtctcttagaaaagcttgggaatccgctgcggcggtcattaaagaagctcagttacggtcaaaagtacaatatgacaagttagtacgaaatcaaaccgttcaaataggagatagggtcctattacgcaattacgcaggaaaagtcaaaacatccaagaaatttcaattaccctggaagggactttatcgagtcattgagattaatggtgtccttattacaattgtaagctgcacatctcctcaaacgaacccaagaattgtacacattaatcaagttaaaaagtattttgagtgctcaggacccccttgcaccacgaaaaatcttcaaaaagatgaagaacaagcactaaaggaggtagaatcaagagaacagatcaatgtacctggctattctcatgactcctatcagaaaatttctgataacacagtattaatagaaaacacacctgcactcacccctaatccctcacccccttcacagtccaataattaggtaaaagaaaaagaactaaatagaaatctttgctcaaaacataatctccgcgaaaaccctaggaaaaagaaacattttggtaacttttcggaggactaattacctgggatagccaaattcaatcattttttccattcttttaatcatactgtattttaagtacgtggaccaacctcgggaaacaacttcagcctgtagaataccaacaaaattgaacagtctttcggaatttttttttaaacaataagtcctgcgggactatttattgctttatctctcctttatcagttctgaggaacttacatatcatcgtttta

SEQ ID NO: 82942 - DNA, 672 bp, Heterodera glycines
  Genomic contig location: Contig_ID=SeqID_334; Location=13401..14072; Strand=+
  SCN-specific regions: Sequence locations=1-31,53-68,90-672
atgacatacgccgcggcgttcgaaaattttaatcttggagagatgaggatgatttcgctacctgatggccattctttgatggcctttcaaggagcgaacgatccatttagtaacttccatttttcgccatttgttcatgaggaggaaaaatactgctgtgtggagcaggcatttgtaatgaagaaagttcgtacatacgaactcaatggagtggcggcggaagtgatgcaatttgtccacaaagacgactccacaccaaactccccgcggtggcccgacggtcacccacgtgaattaaaatggttcggacgtgaagccgaagagagagcctctcccgccactaaaagaaactggtcggagaacgcacaaagaagctccatcgctttctttgtggagctgaagtttcggcaaaatcagcacttggcagctcttctgctagcgacaaacgacatgtggattgcggaagcgtgtaaagatcgaaagtgggctgtcggatactacaaagatgatccattcttgcacaactacccaccagaaaatggggcatttgggcgaaattggatgggcaacatcctcatgagcttgaggatgcgaatgctaaatgagcagcaaagtgttgctggtccttctaggcaaattggtaaacgggaggactcaatagcttataattaa

SEQ ID NO: 82943 - DNA, 723 bp, Heterodera glycines
  misc_feature (707)..(707): n is a, c, g, or t
  Genomic contig location: Contig_ID=SeqID_3044; Location=39..761; Strand=-
  SCN-specific regions: Sequence locations=1-349,371-526,548-723
atggaaagagaagctgagggagtaccagctcaagtgcccgaagtggtggtgctggatgaaagcatcgaggagaacgcctgcgggcaaaatactgataatgaaaatggtgttgtggaagtgttgccactggcaaacccgagcgatccgctgggtttggccacggttgagccggtagtcccagaggaggtgaaagaaatggaagtggatgagcaaaatggggaccaagggggggatagtttcgggaatggcgggttttcaggtgatgagtcatcttctcgccacaccttcttgtcgaacaaggcaaaacgcctggaccagacaaatgcgtcaaaatgctcttcgtcatcgcaggcatgtttggaagacggggctctgatcgacgaattccaagccatcggccgggccaaagacaaattgacgaagactcgtattcaggggccataccctggcaaaaaggaagacgaaaaggcgccaaagtggtacctggtcgctcaaactgctgcaaacggcgtggttgctgcacgagttcagctggcagagcaatggcctgccctaatttgggtggacaatgacattgtccaaaagactcggccattggaagtcggcgattcggtcaaagtggtcagcgttgaatgggcacagacggcgacaggatgggcaggcgccggagattggctgatcatggtcaacaagcgcttgaatcaccnaagccgtgccaaggag

SEQ ID NO: 82944 - DNA, 5475 bp, Heterodera glycines
  Genomic contig location: Contig_ID=SeqID_3044; Location=2698..8172; Strand=-
  SCN-specific regions: Sequence locations=1-514,538-1989,2011 -2682,2712-2770,2792-3330,3352-5475
atgtcaccggttctactgccagccaagctcattcttcaagaagtgcaaaacatgaatccaaaatgggacgacgaattgccagcgaacatcagcaaagactggctcaaattgatggcacagtggctcgacagaggcgaagcaatcacaattgaatttccacggcacatccaagccatcgactcagtggaattccactgcttctgcgacgccagcaaatacggcatgggaattgccgtgtatcaaaaggcaaaaacgacgattatgaaggatgaatgcaacctcatctacgcaaaaagccttgtcaaaccaatcaaagtggccgcacacgacggcacaattccaaagctggaacttcaagcactgactctcggagtcaaggcagtcaaattcatccaagcgcaaatcaaatttgccgatcatcaagtcatcatgtggacagacagtcaatgctcagtcgaacgacttcgagaaaacaagcgccaagatcgatttgtgacaaatcgattacaaaaaatccgagaagcgaacttccaagtccgacacgtcagaaccgactcaaatccagcggacatggcatcaagaggagcggatcctcaatgccttcgatcatcactgctttggcgctttggccccgtttggctttcgaaagcagacaaatggccaaaatcaaacgtcatctaccggcccggagatgaattcaaagaagtggaagagccaccaatcatcgaactgacaacacctgttcatgttgaagaacagttcaaaccatcaatccacttcgaacgattttcgaattggaacaggctgaaagccaccgcagcacacgctatgcgcttcatcaaaaagcttcgcacaatcgaaaacggcacaattagtgaaccgcatcaaaacaacaaaccactgaccatggcacaactgcaacaggccgaaaattggatcttgagagaaacacagcggcttcatccaccatccaacgaccaaatccgagaattgcaactcttccgacaagaaggaatttggagatgcggtggacgactcgaggaagcaccggatctgccatacgacagtaaacacccaatctttctgccgccacacgcatggataaccaagctcatcatccggcattatgacaaacagctcaaacattgcggtccgagaatactcctgtcaacattaagagagaagttctggataccacgcggacgcaaaacagttcagcaactgctcaactccccgcaacacggatgtcttgaatgtcgtcgagaacgagtcaagccgtacacatatcctgaggcatcggatttgccaaggggaagagtcagcgaagcacgaccattcgacaaaacgggagtggactacttcggtccactcaaggtcaaacaaagcaatgacgtggtgaaaatctacgtcgcactcttcacctgcttggccatccgcgcccttcatttggaagtagccgaagactactcggctgaagcattcctccgagcctttcggagattcacggccagaagaggcataccatcacttatcatgtccgaccaaggcacaaacttcgtggcaggagcaaaagtcatcaaagaaaactggaccgacacgttaatgccggaggacatgcaacaacaaatggctcaaagcggaatccgttggattttcaacacagcccacgccccttggaaaggcggcatttgggaaagacttgtcggcatcaccaaaaacgcactacgaaggacagtcggcagaaaccttctcacattggacgagttcggcacaatgctctgtgaaattgaagcgatcatcaacaatcgaccactcacgttcgaatcggatcaggaaccgatcaaagtgttgcgaccaatcaacttcctgataccatacagcaaagcaaacaacaacttcccaatcatcaataacgacacagacgatccaacatacgagccatacccaacaaatcgcgacaaaatggtgacaacactgagccacgttaatgctcggctgaacaaattctgggaaatttggaaaagtgactaccttctttccctgcgcgaacacgaccgaccaaatgcaacgacaggactacaaaccccaaataacggcgacatcgtgatcgttgaagacgaccaaatgccgagatccttgtggaacttggcgagggttgagaaagtcctaataggaaaagatgggagagcgcgcagtgctttgataaaaatcaatggaaaattaagggatagggcaataaaccaattgtacaatttggaattgagccctgaggttccagagcaaccaattcaacaagtccactgcctcatagcatcaatcatggaagactcagtctccttagccggcagtgacgacgaagaacaacgaccacgcaacaccgaagacttcaaaatcccaaaacgccgctcagcattattacgacccatcggagaacaacaaagtccactgcaaggacaacacaaacgccgcaagcaacttcacgactccggattgctaaaattgttccatgcaatcgcggaccaacaaggaagcagcaaggccacgattcaggccatcgcagaaaacagagaagtgcgaaaagcgccgcaacatgagcaaatcgaacacgaacaacaaatggtgcagaaagcgcaaaaagaagctaaacgacaccttcgcactgagcaacacgaacgagaaatgccgcagccacaaaaagaagaacaacaacgagaagccgaacgtcaacaaatcgaaaggcaacaaaacgacgaacaacgtgccaccaatcaacaagcacacagcaaggcatggcaagaattagcacaacaatttgactatgatctgatggatcagccggatccaacagagaagcacgcggaagaaacggatcagtcaacgaaatcaaagcagcaatcagcaaaggacaaagagcttgaacgacatcgaatcggcagaaaaaagactatcgacatgcaagagaagcgacaacggtcaagagacgaatggccagaggaaaacgaaacgctactcagctacgttcaacgcatttacggaccggagaattggacgtcagcatggcaaagaggacgtgttctccgagaactccatgaactggaggaccaagggcgatggatgattcatcataaaaccgatcgacttcaactcagcgtctcacgactgtatggaggaaaacgaccattcgccgagttccgttttgtggacggcggatactactcacacatggtgccagaagatgtgatcttcctccaggccgtgccaaccgaagaaccggaaatcataacgctcgatgacacgccaacaacagaaaaaacggccaccgacaacgcaaagcagccaaagcaaccaaaaacatcggcaccaacaatcgaagagtaccgaatggccgaccccaagccgaacaacttcaacgaattcaacctgtttgagccgtgcgacgactctcacacgacctgcgcgaaaacggcaacttacggatcaatcgccggcaaccgattccaagttgaagagttcaacaactgccgcgcgaccaacttcttccaagccctaatattcaattggctcacccggaacatgaacttgccagctgatgagatttgggcagctcacgataactacacacaactcaacgccgtaacggaagaaatcgccaaaaagttccatcagcaacaagtcgtcagcaaaggacgacaaatcggacgcgaccagcacttcacagaggtcatcaatgtctggcgcaactcatgcgatcgcttcggcgagctctacaatcaaccggcacacaaacaagtcaagtttcgaccaatcataccagaaaaggagcaaccaagtgactacgaggaatggatcgagcgactcaacaaccgaacggcggaaatcctcacaaaagctcgagcaaaagtgcagcacccgaccttcttgaactacaattgcacaaccattctcatcggagacaacgtggcagaagtgtttaagccactcttctatgacgccaagtggttcacccacttcccagcagacgaattccgacttatcccgggaccaaaggtcaaacacatgatctttgcctaccaagcaactgccgacaacatggcggctcaaatcgcaccgatgctccaccgatttctgcgatcagacatcgaaatcacactgatcgtagccaaggacgacaatgcacaatggatcaacaacaagaagtacctgatcgacatcacccgcgaattaaaagcgggcttcttcgttttcaatcgagaaatgggagaagcaagacaaatcgccaaccggatccgacaagccattccggaaccaatggatttggaacaagagctgggaccatcgtcgtcaacaaacacgtcccgacaaggtccatcaacaagccgacaagtgatcagctcgctaatgctgatcagcatgttttgcctactcttcaccggcacggcacaaggactaccaagtcgacaaaagcgaattacgcaagtcaaagcatggcatggcggccatgtttcaaatttcctcaacatcttcacggagcgcgaccgacgggcatcaacgaaatacagcccttacgtccagcgatacatagacaaggttctagcactgaaccgaagtctgagccaatcaacaaatccgccgagatcgacaactccgccatggacaacgatccaacccacaacaaccacaagtcgtccacgcacaacgacaacaaccgcgactacaacgaccacacgcacaacaaattggccaaccagattaaccacacgaccaaccgcacgcacaaccacgacaacgccaatgccatggtcaatggaccaccgaacgacaacagtatcgcgggtacggcaacaacaacggccccgtccaggaatcaaattgattcgctggcccaagagcacaatcacaaccgaaaagggacgcgacgtcttctggtgctcgaatcacggcagcactctctgggaacttaaaggtccggaaaactcgccattctgccgtccaccaccggcacttactgcgcaatggacaccactgaccatcacgctgtacaccaagatccaccggccggaaccaatcgcaacggcatggcactgctccatcaaaacgacgacggaaaattattacacaaacatcgtcggcgataagttcgtcgaaatcaacaaagaatttccgttggtctctaaacgactctgccaacgaatggcacatcagcaagaatgcccactcgccaaaacggaaatgcaccacgacgacaacaatcgtatttgggcaacaaacgaccaactccaagtggatttccctggaccaatcaccggacttttcaaagggaaacaaacaagctcggcaacaaattgttttgcgcaaccagcaacactgttcgtcaaatggcacagtctccaattgctgtcgccaattcatcgagcagaccactgcaattacgcctccgagtattgccagctgcatgacaacagttcactcatctga

SEQ ID NO: 82945 - DNA, 902 bp, Heterodera glycines
  Genomic contig location: Contig_ID=SeqID_18339; Location=378..1279; Strand=-
  SCN-specific regions: Sequence locations=1-100,122-378,400-466,489-902
atggttcaattagattcttatgatgctttaaaaaccgtaatagccaacgggtcttaccactcccagtagcccccgagagaattagagtgaacggaccgcgaaacatttttaatgtatcttatttatttgacctatttatattttcatagggaacatgtttcgcgcatttggggcatagccagaaattatcaaaaaatgatgtaccgaaatgcaaaagactgtgttttttacatctgttacacatctcgtaatgacaggggcagtaatgacaacacttaattttatgtggacagttcattttttcaatttaattttatttttggttgctatttatagaaggggtatataaagggagtgaaaggaccatttgattggtacattgtatcaaaaatgcaaaaacgataatcgtaaatataattgctctcgctaatctcggtaccggaattaaactaaactctctgacgatcaccgaatgcgaatttaagtataaccctagtaaattcaatgccgcggttatcaaatgtacaaaccccatcaaagcaacggcattattatgggaatccgggaaaattatatgtctggggacgaaaagtctgatagactgtgaaaatgcgataaaaattttcatagaaataattaagggctcggggtgtccggggcttcttacaccggacacacggttgaaaatattgtttcgacctttaaattcggacgtgaaattgaactgaacgagtttcgaaaaaatcgtcgtgcattttatgaaccggaaatattttgcggtttaaatttcaagcggggtaaaagcatgactgctttaattttctaggggctcgggggaggtggcaaaaataattgagaattggaaaagggggatcaaataattgattaaaatccaaaataaa

SEQ ID NO: 82946 - DNA, 889 bp, Heterodera glycines
  Genomic contig location: Contig_ID=SeqID_18342; Location=23..911; Strand=-
  SCN-specific regions: Sequence locations=1-340,364-889
  Gene Ontology: Mol. function=ubiquitin-specific protease activity; Cellular component=nucleus; Biological process=regulation of protein activity, epigenetic
atgatgagagtgatcagtgcgacgaagatgctctttctcagctgatgctacattccgaattgtttgttttgacttaacattaaatccgttacaaaatgcctttgagcgccaaacttaaaaaattgttttaggtttagacaaaggtcttcggtcggagtgcagacggattacaacgaagagtttccgccactgaaattcttgcgcgcacttggcgaagatccgaccatgatgggtcatcctccgttcttttttaacgcaagcggtgcaatttccgaagtgccttcgtctcagcaacaagcccatcaactttcaatgcccaatttgtctgcctctgtccctgcaacggccgcttccgctgcaatgaatgctgccaacgcagttgatgcgacaagctcagcgtcgtctgacgggatgctgcaactcgtcatccaaaactttcgacatatgtccgacaccgtcagaggaccttgcaaatatattcaaggcgtgccttggtaagacaaacaaatcttggttttttactcatccaatttcaggcgtataatggttatgccacgacaacatgttgtccagaaaaagggaacccaaaagtgccttggctttttccttcaatgttgtcctgacgcgtactctgagtatgcttgtgtttttttattccataaatttttcttcacagatcttggtcctgtcaagcctcggcggaattaagacttatttcccaaaaacatggggttccaaattttacacggaagactaatcatgtctacactgcgaaggagaatgattggggttattcgtgtttcatgacatgggcggtgagttgctcacttttctcttgatttatatctttatacaaatgctttacaggacattttggatgaggcgcaag

SEQ ID NO: 82947 - DNA, 760 bp, Heterodera glycines
  Genomic contig location: Contig_ID=SeqID_18343; Location=489..1248; Strand=-
  SCN-specific regions: Sequence locations=1-281,307-418,451-760
gtcggaaacggaataacgatgcttattcgtttgaggacgatgaattgttggctgtgtcttcatattcagtgtcggaagtgttgcaaagcgcaaaacgctcaacggaaggattcaacagaataggaaaagaagaagaccaacacagcaaaacagtcagttttatggttgatttaaaaaaagttaaaaagaattcttcagccaaaacgcaaatacacgcgacaaaactcatcctccatagaaatggcaaatgcaaaaattacagagagaacaaattctggtgagtttattcataaaataaaataaaaacggaaactattttcagtaaattcaattttaactgagagaatgaaaaggaaagcgcggtcactttttgcttcatcggaaatcgcaaatgacgatcattccgtgctcacggacattccaatcccaacttgcacaatgagaagttgcagttcaaatgaaaatgaatggtaaagaaataccttttgtaattaagttcaaattcattctccagcactcccttactgcccaaattgatcatccgattcccaaaaaaagaaagttcttcaaatgatgagcaaacggcacaaaaacacgccactcataaggggaataagcggaagaagcgggacaaagacgtcgattggacggaaacgaaacaatggcatggggcacggaccaaagacaaacatcacagagagaaaggacacagaaaaggccatcacaaaaaacggaaatactcgacagaagcggaccaaag

SEQ ID NO: 82948 - DNA, 1212 bp, Heterodera glycines
  Genomic contig location: Contig_ID=SeqID_18344; Location=803..2014; Strand=+
  SCN-specific regions: Sequence locations=1-663,685-830,853-979,1001 -1212
atgttcttctttgcaatatttttattttttacattttttcccattgctggccaaaatttactgaaaaacgaaaacaaatacaaatttatacccagaggccaatatgaaattatcattgctaaaggacaatatggtgagaacctttctgtaacgatcgacagactttcgagactgtaaatatttgtgcctaatatttcaaaatcattgaatttttagcctgctaaatttcatattaggcaaaaactgcagaaaactattagtgactaattctgatgttgtaggatcaactgactggatctaattccttaattttataatttttcagacggtccaaagcaatttggctttttgacaaatcgagatgggaccatcgaatggaattttttggacaattttcacagaaacaaacttatcaataatcaatttaaagatttaaagtcgcaagaaaaatttacaattcttgtgcaaaaagagaatgataagcgaattattagaacattcaaaaattatgcagaaatgcaccgaacaatgaatcaaaaagaaggaacattttatgctcgcaaccaaattttcttcaacaatcttccggtcactttttctgaataaaatttcgcaaacaaaaatttcaaaaaatcattccgttaatggattattaaaatgcttaaataaaattttgttgtttcagaaagcgcccccggatttgccggtcgattggatcggaaacagcagttacacttttttgcctcctagaaaatatcgtatcattgtcgccagtggaccatatggtaagaagcaattgaaaaaagcatttcataaaaattaatggaaacattaatttttgtttatttatagatggtcaaaaacagaccgaatttttaactgataatgatggtaaaattgagcaaaatttcttggggaatttcctcgacaaacgtttaaacgatggatggaatataaatccaccagaatcagcagaaaaaattacaattttggtggagaagggaaatgataaacgtattattagcgaatatacgaattatgccgaattaaagaaaacaatggatgaaaatgacggcaaacttttcaactccaactacatcgatttcgaagcccttacggtttagcgttttgtttacccaaataattcaaatgtttttaaatcataggtagcgtttccggatttgcccgatttggaggatgatttagaattaa

SEQ ID NO: 82949 - DNA, 555 bp, Heterodera glycines
  Genomic contig location: Contig_ID=SeqID_18345; Location=988..1542; Strand=-
  SCN-specific regions: Sequence locations=1-51,199-260,283-286,426 -429,452-460,490-498
atgacaattgttggggaaattaaagttcaattggggaatgtgatttgtcaccgtctgcgagtcgtaataccaataaagctgagccaatccgatcgagaagctggagatgatcagcacgaaaatgaagcagaacttggccacatcgaccagcatgcagcccaaggagatctgcaagggtcccaagtagggattggtctggaacaagtagatgatgcgggcgaagctgaaatgtgcaggacttggccagcagtgccaatggcgcagctgcagccgtcccggacccaacctgaacacgttgccgacagcgaacagcgcctcactgaccaacacgggctcaaacgcattccaatgcgtgcggatgacgtggcggggtgtgaactgctcgccaacgttgtgcatcacgtaaatcgaataggcagaaaatctgtgcaaaagaaagggaggagaaatgaacggcgacagaacagaaaaggaagagagaggagacgaacgaaatgccaaagggaagaaggacagaccgaatggaaatggtgcacaagtacagacagaccatga

SEQ ID NO: 82950 - DNA, 2007 bp, Heterodera glycines; identical to SEQ ID NO: 18345
  misc_feature (12)..(12): n is a, c, g, or t
  Genomic contig location: Contig_ID=SeqID_18345; Location=1..2007; Strand=+
  SCN-specific regions: Sequence locations=1-20,46-106,156-212,308 -308,385-454,484-491,534-694,803-851,886-916,938-939,1045-1053,1083 -1091,1114-1117,1257-1260,1283-1344,1492-1547,1671-1736,1780 -1786,1812-1843,1867-1931,1967-2007
  Gene Ontology: Mol. function=structural constituent of ribosome; Cellular component=integral to membrane; Biological process =regulation of transcription, DNA-dependent

SEQ ID NO: 82951 - DNA, 5400 bp, Heterodera glycines
  Genomic contig location: Contig_ID=SeqID_3047; Location=18..5417; Strand=-
  SCN-specific regions: Sequence locations=1-5,29-190,212-663,685 -976,998-1347,1381-1407,1429-1517,1542-1593,1615-1727,1750-2145,2205 -2223,2246-2266,2288-2923,2963-2980,3048-3208,3231-3259,3281 -3327,3351-3379,3403-3729,...
  SCN-specific regions: Sequence locations=...3751-3790,3812-4552,4590 -4779,4801-5071,5093-5400
  Gene Ontology: Mol. function=protein phosphatase type 1 activity; Biological process=glycogen biosynthesis
tatttcctcattccaaaccaaaaataaagggcagtgggaggggcgactgcaagaaattcaaataaaattagtgtggcattccgttcatggttctccccggatttcttggcaccattggataatatgtcaattcccgaaatacttagctcctaatcgagaatctgtcttcactgttctcagctttcgactcctactttgaattccttaactttttgactcattgttttccctatattattccgggctaacactctaacactatgaaattcgaaatcaattttcgtccatcttacagtctttggcgagccgcagccgctgcaatccgactcggagggcgaggactcgttggtgtccccagacgaggaggtcagcccgtccggttcatgtgccgaagaagaggaggaggaggaggacgagcagcagcatcagggcggcaccgggccgcccatgctgaacgtgttggacgaattggtaggacagttggagggcctggacatcgaccaacagcaagaacacaaaatggtgagtgctgcaggcagccttaagatattctcgagtttgaaatgggaataaatgtcttggattttccgcgcctcgtcaaatttatgaaaattgtataaacaaaatgccaaactttttttccaaatttaaattgcttatgctgtctctcttttctctttctctgtctgtgaatggtaaagtaaaaatcagtgagtgcattcaaaagaagaaaaacattttctgggtcatcaaacggacgacggcacacacaaaataataaacgatgatgagagatgataatccccccgcccccaacgtccgttcattttctcatcgatttacaccattcattggtccactaattcgcatattatctgtacgggttcattgtgcactcaaaaagtctcccctccccactaaaaatagcaattttaaaaaatctacagattttttttggcttttttggaataacaccttctaaatttatatttcaaaagattgaacgggaattttggtgaaaaagtgatggatttcagaaatttagggacttcctcccctttttttggttttgcatgcatttcgtaatttttctgatttttcgaattcttctcattttctggtgggatttggcttcggccttcgccgatgatggttttcgagtcaattttgctggacacttttccgcccttaactccaactttgttgccttcctcctcttgcttccttttcccgagttcgaccgccatccgcgactttgcactcatttccaataatttggttagaatatttttgagggttttcatctgtaacttttttccttttggttgctccacattttggattttcaataatttttatacttaaaaattctttttctgtgcgcagcaaaatgaaaatgccagtttcccaatgcctttcccggcattaagcgtttgaaaaaagaccgaaaaaattaagattccataacctacaaattagccaatcccttttgaattttttttaagtttggcaaactgtttggttttaaggttgagccaattcggatcaataaatgatttcgaatttcaaaccatctttgttgaacagtgaggtattaaaaatttgggttttttctcaactggcgggtggtttgcaattagccacccctccctctctctcccgggccgcgctaacctcgaaaaattgaaactcaaaaaaaaatccctcagggcctctctgaccacctgcaccagcaacagcatcaccagccgatgccgccggcgccgcgttatgcggactcttggctggacaacatttcgcttgtcccctccgactccgggtccgcttgtctgtacaccggtgccaacaatgtctgtgccgccgccgtgccaatggcgtcacctttccaagtccgaaatttcgagaaacaaaaaaacaatgaaatattttttcgtattttcagcagtccctgcctccatcgtcgttggttgagccgccctgctccgactatatgaccgtgccgccaatgctcgcctcggtggaccttgcgatgccagcggagccgtccccattggtgcaactgccctttcaggtgcgttgattatatgatttaaaacggcaaattataaggcttaggacaaacagccggggcaaaaacgatgggttgcgtggggaaaattggagaaataaatgttctttcagtcatactgtatatttatattttaatcctactgtaattttgtgatctggaacttaaacatattaatggtaaaatttttcgctgtattaaacctcaaaaacaagtgaagtagctttttatatgccatataagtaccatcacgctttttctgttatactatataattggcatatttttcttgagccgcattaccaagaatatattatcgtcaatatttcaattttccggcacaggtccctctgctcaatgtcgagctgtgccatcgtcgtccgaccattgacggcagtgttgtgccgccactgttgccgcaaccgccttcactgatggccaacaatgccggcagtgaaacagcagcagacgaaccgtctccacgggcattctttgaaggcaaaggcaccgccaccctttgtccgaacgacagcaaaagcggcaccgttgccagcattgacattttgccaccgtcggaaacaacaccggcaatttgcagcggccacattggcattggcaccatttctgccgagacagtgtcgttcccgctcgtggtagccgcgctgcgccctctgaagcgcgtgcggttcgcagacgactgtggccagtgcctggagacggtgcgtgtgatgaccgagcccagcgactacccgccaaagatcagcccaggtgagtcatactgtatagaatacggtttattaatgtcacacggtatttgttttagaattgattcgttgatttttaactgttcaacatttaaaatgattaaaattcattttcttatttgtattcattattttctctacttttttgatattttaatattttttattagaattaaattaagtaattatttatttattttattttttcaatttttcagctgttctccgtcgaatacgtcgtgcagcagccgcggcttcctccgcaattgctgctgcccattccgccggtggcactgatgcgaacggtcaaccattgagaaacagcagcagtgcttcgacaatgacaattgaggagatggtacattttaattagatcattttttttattaattttttaacggtgtcaaagaaatgccatggaaaattatattctttttattatattcaaaactaatgcttccaactttttttcaatgtaagcactgtgctaaaagcaagagcttttttgaccccaaaaaataagatttgaaagtcgatttttactggctttttccccaaaaatttgaaagtttttggatcaaaaacgatgccgatagacacttttaacagattttcacctaatttgctatttttatgacttttaatttcattttaataacttttttttcacatggtaggactcggacgaattggacgaatttgaggcggaggaggaaaggcagcgaaagggcggcccaatccatcggcgcagttggaagatggcattcaaacagccggccagtgaatatgtgcacttccgcgacacattggaccgacaacgggtggcacttgaaaatgtgatgctgaagaatgaactgagccgaatggtcggcaccatcaaggcacggacggcatggggaaaagtgccaaaattgacaaaatgataaaaaaaacattaggaaaactgcctttttttgttggaatcactagggcagggcacggggaaaatgccaaaatgtgcaaataaacatgtgacaaactgcctttttggcaccactgaggcacggcatggaaagtgccaaaatggacaaaatgataaaaaaacatttggtaaactgccttttttgacatcactgaggcacggcacggcgaaaagtaacaaaatgggcaatatgacaaaaataaaacaattataggtccggcattgggtgtatcatctgaaaaatttggagtctaacgagacatgtcaaaatgccttaattaatggtttaattggttgcaggtggccaacatggcatttgaaaagcatgtgttcgtccgccacacagccaatggttggaaaacgttcagcgacgttgaagcgcaatggcaatgttcgccctcgaaggcatttgacacatttcgctttgatgtgccgttgccgcgcaacaacgaatgcccggtgggaaattttgccattatccaatgcgggaagaggattccctactgtattttagggtacgggtcgggaaattgttttaaatttcatttggatggaaatggagacgattttttgttttttgctcatagcaccaaaaactattttggcactacctgaaaagcgctccgttacataccaagggtgcaccccaaaatctcgccgccgaaatctcgccgccaaaatctcgccggccgaaatctcgccgcagaaatttcaaaaaaaatttcaaacttagaaatttttcaaggaaaaaattcttagaaaaatttttttataagaaaatttaaataaaaaaattgttgaaaaatttttcagcaatttttttttgaaattttatgaaaatttactgttttttttgaaaaattttcaaaaaaacttagcaaatagttttttttggaattttcttataaaaaaattttctaaaattttttccttgaaaaatttctaagtttgaatttttttttttgaaatttctgcggcgagatttcggccggcgagatttcagccggcgagatttcggcggcgagattttgtctcggcgagatttcggcggcgagattccggcggcgagatttcggcggcgagattccggcggcgagatttcggcggcgagattccggcggcgagatttcggcggcgagattccggcggcgagatttcggcggcgagatttcgtcccgtccccacataccaatcctattttatagattcttgctaatgcttttatagaacttcttttccttgttaccatatactctataaacaataacgtaattgagatattattatagtattttttgtcaaggattatgggttcctttttaatcgcaatttaattttcagttcatccgttttgagttttgcgtccgctttttggccggctcgtcgccctccgtggaggagcattgggactcaaatgacggcaaaaactttgtgctgctttcccaagaccaattcccgacaacaatgacagcgtcttcgtcatcaccagtgttggcatcatcgcaaccatcgtttttggcattgtcgcatcaatcgccgacggcagcggcacaccgattacggacgacacgccaaaaagtggtgggtcagcatcgtcaccgttcttg

SEQ ID NO: 82952 - DNA, 1023 bp, Heterodera glycines
  Genomic contig location: Contig_ID=SeqID_18351; Location=28..1050; Strand=-
  SCN-specific regions: Sequence locations=1-103,125-978,1000-1023
atggagtcaaccggttttcagcaaagatataattttcgagtgcgccggccgattaattacatggaacaagaggaatcgtcgcattctcgccacagccgacgaaatggcactgaacaaaacaatggtttgaatttggcccctcaaaacattttggacaatgtgcaagacccaaatccatttccgcgaaatttcgaaaacagtatcccccagcaagtgggagtgcaacaaaatgtcgaagaacaaatgcagctcgcagtgttccgacctcccaaccaaaatgttgcccaaagtttcggaaatccccgggctcattcaacccctcaaaatgtctcaccgcatatttcgtacaatggccaacaagaaaatttcgagcaaaaccaaaatcggaatccggatgcgaaccgatatggaaatcaccgccgccaaaatccccgaattttcgttaactcgcaaatggcgaacaaccatcagttttctgcacgaaattcccaaaattttgtaccaaatcagggaataagggcacaaccggttcggaatgctcataatcccgggtatggagaattaattggtgagcaaaaccgaaatgttcataatccaaattatggtcgagaaattgggatgaattaccccattcaaaatgtacgagattttggaaacggtccaaatttcccaaattataatccggttcggaatatgaatcaacaaaattatcagcagcaaccgaacccgaattttgaaccacagcccaatcaattccaaccgtttttgcccgaccaatttccgaatactcaaaatttcgagtttgtccctcagcaaaatttcctacaaaatcaaattcctgatattgtaatggaattacataaagttactctgtcaaaccaatacgcaaatacgctccgagaaatcccgaacctatacggaacggaaggtcgggacaaaattaaggattttttcctaaatgttcaaatgtgtgccggagagtggagaccagaaaagcaaaaagagttgctacagacaaagtga

SEQ ID NO: 82953 - DNA, 1192 bp, Heterodera glycines
  Genomic contig location: Contig_ID=SeqID_18353; Location=493..1684; Strand=+
  SCN-specific regions: Sequence locations=1-280,344-416,459-460,499 -592,615-824,925-953,1010-1192
atgcatattttccgtccgatagaattttacaattgtaacttcatttccggtaaatgcgcattttccgatagaattttacaattgtatttcatttccggtaaatgcgcatttccgatagaattttacaattgtacttgtttaccatttctgatcaacattgaagctgacgagctgatccgaggcctcatttcactgattaaatttggttgcattttgtcattctctccatttggcattttgtcaatttgtggggacacttaacaaattattgcatgatttcaaataataaatgaagaattttttataatatttttgaaaataaaaattttaatttttaaaaattgcctgattcttcgtcatcattgtcttcttctgccgcctcaatgccaattaagctaaaacaatattttataatcgtctaaatttaagacagcatttcaatttattatttggattttactaaataattaattttaactaattaataaatatttataaccgttgaaaagttgatggagcagcatcagctaatggaccaagcgcagctccgtgcgggttgcgggaacgaagcgcaaaatcagaccaaagcgctaaatacagaaattaatcaaacagtaataagaccacataattagagaccgaatatggacagacccgtatacgggtttttaccggtcagtcgccgataatccgcattttttgatcgatacagatttttagtgattcgggttttacggtttttttagtctgtaagtccgtaacccgtgtatgtgactgtatgtgacatgcccagcccgttttgagaactaatatgttcccagttcaaattaatttatatagtttatagaattgaattaattattcatttaaattttttcgccaaaatttgtttaaaaatgcaaaaaaatatatataaaaaataatggaaaatctcaatttttctagcgtgacgcaaaattaaaattctcatttttaataaattatttttaaaatttattattgtaattaacgaacaacaatccatcagttgtagttgcattgcgttgcgccagccgagcagtgccgaacgggtggaacaaatgcacaaaagatttgccaaaattggctgttcatgcataatgctggcaatgagccgaaatgcggtcggaaaagcagtcttttcaagccgagtggactaaatttaaaaaattaa

SEQ ID NO: 82954 - DNA, 1370 bp, Heterodera glycines
  Genomic contig location: Contig_ID=SeqID_18353; Location=985..2354; Strand=-
  SCN-specific regions: Sequence locations=1-294,348-360,382-397,688 -853,910-938,1039-1248,1271-1370
ggaattttgcatcaacgacttcgctgctcgttgcaaggcgggctgctgaagtgttggaatttggaggccaactctttggacagctcaaatctcagcagcaggacgtccaattggtcgctgaacactttgagtaccggcggcaaagtgcccattttaacgctgttaattaatgaggtggtgcaaatttttgtatttctttctccaagaaattattttgtgaatttaacaaagttcgatttgcttttttttcccattcaattttatctaatttatgtggatatatgatgaaattaaatttaaattgggttttatttattttggtaaaattatattcattaaaatattttcaaaaagtcatatattttacatttttccctcatataaatcatacaaatgcaaattatatttaattttatttattgtttttataatttaaaatttttttacataaaaatatttaattataattaaagataataaataataaacgaattttaatttaaagattacatttcatttaaagaatttaaaattaaaagaatgaaaaccgcaaaatatttttgaaaatttattaattgaaataaaaaaataaagcttttattttttcatgctttttctcataaataaaatgaagaaatatttaaaacttaattaaaattagtttatttatttaattttttaaatttagtccactcggcttgaaaagactgcttttccgaccgcatttcggctcattgccagcattatgcatgaacagccaattttggcaaatcttttgtgcatttgttccacccgttcggcactgctcggctggcgcaacgcaatgcaactacaactgatggattgttgttcgttaattacaataataaattttaaaaataatttattaaaaatgagaattttaattttgcgtcacgctagaaaaattgagattttccattattttttatatatatttttttgcatttttaaacaaattttggcgaaaaaatttaaatgaataattaattcaattctataaactatataaattaatttgaactgggaacatattagttctcaaaacgggctgggcatgtcacatacagtcacatacacgggttacggacttacagactaaaaaaaccgtaaaacccgaatcactaaaaatctgtatcgatcaaaaaatgcggattatcggcgactgaccggtaaaaacccgtatacgggtctgtccatattcggtctctaattatgtggtcttattactgtttgattaatttctgtatttagcgctttggtctgattttgcgcttcgttcccgcaacccgcacggagctgcgcttggtccattagctgatgctgctccatcaacttttcaacggttataa

SEQ ID NO: 82955 - DNA, 313 bp, Heterodera glycines
  Genomic contig location: Contig_ID=SeqID_18354; Location=120..432; Strand=-
  SCN-specific regions: Sequence locations=1-133,170-272,302-313
atgcccatttccgacttcaaaatgcatctttggccggccgacttcacaattatgccatggacaaattaccagcacttgggcgccaggaattattgccaatttatggcagtatttgtgcccaaattttggttgcaaattttttaatgaaattctattttttataatttttcaggtccagcccacttccttggttagccccttggcccaaggatcgttggatatttttatgccagacaaaggcatcattttttaattcagagaatttacatttgttttttaatttattttaattattttaaatgtttggaataaa

SEQ ID NO: 82956 - DNA, 968 bp, Heterodera glycines
  Genomic contig location: Contig_ID=SeqID_18355; Location=320..1287; Strand=+
  SCN-specific regions: Sequence locations=1-109,131-281,303-641,666 -707,729-812,835-968
  Gene Ontology: Biological process=reproduction
atggaacgtcacgtgttccccgatgtgagtgactttctgttgcttttcaatttatcccaaaaaataaaaataaattcccgcgtccgataattacaattattacatcatcaattaatgaattaattgacgaattaatacttaattgaatttcgatggggaaagggcagtgtccgtcgttttcccgtgcattcgcacctttcccttccatcggtcgcaaattttcaattaatcaaacggcgaaggacgaaaaagcgtcgaacattcttttaaatttaacaagaaaaaagaaggcatcaaagaataaatttgggaggaaaagaaatttaaaaaacaaataaaaaatagtaaaaaaggaaaatgaaaaaacagctgatcggccgatcaaaaaccaattggtcttatcagccgatcactgatcaatcagtgtttgatcgttgtcagatgaattggtccacttacttcggctggttggtccccgacgaaatgcgtccctacgtggcctccgacccggaagttgtgctggccgagccggcgtatttcgtccgattggcccatttgctgcgccggacggacaaacgaattatcgccaattacgtcctttggcgttatgcctccgcgtggtctttccaggcgagtggcgcaaaatttaaatttaatttaaaaatgcaaatggaattaaattatccaattttatttgaacttatttcgttttattaaataaatttttggtcattttcagatggacgaacgctatgacgacattcagcaggtaaagcaattattattctcgtggaaaaactaattgacgacatttcaggactttctgaaggcctttttgggcaaacagagcaaaagcccgcgatggaaagactgcagcagttcggtgtcccagagaatgagctatgctagcggggcgatgtacgtgcggaagcatttaacaagaagagcaaaacggccgcatggaaatg

SEQ ID NO: 82957 - DNA, 670 bp, Heterodera glycines
  Genomic contig location: Contig_ID=SeqID_18356; Location=1..670; Strand=+
  SCN-specific regions: Sequence locations=1-287,310-670
  Gene Ontology: Mol. function=endothelin-converting enzyme activity; Cellular component=Golgi apparatus; Biological process=reproduction
agtgattggccatgagatcacccacggcttcgatgaccaggggcacaatcgacggcattgcaacctcaaagattggtggacccgaacacgcagcagcacttgtggagcgaaaggtgtgaattggcaaatttgaattgaatgagcaaatggaatttggtaattgcagcggtgcatcatcgaccaatattcttcctttgaagtgcccgacataaatttgcacgtcaatggcattttgacgcagggcgaaaacattgcggacaatgggggcattaagcaagcttaccaagtaaaagggaggggaagggaacagcaaaatgagggaaaatggtaattaaggcttacaaaacatatctgaacaaattgggacgggaggagaagcggttgcccggctttgagcggtacaacaacgagcagatcttcttcatcagttttgctcagacgtggtgcggacatacgaagccggagacggtaagcggaaggcaggcaggcattccggacaaacattcattggcattggcacgctcagctgatccgacaaattctgaccgacccccactcgccctaccgctaccgcgtcaacggcgtcgtggccaatcagcccgaattcacccgcgcctttggctgccccgccggcgcccggatgaacccggcacggcggtgttcggtgtgg

SEQ ID NO: 82958 - DNA, 1616 bp, Heterodera glycines
  Genomic contig location: Contig_ID=SeqID_18359; Location=719..2334; Strand=+
  SCN-specific regions: Sequence locations=1-267,330-341,394-878,901 -1270,1292-1525,1547-1616
atgacaatttatgcggccggccttgttgaagacccattcgcattctttcacagttcctctctggtggcgaagtggttgttttgcctccctgaggtacgctggttgaacgcctaattgagcaatggtatttactagagatcggatacgggccggacccgtatacgggtttttacggacccgtagcagtcaattcgccaaaactttgaaattgggcggtcaatttcgtaaaattttcggtgaaaatcgaaaaagcattggtaaatattggaaaatttatgtaatttgaaaagaaatcaattatttctgtaccaaaaattttttaagttattgaatagctttcgtttaaattttttatgtaattcttttttattttttaagaaattcttttttttacgaattggatttgtaaattcttcaaaattataaatcattttaatgaaaaactgtcagcaaaattcatgaaatcagttaaaaatcgcaaatttggtcaatttttctattaaatctattaacaaattgcaatcaaattttaaaaaatttccgggaggcgcccaacggccaccgccggatgccaattgttgtatttttaaattttgttgcttaaaatttataacaaaagttattataatgtcttgtatttataaaccgatttttatcaaaaagaaaaaacccttacccgtatacggacccgtattatttttgaatacggggtttttacgggttaagggttttacgggtttttagcccttttcgaataacgaaaatttttagacctaaaattttttatcaagaaaaaaaattttggcaatcaatttttgagaaaatttttcaattcacagtggtgtattttctcaaaaattttcaagtcctttcttagggggtgtattttcccgattttattgcatttttgatgtaatttttgtgaaaaacgccaaaaaaggcatcaaaacggcaaaatgccaaaaaggcatttaaggcacgaaaatcccgaaaaagtcaaaaaaggcataataaaagtcaacgtagaagcctcaaaccaagtggaaattacgttttttatgcttaatgtcgtccgaatcgagagcaggtggtcgtccggagcggggttcatcttcgagctgctcattgccttcacgaaattttgtgaaccatcgcttaactgtagaaagagagagtgcatcattgccctcactttcacaaatatttcgaagagcttgggttggggtagaattttttcggaattcgtaaagtaacagttgtcttaggcgaattttgtccattttttgaaaatcgttcgattttgcaaaagtaatggctatacaacaaatgcaaatggcaaaaagatggccaaccgtccgctgattaatccaattgcttgcctccctttttcaatctctttagaattaaatatcattttttgcataatttgttttttcagagggtcagaactttttcaaacccaatatatcgaaacaggtgcgcagaaaaaaaaagcaatgcctcaaaatgcgagctctatattttatatatatcattatgtaaatatcagactttctgagtatatttcttactatttttaggtggtatattttatattgaaatgataaagtgaatta

SEQ ID NO: 82959 - DNA, 284 bp, Heterodera glycines
  Genomic contig location: Contig_ID=SeqID_18361; Location=2448..2731; Strand=-
  SCN-specific regions: Sequence locations=1-149,171-259,281-284
atgcgaatttcagacaagcgcctgatttccgaaggacttcaaaatgtaagtttcagttctcaaaaagaagaaataatctcccgtttagcgctatcgaagtgaccccgctttcgcagaaacgtctcatatgatcaccgcgctcgcatttgtgccaattcagcatttaactgctgcaattactgcgttgaacgatgtcgtgggacaagaactcgaccaaattctggggtggtaagttttgtcggaatttgccaatcatatggttattaatttaaaatgtaaataaa

SEQ ID NO: 82960 - DNA, 178 bp, Heterodera glycines
  Genomic contig location: Contig_ID=SeqID_18362; Location=129..306; Strand=-
  SCN-specific regions: Sequence locations=1-178
atgaatataatgagaattttctgctttcgattgattataaaaaccagggaaattatccatgaaattacttctacattaatttacaataacaaaaagtaattataaaaaaaaaattcatattcacaggacaaacgtgaaaaatcaggacacacaaaaccaatttattcgtccgttttaa

SEQ ID NO: 82961 - DNA, 1636 bp, Heterodera glycines
  Genomic contig location: Contig_ID=SeqID_18362; Location=399..2034; Strand=-
  SCN-specific regions: Sequence locations=1-9,31-299,322-502,524 -592,617-649,671-787,809-932,954-1091,1140-1452,1495-1636
atgctaatttatatttacaattgttttatcacaagctgtgccgatggtgcatctgcaacaaatatatggcaatggtattatacaaaaggcgcagtcagcggcacgaatttcacaacgggtttgggttgcaagccctatttgatcaacagcagcgaacctgacgaatcgttattctgcaaaaaagaatgtgacggtcaatcgccattcggttacagggagggccgaattttcagtgagtgtcaaaagttaatccaatacccctggacatcccaatcagctatggctgggaaaggcggttgaatattttaaataaattaaaatgatagatctgtcaagtcagccgtcgcgctggaatggattagaaaaaaaccgcgaagcggacatgatgatggagatttacgagaacggaccaatccaagttggtgttacagccaatagggctttgctctactatggcaaaagcaatggacggatcaatatttacgtggtaaggcaaaaacactgtaattccttgataaattttacttaggacaccctcgtcaatggtcccatttatgacgtaagtattgagaggattctttacgattttctcaaaatattttattgatattttcaacttgattagcgcattttctttaaaagccacgcattcaaattgattggatggggccatgaaacgcgagaggacggtgagattgtcaaatattggcttggcgtcaactcatggggaaccgagtaattgccatgatggatttagcagtttgtgttcaccaaaaaatgcctatttagttggggagaggagggactgttcaaatggcgtcgtgggacggacgaaagcaaaattgagtctgaaggcgttaactttggcactccatttgtttgagaaggccggccggctaaatgcgtgagaaggagcaacaagtcgatttgttgaagttgcatcaagaaaattgttgaataaatttattgaaaatttgactttcataaagggacggagtcgttaattaaaaaatatgaattttttttggtcataacaaaaaatcatcaataaatccaagaagaatgagatgtcatttcctaaaatctttcgctatttaaaacaaaaaatatacaataaattaattcaaataaaattttatggctaatgccaaattgtttttccatcttttaattaatgcataacttactccgatttcttaaaaaatttcggcataattttggcgccattgtttttttgaatattttcctttttgtttaaattttttggtcaatgaaatgaattttttcagaatgtcatttttttgttcatcacgtttgatttatgacttttaattttttggagaccaaattctctgatcaatttttgaatatatgtttgatttgtgcccaaactttttgcaattttcgtattaattttttccattcatttgttgaatattttctttctttttgtttaattttatcttttatttgaaaatattttcttattatttaccgtttcttctattcatttttcagtttttgttcattttcttcccatttttctccaaatatttcatcaaatgacttttgtttcaactttttcttttctgatccaatttgatcaattaaattgatcaaaagtaaaaataataaa

SEQ ID NO: 82962 - DNA, 1281 bp, Heterodera glycines
  Genomic contig location: Contig_ID=SeqID_18363; Location=261..1541; Strand=-
  SCN-specific regions: Sequence locations=1-52,74-96,192-264,286 -525,547-606,651-669,692-829,851-1027,1056-1281
atgaattccgtttcattaattgccacccggttatgtattgaagtaagtttacttatttagaatttctagtttacggcattgcctgcgccgaattcgttttaatgaaatttattatttataatttcatttattatcaatagattttcaaatggattattaaaattttattatcaattaattataatttttatgcctggataattcgattggaaggccctagtgttcactgttccctacagtgacctgccctctgacacgtgcatcactactactactaccaccttatcaaaacaagaaacgcaaaccgataaggacctgaaacgcaaagcattagtggaaaccggactaatggcctactccatgcaggacggcgcgcgtttgaagaaggccaaaaccgcaatcaatgtactcggaaacctccttttagcggaatcgctggacaacaaagtgacaaatagccctgtggacgaagagaatatgcaagatgagcgcagacaagaagatgatttaaaaatagttttatccttcttttatactttttggttttgtagtattatatatcttttcatgggattttattacgtaatccaatagttatttagttactatataaaaatttgtaattctataatttaaaataattatttaatgcacttcggtatttttttcaagacaattgtttaatccaatagaagctccttgtcacatctaagaattttgttcgtctatacgcccatccatattaaaaaaattttgtttttgcgtaataattttttacaaaatttttgttgtctaaatctacaaattaattttagttttggtgttttggtcattttaatttataaattgcacccattgacaaattcaattatcataataataattcttgatggtagaaatggtcttgatcaaaggaaatcgttaggagataatttaattttagtacaacttacttttatatgaaattaaagttttttaaagtcattttatattttatcttttcaatgacttgttcatattgtttatgatatttacttttttattttttttattttcctctttcatgatttccaacagttttaagctttattgaatattaaattttttttctaatcattgaattactaatttgttttatttttgtagccaatttttagaaatatttttctttatctttaattttactttaactttatcggttccattcttgtcccagtggttgcagttgtagaataatagattgtaatttttgtttttgcaatttttcatttgaataataaa

SEQ ID NO: 82963 - DNA, 698 bp, Heterodera glycines
  Genomic contig location: Contig_ID=SeqID_18364; Location=6..703; Strand=-
  SCN-specific regions: Sequence locations=1-698
atgggctggaagaaaacagttgatgattattacaccggaggtattaaaaaataacactacactagagacatgaaattttaaaagcatcattataaaaaaatccatttgagtcaattaaagaacggggtttttttgggggggggggggggagggcccgccggaccaatagtcggcgcatagggattttggattttaattcagtttggtaacgataaaataaaacaatttttgaaaactttcccaaaaactacaaaaagtctaaaaaaatagttaaagtctatatccttattttgaaaatattcgtcattggcctctcaaaaaaccacaaactgttgcgaataaataaggcttcatatttttgaaaccccactaaatcatttaaatttataaaacgtcatttttgtcccttcaacagcaaatggcaaaattagcaatgccggagtacggtacattttgaatacggtggtggacgaactgcaaaaggaccagcgtcggcgcttttcctacgccgagacgggctttttgacgcgatgggtggaggaaatggcgcccgatagggtggaacagctcagaaaattggtcgtcgaaaaaggcaatttcaacaataaagttaaaatcgtacctcaaccctcgttaatagaaaagttttaaaaaaaggcaagaaaggaagtacggtacttacaaatggctaaaataaa

SEQ ID NO: 82964 - DNA, 5191 bp, Heterodera glycines
  misc_feature (5059)..(5059): n is a, c, g, or t
  Genomic contig location: Contig_ID=SeqID_3049; Location=1..5191; Strand=-
  SCN-specific regions: Sequence locations=1-46,68-305,327-503,532 -1190,1212-1757,1779-1815,1840-1862,1931-2390,2424-2681,2703 -2881,2903-4187,4209-4227,4249-4884,4909-4929,4954-4976,4999-5191
  Gene Ontology: Mol. function=pre-mRNA splicing factor activity; Cellular component=nuclear matrix; Biological process=cell proliferation
caacgtgccctacggtgacctgccctccgacacgtgcaccactcctactcccaccaccaccaccacaacgcaaggaacgcaaaccgatatgcagcagcaggacctgaagcgcaaagctaaggtagcacttgatttagtggaagccgggctaatggccgatgccatgcaggacggcgtgcgttggaagaaggccaaaaccgcaatcagtgtactcgggaacctacttttagcggaatcgttggacaacaaagtgacaaacagtcctgtggaggaacagaattatgtccaggaagagcccagaagagacgaagaggaaaacaagaaggaccttggcgacattgacaaaacgctcgacgagttttttgatagtattaaagcttcgacctcaaacatgtaaatcattttgtccctaaaaatgcttaatacacaatcctttaccaataaagatatttgttttaaattgccgtttggtctaatcatttcgggtccctcctcatcgggaaaaactgaatttttgttaaaatttattgctgaagcggatcaattaatcacaccaaagcccgtctcaatgctctattgttttggtgaaatgaattcggcagtgcctccgcttcaaaaggcgggagtcgatgtgtattcgggagtcccatccgaagaattactcaaacgcctcccaaagcccctcttgctcattctcgatgacctaatgctgtccattgacgagaaatatttgtccgatttgttcactaaaaagtcacatcaccaccaatttgcggtggtgttcgtcactcaaaatttgtttgaacgtaaaatcaaagtggcccgcctgtccgctcagtacctggtgttgatgcgggcccctaattccctgttgtccattcgcaacattggcgtccaactctttccgcgtcagctcgactttttccttgatgcttatcgcaaagcgaccgcccgtccctatggctatttgctgattgatatgcacgctgcatcagatccgtcgttacggctgcgaaccaacatatttaaggatgagcaggagggtgaagacgaaggaacagttgtattcattcccaaaaatggagcggcataagcagcaacaagtaaagattggagagctgataaaacagaatcgcgactggttgtgtgctttggccaagacgaaatccggaaaaaaatgcaggaaacttatacgaaaagcaaacactgaacaactactatcgctggttgaaatttgtttgaatctcgtcgcttcgcgcttccaattgacaaccagacagaagaagcgactaatgccttatgtggatactgtacgccgaatcagcagagcgagaagtgaacggggtgccaagcgagtgcttgtccagaaaggcgcaggatttggcggattgttcgctgccctattgacacccgttctaatggaagtggcaaaatcctttgtgaacaaaaacgcataaatacctctcatcattgttgaattttgtgaattccattattcatttaacagagatggcaaataaatttttacttgtcccgcaagaaatttatcgtggtctcacctccatgtccaacacgggagacctaaatctggatgctgttcgacatgatttagaccgtgccagggtcgagcgaacacatcccagtacaaaaaatgtccattacaatcaacagcttaggcgatacttgaaaatgaggagggaacttgaagatagaccagccaaagttgagctgacgaaaggaataagtgtactgctaaggaaaggcggcgaagatgaagatggagaggttgtagacacagcaccccgacctcgcgccccgccaccacctcctcctccgcctgggagacgtcctcgacatggacctagtcctccggctcctcctccaccaccaacgccggctgggagaagttttcggcccccacccattcctccagctcccgctccttatcctccatcaagtcctccgcctcatccagaacgtcctcccagaccgagtagagctgctgcgccttctaggagagatagtcgattggagcaatggcataaaaggcgatctgatatacaacgacaacggccaattgtgcgagaccttcttgcggaagcagctgctgcgccattgcctgaaagtgatgatgaatatgattatatgctggagagtgggtttgcgctgccagcgccatcacagtattatggcgatttgcctgcgctgcccgacaacgcggacgaaattgaggagatggacactgctcagcgcaggattgctaccagaagaaaattaaaaaaggacgagacagatgatgccgatttacaaggtaaaagacataggacctatcgcccttcacctccacgactcccacttccacctcgtttgaaaacaaaagctgaactaaggcctcctccaccccctcctccacctccacgacgtccttccgtcaagatagaaaaaaaagaacaaaatttggtggaaatgaaagcctcgacgccaaagcaagccgaccaccctactccagcgcctcgggcgaatcgagagccaatgtccgggctcgaccctcgaccatccacatctagacaagccggttacttccctcccgcaacatacaaaatcgagccaaaacatgaaccgacaaagaggcccatgccgtaccgtatcccgaaaaaagagccaaaaagtaaagaaaagccaccacagacgcagcagcagcaacctcctcctgctgctgtcgtcgaagaaatgccctatgttcctccgcctaggagggggaccaaacgccactaccctgtaaatggtgatgatgaggtgcgcataagaaaacgagttaggcaaccgagaagggtaagagtacagtactcgcccgaaccgggtccatcaacatctgcacaaagtgatgaacaacagcaacaacgtgaactgtttgccattccatcaaatcagctgaccatgactcaacgggtggaacgactgtacatcaaatgcaaccgttacgcggatcgtatgggtgttcgggaaaatacaattaacacagcaaacggtaagccgttggcgcatagcaatttgcgaatggccatcaggtatataattgaccggagagcgggccgccccaccattagaccacctggagcggccatttttgaggagaggcttaggcaggacccaattttgtattcatggacggctccgccaaagaggccgtcaaagagcacgaccaccaggacggcaccgaaaatcaagaaggaatttcgtccgaaaaaatggagctgatcaacaccactcttgacaagctgtacaatagtccatcttccccggcggcgttcgcaggcgttacagcgttgtggaaagaggcgcgaaaaaagttgaaacatttacggaaaagggacgtgcagcattatttggagggtcaccgtacatacactctgatgcggccccggagggcacgctttccaagggcaaaaactgtagcagcgggattcatgaccgatgtccaggtggatttggccgattttcaagccctttcgcgtcacaatcggggtcaccgctacctcctcgttgcggttgacgtcctatccaaacgtttgtttgttgtaccgctgaaaaacaagagagccgaggagatgttggacgcatttaagcaactgatcgatcaaatgcccatggtcccccatcgcattttctccgacaaaggcacggaattcaagaacagattgatcaaggaatttttcgaggaacaggaaattgaaaagcacgagcccgtccattcgtccgtcaaagcttcggttgctgagcgggccattcggaatgtgaagcagcgattgtacaggtattttgcggaaaaggagacgttgaactgggtggatgcggtacagaaaattgtggacgggattaacagttcaccctctcgtgttcatgggatgcgcccgattgatgtcgacttttcaaatgcccaaaaagtgtggaagcgattatatgggcaccctgcaatacaaaaacggtcgccacgcttccgtaaagacgaatttgtgcgcatgagcagagagaagggacaatttgagaaaggatatttgccaaattatggggacgaaatcctggagattgatgaggtattgaaagcggtacgccctattcggtacaaactgagggatgaacatggagagaaattcaagggcagcttttatgagcaggagctggcgcgcgtaagaaaagatgcagacacaagctaccgtattgaaaaggtgtacagaaagagaaaaagagcagatgggtcctcagagatgcttgtaaaatttataggatatcccaatcgggaatggattcatgaatctcagcttgtataaaagcgatcacatttttcattttgttgttgataaacaataatgtcaaacagtttctttgtgtttttgccgagcaatgtaacggattatcccgacaatcagcccaacaaatttcgggtccgcctcccgaagcctttacattttaatggctcatgggtctgtgggctgcatagtattagttacccctactcatggtcaaccattggcacattggacgaccaatggattgacattcacttcaccgatcgccgtgctagtgatgaggacagacagcgggtgatcagagttccagtgcccagggcatcgcatagtaaggttgaacagctcagagattttttgactgtcactttgcgaaatcatagtggtgcaaagttgttgccactcccccgtgaggaggaagagaatcgcaatcggacaaaacctctcggttcgccaccccctttgaaaagagaaaaaagagctgcgtcatcgccagtgattaatgagagcggaaaacagcttgactcccccttattgtacgatggaaatgatcaaggtgggattgacgagtctccgcctcatcatgaagaagaagaagaagggacaattgatgagtctccgcctcatcatgaagaagaagaagaaggggcgattgaggagtcaccgccccattatgaggaaacaccaaaagaaactgtgaaaacgcccgtcacaccaaaagtgccgacaccaccgcctgccataagccctactanaccaacaatagtaaaaacgccagctcctccctctgatacaacaccatcgcctcccacaactgtaaagccaccagtaaccgtccctcctccaatcacaaaaccaataacgccggcccctcctccagccacaaa

SEQ ID NO: 82965 - DNA, 351 bp, Heterodera glycines
  Genomic contig location: Contig_ID=SeqID_3049; Location=5780..6130; Strand=-
  SCN-specific regions: Sequence locations=1-351
atggactcagcggaccgtcgctcacctacccccgacatggagctttgcgaattgtcatcctggtacgacattttgcaggatgacgacgacaacgtaaaaaatgttttttcatttttcattttcaaaaattattattccagattttaaattggttcacaccggtgacggctcgcgacgtttgccaggaggtgttagcatttgcacaagagcgccgcatgccgtttgaaaagattgttaaatggaagcaaattttggacaaaatttgtgctcagatcgcccaaaaaaagtgatcgttttgtgatcgaattcatttttaaattgatgcgctttttttggcactgttaaaataaa

SEQ ID NO: 82966 - DNA, 832 bp, Heterodera glycines
  Genomic contig location: Contig_ID=SeqID_18365; Location=528..1359; Strand=-
  SCN-specific regions: Sequence locations=1-56,78-349,371-832
  Gene Ontology: Mol. function=protein kinase A anchoring activity; Cellular component=integral to membrane; Biological process=eye photoreceptor cell development
atgcctggggaagagccgtcgcctcgtgccattttgactggacacgactcggaaatcagtggtgggtgggtgagaaatgcaaacagttttgctgcggcttggccccgggtgcataatcgtttaaatttaaaggcacttaattaatttggtttttttgtgctttagcaatttgcgtttcggctgagcatggcattgtcctctccggctccacggatggtgcccttctgatgcattccacgcagggggacctgctgcgcagcatcatctgctcaaacggcaacggaacggacacattggcaccaatcaacaacattctgttcagcagagactgttacattgcggtaattatttaaatgggggttgatttacatttctggcgaagtgccacgccctatccacctacaaaatgccaacccattaatttctttggcaaaattcattttaattaaaattgtttgaatgccccctcaaaggctttcattggcaacgattccctcgccaccttttcgaccaatggtcagctgctgaaacagcgcgggtacaaatgtgccgagaagattctctgtgccattttgtcccgtgacggagaattcgttgttttcggcactgacaatggccgcatttccatccttcggcttttcacgttgcaattgctctacacttttgccgtgagtattagctaacattgtggtggcgtgtgtcacaaatgccaactttagtgaaaatttgttcatttttttcatttcagcaatgcgacagtcctatccgttcgttggcactcagcacaaaccagcggctcatattcggcggcttggactccggggcaattgtg

SEQ ID NO: 82967 - DNA, 733 bp, Heterodera glycines
  Genomic contig location: Contig_ID=SeqID_18366; Location=139..871; Strand=-
  SCN-specific regions: Sequence locations=1-216,268-388,410-446,482 -532,581-733
atgcgaacagaagaaaagtgagatgaataattactcgcatttttaacttaatttataaaaggaattaaaattgttcaaaagaagctaggagggatgccaatgccggcggaaaaaagaagaaaagcactgttttgaagggaaactgacacggaaacggaaagccgtggggttgaagacaccgacccattcgggggataatatgtatttgtcaagcacttatatatttattattattaattatttaattaaattcatttattattttatgaaaatgataacgcttatgtgcaaaaatgaaaatgatgaataaaattgttaatttggtttatgtaaaaatgggctggcgttggtggtggtcgtcggatggtttatccgttactcgtcggaatgaatgaatgttttgattattcatcaatcagtgggcagaagcacttttaattcctttcaaataaaattattaatgagaatattaaaaaaaattggtttttattagactcgacattttgaaaaaagcagggcctggtccgggattccatgttggacttggacctggatttcctgggcaaaaatccaggtccagaaaaaatccaggctcctcgagacctggatccaggcctggacctggatttttcaactgaaatttcatcaaatatttcctgataaatagggctatccattgtatgaactataaatccgagaaatggtcaaatatgaattgaaaaaaaggattaaa

SEQ ID NO: 82968 - DNA, 754 bp, Heterodera glycines
  Genomic contig location: Contig_ID=SeqID_18366; Location=989..1742; Strand=+
  SCN-specific regions: Sequence locations=1-172,195-250,272-282,314 -644,666-754
atgcgaagagcgttcgcgggaagcgcatttcgagaccgaatacgtggcattggaccaatgcacgcgctggggcacggcgcagttgcggcacaattcgttcgcccttcgatttcaactgaccgggaaatgtgaaaatgggtcagcattaaaatctgggctccaagatctgaggattatcctcattttgtggttttttgataggtcaatgagggtttttttgaaatgaggatttttgtggctttttgagaaattttgaggcttttggagaaaagcgtaagaatctattaaattttatatttacttttaataaattggcataatgtttgacaatcatttaataatttgggtttttaatatatcttctaatattttgaaaaagtctgcatctgtattttttttactacataggttcaatatcagcaaaacgaaaatttagaattaaatgtgccacaaaacacaaaatgcttattgctaaaaaactgctcaaattgatcatggacaatcaaaaatataacatttgaacaatttaagagtgttttgaatgaattttgtaaaaatgcggctttttgacctaaaatgaggcttttgaaaattttaatctgggagccctgattaaaatgcttaacgattgaaaaatcccgggtcatatttcagcattttaatttgttatctcgggagtttggacccgagcggatcaaattgggcttatggcatgagtcctgaaattcaattccaagtgccgaaccaccaggaa

SEQ ID NO: 82969 - DNA, 555 bp, Heterodera glycines
  Genomic contig location: Contig_ID=SeqID_18367; Location=394..948; Strand=+
  SCN-specific regions: Sequence locations=1-88,125-305,345-555
atgagtcctgaaattcaattccaagtgccgaaccaccaggaagtaagtaatcactaatcaaatgccgggtacgaatatcgataatgtgaaaaattaattaaaattttaataaaataattatttactttcctttctcccactataattgaaaaattttgtttcattatcattttttaattttaatgatggttttctgtggtctttgtttggtggcggaaattcccaaggatcataaaatccgttttatggccgagtaaattggcacgaaaattgggagaaaaagtgggtggatttattataaacccacaaatggaaaagcagtaaattatgaaatgatttatcaactcatttgcaaatatttagagcaaagtggctgaagagtgtttggaatatcagaaaaaattcgacaaaaagataaaccaaatcgcaagtcattggcacggcgtccgcgtgagcgcgccgaaagcatttggcggcataatgatcgaattgtcaattgcaaaagaaaagtggaaattaaaaatggagttggaatgggacggagtcgctatttaa

SEQ ID NO: 82970 - DNA, 445 bp, Heterodera glycines
  Genomic contig location: Contig_ID=SeqID_18370; Location=77..521; Strand=+
  SCN-specific regions: Sequence locations=1-262,284-340,362-405,428-445
atggatggtaaaaaaaccgtcaaaactcattttatttttttgtcgttttgttattttccttttttctcaattttatgttagttctttgtttaactataaaaagaacaagaactttgaaaaagcaggtatcgcttcttcctcttccaaactaagcaatatcggtatcattcgaaagctttgagagcgtgactgtacaattggacagttgacaatccgacagtggaatcctacagtggtggacaatcggacaatggacaacccgacaataaattacactcaaagatatgaaaatgccgtcccgaaggcgatcgattgtgccgatctcaagaaaataggcaataaattatgagtttttggaataaccctaaaaatcaaacgaaagaaaaattgagagaaatacattataaaaactttgtttgaattaaaatataaatttaaacctcaa

SEQ ID NO: 82971 - DNA, 67 bp, Heterodera glycines
  Genomic contig location: Contig_ID=SeqID_18370; Location=1516..1582; Strand=+
  SCN-specific regions: Sequence locations=1-67
agagtgccacgggaccgggaattttgggcaaaaccgggaccgggactttccgggacctgagaagccg

SEQ ID NO: 82972 - DNA, 511 bp, Heterodera glycines
  Genomic contig location: Contig_ID=SeqID_18370; Location=2352..2862; Strand=+
  SCN-specific regions: Sequence locations=1-181,217-233,258-280,303-511
atggctgattcttctgctcctgttgataaagaggagccttgggtcaggcgctttccaccatacaggtgttcgatagaggttgaagagctcaatgaattctatgttcttcatcaacaagtcgtgcccaatcgtgttgtgccatgctgcgtggattgtgtcgaaattacggtaaaattcactcattaaaataaaaaaagacaaataatttttaaatttgtttgatagacatttataacaattttttaaaggacatattcgaataattttgaaaaaaatcaccttaaaataactaaaaacaaaactctcatttatgggattttaaattagattcgatcaaattcatttcattcataggaaattgctgcaattgcggttgagaaaataaacagcgatcggatcagtgaaggaatgaagcctttgaatcttgtcaggatcatccatgcaaccacacaatacgtttcgggcagaagcttttgtcttcaaatactttttaaacagacaaaggtaaatg

SEQ ID NO: 82973 - DNA, 696 bp, Heterodera glycines
  Genomic contig location: Contig_ID=SeqID_18370; Location=2700..3395; Strand=-
  SCN-specific regions: Sequence locations=1-132,154-504,526-696
atgagtgatttccacggtacaattctgtgggttttagcaacaaatttcaaatattggtatcattcggaagctctcaatgagaagaacatttttctaagaaaatgctaacttcattggacgcatgagaaaacgaaaaatataaaaagaattttccaagtagccgagaattggttcaaaaatagtttttttcaacaccgagaaaaatttcatttgagtagcgaaataggaccgaaccgaaaattagtttttaattcttaaatgaataacaccaattaaaatgctgtacaaaagtggcttttttatgctaaggcattaattatttaggccacactttgattgttaaaacctaaacccaaaagttgagtcaaaaatgagaccaaacaaaaagagttaattagtcgaaaatgatttcttcccgaaaatctttggtagagataaaaatattttttacgtaaaacttaaatcttttttaaatcttcaattttcagaagccaaataattgttgaaaattataaaaattttcaatcactcaccatttacctttgtctgtttaaaaagtatttgaagacaaaagcttctgcccgaaacgtattgtgtggttgcatggatgatcctgacaagattcaaaggcttcattccttcactgatccgatcgctgtttattttctcaaccgcaattgcagcaatttcctatga

SEQ ID NO: 82974 - DNA, 829 bp, Heterodera glycines
  Genomic contig location: Contig_ID=SeqID_18371; Location=41..869; Strand=-
  SCN-specific regions: Sequence locations=1-191,215-357,379-829
taattaaatccattccttcgggggaccgtgccgggtgccgcggggtaagcagtgctggttcgtttcatcacggcaccgaaccttttgctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgatttttt

SEQ ID NO: 82975 - DNA, 1449 bp, Heterodera glycines
  Genomic contig location: Contig_ID=SeqID_18372; Location=358..1806; Strand=-
  SCN-specific regions: Sequence locations=1-156,178-306,328-766,808 -1152,1174-1449
cttcatctccgccgattgttggctttgtgtgttcgatttgattacgccttctcaacttggcctcggaattgcgatgattagccacggatttgacttttacgtcgacgaacatttcaagacgcgcaaatggacatttggaaatattcgaattaacaacaaaattggagaaaatggccaaaagaaaatggaaattaccaattgccgttggaaatcgatgcaaattccgcaaaagccgttgccaaagaaagtcgtcggattcgaagacattttaataaggtgaaatgaatgatttattgtgttttctgtctgccattatttcattttcagacatatcaacaacagtgccatcgcttttcttcgccattttcgcccacttttcgctaaatgtcaaattaatttggccatgcgcacgaacagtcgccgcactttggagttcattttgcgcaacatttggccaatgatcgaaaaaaacattcatggctttgaattgcccgtcggaatttttcatcgtttgcgtcaattcaccccgtcacttctcaatgaatgtccatcacttcgcattgtcaaattatatggcttcgacgatttcttcactgaatttccggccgatgacaatgccacggcatcggatagacaagcggtggccaaatggcttttcactccccgtccggacaatgtgccaaaggtgctcaaatgctcgttgcttatggacatgggtgatggggttttgtcgccgagtattgaagccttaaaaacggtgcttaccattattaattaactaattaattaatgtattttttaattttaggcatttttcaatgcttcatctcccgtcaattttattgttatcgtttattctttcgatgactccgttgtgccattttatttgaccaacgaattgacacgggaacaattggcattgaaaaggattaactttagcaaccgtgttctgctgatccgttgtccaattgagcgagacgaaagcaaatgggccaaatgggaggaggaagcgattggatgggattgtttttaccagtggaatcaaattgacattcgaattgatgatggcgaaatagaggacggatcagtgtatgttttttttctaacattcaatttaggtatataattttttgatttttaggcttcttgacgaaactcctggcccaagtgatcagcaccaaaagtgacagaatgaattgctgagaagtgatcaaacaaaaatgaaagatggaattggataatgaatttgagtccatttaacgttataaaattgttcattttgttgcggtgatcacaaattgtattttatgtatgcctttaggataaatttagtgaattattgaaatcataattggctttaagtgtttaaaaaaagatttttgaggtccggcacgccgataggagacttttatcgagtcgagattgagatcgaaactcgcgagcattaaa

SEQ ID NO: 82976 - DNA, 318 bp, Heterodera glycines
  Genomic contig location: Contig_ID=SeqID_18374; Location=329..646; Strand=-
  SCN-specific regions: Sequence locations=1-318
atggcatattctaaggcaacgaaaagggacccagagaaagagaaaaagtgattaaatagagcaaagctaatactttaagaatatactaaaaaaatttttttaatttgtaatgatggaattattggagagccgagtttgaaaatggtctccaaaaatggaatttttcggaaccaccgctaacaaatttttgtaatgcgatctgaaaaaaaacttaattttcataattttgagtaattcaggcacgctgagtcgaaatatgtccttagatttgaatcttcgttctcactgagcctgtacagctccaacttcatgcattga

SEQ ID NO: 82977 - DNA, 390 bp, Heterodera glycines
  Genomic contig location: Contig_ID=SeqID_18375; Location=199..588; Strand=+
  SCN-specific regions: Sequence locations=1-191,215-390
atgagctgttttttctccccattggcgttgtattggtcgctgctgctgctctttccaggcaacgcttttgccaatttgaaatgccaaaatgcgatgacaaacgaagcatacgaagtgccgaatgacaatgtgctggtgaaactgttccaggatggcaaattgagcatcggcgaggagatgaagcagttcgtgtgtgatctaagcaagcagagcatggcgttggaagctgctgacacagacacatcagcacaattgacagagtgccaacaaccaatggcagcgcaacttatcccgaatttgcgcagtgccattcgaaaattgaccactgcgataaatgggggtaaaaatggcaccgtttacaataaaactgttaatccaaatttattttga

SEQ ID NO: 82978 - DNA, 1643 bp, Heterodera glycines
  Genomic contig location: Contig_ID=SeqID_18376; Location=670..2312; Strand=-
  SCN-specific regions: Sequence locations=1-438,462-975,1002-1221,1244- 1294,1316-1331,1353-1354,1376-1409
  Gene Ontology: Mol. function=acetylcholine receptor activity; Cellular component=nicotinic acetylcholine-gated receptor-channel complex; Biological process=memory
atggtatcgtaccccctcccgcttggccactgttttgctgccttttcatgtggctgacatcactccgcccacctccacctccgtgccgatcattgccgccttcttttccatttccatggtcattctcggctcttcgatcatcttcactttgctgatcataaatgtgcactttcgctctccacgaacccacaaaatgtccccttgggtattgttctgatcatcagcagagaagtgtgagcaaagggtgtgccattctcaacataagaacgtttattcattggacaagcccaccacggagcgcaccctttgcacatttggccaaacattcaaaaaacgatgctttgcctttggctattatctttttttctctctttctctgttaaggtccgtactatttttctcgaatggcttccgtggcttttgttgatgaaccgtcccggtaaacaattcaaaaaaccaaagcgaaaacggcgccgtgccctcgtcgctcgcgttccgttgcgcactgcgcccgcccaatgccatcagcgcgtgttcccggtccaactttgcaccagcgaatccaccaccagccgatcgaccctggttggcacgcgttctgtagcagccgaaaaacacatgttactccatgcagaaacaagtaatgaaatgggagggcgaaggggtgaaagggagtgattggacggaaaggaaaattagggagggagggagaggagattaagtagggtaattaaggagatagagagagggataatgatcaaacaacgagtagtgatcggagcatgttggattttttgattacaaaatgaatgagcaaatttttcagcggaacctttcgacgctttccttgacattggcaccgtcgaattgttgcgcggcacacttaggcaattaaaagcaaaaacaccgacaattgagcaaatcaaattcattcagagaactcagtgactttttgcttttgtcgcaacagataatggaggaggaagaggaggaggaggaggcgaaggccgactggcgattcatggcaatgtgagggaatgacagaatgggcagaagaaagaccccttaaatgacaggtccctggacagggcgtgccttttcttttacggtaggaccgaacgactaccgtaccgatcggattacagtaagaaatgcccaggtttcatttgctgtgctttgccactttggattttcgctgtgactcccgccgcgtcaaatgttacaatggaagcaatggacaaaagtgccttttgcgaatcgccatctttcgccgtttgaccattggcttctcatttctctttcatttttattaaaattcaaaaatggcaattttacaattttatttaataaaacaaatttgcttttctctcatcttaaccaactcttcgttcatccgttttcgcgttgtcctctctctctctctctgtctctctctctctccctctctctctctctctccctctctctttctccctctctttctctctctctctctctctctctttctccctctctttctctctctctctctctctcccactcttctctctctttctccctctctctctctttctctctctctctctttctctctctctatctctcccactcttctctctctttctccctctctctctctttct

SEQ ID NO: 82979 - DNA, 898 bp, Heterodera glycines
  Genomic contig location: Contig_ID=SeqID_18377; Location=1..898; Strand=-
  SCN-specific regions: Sequence locations=1-118,142-424,446-833,855-898
  Gene Ontology: Mol. function=acetylcholine receptor activity; Cellular component=nicotinic acetylcholine-gated receptor-channel complex; Biological process=synaptic transmission
atgggcagagatggtccgactacaaaatggtttgggacccgcgggagtacggtggcatcgaccgtatccgtttgccctccagcactttgtggaagcctgacgtcatcctgttcaacaggtgacagacagacagtcagatcaagcagattcggactccaaagcccatcaaattgatgacagtgccgatgaaaacttcgatgctcgctttgcggtaaattttgtggttgaccacgacggaagcattctgcagacgccgccggcaattatcaagtcgtcgtgccaaatcgacatcacttggtatggtttaagctgaaacttaaaagtgcacgtgccgacgccatttgatgccgttgtttaggttcccattcgacgaacaaatgtgtctgctgaaggtacagttcaataagcaaccaatgaaatgcaatcggatggctaacccaagccaattcttggccattccatacatttgccatgcaaattcgtggcaatcccatcccttgatcattccatccttggcatgccattttcagttcggctcgtggtcgcacacgcgaaattcgttggacttatgcgtcaatggcacttcgttggacatggtcaaagacagcatcggtgggaaaatgggaaaagcacgtgaaaataaaattgtaaacatttggtactgatcagatttgggttattatgtgcataacggagaatgggaagtgatcggtcggttttttctctttttgaccattcaaattcaaaacaaacgaagcaacgcccgtcaaaaaagtgcttcctccgtatggcgattccaatgacttcttcgtcgaattgcatttcgtagcgaattttttaaaattttaatcatttccatttcatcagttcattcacatccgtcgcaaaaccatttact

SEQ ID NO: 82980 - DNA, 339 bp, Heterodera glycines
  Genomic contig location: Contig_ID=SeqID_18379; Location=397..735; Strand=+
  SCN-specific regions: Sequence locations=1-41,66-339
atgaattttttaactttaatcattcttctactgataataccatgtgtatttggtcattatcaatgggttcaagtgttgttacgcctgtttcgttggattgtaccaagaacactaacgctatccgcgagtgtcgcatctgtcagaactgcagcttcatacagaactgcattatcaacgatcggccgtgcggcatctcacggcaaactaaaaattctggcatcaggatcagcgggacttggtggaggagcaggcggtacgatgctcttgatggagcttctcgagaaaaatcgcaacgacatcaaaggcagtcctgaattggacaaatcgagtaaacattaa

SEQ ID NO: 82981 - DNA, 946 bp, Heterodera glycines
  Genomic contig location: Contig_ID=SeqID_3051; Location=343..1288; Strand=-
  SCN-specific regions: Sequence locations=1-294,331-391,413-771,813-946
  Gene Ontology: Biological process=proteolysis and peptidolysis
atgctcgtcgaaatcactgagcgtgcgatggcacacagcggtaccgccgaggtgctcatcgtcggcggggtcggctgcaacgagcgactgcaacaaatgatggacacaatggcgcaggaacggggcgccaaactgttcgccaccgacgaacgcttttgcattgacaacggcgcaatgattgcgcaggtgtttttcagcaggggtgacacacagcaaagcacggcttctaatttgaccttttgttttttgtgcctctggggagtaatttgaccccttccccttttcgttccttccaaaattaaaaaaaaacaataattttttctttttttagagattttttcttagcataaattaaatttttcaaaatattgttcaaattaatagaaaagaacttcctttttaagatcgtgaaagaatttgaaaatacactaagaatatttatagggttttatgacaaattttctcatttttcttcacaaattttcaaaattccctttgaccaagcgtggcctttcctgttctcggcactgccgtttttaaagctgaaaccggtttaaaatttgcatttaacaaattgaatttcagccatgccccccgggggggggcattatccccggatagatctttgaagggttttctttgaaaaaatcattcgccatccaatttcaatgatttgttttttaggccggctgggaaatgtatcgtgccggactcagagcatcgcttgaccaggcaattaattcactcactcactaattgccatttttatcattttttatgaaaattactttttcagtgcacttacacacaacgttaccgcactgatcaggtgaatgtgtgttggaggaaatgatattttattactgcttttttgatgttttttaccaaattttccgtcacagattttttgtctttttttgttgttgtttttctcctttgaattaaa

SEQ ID NO: 82982 - DNA, 1824 bp, Heterodera glycines
  Genomic contig location: Contig_ID=SeqID_3052; Location=562..2385; Strand=-
  SCN-specific regions: Sequence locations=1-394,417-554,579-1222,1310 -1551,1583-1824
  Gene Ontology: Biological process=proteolysis and peptidolysis
atggtgtgcattttgggcattgaggggagtgccaacaaaattggcgttggcattgtgcgggacggcactgtgttggccaacccgagacggacattccatgccccgccgggccaaggctttcggcccaccgagacggctgtccaccaccgtcagcatattgtcagtttggtcatcgaggcactgcaggaggcgcaaatcaaggcaaactttttacgaaaaattttttttccgagtgctgaatttttaactttgtcctgcggaaaactaaccccaaaaaccaccaagaagcaaaaatttattttcaaagatgctcacaaatcgggaaaaaaaccccaaaaaaatctcccccccccttcgtgttaccaagccaaaatctcggaaatccaggtccaattttttgtttccaaatttaggggccctaacacaaacaattgttagccaggaaaggtttaataatagcccatttttcttgtcaaggatcccgtgttggagttggacgcgattgtctacacaaagggaccgggcatgggagcaccggtaaagcaaacaaaatcaaaatttaaatattttttattttagctgcaggtaaccaatgcaaatgatgctctcttctgttggtcattattttatgtggattttggggttgtacatgacaattatacgtaattacgagccgtaaatccatcctccttcccgaaaatggaatttttagaaatatattccattttcttccctcacccaatacggaaaattctttttactgaattgggtttttaactggatttactttgttgctaaaagcccggcatttgcccaagttttttgggttggtccgtgccggattttcgtaaaaatattggcatggcgttttttgaactttgttttacaatttttttgtgatggcgcgtatccctgtggtgccaatattttattcgttttgttaggtgggcgctgtggtggcgcgaacgcttggccaactgtgggcaaagccaattctgccggtcaaccattgcattggacacattgaaatgggccgtctgatcaccggtgccgagaatccggtgattttgtacgtcagcggcggaaacactcaggtgggcgagcagtttccctccccccccccccgcctttaccctcccccgaaatgtttttattagaaactatttagcatagaattaaaaaaaacattttttaatccggataaaattttcagcgatttttgaaatttttaatgaaaaattaataaattttatttacaaaaaaaatcgctgtaaaatttttattgaaatttcttttaaaaaaaaaaattcggaaagggcagaaacgtacaaaaaactttttttaagaaaaaatagaaatcattcgtcggatatcaaatttttttatattttacaaatgaatttttttctgccccaggtgatctcctacttgaaccattgctattgcatttttggcgaaacgttggacattgccgtcggcaactgtttgggtaatttttttgcaacaatttttgtttttttacatttctccttaatttagcattttcggccctaatttaaaaaaaaaaatttaaatttatttacccaaaactttgattttttgaaagatcgctttgcgcgtgtgctttgcctgtccaacgagccaagcccgggccacaacattgaacagttggccaagcagggcaccaagttctacccgttgccgtacgctgtcaagggcatggacctgtcactgtccggcattctgtcacacattgaaaaggcggcgcccgcgctcatccgctccggcgcgtacacagccgccgacctgtgctactcacttcag

SEQ ID NO: 82983 - DNA, 918 bp, Heterodera glycines
  Genomic contig location: Contig_ID=SeqID_3053; Location=286..1203; Strand=-
  SCN-specific regions: Sequence locations=1-39,61-232,254-497,526 -826,853-918
atgcatgaaataatgtatgctctagtcaagaagaaatatattatcaacaagaaaatgatattcattcattgccattttgttcgcccgtgcaataatggtacatatatacttctaatattttaaaagtttttttgtccgacttttcaaatgagggtttctcacctaattaaatggttgtaatgtaccgtatttactgaatacgagcccctggggactctatttttcaaaccccatcaaaaggaggtctttatttcagagggaggggagtctaatttagtaaatacggtactccccaagtttctgggtttttggagccctcattttactgtaaaaaagtggtgattactgttggctacagtaattgtgccagttaatatctccaaaattttctgtccgataaataaacataactctcttttttagagcattcaaatttctatttggtttgtttgatgagccctgtccgctccgtggttgcacatcgaacaaaagtgctttccatttacaaacatttgttgcgccgcttctgtgccgagtttgaactgtccgaccctgactatttgagccaacgaatccgtgacgaattcagagcaaacaaggaattgtccaacaaacaggcggagcacaaattgaaggtgggtggtggtgtggttatttacattcagaaatttgggagcgttccctccccgaaaattcaaaaaaatattgggcgtccgaatgattcaaacgaatctcacgggaaaccttaaattttaatgagatttgttaacagttgttgccctaaaaagttgtaagagttgaaatttaaatttttttgtgaaaatcctaaattaaaaaaaaataaattttttacccaattcaaattcccattttttgcagaaacttgagcagattgtgaagcagaagttggtcatctga

SEQ ID NO: 82984 - DNA, 2999 bp, Heterodera glycines
  misc_feature (2989)..(2989): n is a, c, g, or t
  Genomic contig location: Contig_ID=SeqID_3055; Location=212..3210; Strand=-
  SCN-specific regions: Sequence locations=1-296,326-845,867-913,936 -1056,1080-1788,1814-1817,1842-1975,2000-2642,2664-2999
tttttaataatggaaaattcgtccaaataagtcataaaccccaaaaggtgcactcgtgcccggtcaaatgccttgaatggtgtggtccaaacgcgttcatttcggctgcctatttgtcctcgttgagtgcctcgtcctccaccgtccgcaacgacattttcatcactgacattcgaacgggaaccaaacgacgagtacggcccgaacaggaggagggccctgttgaactgctccgtgtcagtcattacgggtccgtttttggggtggacaaatgaaagcagcaatatggcaaaatcttataaattaaaaataaataaataaaaatcagagacagggaaattttgaaacagacggaaccgggatttgatattggagtggaatttccaggagctttatcagtcccattttccatggtcccggtcccgatccaatgaagcggaaaaagaggaacaattttaaacttgaacaaccttttctaacaaaattcattaaatttcgaaacttttcacttgcggtcactaaaaatccttatttctcttggaaaaaattggctcaaaatcgtctaattttttaacatattcattaaattgcactttttcagctgttacttggccatttcgtttcgcagtgatccgttggaaatttgggatttgaacacttttcggctgctccgtcggatgtccaaaaagtgtccagtgattgtggacatggcctggtccaccaagcaccaccaggtcaagctggtcaacgagaagacgcaaatccatagggaaaacttggtcgtgttggacaacaacaatttgctgtacacaatttacatatttctctttacatattattcattagaaatgaaaaaattgcaagttggattttttttttaattttcaagcctagcgtaagaaattttattccatttttaatggtttataaaaaatttagttaccatgttgttgtcaagggtttacatgtgcgagatgggaaggaagtgagcacacaggtggtttacttagagatacattatataaaaaatcatgggaaataagaaaatacaccctcaaaaaaaaaaaaattttttttttgccagtttgatactttttcatggcaatattgataaagagcaacaatatctgtttataatttgttgtattaaagtggaaatccggcgccgcattgcttcgctgtatggtgtggaaggacgacgtgttggcatttggggacagtgccggccgagttggagtttgggacttggccaggtatttgtacaatgtttgaattcggatttttaattttttgaggagtcaatgtcgtcagacgggccttagtcagtccacacggggcccagtccaacgggtggtgttctcacggcttacgggtgactacacacttgcggtaagttcagtcccgtacgtaccacgggggaaatggaagaattactacaaaaaatctcaaaaaatagccaatttttttgcgattgttgctgttttgctaacaaaatcttgctaattttcacctcgattcccatgaattaaattttccttctagctagcattaaatgattttcgaaaattcaaaaaaaaaatttactaaatttaggcccagcatccaacctctgttgtagtgtgggacactgaacggttgcagtcgctgttttcactgcaaaaaccgggccacagcatcatcgacattgacatgtgcggactgaatccgggtactcaattatactatagttttttctatttgttttttaattggttttctctgactgtctgtcaactctctccctcttcggcccttttttctctctcccactcactctcaaatttaaatataaaaaataaaaacatttagtgtacatagcctctgatgggatgtttcgttttgcattttcggacacggatgagaaaagtcgcaccaacaacaccaacctgaacacatcgccgccactcatcaaatccggtcccgattttgtgacatcaaatttttttaaatatttttttttgttgtcagacattcccctgttgttgcgcccgtcgtactgtcaagcattgctgtcgttgttgtcaactgacacaccaccggcggcggtggcggaacagaacaacaacgacgacacaaccaccaagtccaaccaagaaaatgctgtcccatttggtattgaccatgatggccaccaattgcacacatttgacgaccccgacattgaccatttgatcaaccgtttgtccgcaaaatgctgccgaacaccgttagaccgtgccattgtcctccaccaatttgtcggccaacaatgtttggctgaccttggccggattgtccaatgtgcggcgacgacgacaatttctaccgctggagatgacgcagcaaatcgaccgccaccgccacaattgcgtcagccaatgttgccaccgaatttgatgcttttttggcccaaaaaagcgtaccaagtttgtggcattcgaggccccgaaaatttacagaaattggaattcgtgccaacctttgtgtgtagtaagtacacttaaacgggttgttttttgaaagtgtggtgtccaacttttgatcacctgccatttgtactgaaattctttttgttgattgtgagacggattggcgtagccatggaaatctttggcatcattttgaaagatcatttttattcatttttacagaaacgcgttgaacgcttcacccgcttgctgctgtccacatttcgcacagaacggcaattggaaatggccattgagaaatgcgtgattatgcgaaaggtcacattttcaatggcaattttacgtttttagaccggaatttcgaaaataaaaatttttttgcttcggtactcacttttccctcatttcattgggccttttccatcattttattccccgaaatatcttcagaaattaaacacgacttgttcagaatgacttggcactttattacctgctcaacaatgaccaattggcgttcggcggtggcgccgcaaccgccngcgcgtggcg

SEQ ID NO: 82985 - DNA, 1268 bp, Heterodera glycines
  Genomic contig location: Contig_ID=SeqID_18380; Location=293..1560; Strand=+
  SCN-specific regions: Sequence locations=1-158,180-299,322-495,519 -1100,1122-1140,1182-1247
atgtcgtttcttaatgttccagagattctaaagcaaaaattaatcgaagttgaagggactttgaaagcaatatcgcctcaatcttcgcatggagagagtttgccagcaccagcgcaatatgctgaacctttgtcctttaaaaagggacgtttcttattatggaaaggtgtttgcattgtgttgttttagtataaaccaaacatttgcaggtgtcgagactggctttctttatctcactgggcatcccaaccccggttcattgactgtctacgactataaaaacggaacggctaacgccgtactttgcttcagccatcaatttggccccacagctctcatcatcgacgccatttactttccgcttagcactgaccacccgggcattttggttgcggttacggaccgctctatggaccaacacggcgactatttggcctatttttcgctcctttcacatacccttttgaatgctttttatgtgccacaaccaataacgtccatctgttcaattctcgatggaagtgcacaaagggatcaatttttgaggctgtctaattcattccacaaagtgtttttggaattattggattatgcaataatctgttaaggattggccacacattttgctcgttggttgccgttacggcgatgtcattttagtttatttggacttgcaaacgcaaaagttgtctactgaagcagttcaaaaatccaattcaccatctacagcattgtcgactaaaactgaagagattcggccgattcgttgtaaaaagaatgtgcacttaacgagttgagttactttcctgaatttgatttattttcaaatttagaaattttttacgaagacaaaatgtttgttttccgagccgacgatggaacgaccaaatgtttagcaaagggtaaatgctgataaatggaaaaagccaatgtttaatccagaaaaggtgatggtctccgcattgcattgggaggaaaagtgcggtttggttttggtcggtttcaatttcggcggagtgatggccgtgtcgctgcgcacttcgaaagtctattcgctgctttacatcgatggctctgtgcttaattttgcgttccaagagcccgaagaagacccaaggcccatcctttttctgtggatagctttttcttcccctcggttattttgccattttctaaaccatttttattaattcgtcgttccttatcgtttagcagtggaacttctttgcttttatgcaatgttaactttccaaaagatgaagaaagaa

SEQ ID NO: 82986 - DNA, 761 bp, Heterodera glycines
  Genomic contig location: Contig_ID=SeqID_18385; Location=650..1410; Strand=-
  SCN-specific regions: Sequence locations=1-139,161-761
atgtactatagctattttctttgtcctaccattgtggtatcattcgtaatggacggttcagtcccacaggcatttggccacttgagtcccggatctgtaactctaagtgttatattaattcaggtagacgagataatggagcaaattatgtttcaaatgttagccactcacccgtcagacatgaatcgagagacgattgggcctcgggtgctggcggtcaggggttagttggttaaggaaattggtccaagcgaagaaaaaacgggaaatagtggaagacaaattacaaatacatacggaataatttaatcacagctttttttgggtgggccatttgtcccttgtaaatatgaacaaaaaaatgaaaatgttcaaataaataattcacacatttttaagccgtgccctccctgctaagggcgatattttgtagattttcaagtttattacgaatcattttgttcgatcaatgaataacaaaatctgaagacaaaaaacagcatatattttaaccgaatttgagatttttcttattcgggtgggtcgaaggttaggaaatgggttatataaatgtcgtattcgtattcagcgaccccgaataccttaatttagacccattttccggctttttaatagctttttcgagttttggacacttcgtgggtttttattcttttggacatttcgtggcttggacattttgtgcatttttgcttatacgagttgtcttcgtggtatagtgaagcgattttgtgaataaa

SEQ ID NO: 82987 - DNA, 282 bp, Heterodera glycines
  Genomic contig location: Contig_ID=SeqID_18385; Location=1658..1939; Strand=+
  SCN-specific regions: Sequence locations=1-218,244-244
atgaacttacaatttttggttttccgattagccccgggcaattgtcggccatcaaaatttcaaaaaaatcattggccaaaacttttcggccgtccacgccgacgaatgcctcgtagtggccatgggtgagtaccgccacaattgcgctaaagaaatttgtcaaaatctttcaggagcgccagatgttgggactcggaatgggccgggtggggtatctcaaactcaaacttgggtaattaaacctttatacttatttgataaaaatacaattaaaatatgaaa

SEQ ID NO: 82988 - DNA, 1532 bp, Heterodera glycines
  Genomic contig location: Contig_ID=SeqID_18386; Location=469..2000; Strand=+
  SCN-specific regions: Sequence locations=1-227,249-805,829-1308,1330 -1465,1488-1532
  Gene Ontology: Mol. function=DNA binding; Cellular component=nucleus; Biological process=locomotory behavior
atgtcaaacctttcgggctcggatcagcagcatgccactccaaatcaaccggggggccaacaatttggtgccatccaacagcctttgtggtctcaactggcaccacaaaatcaattttttggagccattccgccgccatcacatcaattcactgcgccaccaccatcagtacagcatgttgctgctggcgggggcgtgcaaccgccacagcaatttcccgggcccattgctggtggtggtgctggtagtgtgcaaccacagcaaccgcagcagcattcgcaattttttggaggcattccgccacagcaattcactgggcccgttgctggtagtgttcaaccacagcaaccgcagcagcattcgcaattttttggaggcattccgccacagcaatccaccgggcccgttgctggtagtgtgcaaccacagcaaccgcagcagcattcgcaattttttggaggcattccaccacagcaattcaccgggccacaaccgttgccgcatgttgctgggggtgttcagcagcaacaacaattttttggcgggtttcagccgaggcaatttggcgttcacccggttcgcccgtatccccaatttggcactgcacagcaatttggtaattgttgtgaactgaaattcaaagttattcggcaatttcagttggacagcacaacccaaaattggatcatcaattttttgcgcattcaaatgcctcgggtgtgccgcaacgcccttttatgccaccaccaccgcaataccaccacccgcaatatcaaagcggagtaaatacacaatttttttttgcaaaaaaaataaataaattttttagggatatttgccaaacattgcacaattttgtgttgatggaacaacgagcactgcgtttctcaacggttgcgtcgacactttcaaccgggttcttccgtaatttactcctttttttggtttaaattatgctttttatattacagccctgttcgtctgtcggttattgttgttgattttcgagagcgacagtcaacccccgctggagaattgccggttgcaaatgttttgcttggaaacgcggagggggcccggattgaggcgtcagcgtggcgccaacaggccgaattgtttgccatgctgcgcataggagacacgtactctttcttcaactgccgaacattgccaccgagaatgattgcaaatggcgtgtggtttcgtttgggactcaacctggcttcatacattgaccagcaacatgtaatgttttttcaaatttttttttaccgtttaaaggacctgacgaaaaaataagtggagtataaaaaagaaattgtttttagtttgtaggggtaaaactgatcaccggcatttattttcgatttattattataagattacaaaaaaaaagggtccattaatctgcaaatgtcaattttttttacatttacaaaaaaaaaaatagtttttgtcgttgcccccaccgccgccgccgcaacaacaacagggaaatgagtcggcagcggagagtcgccctgtggtgaaca

SEQ ID NO: 82989 - DNA, 999 bp, Heterodera glycines
  Genomic contig location: Contig_ID=SeqID_18388; Location=142..1140; Strand=+
  SCN-specific regions: Sequence locations=1-27,52-999
atgtcaaaacattttggtcatcaccaaccatttactttttataaagccaaatttctcgaaaaggctagtggtgttaaacttatgcacctgaccgtaacaaaaaaaatcatttttattatttttttgttttttcattccctaatcaatacacatggagcatcatcaatacccttaattttctcagaactaaaagtcagttttagaaaagacgaaatttgtttattagacaattattcatttcgtattatgactaatttaattggagaagaggaagcgccgacggaaatgcaacggtcgtccagtgaaacatgtaaaaatcacaaaaaataacatccaattttcaattttattttgttttgttttcaaaggctccgaatcgtttcacagcaaatttatgcaaaagcggcgcttcgttgagtaaaaaagactttgtcaagaaggaaatcgttggtttggttgttttggtggccatttccgtcctcctcttcctttttttgctgtttgggcgtcaatttgcggtgagttttgtgattttattttaattttcaacaattttaatggaaatttctcttttttcagtccgaagagacgaaaacatttgatcatcagaaagcatttgacgagttggagaagaacattttggcaaagctggaacaaatggacatgaaactgggctcaaatgcgcaaggatggtcctcgtttttgatgaaaagcgttggcattggcatcggcgcagtgattttcctgcaaattgccaaacggatcattcactcgcacaccaaaaagggcgtccgacgtcatggccaatttctgtttcggatgaccgacttcaaagcgttttcgcagggcaacgggccgaaggaagtgaaaagtgacacgattgggtacatcaacggaatgccatggcaaattgcgattcaaaacaacggagcaagcatcggcctgtttctgaactgttcctccctgaagattcgtaagtgcgatccaattggaagctga

SEQ ID NO: 82990 - DNA, 58 bp, Heterodera glycines
  Genomic contig location: Contig_ID=SeqID_18389; Location=570..627; Strand=+
  SCN-specific regions: Sequence locations=1-58
ttttacgcgtcccatcacattttacgcgtcccaacaacagtttacgcgtcccatgaca

SEQ ID NO: 82991 - DNA, 194 bp, Heterodera glycines
  Genomic contig location: Contig_ID=SeqID_18391; Location=273..466; Strand=+
  SCN-specific regions: Sequence locations=1-1,47-76,98-105,132-194
gaatttttttttaaatttttaaaatttttttgaatttttaaaatttcccggttggtcccggttcccggtttttcttgcggtcccggtcccggtcccgaagaaaaatcgaggtcccggtcccggtcccggcttctcaggtcccggcaagtcccggtcccggttttggcaaaaattcccggtcccgtggcactcta

SEQ ID NO: 82992 - DNA, 512 bp, Heterodera glycines
  Genomic contig location: Contig_ID=SeqID_18392; Location=46..557; Strand=-
  SCN-specific regions: Sequence locations=1-35,57-512
atgtgcccaaaggttgagaaaatggcggtaatagaaaaaggaatggagaaagagacgggtgaccgaccgaccacacatttgaaggagtgtccgatgacaacgccggcggggattttccagggatttgacgagggcgaagacggacaaagggaggcggggccacgagcggtggacaaattattgccattggttgtcgaatttgtaggtcttaaccattgattaacggatgagtaaacgaaattgcaaatgctttttcagatgctggagaatgaggtgggatttgagggggagcggggaatgatcggctcaatggcaactcggacaaaaggcaactcatattttacaaaataaggcctaagcttaagcctagacccaagcaagcctaagcctaggcctagcttaaagcctaggcctaactcagaaattgtacgagttgtcatgacaccaactgatctggtgaaaaatccgatcgggaaattttattgctcagcccaatgaattggaaaattaaa

SEQ ID NO: 82993 - DNA, 3035 bp, Heterodera glycines
  Genomic contig location: Contig_ID=SeqID_3057; Location=128..3162; Strand=+
  SCN-specific regions: Sequence locations=1-101,123-126,148-285,309 -479,501-963,986-1404,1426-2622,2655-3035
atggaaaaccgtcctccaaaacgcccattcccattcactattaatgatattctcaccaccccgccaccacccaaaacattacagcaaggcttcctcatcaatcagctgcttggtctcaccgttcaggagggtgaaggggccgagagctcatccaacaaaaaactacccagcgaatttgttgaaaagctggagtgcagcgttgaacatgttgccaaatttaactacacgaaagtcaaatcgagcttcgtcatccgggatgtgccagccgatcccgaaagtcttctttcctccatattcaagcactgcattgacgaagcaaaaagcgacagccgtgagaagagcagcgaaccaacacaccttggatgcctgatcagcagtgcattattggatggcggtgatgtttttgtacccgtgcgccaaataactgccaacacaatcgacgccattctgaatctgttcaccaaagttgcgcagtcaaaacaacagaaaggtgttaccctatggggagagccgttcaccattaccataacaacaattgatcgcagcggacttccggtgaaacggcacatcaaagggggcgccagacgtcgtttgacacacgttcagcaccaagtgcatgagaagtgcttgatcaaggtgaagcgtacaacttatttattatatcatcgactgacaatttaagatcaataaccaaaactgggacaacagtgacaacaattattgccttttctatgctctacaggcaacaatggtatcaaagacacgcggatggccgagctggaaattttttcgctacataaacgatcaatttggacaacgcggattgttacaccaagaaactgttcaactgatgcggcaaatcaaagtgccactggatttggacgcatacgatgccgacacttatgtgccgctggtcatcaaccactggaataacgcgcaacagcggcatcgctttgccgttttcatctttggaacaaccggccactacaagccgctttacaaatacggcaacgacgattacgatacaccattggttctatattttaacaacactcatttcgacgatgtacatttcctcagcggactttttggtggaaaaaagtattgcctggagtgcgagaagccttataagaagccgtcggaacacaaccagacctgcaaagcgcactgtctgatgtgctcgcgtgttggacctgcgtttccgtgtccctcggagcctgacttcttccgaaaatgcaaagaatgccacaaaaacttcaacaacgcgggatgctacaatcaccatcttcaatccaactactgtaaacgttcaaagaagtgcaaagactgtggtgtaatttggaatgttgccgacaacaacagacgggggcgaaagggacatgtgtgcggtgaaaaattctgtcaactctgcaacaacttccacagcacagagcgcggctgcttcattgcaccacttgagcccaaggatgagatggaagcttatcgattcgtggcgtttgacctcgagacgatgcaacacctgcctgctgaccctcatctgcctgaacgacgcaaccacgagcccaacttcatagcagcaaaggtgtcttgtcccatgtgcattgaaaatggcaggtggaagcaaggaactgccggatgttggatatgcggcccacaccgaaccgttgctttctgccaacgaccatttaccgacactccggttgacaagcaagtggtcaccgacaaccccatgcaagcatttgttggttggctgatcaacgacttgccgatcaaggccaacaccttcgcctactcacattttggtggccgtttcgacatggtcatcacattccgggagctgttccgtcgcggatataacccggagatgatcagacgggtgagtatgtttttacatatattttattctgataaacaaattaagggcaataaaatgtatgaaatgaagctgagggcgcagaagaaccgacaccccaacatcgtcttccgagattcgttcaatttgatgccctgtgcgctaggtcagctggtccccgcctacggcttggacgtcgaagagaagccattcttcccgcatatggtcaaccgtccggacaactatggccgcgaaatttttccgacccccgacgactacctcgcccatggaatgatgccagaaaagagacgacagtttgacaactggtacgaacaacatcggagtgaaccattttttctggacgaggcattggccagctactgcaccaatgacgtggagatcttaatggcagcgctggtggcatttcggcgggagttcttggaaatcacaagacgtcaagaacctgtggacggccgtgaaacgcacaacggaattgatgttctgaagcagtgcatgacaatcgccagcgcctgcatgaagcacttcaggacaaatcatcttcctgctggtcatttggccatcgtaccggaaagaggctacgacaacgcccaaaaccagtccctgttggcccttcgcttcttcaaatggtatgcagagaagcacggagtgcagctgcagactgcccactcggcaggcggagagaagagagtcgccaactactctctcgacgcttggatcgaagcggagaagagggccattgaagtgaacggtaatttttacaaaaaaaatttttttttttaatgacagcaaaatttgtgtaggctgtgtgtggcacggatgcagcaaatgcttcccggaggacaacatgcttctgcccaatgggaaatcggctggagaagtgcgggagcgagacgcgaaacgactggaatttttgcgaaaccaagtgggcgttgtggacgtctactgggaatgcgagatcgagcgaatgctggcgtcagacccggagatgcgccaggcctttgcaggctacgtggatgacggaccactggagatccgtgctgcattcatgggcgggcgcactggcccgctcaaactcttccacaaagcgcgggaaggcgaaaaaatctcgtattacgacttcacgtcgctctatccattcatcaagtcatttttgatcagttga

SEQ ID NO: 82994 - DNA, 2474 bp, Heterodera glycines
  Genomic contig location: Contig_ID=SeqID_3057; Location=5238..7711; Strand=+
  SCN-specific regions: Sequence locations=1-476,510-1512,1535 -1691,1717-1836,1858-2430,2461-2474
atgccagaaaagagacgacagtttaacaactggtacgaacaacatcggagtgaaccattttttctggacgaggcattggccagctactgcaccaatgacgtggagatcttaatggcagcgctggtggcatttcggcgggagttcttgcaaatcacaagacgtcaagaacctgtggacggccgtgaaacgcacaacggaattgatgttctgaagcagtgcatgacaatcgccagcgcctgcatgaagcacttcaggacaaatcatcttcctgctgatcatttggccatcgtaccggaaagaggctacgacaacgcccaaaaccagtccctgttggcccttcgcttcttcaaatggtatgcagagaagcacggagtgcagctgcagactgcccactcggcaggcggagagaagagagtcgccaactactctctcgacgcttggatcgaagcggagaagagggccattgaagtgaacggtaatttttacaaaaaaaaaaaattttttttaatgacagcaaaatttgtgtaggctgtgtgtggcacggatgcagcaaatgcttcccggaggacaacatgcttctgcccaatgggaaatcggctggagaagtgcgggagcgagacgcgaaacgactggaatttttgcgaaaccaagtgggcgttgtggacgtctactgggaatgcgagatcgagcgaatgctggcgtcagacccggagatgcgccaggcctttgcaggctacgtggatgacggaccacaggagatccgtgccgcattcatgggcgggcgcactggcccgctcaaactcttccacaaagcgcgggaaggcgaaaaaatctcgtattacgacttcacgtcgctctatccattcatcaagtcatttttgatcagttgaactaaatttgttattacatgacattattttagttttaccacgcgctacccaattggtcacccaaaggtgcacgttctgaatgaggaagtggaatggaagtgcgcaacggacaacccctacgatttgtcgctgctcaaagtttgggtcatcccgccgcgtcaatgtgatgtgcccgtcttgccggtcaaagtggatgacaggctgtgttttccgctgtgctacaaatgcgccaaaaaatacccgactggcggtgttgacaacgactaccattgtcggcattccgatgaacaacgcggttgggtcagcacctgcacctcgcttgagctgaacgccgcactggacgaaggctaccgtgtcaccaaagtgttccgggtgttacaatatgagcagagcgacgaccaactcttccgttcctatatctccgagttcatggcgttgaaaatccaggcgagcggcttcgactccagcatcaaagggaataccgaaatggagcaagagtttgtccgcgagtgctacgaaaattttggaatcaccatcgacccagccaagatggagccgaacaggggcaaacgctcaattgctaaattgtgccttaacaatttatgtaagaattttttttttcatttaattcatcaaatcaaatttgaaggggggcgattttcgctgcgcaacttcggtctgtcgcagactctggtgaccgacgaccccgctgtcctggctgaatacttggacaaccgctcgctcgaggtcacggcaatcgatgagcttgatgctgagcacattttgatcagctatgagacgaaaaaggagtgggtggaggaaaactcatgctccaacataggtggaaattttttgtttcaattgaactaataataaaaatacctcaagttatctccctgtggaccacttctgcggcgcgtctcctgttgttgaaatcaatgcagaaggtggtgagaactccttcctgccaactcctatacaccggtaaaaatcatatattctatgtacataaatacaattgttcagacaccgacagcattattttgacccatccggatgacaattgcccactgaagaccggcccacaccttgggcaattcacggacgaataccctaagcatgagattttggagttttgctcgggaggtgccaagcaggttaaaaattttcacttttaactattaattctaaaatgaattttagtatggactcaaattgcgcagaaaggacgcaccacccgacgctgagaacgaatatgtgctgaaagtgcgcggcatgacgctcaactatgacgtcatccaaaaccaagggctgcgctacgagacattcaaggaaaaggtgctacgatttgctgaaactggtgagccccaaccgatcaatgtgatataccccaattttcttcgaccaagcataaaagatgggagagtcatatcctgtccactccaaaaaatatataaaccatttgtcggcaaaggtattgtcggagccgactataaaattttagattttggtcacactttgtaatcatttttgcatattctttgtatttttcattttattgcttgcattattaacgaatggaaa

SEQ ID NO: 82995 - DNA, 276 bp, Heterodera glycines
  Genomic contig location: Contig_ID=SeqID_18395; Location=93..368; Strand=+
  SCN-specific regions: Sequence locations=1-175,197-247
atgcccatcatcagagaggggggaggggtaaaagtgcccccgccacactttgaccaatttgattgtttaccgaccaaccaataaattataaataacggaaattgaaacaaaacaaggctcaaaccaaaaaaaaaaaacaatgatttttaaacgcttttcaggcggtgctcattaacaatttgctgaagcagctcagactgaaagtgggacaggcgaacaaaacacatggaaataatgacagacacaattgaagaacaaaacaaaacaaaatataaa

SEQ ID NO: 82996 - DNA, 528 bp, Heterodera glycines
  Genomic contig location: Contig_ID=SeqID_18395; Location=1821..2348; Strand=-
  SCN-specific regions: Sequence locations=1-528
tctcgtcagagtttcacgcttatttacgccggatgggttgaattttgtttgaagaggaagtctgctgacactgagaatgagaatggctacaattccgttcaaaatgcgtctctcgtcacttcgttttgcttcgctttgtctatgctcggccgaagggcgttgggcaccgccgcgtacaatcgccactcgagcgcagccgaatcgtttttgttcggaatgcacacactctttaaggtcagccgactctggcaccaatatgcagatgggacgaacgaacacatcattcataatagttataattgcttttagggcgatatgcgtatagctcatccagcggatgaatgggtttttgccgacttggacattctcaacagtgtcgtttctccggcaattcgaatggcgcttaaacttcaccaagatcactttgctgctgtggtggatttggatgagccagccgaactctttgaactaatcgatgactacagaaaacggcttttcatctcccatgaacacgatccggaatggtaa

SEQ ID NO: 82997 - DNA, 570 bp, Heterodera glycines
  Genomic contig location: Contig_ID=SeqID_18396; Location=2240..2809; Strand=+
  SCN-specific regions: Sequence locations=1-399,435-570
atggtaattatatttaaaaatggagcaaagaattggggcttaaccaaaagaaatgctataaatcaaaaactgatgaagaaaagttagaaattgtacaaaaattcattgaaatgacaaatgaatataagcaaaaaataaaatattcagcaaaagaatggcatcaaaattatgccgaaatttgtaagaaaattggcgtaagctatggaacaattatgcaatggaagaaacaatctggattaagcaataaaagaataacggaagaagaaaaaattgaaaaactgaaaatttattggcaaacaaaaagagaaaatccaaaaaagagtgaacgggcatttgctaaaatgctgaaaattgatagaaagaacatttaaaattggaaacaacagtttggggaagagattttagaggatttcaatggatgattataagaaaaattgaatagatttgccaaaaaatcatcagaaaaactgtaacccaaatcataggctttatcaaatcttattgtagttaaaaaaaaacttatttttgaaacggtgcttctttttcaattatcttgaattttttattcaa

SEQ ID NO: 82998 - DNA, 1245 bp, Heterodera glycines
  Genomic contig location: Contig_ID=SeqID_18398; Location=1..1245; Strand=-
  SCN-specific regions: Sequence locations=1-226,248-576,598-1046,1068 -1070,1092-1105,1127-1154,1176-1186,1211-1218
ggggacctctagagtcttggccaagtgcccagcagaaggggcaccggctcactttacctccgacttggcactctctgtccgatttcgtcgcttcttctccctattttctgcttttcctttttaggctttggcagcagtggcattgtgctgttctgcttggaagtgttcatctgcttctcagataaagcctgcttcaattatcagctgatcaattggcttttcgccggcactttcactttcatccaaatgcatttcattttctgcaattcaaaggtcctctaaaagtggaatcaatttttgagcaattttacagttgattattgtcgattcaaaaaattctgcaaaactcggaaccatgcacttattggcggtcaacatttggacatggcttcgatttgtaattgcaaaaaatgcggcgcttgacaaaccgttggaccgaagagtcagaaaaagcggaatttgactatttattaatgtttttggtatcagttgctacaaatatttcgactgaagcgtgatttgacaaatggcgtgagcagcgaagagatggaacagtttcagccccaacggatggccgagttggcgtacggcccagcaaatgcgccgctcccttccaaagtgtactccttcaactacttcggagactttgccactctgttgaccacttgcattgtggtgagtgccacaccatgccatggcatttctctgtaaatgttcaaggaatattctgtgatcggcgctgctgtgatggtgtgtttgtggcgatcaattggcgaacataggacagaaagtgaagggaagagctgtgacgagacaaagcctcaaaaggagcacaaaagcgggaagagtgtgcgcatcgattgcaggtcgttcattccttcgggcgttcgttgtcgccacaggggcgtcgcacccctgccgctgtcaaatggcagcccgtcccaaggcggtattctcgcaggtctataatatctgatcggccatttgcatcccgaggcaaacaaacattggtaactcatctctcggattccccagagcgcccatcatactcatactccccccacccttttcttcttccgccacccacctccgccggtacgcgccgctcccctcccctccctctcttgatagtttaaactgaaggcgggaaacgacaatctgatccccatcaagctagcttccgcaggtcctgctcgagcggccgcccggggatcgatccccgatctagtaacatagatgacaccg

SEQ ID NO: 82999 - DNA, 417 bp, Heterodera glycines
  Genomic contig location: Contig_ID=SeqID_18399; Location=305..721; Strand=-
  SCN-specific regions: Sequence locations=1-417
ttcgtacgttgtgtctcttctggttgtcggctgtggctccattctttggttcttttgggactacgtcaaaaaacgacgacgccaaaacaaaaaagaaatgtaaaaaaaatcagaaaaatcataaaaattccttttttcagctttatctccgccgactgttggctcaaagtgttcgatttgcttccacgctctcaacttggcctcggaatcgcactgattagtcgccgatttgaccgccgcgtggacgaacatttcaaaacacgcaaatggaaattggacaacaaattgtggattcataagagaaaaggatggaatggcactactgaaatgaaaattgtcaatgccaacggaggaaaagcattgccaatcccacaaattccattgcccaacaagtcatcctattcagacgcattttga

SEQ ID NO: 83000 - DNA, 58 bp, Heterodera glycines; identical to SEQ ID NO: 51629
  Genomic contig location: Contig_ID=SeqID_18399; Location=916..973; Strand=-
  SCN-specific regions: Sequence locations=49-58

SEQ ID NO: 83001 - DNA, 1746 bp, Heterodera glycines
  Genomic contig location: Contig_ID=SeqID_18402; Location=554..2299; Strand=-
  SCN-specific regions: Sequence locations=1-259,281-311,338-383,413 -447,481-489,562-609,683-741,764-899,972-978,1000-1073,1152-1295,1318- 1562,1584-1746
atgtggcattcgaaacccgcaacagaaccgattctccacgccaatggaacaattccatctgcaaattgtggtcattttgtttgttttgcgtcacataaatttgaactgttttcagttggttttccatcaacaaaatgcctcttcaaatgtccaatcgttttttgtccaatgcgcccaaaacagagaaaacggaggcgaaaacgaaagacaggcgaaattgggacgaaacattgaggaggcattggacgaagtgagaagaacaaatgggaaaggaagggacagaagggaattatttgaaataattttggaaataataataatttaattaggtaattaaaaggatttataggtaaaaaaaaatcagtaagaaaattgaagaagagtattttatatattttttcttaattaattacctaattttggtattgctccttttttattttttaatatttccctatcataagaaatatataaaaccactctaacacaggggctgtaactcagtggtagagtgcttgcttagcatgcaagaagtcgtgggttcaattcccaccagctccagtacattttttacattttttacatttttttgaccaaattttttggtggtttttatttttttaaataaaaattttactgattttattataaattaaaacaaggaaaattttaaaaatttattccacctaaaataccatataggtaatagatttggactgctaaagacatgctaaaagtaccaaataattaaaaaattttattaccctttgcttgattaacactaattgagtaatcaatttaattcgattgtctttttgctcaattagtgtagcaaagcgccataaatactcaaagaaatcgaaaattacttattatttccgaatttttattgccccataggggctgtaactcagtggtagagtgcttgcttagcatgcaagaagtcgtgggttcaattcccaccagctccagtacactttttgcatttttaattatagtaatttgttttttatgtctaaatttaatttctcaacaatatatttatagtttcataagaaaaagtatcaaataacaataaattaataatatctaaaagaatttataataaaaatattttttttgtcattaaaatttaaaaaaaaaatttaaaagtgagcaaacgaaacgtgccgtgctgcaacaagtgcaagatgaggcgaaagagtcgggcattgaaattccgcccatttttgaattcgaaacaatcgacgaaatacttgcaaacaaagtgagaaatcagagataattaattattagtgggacaggagggaggaggggtaaatcgttgctaaataatatttaattggaaacgaaaaaaacaattagtggtcatttgctgaaaacttttgatactctaaaagtgtggaatttttgatgcttcttaatttctaataaataaactcgggactcaaagtgtttctgggctctattgccacctaaaaatttttatgtaaaatttatgacaactttttctgtcaggacatagcaaaggatgaagatgctcagtcggcaatcattgacgaaattctctggaacactgaacagcgatcactcgagacgagcttaagggaacgatcggtcagcttccaccaacgcgaaaatcatacgcaaacggaaataatcggaaggcatggcaaaatgaaagaacaaaaaagcgaaaggaaaggcaaattgaaattggcacaattaaagagacgacaaaaatga

SEQ ID NO: 83002 - DNA, 1378 bp, Heterodera glycines
  misc_feature (1310)..(1310): n is a, c, g, or t
  Genomic contig location: Contig_ID=SeqID_18404; Location=21..1398; Strand=-
  SCN-specific regions: Sequence locations=1-29,56-290,319-1151,1180 -1378
atgccgaatttaaaaagaaagtctgtttgtttccaaattttcaaaatttattttcttcgttctttagcgctttcacattgtcaaagatggacagcgagaagcagcagtttttgctggaaagggtgtacaaactctaaatgtacaccatcaacagcagcaaaacattgacaatgaaactgttgccaggccgaaacaaacgccaatgttcggaggtatacgaacattgggagcaactcgtttcccctcgccatttcatataaaaaatagtatttttttcaaaaaagtcttcgaaaataattttataaaaaattaaaataagcataattaatcctaaaatttagaaaaagccgattaaaattttttttaattagtcagataattttctgatttttttaaatcgcattttcccaaggctgcttatattgttattagaatatttaatgctttacgcaaaatttttcagggccaacgaatgcgcatcaacgtgccattcgtgaagcatttcgctacgcgtggaatgcctacaaaaaatatgcctggggccatgaccaactaatgcccatttcgcacagctttcatgaatggatggaatgcggtaaatattatggtcttatttcatcggttaagccaactgggaagaacgggcaatgatggtgggaattttttttaactgggtccaccccccgcccgaaaaaaattccatacatttttctccgttttgctctgacgggatcgcaatctcgtcgggattttcccgcgaccttggtattccgactttaaaaaaaaacttggaatcagagttctgacaaaatccgcaattgaattctcggtaattctacccggcataattcccaattctgctcctgtttttttctatataaaattccagcctctaggtcacagcacacaggttttatctgggttttttggactaggtcttacaatcgtcgactcactggataccctgttgatcatggatttgcgggacgaatttgcggacgccaaacaatgggtggagacggaattgcgctttgatcgtaaccgttttgtcagcctgtttgaaaccaccataagggtaaatattagaaaaattagtcattgtttatggtggcaaaattttctgaaattttgctactacccgccactcaccgaaaaaaaattaaaaaaaaatttttttttcggatattaaatagtggcaacaaaaatttcaggttctcggaggccttctcagtgcctaccatttgtctggcgaacaaatttttctcaccaaagccgaggatattggacaacgtctgtttcccgccattagncagtcgccaaccgcagtgccctacaggcaaatggaaaatcgggcttaaatgagacttatataaataaa

SEQ ID NO: 83003 - DNA, 1161 bp, Heterodera glycines
  Genomic contig location: Contig_ID=SeqID_18407; Location=717..1877; Strand=+
  SCN-specific regions: Sequence locations=1-89,112-1161
atggaaaaagctcgaaagtcaacgccgccgaggtccatgactttggaagcacttctggaagagtgccgttccattcaatcgcttaaaaattcggctgccgctttgtctggtcccggacaagttcattcagtgcaggtccgaccgcaacgagtaagcgatggaagtaagaagtctaaccgaggtaaaatggtcaaccaaaagggcaatgtttcggttccaatttcgaaagagaataattttcctttcaattcaaatagaaccgatcaagatcaaaatgtgcagcaaaagtgcaagcgatgtggtcaattccatgtcaacgactgtccttatgcagccgatgtgaattgctaccgctgtggaaaacgtggacacatcagacccgtttgtcctgaacgtacgcagtcaaacgctgtcactgtggcctcaactttttgtgtaactcaaaagtgccacgattggatttggacacatcctctgatcaatggacatcctgtcaaacttgcggctgactcgtgctcgcatctgacaattattcaggagccactttggataagtttggggagtccaaaattgagaaaacaaggtaaaaaagttggtagtttttccgggcataaattaaatttgttgggcgaattcgattgtttggtgaaatttaaaggtgttgaatttaagctcaaatgttcagtagctaacaccggagctccaaacatcatgggacttgattggattgtgccgtttgagaaggctacgcagtctcccatcgcgacaacattggatttgtcaagcgccccaacaaaagtcaacacaattgatgaacgtccccgtcatttcaaaatcggtgacactgttcgtgtgttgaactatggaaaatctggcaagtcaaattggtttgaaggcaaagtcgtcgctggtaaaggtctgatttggaaagtcaaaattccacttttaaatattactgtcaacagacatgtaaaccaaatgcgttcttttgtcccttatcaatcagaaacgacgtttccgaatgatacagttgaccaagttccgcaacaaaagagtccttgccacagcactgtcacgactactccgccgaccaacttgccagttcaaccaacgcaacgtcctcagagacaacgccgtccgccgatacgttactcgccgtga

SEQ ID NO: 83004 - DNA, 1640 bp, Heterodera glycines
  Genomic contig location: Contig_ID=SeqID_3058; Location=552..2191; Strand=-
  SCN-specific regions: Sequence locations=1-307,330-447,469-750,772 -1022,1044-1434,1456-1640
atgtattacaaaattgtgtctttttacggttttcaagcgaccgcatcatccacggttttaaaagataccaaatctgttagatttgctcaacaaaaagttgtgcttttcgaacttggccgatggtgagtgtgatacgaaatgaaccctctcaccgcaccacacaaagatatatggtgtaatacattttccctgggactgtttcatggtacaggggacgcaaaaaacgaacaaacaatgggtttttgatcgtattgtaaaacattgagtttgtttcatcccttttttttggttgtatagtgcataaataacaccatatttggcgctttttagccaaatccggctaccaattggaagtgactgttggccagcgcaaataccactcaccgcccggctacgaggggccggacccgaaccaaacggacggcggatgtgtaagtcaagcaaacaattattgtacatttatacaaagaggggaaaaattggttgacacatttgtaagacaatatttaccaaaattttgctacactttgggccaactactgttttaatgagcactaattacaacacatttcctcccccctttttttacagatatacattggccaaattccaaaggatgtgtatgaggacatgcttgtcccactgtttgaaccactcggtgtcatccatgatcttcgtaaccatttttttttttttgaattattcttgcaaaaattccatgtcctaccctattcgtttgcatttttcatggaaatttgcaaaaaatctttttgaaatgagggccctcgttctctcgtgcctcagcctcaataccgaaattcccccccccccttcaattttttccatttctgatatgaaacctacttccccggtttgttcaggtataatgatggatccggtgaatgggaagagccgtggttacggttttctgatctatacggacaaaacgcatgcgcaagaggcagccaaaaaggtatgttttcttcgtagttacaccaaccaacagtgtactcaatttgttgccaccaaaaaacgtattggaaaaacagtaagattgtacatagttcccaattttgtaaaacttggcacaaataatgacatagcatgatataaccaaaactggcacaagtaatgccatgacataattttacaaaagtgtttttttggtggcagcgtttgggtacaaacaattgcaaatcttgtcttaattattctcttcttgatgcatttttggcatttttattttctgttgacatttttcgcttatatttttcggcgcattatttttacggttttgtgtatacggtacattgaagtgatgtgtaccccattgccagtgagtttttttgttgtgatgttgtacggcttgcatgtcatttccccacgtcccgtcgctcccgtttcacacatttccaacatcttcgacgagtacaccccccaaattccccaaccccaattccatccctcattttgatggaatgaacacaataaacacaattcattttcatttgtggagagatgcgcatcataaaatctgatggctctcttttctgttttcatttttcaacaaaaaatttttttctaagaaaatttttcagacaaatttgtgccaccaacaaacacactcacacattttttag

SEQ ID NO: 83005 - DNA, 714 bp, Heterodera glycines
  Genomic contig location: Contig_ID=SeqID_3059; Location=222..935; Strand=-
  SCN-specific regions: Sequence locations=1-78,119-182,204-257,279-714
atggcatcaccatccgatttggacatgaaaatggtgccacaaaatggtgacttcaagcacgatgtttctgaagaggtgcagcagcagcaacaacaacaacatcaagaacagaaacaaccgaacgatttggtgaagaacgatgaggacggcggaggggcagaggccggccaagacggcacagcaccgacagaaacagagcaaaagccaagccctgtaaacaatacgataccactccaaaaggaaacgttttttttctgactctaaggcaatattaaatgcacgtgcgccacaatttgtatcaaaaatatgatgcaaaatgacccaaaaattgtctcttttgtgaaagcccggcttaagacaaatgtttagtatcgtcaacttaaaaacaattgaactttttaggagttggaaagcgacaccacctatgatgacactgacacattcaaaatgttcatgggcaagagtttgtccaagccggtggccgtcatactgatgcgcatgttcgacgagctcggcctgaacacggacgagtttgatgagcgtgccgtggaaatgctggccacattcccctttgagcaggccaatttcatcctcaaagagctcaaggttttgctttttgtgcacttttttttttggtttacctgggttggcaccagaggctgttattttgaaaaagaagccgagattgtcatcaggccggcatccggcatatga

SEQ ID NO: 83006 - DNA, 714 bp, Heterodera glycines
  Genomic contig location: Contig_ID=SeqID_18409; Location=815..1528; Strand=+
  SCN-specific regions: Sequence locations=1-6,42-105,128-373,405 -485,579-587,609-616,638-714
atgttgattatttattattatttattttgttatataattaaggtaattgctcttattgtgtaatttttattctcatcgagaccttaaataagtcatgcaattaaggaattattgtaaatacaaaaaataaagggttttctttttacttattatttatttttgtttctttttgttatttcacttagatagttgcacataaagtgttattttttattatcctctagatcataaataagtgatgcatttaatgaatttataaaagggtttacttttatactcgcgctcgtaccaagatatgtgtttgaaagatgtagcgttttaacattttaaatgctaattgctattttggtaattaacactagtatatatgtttttactatttattttcttttgataatttcaaataattttattcagtatattattttggcaatagactcattaaataatatttgaagtttaatttgggtgagcttttgtcattgtttttatatttaaattttagtaattatgaattttatttattatttctttagggataaaattttggaaatagttttttttttaaatttttataagattttgtgtgattttaatttatgtttgtatttctgacataatttattttatatttatagcggattgttcggttcatgatgtggagctgcaaaactgacaagttttgagtcggaaagatcgccgcaccaggcacaa

SEQ ID NO: 83007 - DNA, 1192 bp, Heterodera glycines
  Genomic contig location: Contig_ID=SeqID_18410; Location=166..1357; Strand=+
  SCN-specific regions: Sequence locations=1-46,121-126,148-151,173 -523,545-817,857-1009,1090-1152,1176-1192
atggtgctgcagtttttggaggctcaatttcttcaacagcaacaacaggaggaggacgaggatgatgaagaagaagacgagtcggaggaggaagaaaaggaagaggaaggagagaaggagtcaaacgagagagaaggaggggaagagaacggacagaaaggaggagagcaaagggacgtgcggaacgagaagggggagcaggacgaagtggcgaaaaggtaaacaaaaagagtgcaaaacacggcccaatcccaaatttgaagttcactacatttcctctacccccctccccccacccccgaactggggatcctcctcgtttcggcgccagcccagtttttggactataacttttttctttttccaccaaatctaacattgttggtatcattcgagagcccttctgatgctctattattttgcataattccaaaaaatttgatcaattaagaacaaagttatggccaaaagtacacatgtggcctggttttttgaattcttctagtcataatttttttgagcattaacgaaattttttgaaacttagcaggctaatagagaacacttagagctttcgaatgataccaataatgttagatttggttgacaaagaaaaaaatcacgagagttggcgagaagatgagaggcgagaatttttcaatttttctgtagtcttttttttacttcaaaaaacttcaaaatcgtatattaaattagggttacgggtccgggtatttgggcaaataccgggtccaaccgggttctggaaaatccaaaaaaatcttcgaaattttttcatgaaaataaaagcttatagtttaaaaaattatataaatattttcatgaaatatatttacgagaccgggaccgcaagaaaagctgggaccggaccaaccaggaattttcgaagaaaaaattttttttgaaaaaatccaaaaattttcattaaaatgcatagattaatgataatttaaacacttttaaatatttctctatgtaaatgattgagtatttttttatttaatggtatttttctattgttttaataattgaaatatcttaaatttttgaaaatataaaaaaatttttgttcagttggggaattgaacccaatcgaaaaagaataaaaggcagaaggtttagtcaacagaccacatttgaatttgagttatccaaaaataatgttctttga

SEQ ID NO: 83008 - DNA, 1023 bp, Heterodera glycines
  Genomic contig location: Contig_ID=SeqID_18413; Location=417..1439; Strand=+
  SCN-specific regions: Sequence locations=1-849,878-1023
atggaagagttcgccattgagacaactctccacattttggacaataacggtaggacagttgttgccacttttgaacattttcttgacaacaaacgtaagtttgttgatttagttgaattttgggaggaagatgccgcaattcaagcgagattgaaaggggtaagaaaaacttgtgccaatggacagattttagaggtgaataagtatgtccaaggggggatgtacgtctttcaggcaagaattctgctggcatatcaagctgccaaaaatcacgactccgatggcgactttgaattcatttgtgaaggccatgaagttgtacttagcccttgtgaatccgcaacggccatggtcaatcggatgacactgttttattcgaattctttcagcttgatttcgtcggagcagagtggaaccggacaaatttggagagctttgttatcatcctcggatgaacagtccttgcctgctcaaatcacggagacgcgacacatacgtcatccggcattgaagcgccttgaaggtggtcaaaagcagtcggcaatgctcatgcttgatgatcagccgcgcattgttgcacaacaagcgcctcctggcagcggcaaaacttttactttggccgccatcgttgctgctctgctcgaacggcccgatgcaaaatttttgtgcatggcaccattgaacgttgccgtagtaaaaatttgtgaggaattggttgatgctttacgggtagagggggttgccgtaacgccgttagccctattttcaggaaatggtaaagggaaatacagggatcagcttgaccgcatctcggacaatttgcttgaggctgcagccacgtcagaggaattttggaaaaaattgaatgaaaaagagcaaaaggaggtaaaacggtacaaaaacatgcccgaaaaaggccgagaattgccaaagaggcgaaaattgcagaagttgtgctctcaattgaaagcaaaagaattttgtgttgcacattgggttttgcggaacaaattggcagactaa

SEQ ID NO: 83009 - DNA, 523 bp, Heterodera glycines
  Genomic contig location: Contig_ID=SeqID_18413; Location=1439..1961; Strand=-
  SCN-specific regions: Sequence locations=1-523
ctgagtaaagtgaaatgacccggactgaaccaggaaaacccctccagctccttaaaaggtcaatgacagtccgagtttgaccagaattggtcgcagaaaaactagtttcttccgcttccattggcgaatcttggtgaatgagcacaattggagattcagcaattggcattttggcaaaactcgtcaacatcctaaagattcccggtcccgatcttagcctttcaccatggggtgtgtatgccgcatattcaacgcagttgacaatttctggatgtgaacggtagttcacttccaacgttgttttgtccacaccaggagatgagtctgtgttgagtaaaactgtgtcaaagccgaagccgactcggagttgttcagggatgtccttcatgttcacggccagctgataacgatcaccagtgatgaacagcttctgaacttcctgaaggggtgagaggaccgagcagacttggacaaaaggcgcttggcccgattcgtcaagcactatcatgtttctgtccatgat

SEQ ID NO: 83010 - DNA, 48 bp, Heterodera glycines
  Genomic contig location: Contig_ID=SeqID_18414; Location=2484..2531; Strand=+
  SCN-specific regions: Sequence locations=1-48
atgcgcgagcggagggacccgtgccggttgttctgtggcatggcatgg

SEQ ID NO: 83011 - DNA, 2914 bp, Heterodera glycines; identical to SEQ ID NO: 18415
  Genomic contig location: Contig_ID=SeqID_18415; Location=1..2914; Strand=+
  SCN-specific regions: Sequence locations=1-215,238-514,539-1332,1354 -1429,1527-1674,1705-1742,1772-2432,2454-2739,2796-2914

SEQ ID NO: 83012 - DNA, 975 bp, Heterodera glycines
  misc_feature (871)..(871): n is a, c, g, or t
  misc_feature (894)..(894): n is a, c, g, or t
  misc_feature (926)..(926): n is a, c, g, or t
  Genomic contig location: Contig_ID=SeqID_18416; Location=43..1017; Strand=-
  SCN-specific regions: Sequence locations=1-975
atgtgtgccgcgttttttccaattgagacacaaacagcggtaaaaatttaccgaaagagggcagaaattctcgcccaaatgtctgatcaagatctctataagagatttcgatttgacagggaagggataaaggtaccatttttataaattcatttagaaaagtaaattaagtacattactaatttggtgcgtgaagaagttgagtctaacggccgttcgagagggggagcaattccggtagagttgcaagttgttgcaactcttgcttatttggcatcaaattcttttcaaatgatctgtggtgatttgctgggatttgatcaatctacagtgtcccgatcagtgctaagagttactacagcattacgaaatttggctggaaaattcatttattttgctccttatgaacaagtaccggaattatgaatgaattttggtcaaaaaattagtaccctttgcaggccagagaaataattataccaagcttttataatgttgctaattttcctggtgtaattggcgccattgattgtacacacgtgcgaattattcctccagcatccgctcacgaaaaggactattttaatcgaaaaggatacccctcgattaacgtccaaggtacaatacatataaaatggacagaataattcattagcaatgtgattaggtgttgtcgatcacaatggccgattttcaaacatttcttgccaatggcctggttgcagccacgatgcctttgttctccgccagtcaaacgtatgggaagcatttgaaggtggccaaatccaaggaattattctgggtgatagtgcttatccaacacgtcgctggctaatgacaccttttgcaaaccccacaactgctgctcaancacaatataattatgcacatgcnaaaaacagggttattgtcgagaatgcatttgngagatggaagcggcgattccatattttacatttcgaagtacgaattaaa

SEQ ID NO: 83013 - DNA, 372 bp, Heterodera glycines
  Genomic contig location: Contig_ID=SeqID_18416; Location=1105..1476; Strand=-
  SCN-specific regions: Sequence locations=1-265,287-372
atggtggctcgcttgatcgcaagagaacaagaggaaagtgccgaattttcctcacagcaagttgttgttgaagaaggaaagtcctatgccgttcttggcactgtgccacgcggagaggcggtgaaaactccaaaatttgaatcaagcacctctcgcgtgccattccgatctcgtgccggaactgcttcaactgttacagctgctgatgtaatggaactgcagcggagtgttctcgagatgcaattgaaagaaatgacaaaaaaacaagaaatttttaaaaaatttgaggatgttcttgacgatgttaagacattttttactgagggtcgcgaattttttcgtggaaagcattcaaatgagaaagaaacttaa

SEQ ID NO: 83014 - DNA, 314 bp, Heterodera glycines
  Genomic contig location: Contig_ID=SeqID_18418; Location=1..314; Strand=-
  SCN-specific regions: Sequence locations=1-215,238-314
ttctaggtggttatgcgacagcacgataggtaattgtacatttatgtaattctttcgcttctgatcatttgcaatcgccgcacgttatggaacacacccttcgctgtcctctgttgaaatttagtcgtcccacttttggcatcgcacagtccatcgcccttccattggatgtatctgtcatttttggcgattcgtggccattccctcccttcgtcatgcttttcctttccttccctcccttttggctttttccaattacctattcccctctgtccacacattccctccctcccccccgctgctgctgttgtttc

SEQ ID NO: 83015 - DNA, 578 bp, Heterodera glycines
  Genomic contig location: Contig_ID=SeqID_18419; Location=1..578; Strand=+
  SCN-specific regions: Sequence locations=1-88,111-472,494-497,519 -522,544-578
ttgtatcaaaaatgcaaagaccgataatcgtaaatataattgctctcgctaatctcggtaccggaattaaactaaactctctgacgatcaccgaatgcgaatttaagtataaccctagaaaattcaatgccgcggttatcaaatgtataagccccatcaaagccacggcattattatgggaatccgggaaaatgatatgtctggggacgaaaagtctgatagactgtgaaaatgcgataaaaattttcatagaaataattaagggctcggggtgtccgggggcttcttacacctgacacacgattgaaaatattgtttcgacctttaaattcggacatgaaattgaactgaacgaattcagaaaaaatcgtcgtgcattttatgaaccagaaatattttgcggtttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaatttaatgagacgataaaaatttttatttattgag

SEQ ID NO: 83016 - DNA, 134 bp, Heterodera glycines
  Genomic contig location: Contig_ID=SeqID_18419; Location=2243..2376; Strand=+
  SCN-specific regions: Sequence locations=1-134
atggctgtggtccgtctgcgaatgttcgcccatcgaactgcactcgcagcagccattcgactcgagcaaacgccgcacattgtcaatcggaccttttttcaaaacacattttgccaatcccttgctgttcgaga

SEQ ID NO: 83017 - DNA, 915 bp, Heterodera glycines
  Genomic contig location: Contig_ID=SeqID_3060; Location=175..1089; Strand=-
  SCN-specific regions: Sequence locations=1-61,101-915
atgccgaacaaaggttggcaagagaattgttgttttttttattcatattgacaaattcggattcttctttgatgccctcctgctgttgctggtggtgcccgtttgattcaaacccagcggaattttaaatgcgtaaatttacggttttttttaaatttgtctcagttttttaaccaaaatttcagcccaactaaagcggaacatcaaaacaatgtgcaccacggacaatgaagaggagaaagctgagccgtggaagaagttctgcaaaatgttttcacgggttcaggtatgtgtcctcaaaattattcacctaaaaagacactttttcaattagtcgttcaagtgattggccgaacatattattatctcattatcacttccgaaatcaaaagggacgtaaattctttttttaagatgtccttttgcttggttttcttgctcctttcattttctgtgttatgttgcgcctccaatccaactcttaccaacaaagtttgtgtttctttttttttgctttaaattcttttttgtaactgtaatattttcattttccagcaaatgccgttaaatgcttccacgcccgtcacgcctaagcccccgttttggctggtcactgatcccttttggcgtcccgtggtcatgacaatgttttacacaacccttgtcatgtgtggcctccttttcgtttttgtctacgcatattcatactcatttattgcctgttgtctcgtatggcagacgatggaagagttatattgcaaccccgtaatgatattaaattccctaaaaagacgaagaaaaccgtcccttatcctgctatattgcttagccaatggaaaacgtttagacttgtacgtgtgtaactgatttacacagaataatgcaaatgttggagccttgcaagctcaaaataaa

SEQ ID NO: 83018 - DNA, 916 bp, Heterodera glycines
  Genomic contig location: Contig_ID=SeqID_3061; Location=291..1206; Strand=-
  SCN-specific regions: Sequence locations=1-61,101-916
atgccgaacaaaggttggcaagagaattgttgttttttttattcatattgacaaattcggattcttctttgatgccctcctgctgttgctggtggtgcccgtttgattcaaacccagcggaattttaaatgcgtaaatttacggttttttttaaatttgtctcagttttttaaccaaaatttcagcccaactaaagcggaacatcaaaacaatgtgcaccacggacaatgaagaggagaaagctgagccgtggaagaagttctgcaaaatgttttcacgggttcaggtatgtgtcctcaaaattattcacctaaaaagacactttttcaattagtcgttcaagtgattggccgaacatattattatctcattatcacttccgaaatcaaaagggacgtaaattcttttttttaagatgtccttttgcttggttttcttgctcctttcattttctgtgttatgttgcgcctccaatccaactcttaccaacaaagtttgtgtttctttttttttgctttaaattcttttttgtaactgtaatattttcattttccagcaaatgccgttaaatgcttccacgcccgtcacgcctaagcccccgttttggctggtcactgatcccttttggcgtcccgtggtcatgacaatgttttacacaacccttgtcatgtgtggcctccttttcgtttttgtctacgcatattcatactcatttattgcctgttgtctcgtatggcagacgatggaagagttatattgcaaccccgtaatgatattaaattccctaaaaagacgaagaaaaccgtcccttatcctgctatattgcttagccaatggaaaacgtttagacttgtacgtgtgtaactgatttacacagaataatgcaaatgttggagccttgcaagctcaaaataaa

SEQ ID NO: 83019 - DNA, 7003 bp, Heterodera glycines
  Genomic contig location: Contig_ID=SeqID_3061; Location=1066..8068; Strand=+
  SCN-specific regions: Sequence locations=1-41,81-284,306-692,761 -879,901-931,956-1087,1109-1336,1361-2172,2194-2804,2828-2974,2997 -3070,3092-3196,3219-3275,3297-5743,5765-6020,6042-6178,6201 -6379,6401-6922,6945-7003
  Gene Ontology: Cellular component=AP-3 adaptor complex; Biological process=ommochrome biosynthesis
taaatttacgcatttaaaattccgctgggtttgaatcaaacgggcaccaccagcaacagcaggagggcatcaaagaagaatccgaatttgtcaatatgaataaaaaaaacaacaattctcttgccaacctttgttcggcattctgcttttccctgggtaaaattcacaatttttgatttgctagactcattctctaattagctaattagtgtaaattatgacagtggcccaaattttgcattttaaaccctatcaagcaatgtccactgtccgccgcactgtcgtccgcggtgcgtccgctctcgcatttccgcgcattgttccgcttgcttccttctttacggcgcgggcatccgtttttggcacacctttccgcgcttgcgcccgactcagtttttccacccgcttcatctcctattcatcgcttttccgcttcaacttatactttgcgtgttgacaaagtttatgcacaatgatttacaatataccaaaagttatgaacaagtttgtttttccttttaagttgctctttttttcatcctgttttgttgttttactactgtctcttctgccgatttcgactttcgagtaaataaaccgcagccaagcggactcgaaccccagacccccttctcatatgacccctcggtgattagaattgatttttatcaattcatattttttgtaacatcataatttttaaaaaaaattttgatatgtaacattttgccataaaataaaaaaaattttaatttaaaaacaaagaaaaaattctcctttctccaaattcttcacttttgttagttatttcccttggaagtcaattaaataatttcaacagtgaaaatttgcaacgtaaattggctgttaaatcgatgcttaaacttatataaaaatcatcaataacagcattataaaaaacgatcaaatgaaaattttttaataaaaaattattcatatttgcccaaaatcaactaacctgcttgcttgtgtacttttgtctataactttgttcaaattaaacaaaatttgttgaaatttttaggctaatagagaatttttagagctagcgaatggtttcaagactattccgaactcggacccgaattcgaacaaaaagtcgaaaatccaaaattttcgaaattcttacttttgttcctaaattgatctaaataagctaaatttagtcagaagccattgcaacatcaaaaatggtcattttttacagggacgaacataaaagaaaatttcgaactgccctgccagttggagtgtgaagttctttgtttaaaaaataaaaaagatattgatcatttttatcctatgcaataaagcaacatttttcattcattcaaaattggtttcatttaattttccgtttcgcgtgccctgtattatactacatttttcctctccaaatttagctgcaagtgctcggctacgacatttcctggacaacatttaacatcattgaagtgatgtcgagcacgcgttacagcgaaaaacgcattggttatttggccgcggtgcaagcattcaatgacgaaaccgatgtctgtgtttagggccctggtttttcaaaaaaaaatttaaaaacaccagtgcaggggggtagacagacttctttgatacaaataggttcaattattaccaaaattctcaaattttttcatggcagcgtctgatgggtcactcattcctcgaaattttttctcttgttaaaggccgaaaagcaaaaaaaaaaaaaaatcgtcgcccaatgcggcctaccccccccccccccaagctagggctaaccccctcctcttttgcttttttcacccttttaatttttttaactgcgttttttaggtgctcatgttgacgacaaatcttatccgaaaggatttgcaaagttcaaacactgatgatgttggcgtcgcactgattgtgagcggactttcctgtttcaccaccaccgatttggtgctggacaccgcagaggaagcaacgttggcatatgtttttttggtggacaacaacggcatcggcatcgcttgtttaagtcccaggtcaaaaaaagcatatggctgacaaacgccatgaattctggcaaattcataaaaattgagttgcttgccaagaattctcgggtcgttttaagagagaatttacaaaaaaataatttccttaaaatctgcactgttttgaagattgtacactcggggagcagttgctttgttcgccgtccgacgaaccgtgtgccatcgaatttcttccactctgctactctccaacatttgcgtgccattcgccaggccggacgagttggttcaccaacagctgctgtgctacatcattgactccgtgccgcatcgtgcccttcttgaaactgagcccggcacaccactgatgcggcacttctgggcgcgacttgtgcgtcgacagaagagcggcattggcacggcaccgttggtgaaggacgcgcagcgacaagtcagtgctgcgtttgaacttctgaatgcaataatttaagctcatatttttgtcacaatttagagcaagtttataacaggaggccgatcgtccttattcataagaaatgttctgaattgaattcaatttccccgacagcgcctgccggcaccgggatttgaatccgacccagagaatcaaatctctattatatccggatcacatttgtccgcgaaaattttgtttttgggttcattggagaattaatagctaatctctttgtttttgggggctgaggggaaattctcgtataaacataatttttgccaaaatttactaatctcgggcttggcccactttttccctccccctcgtttgactaatcccacaggcattggcatcttatcaactggatctttggtggaaatgtgccgtctgttgttcttccactcggccccctcccgccactgaacatcacatcccgcccgtcttcgccatcggcccaccgtaccatcgctcgcccattcgcccgcgcccgccccgccctttggcccaagcacatataaaagaaagatggatgagtctcgagatcataaccttttcctcttcgttttttgccctgctcttcgaagatcttcaactctctacaaaccccttttttcaccactttcgcttataaattttgggaagaacaaaaaaaaaatcaaaaaaaaaaagcggtacacgccccatgggacaatggacctggccaagttggaccccaacactccaagcctccaccacgtcccatagagacaataagacgtgcttttccagtggtgggggagacaaaaaggggatttccgaatcggttatgctcactgtgcctacgggagggacatcagccctccaactgtacggcctatcgaacggcggaccagcgaagggctcgcctcgctgaacaagggcggtgctccctttgcgcccgggaagggcactattcagacaattgctcgtcacgggcactttgctttcgatgtggagaaaaacatcacgttttggtatgcccgagtccggaaaagacacctaccaaggggagcaatttggctccgttaggcacccgtgcaccaggcggaaggacaccccagtgggaaaatgcgcccactacttcttcggcatccccccctcagggcaacagaaatggcactcaaattgccttggcaattgctgagggtgaattttttgcccctactaatgagttttacgccgaggaaaaaccccgaccaaaggcctatctcatgatcaaaaaaattcctgtttttaaccctaatggaccctctccgatgccggtacctgtcttttttgacccgggttcagcccgctttcatttcatcgcccctcgtctcgcggatccgccctcctctgatgtcacaagaaaacatgacagttgggggcttcttgtgggatggaccatcccacacaatgaaatttgcttcctctcgtttttctgtccgcctacgtcggaaagacggtggttgggagactgtggaattgaatgagagtcccaaaataatcctatcagtcgagtttttgagggaaatccattggaacccttccgaaaacgtaaaaatgggagtgacagttgaggagccacaaattttgcttggaatcaaggaaaacttcgggtggtttatgacgcttccgtgcatgagaagggcaaaccctctctcaatgagctgctcctccccggccctaatttagtccctgagttggcgggggttttactccgcttccgagcctcgacctgtccagtgctaggggatatagaaaaagcatttttggccgtgggacttaaggaggaggacagagaagcggcaaaattcctttggttgagagacccctccaaaccactgaccccggacaatttaatcattttccgtttcaaaaggattgcatttggcgtgagttcttctccgttccttctggcatctgtcctgcgctaccatttggcctctttgggggatccattggggctaatgagcaacttttacgtggataatttgcttatttgttgtgaaactgccgaagaagccgccgaatctgtacgcaaggcacgagaagtgatggcccgggccgggatgcgcctccatgagttcgtagccgcaaatcgagccgttttacggggtctccctaccgaagaagtgctggtgggtgatgtccaaagggtcttgggcatttcatgggatttgtcaagggataaactgatttttgagtttcctaaggcggttaattttcccccgactcggagaggagtcctgagctcaattgcctccctctttgaccccttagggctatgtagcccgtgcctcgttaaggccaaggtctttttccaatctttgtgggattaaaacacgggatgggatgccccgatcggggaaacgctcttgagcgaagtgccgttcacagacaatcccccctcaggcaaaaagagggaccaacggcgacaagggattttgaagtgggctgaccgccctccactctcaaaaaggcccaccctcggagccgacaaaggcaagcctatgcattttcactgggcgacgcgcttgcccttaatcacagtttttattccaattttaacccttttttgtggtacggatgctgccacccgggctctctcctgcgacgaacagggaatttgggtatttttgaacccacaggcggagaatagcatagtgtgctgtgagggcatatgcagcagtaggggaaacccttcaccctatctactgccccttcccccggacctgttggcaagcgcttttgagtgccacatctcctattcaattgcaggggaaaaaatctcatcacaaattcagtgcgagcccgtggaggggtgtagcctcatcaaatgctatttgtgttgggaaagagtccttaattcccattgctccccgttccttcttgcctttgcggtcggcaaatgaaggcgaggttgtcatacgccatcggaacttaatagggggagtggacccacccaatcggtcggaagtcgccggtcccgaggagttttcccgtccaatctcgccccgaatggatgcaaacaatccaaaccgtttaactcgtctaagttatgcgttagccccaacccttctcgcatttttggccattttaagtttttccttaatttcttcggtaaatggcggcctggaagtagtgtcagtctcagcagacacggaggagtgcattgttgaccatggggggacgaaatgcctattcaacagtgtcacctcccttactcttttacctattggccaaagggtggaattggttttccataccccccatacagtacccatgggcagtctatccttcgtcctaaaagggttggcccttcggtgcatcagagaaaccagcagttggacccggtcataccgactcaacatatcctcaatgctgcgttgtcctgcagcagggtcttgtacgggctccttttgttctgatttagagccctatcaatcagtaccagatttaagtgatgcttttccaggggtcaatttttgcaaggaagcatccggttttatccgccagggatgtctctcgccttcttatgcgtgcttattttacagattgtttgcggcgcctctttccccctacccctatgagctgtacaagtgccctgtttggcaattccaattgagactcgggattattttgcagcttaatgggtccacaaaagctgaagaaataactatgtctccagggattacccaccattggccgttagctaagttgtctgtcacctttacccccagcggtttgccacccttaccaattttgggaagcgattttattgctaaccgttcacatgcggcattggtccccgaatggcattgccaagaattctcgggtcgttttaagagagaatttacaaaaaaaaataatttccttaaaatctgcactgttttgaagattgtacactcggggagcagttgctttgttcgccgtccgacgaaccgtgtgccatcgaatttcttccactctgttactctccaacatttgcatgccattcgcaagggcggacgagttggttcaccaacagctgctgtgctacatcattgactccgtgccgcatcgtgcccttcttgaaactgagcccggcacaccactgatgcgccacttctgggcgcgacttgtgcgtcgacagaagagcggcattggcacggcaccgttggtgaaggacgcgcagcgacaagtcagtgctgcgtttgaacttctgaatgcaataatttaagctcatatttttgtcacaatttagagcaagtttataacaggaggccgatcgtccttattcataagaaatgttctgaattgaattcaatttccccgacagcgcctgccggcaccgggatttgaatccgacccagagaatcaaatctctattatatccggatcacattcccggcaaattttggctgggtcccggtcccgtaaggcttctaaaaacaggaaaatgtaaattctcaatcatttgtaaaaaggcaattggatttttagcccatgttttttgaataac

SEQ ID NO: 83020 - DNA, 724 bp, Heterodera glycines
  Genomic contig location: Contig_ID=SeqID_3061; Location=6661..7384; Strand=-
  SCN-specific regions: Sequence locations=1-119,142-278,300-555,577-724
gccattcggggaccaatgccgcatgtgaacggttagcaataaaatcgcttcccaaaattggtaagggtggcaaaccgctgggggtaaaggtgacagacaacttagctaacggccaatggtgggtaatccctggagacatagttatttcttcagcttttgtggacccattaagctgcaaaataatcccgagtctcaattggaattgccaaacagggcacttgtacagctcataggggtagggggaaagaggcgccgcaaacaatctgtaaaataagcacgcataagaaggcgagagacatccctggcggataaaaccggatgcttccttgcaaaaattgacccctggaaaagcatcacttaaatctggtactgattgatagggctctaaatcagaacaaaaggagcccgtacaagaccctgctgcaggacaacgcagcattgaggatatgttgagtcggtatgaccgggtccaactgctggtttctctgatgcaccgaagggccaacccttttaggacgaaggatagactgcccatgggtactgtatggggggtatggaaaaccaattccaccctttggccaataggtaaaagagtaagggaggtgacactgttgaataggcatttcgtccccccatggtcaacaatgcactcctccgtgtctgctgagactgacactacttccaggccgccatttaccgaagaaattaaggaaaaacttaaaat

SEQ ID NO: 83021 - DNA, 372 bp, Heterodera glycines
  Genomic contig location: Contig_ID=SeqID_18420; Location=327..698; Strand=+
  SCN-specific regions: Sequence locations=1-91,113-335,357-372
ggagcaaaagagaattttgtgctaatttgggttttggtgaatggctttggcatctatcatttgtgcttttatatgccatgatgtctctgcccatctctgctgttgccattttgtttctcttctctcagattaattgccgttcatctgtccatttgattttacttgggttaatttgagcggctaaatgccctcctgctagtgaatggggacgggcggcattttctttgctcgcacaatggcactttgggaaaggtaacttaatcttcaaccaaaaaatgaaaaacaaaaatgaatgggtttgatttattttctctttaggccgaaagtgatcatttaaaagtgaatttttataaaaattaagcatatgtctaa

SEQ ID NO: 83022 - DNA, 560 bp, Heterodera glycines
  Genomic contig location: Contig_ID=SeqID_18423; Location=1983..2542; Strand=-
  SCN-specific regions: Sequence locations=1-315,337-535,557-560
atggatttgcatttaagcgtaagtcaaaaaatggagggctataatttgtgttcatttagttctgttttcattaaattttcaaattctagcttccgcctttcaccgatttcactgatctccgccccgaaatatttgtccatccgtcgtacggatcaaaagaagaccttctcaatctgttgaaccctaaacacattcgccaggtaaaaaaaggtcgaaattaatacgatcaaatttagaaaattttcattaaaaatcctattgttttagcaaaaatttcatgaaaaatttaaaaatttaaaagtcctaactccaaaatttggcatcattttaatccgaggtccgctaaccgttcagttgaagaactttctgcgcgaaaacaattggccggtcagccacgaaattcggagggacctttggcgcgtgttggtctccaacggggacaaggagttcgactcctcacggcacttcttccacgaacacattgacactttgtttcgtggaaagggtaaaacggcgacacttttcccacggcgtcacaaagggatgggccaaaaaataaa

SEQ ID NO: 83023 - DNA, 115 bp, Heterodera glycines
  Genomic contig location: Contig_ID=SeqID_18423; Location=1032..1146; Strand=+
  SCN-specific regions: Sequence locations=1-115
atttcaattttgccttcgctttaaaaataaaaacaaaaaaaaaccttttctcttttggctttacattaaatttctccgcgtttttggcccctgatcatttctggggcatttctca

SEQ ID NO: 83024 - DNA, 2777 bp, Heterodera glycines
  misc_feature (63)..(63): n is a, c, g, or t
  Genomic contig location: Contig_ID=SeqID_18424; Location=1..2777; Strand=-
  SCN-specific regions: Sequence locations=1-97,120-129,164-332,354 -1047,1072-1509,1531-1618,1640-1848,1870-2274,2334-2541,2563-2777
  Gene Ontology: Mol. function=calcium ion binding; Biological process =cell growth and/or maintenance
tccgctcgtcccctccccccagcggtgcccctccgactccgtcgtgtactcttcccaattgcncatccaacagccactctatcagatttactaccttcgtcctgctgctgctgacccacttcggctggccgcctcctcctctccctcagcttccatttccgcttccgacccgagctcctccattctcaccactgtcgacgatatttctaccgccgttgcgcctctccgattagaaaccatcgcggaactcagcgggtgggacagccaatcgaaatgcatcgccggaggggaagaacagcgggggacgaacggacgagggacgcgcaatgagcaggacaaggtggaggagacggacaggtcggcagaggaagggaggatgcctcagacggaaggcttctactgggaattgtctctgaattaattggcgggtccatcggccgatcccatcatgagatggcatcatcagccgatcctctatagggtgatggcatcattgcctatgggatggcatcatcggtttatccccaatgggatggcatcatcagccgatcctctatatgctgatggcatcattgcctatgggatggcatcatcggtttatccccaatgggatggcatcattggtcgatctcctagcgggtccggggaatgccattctccccatcaattccgattatccgctcgttgtgattggttatgcttttttagcgtttgcaatgatcccactgatatcgcaagtgtcagctcctcctctgccgtcgttaacattcgtcgtcattcgtccaccgcctcatcgtccgccgattcgggaagaggtcccaaatttgatttttttttgtccattgttcccaaatgcttttccttgccctttcacttcttttcccgccgtttttcagctgattcgctctctcgtatctcctcatatccgagcactcccaacactttgccggtccgaagggaacgtttgcttgggggcagcaaatacggctctcaacggtcactttggtgcgaattgcccggtaattaattgtccacattaattacagctattaattatttaaaattaaaatactcaattttattccattaattacttcgcactctttcccttttaagaagtgaaagaagcgggccttctcgaccaattggacgacggtcagaagaaattgcaggaggcctatttcgaagtcggctgatttttttgggttttccttaaaaatcgctttttcgccaggtgatcacttccgaggcctcctatctccgatcgctctcttttctcatttcccactttatgtcctcgcccgaattgctcggctcaaagagtgaccgttccatcattacggtacgtgtgaatgaatatatactgttttttttactgtcaaattttctcgtttatttttttacttttcagacttccgagaggaaacatttgttcaggtggtcctcatattagcacaaatagtcccattcatttgtactttttctcagtaatattgttgcgattcgcgactgcagtgagcgccttttgtgcgacttggagacgcggctgaaggacagtttggtgctgagcgaactgtgcgacatcctttgctactattacgagtgccatttcagcccatacatcagctactgctccaaccaagtgattgatcaagcccacatcctaatttgagccatttacattccattgcttaaggtgtaccaggacaggaccctcaaggcgttgaagttggtcacagtgtttgaatttttctttggcatttgccttgatattcccttcccccccccccaaacagggcgtccaactcgctcttcttggcctgtattcagcgtctcgagacggaccgccaatgccaagggttggacatgcgctcttttctgatgctgcctatgcagcgaatcactcgatatccgctgctcattttcgccattcgagaacgactccatcccgacaaaatccaacactccgtcgccacgcgggcgctgactttggccaaccaggcaagcgaaggcgcggaaaagcggagacaatggcacattcattcccttcccttttccgtttgtgcacaattgcaacgaaggagcaaggaaaatggcacagacggagcaactgttggagatcgacgcgaaggtcgtctacagaggcagcgaattgcgccgcgttccgctggtgtccagcgggcgttatctcgtcaaaagcggacgcctctctcagctggtggtggagcgccgtgggacgagcgcactgaaaacgcggcatttggtaaaataacgaattaataattaagtattatttgattaattagcgcttaattaattaagtgattaattaacgtttcaatcatttgcatatttctaccattgatatgttggttttgttgtggtgcagatgctttttctgttctccgatctgttgctggtcaccaaagggcggaccaacggcactttcgtctgcaaagattacgcccttcggcgcttcgtcttcgccgaacccctcgaggcaaacgacgcgcgcgttcccttgcgcgcactgcacgccattggcagcagcagcagcaatttgcacctgatattgtgcactttagcgcagaatgccaggggcaatcagcagatggaactattgctgaatgccgacagcgaaagcgacagagaacgatggctgacggcgatgagaccgcccactgtaaggaaaacgaagttgggttggggggagccatgagagaggaagccaaaggagaggaaagagtgccaagggcgaggaaagagtgccaaaggag

SEQ ID NO: 83025 - DNA, 1446 bp, Heterodera glycines
  Genomic contig location: Contig_ID=SeqID_18427; Location=85..1530; Strand=-
  SCN-specific regions: Sequence locations=1-116,152-707,729-981,1006 -1230,1253-1446
  Gene Ontology: Cellular component=basement membrane
ttatcgctacttttaaattcgcagtcgcaagaatgcgtcttcttatcaatacaacggatgcgacggaaattcgaataatttctgcgacaagggacgattgtgaggtaataagagagaacggaagaaaaaatgagaaaccaatggcagagttattgcggagtcgggggatgcccaaacggagggacgccggagagaaacgaattcggacaattaatcgtttgtgggacgggagttaattgcccatccacgcacgaggcgagtgccattccaagggaacgtgggcggggggcggcacaggttgaaggctcacaaatggtttcagtgcacttcggtgaccaccggcacaagcgtgatcaaccgctgctgtcccaccagaggtgctcattagcgtaattggccactaatgagtgtgtctccctcagcttacatttgctccctgccgcctcagcagggcgccacttgcagttcgtccgcttcgtctcgctattactttaacattgtcaccaaagaatggtcggtccgttcattcataacacaaattgacagatgttcgttcgctttatgaatgtttagcacccaattcacttacaacggatgcagcggcaatttgaacaatttcggcaccatcgaacagtgcaacaatttttgcctttcggccgcttgtactcccggcgacgtggcttatgtgaacccaaacacaaaggtcgccctccccaccccctaccccaaagttggcatttgccctctcaacccggcacctttttcagttgccattcgagtgcaattccgcgctgagcaacagctgccccaacaactttgtctgcacctacgaccctttgtccacgaacagcgtctgctgcggtgccacaaacatgggtttgttcagtggatttgcttcatttctcgtgggttatttcttatggtattggtgttgtccgttttgatttccccttggatatttcatctttccctcttcctcatggctttttcttttcccatttcccctcaggcgtttgtcccgagggtgaaaaggcctatgtgaacgcgttggacatgagtgtgcgcgagtgtctcattaatgtggacggaagttgcccctccaattatttgtgccgtttcaacgcgcccaaaaatcgctattactgctgcgcgtccatttcaggaggtgctttttgttaaggccataattcaattcatcacaaaatattcactacagacctttgtccgatcggcaaagcattggttaaattggttatccattcaaaaaaaaatgtcccatttcaaagtatcgcgatccgtcctcaaaaatggcggttagatgtgccatcaatggacccaacaacccttgcccgtaattgatcagtcatttctgtgataaaaatattaatttctttcttcattagccccacttattcgtgccaatccgaagtgcaaagtgctttccag

SEQ ID NO: 83026 - DNA, 1294 bp, Heterodera glycines
  Genomic contig location: Contig_ID=SeqID_18430; Location=1596..2889; Strand=-
  SCN-specific regions: Sequence locations=1-321,346-592,614-616,638 -685,708-779,801-1294
gagggcatttatcgtctcatccacattttccggcagagcggtggttctttcagcaagattgatctactcgagaaaaagtattcggacaactacggcacccgtttgaactccaccgaggtgtaaagaattatacgttcgtttttaatactcttttttttgtagcgaaatcgtcttctcggtgccccggccgccactcgcattgccaaggactccttctcaaaggcggcctacccgggattatttcgagtcaccgagcgcatggccaattattacggagtcaatttgttgccatgccttacaggcatgaatttttcgcaaaatttgtttttcatttaaaattaatttcctaggcaactgcgtggatccttcgttgttttggtctgcttctcctcctttgagttcagcgccaagccgtccctccacctcagcgtctatcaaaagggaaccgccgtccaacgtaccatctccggcgcattccgtggacacaacagcacggaagcctattggcggaggacaagtaaaatgctctatctaactttttggaaattctgttttttgaagactagtccatatattttaactgtgagcagataaaaaacaaagcagaatccacctccttccctttctgaaatctaaattttgtcaaaaagaaaataattataggattgcgaaagaggccctggttttattattattattattattatcagcccaagcctgctgatgacatccctcaatttacgcacttctgtgggcaaaaaattgagtctgtgctgaggtagtttctttttatcattatctttttaaatgcattcatcctttttagcgcttactccgatttgttggagtctctgaaagaaccgccactttctccgccgttcactgttggccagttcgtgctgttccgtcatgataaactcggcatgtgccacgggacagttgtgcgtcaggacagtcagcatttggttgtgaagcacttggtcacgcaagacgcacactatgtcaagatggaggccattttcgcctttcccgaccaacttttgaaggtgatttttggtattactcaaaaaagactgagagccattttttacgacgacttcggtcatttctttgaaaaaatgggcagtttgcttaggctgaacggtatttttcttcattaaaccaaagcttgctgctttatttttaggagtgttcgacaaactctcgtcagccacgcagcgaaatggcttctcatccgggcactcaactcgcttttgctgtgcccattagtgagcagtttttccaccatttttga

SEQ ID NO: 83027 - DNA, 345 bp, Heterodera glycines
  Genomic contig location: Contig_ID=SeqID_18431; Location=964..1308; Strand=+
  SCN-specific regions: Sequence locations=1-65,87-345
atgactcgagagtatgctgacagcgaaattttggagtttgtgtccgcgggtccgaagcagtacgccttgaaacttagaagaaagaaggacggtgtgatttggcacaaaaccaaaatcagagggatgacattggatagacgaaacgaatttaaatatgatttgttcaaagagatggtgttggattacaagaaaggggtcaaaaaagtttttcactacccggagaagattgggccgacaaacgacttccgggttctctcaaaagatgtacaaaaagaatatacgccggtgcagaaaaaaggaattattgacgatcactttaatgttttgccctttggatattattaa

SEQ ID NO: 83028 - DNA, 647 bp, Heterodera glycines
  Genomic contig location: Contig_ID=SeqID_18431; Location=1390..2036; Strand=+
  SCN-specific regions: Sequence locations=1-81,108-115,139-383,408 -501,523-539,561-597,620-647
atgtcaaagaaaaacttccaagaaacttcaaaagaaattcgccgctcgaaaaatacaaaaaattatttcaagaacagtgctaatttgggaaaatgttttgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagatgagccgggctggaaaattgagaagatttcagtggacctttattgcagtgccctgtcagacccagtgatcatccctgcccgccccttccaacaatcgaacccagacattgttttcaatgagttcatgcacaggcagcaatcatttggggaagtgaatttgttagaccagagaatttcaataattattgccacttattctttccctgttaaataaaattttttcatttttccctttcattattttttgttcattccattattatttattcgagttttttttctttattaatttttcagttaaaatgtattcgtttcaaaaatattttgtggaggctctcgaaaaagaagattttttctggcagaaaaacagagcagaagtggaggcattgttaa

SEQ ID NO: 83029 - DNA, 2339 bp, Heterodera glycines
  Genomic contig location: Contig_ID=SeqID_3062; Location=37..2375; Strand=-
  SCN-specific regions: Sequence locations=1-145,178-189,226-333,377 -507,544-857,880-926,983-1254,1287-1356,1381-2047,2068-2163,2260-2339
atgaacagtaagaaaacgttggatttcctgagtgaaatgaaaaattaaaggggcttatacgaactgatcactttgccacgcttttaccaacaaacgattggccaaaccgaacgaatctctttcaaagacgcggccataattaatcaaatttattgcaaaggcaaatcaattaaatataattaagtgattttccatttttcagactcatgcaaaggacatgaggacaagtgccaaaacgggggctatttgaatccgaatgattgcacaaaatgccattgtccggacggatacggtggccaatactgtaaagaactcgaagagagtgagattaactaattatttaattcaacaattaaaataaattataaataaatttgaagatttgaattgcgaggatttgagtggaattccgagagaattggtggccaatcagtcagcagtgttattgaagacgaaggccaaatgtgtggggaataagccgtgccgatgccattggcgaattaaggcaataaataatatttatgaaatttttgaatttattttgagtattataaatgcaaattttaattgctttcagcctgaagctgggaaggcgcgaattcagttcaaaagtttgagcaatttgtttgagtgcacatacaactgctcatcggcgtatgtcgaggtcaaataccgagccgacaaaagagcccaaggcaaaaagacaaacaattaactaattaatcattaattagcaaaatgatggctcattaaggtgccaaactttgttgtgccgcatcactcactgatctgcaagcaaatgaatacaaaaattggattgaggcggaaaagccgggcatggacattgtcatttccgcgcgcctttcaacaaaatggaccgtaccatctaccgtattcgagctgacgtattcaggcaaggaaaattgtaaaataaattttattggtttttaaatttttttttaagtatttattattttaaattgacttttcttcaaaggctttcggtaaatcagaaccattacacaactgaaactgttcaaaaatgttaaggcaacgtcaagctcataaaatcgagcaagtgccgttatgccggcaatttgtatgccgaaaaaaggaaccccggcagcggcactttgcagtgttatgacgcggtcaagcaaaaatacaatgattgcccctgtagtgatggtgacaagaaatgcctcactgaagaaaaatggtcacacgaccactttgtttgcccaatattaaaggtaattaattcgttaattggttaattaattaatgccaaagggcaccgccacagaaaagttcacttaaatatacaatttaatttttaggcactaaaaattaaagttttttgttccttttgaatcaaagttgaacaaataacgattaataaggacgaaataagtgcaaatcttagaaataaggacaaatgatttacttgtaaactcaaggtcaatggaattcaaatccaaaaaaatcctggatacaattgggctcggattgatgttgtttgttatgtgagtttggtattctaatttcaaaaaccctttttaattgactaattttacagaaggccgaaggtggtaccgtaagcttttggggctacagtaagccgaataccaaagaaatcattcgggtggacgaagtccactgcttgcaagcttgggcagttgctgaagtgccaaaacagtccaaaagtttgcaagtcgaagaacagccgcccgccgttggcaaaaattgagtccgagtccattcttggccaataatgcttcatcacttatccatgtgttcgtgccatttgttggccatccatgagagaaaagggggagatcagtgatcattggatgatctgtcttctgccgctgatcagcattggccaatttccaatcagcaaatttattttttttttaaagtgtcattgttttgagtccctctctattcagtcctatacgcatttttaaacacatcatccaacagcatgtgctatataattttttggcaaaaagtacaaaaatatcctctcttaaatacacaagaaatatatatatatatatatattattatgtacaaagatttgtcaaatttgattaaatgcatcgaaaatatattaaatacaaacaaattaaaaagttaattaatgcctgtggagatgtctttttttgttcatcttttttcatgttttgtaattattatttttttaaatgacacattaatgtatttttttattcatttaattatttattattttatgctttataaaatatgggccaatatctctgaagacaaaaatgtttatgaaaaatttatgaacaaaaaaattttaaaataaa

SEQ ID NO: 83030 - DNA, 2247 bp, Heterodera glycines
  Genomic contig location: Contig_ID=SeqID_3063; Location=1039..3285; Strand=-
  SCN-specific regions: Sequence locations=1-225,248-583,605-840,862 -920,968-1134,1177-1383,1418-1564,1591-1742,1791-2035,2058-2126,2156 -2247
atgaaagatccggaaggtccgcccagcgaaaagcaccgttatttcgatgcttgtaacaaagtgccaacggaagaaaaatgcgaaaagtaaaagaaaattggatcatcattaattagtgaaacagtcattaattaatgagcggggcacagatttattaagtgccttaaaattgggtcgggtcactttggagcggcatttttggcgctaccaaatttaaagtaacataatgccaaaatttccagaaaacacaattttttgggcttttggccatatttgtggctcattaaattttgaaatttaatttgtcgacaaaatagttggcgtcaaagtggcctggcaataattagggattatggcaattaaaatttgaacttgctttaatgaggaatacattcagttccgaagagctgatcgggtgctacaaaagctcgaaaaaatggcccggaaacagtccaatcgccgaaatgtgccaaaaacatttggaaggaatttcggatggtgccgatgccaatgccaatgttgccggattcattgtcaaaatttgcgcccaccgtaacgaaaacgatctcgtcattgagtcaactttcaacatttccttctccaatgaaacgtataatattgattttgcatttaaaatttaatctgagaaataatcaaacaaaactttctttatattattcattagtaactcttaaataaacttcattaagaagtaaaatatcaaaaagtatatggccaaaaaagatcttacaaaattcaatttaccaatttttttttggacttttgaaaaattttctgaaatttcttaagataggtaggtaggaaccattagggctatctaatgctagcaagaatgtttaaacgttttgcttctaagcaattatgtagaaatatgtaatttattgaatcgatttgagtcgaattaaaataataaaaattaaaaataatatttaattgaaattaaaaacattaagttgcaaacggacgcgaacatttccaatttcgttggaaaaaataacagaaataacaaattggatgccaacattcttaatcgaatttggcaccgaccagcggaaaagcgcaatccgagaaaagggcgacgaaaaaagcatttgtgaagaattcaaaacggtcaaaaaaatcataaattaatttatataaattaatcattttttacagagcaatggcattggcaccattctcaaagacatttcgccgcaaatggtcaacggcactttggtaaaaataattcattttgtgccgccatcggatgatgacaaaatgcacgcgtttttccaaattgaaaggccaatattttcaaaacgcataatcaacgacacggatttgttgccctaccaagatgatccgaacagattcagtcagtaaaaaataaattgaatttttaaaaaattaatttcggcactttttaagacagtctagacccatgtgatgaatacggcgcagattgtgtgccgatcagaaatttgttgttgaaaattgaggcattggcaaactgtgggaagaacgaaagcaaaacaaacgcagtaaaaaatagaaaaaacagtttaaaaatatttaaaaataattttagattttcaaaaagccagactgggccccacttccgccagagatgccctggaaaaagccatccgaaacattgttatgtggaggggatatgttttgtgacaaacgaaggcttcaacaacagtacaacagattgcggaagagtgagttcaatttgcaaatttaattaattaaaaataaattaattaaaaacaaaattaaaaaatccaaattaaaattcacagtttgtggacttcagcccgaggaagtggaaagtcagcggaaaaaacgacaatacaacccattcgaaaaatggaccgaattcccgatcaaaatcgcattcaacaaagatgctcgtaataatcttgccacatcatacagtatttgaacaaatgttttaagtgccaaaggacgggtaccaatcatggaagcatgcgatagaaattggtgccgatttgataatgtgagaatgatatttttaggtttagttaattttcgggaaaatgtcggggtcttcagccgactttttatacaaccaaaaaaaaaaatgcgtaggggaggtttcatatattttttattcatttctctctcttctgtacagggaggtgacctgtgttcgatttgaatttgtcgataaaatggtgaaaggacagaatggaattgcggttaaaaatggtgttggcg

SEQ ID NO: 83031 - DNA, 465 bp, Heterodera glycines
  Genomic contig location: Contig_ID=SeqID_18433; Location=693..1157; Strand=-
  SCN-specific regions: Sequence locations=1-117,139-465
atgaatttgattgaatttatgacagcatcaacattcccatgctgtgctcccgttacaagcatctgcaacccttttggatgtttggtttggcggagtgtttatacatttggttggcactttttcaaatttggcactttcaaaaacataatgccatttaaaaaaaaggtttgtctgctctgcttggagttggcattgcccgctcgacaagtgcttgtgttcaaaaaggctgattcaaccctgccaaatgggacttacaaatcgtcaccgatccaaaatggtaaaatgccaaagaaatggcgcgcaatggcgccaatttgaattatcaatgaagtgccaaagaaatttaatacgaatttattaaaatgttgaaaattcaatgattctccttgaagcttttccttttgcatttagcttatctttacgtgatttgtagccaaaaaatgtacaaaaaatttaaaaaataaa

SEQ ID NO: 83032 - DNA, 826 bp, Heterodera glycines
  Genomic contig location: Contig_ID=SeqID_18434; Location=57..882; Strand=+
  SCN-specific regions: Sequence locations=1-55,77-231,254-289,311 -606,628-826
atgctttttgcaattggcaatttgttcctcggatttacgcgaaacaatccattcggaagcccgggggaattaaaaaatatgctaattgactattcgaaaagcgaatggtttgaacagaacaccaatgcaatggagacggtgctgcaactttggcagaaatttccaaagacggcactgctggttacggtaatggcaagggaaatattgtagtggtgcttttgtgccgaggacaaaacaatgatggcattttcatgaattaaaggcagagcgattatttatagtgaaaacgaaccaatatgtattatatgaaattaattttagaatatgttaaatgtcgacagaaagaaccgtttaacagccaaagggattttaaattatattaaaggatcatgccaaattggagagttcagagaagtcaaaagttccaaagatttgcgaatttttaattcagtgaagttcggcgaatttttaaataaactgcgaattatcaaactaaagaataaagcgaaatgtttgattgaaaagtatagggaattgaatggaacatacaaaaaaataaagataatggtaaagaaagtgatcgaagagcaacaaatggaaatcgaagaaaagaaaaacccggaaaaactcgacgattgcgaaacgaattgatcggcggaaaagcgaagcacccttcaaaatttatctaaaggatttatttgaagggagtgagggcaaggcatgtgagagggggcggcggacggacggagcctttagaaataatgtcgagagtgtttgtttttaacgtggattttattacaaaaatttcctttatttctaaaattga

SEQ ID NO: 83033 - DNA, 189 bp, Heterodera glycines
  Genomic contig location: Contig_ID=SeqID_18434; Location=1695..1883; Strand=+
  SCN-specific regions: Sequence locations=1-189
atattgatcataggccccaaactcaaaaatgctttaaaacggtcagaatcgatgtaaaaaggttcgaaatgggttggaaaaatagaattaggggcgcgcttgccctttttcaggctgaaaaagtgccggaattggagtgccaaactcagctgggactcaagtgaccgcactataaaaagcactcaaaag

SEQ ID NO: 83034 - DNA, 1812 bp, Heterodera glycines
  misc_feature (562)..(562): n is a, c, g, or t
  misc_feature (586)..(586): n is a, c, g, or t
  Genomic contig location: Contig_ID=SeqID_18435; Location=1151..2962; Strand=+
  SCN-specific regions: Sequence locations=1-332,463-941,1008-1726,1751- 1761,1784-1812
atgttttcggcaaagtcccaacggagggcgtgggccccccgtgccgccctcaacaacggcaccagcaaaaatggcactaatttcggcgatcgtcgctctttgccggtgaacacttcattccgtggcacttacagttggggcccaacgaatggaaaagcgaaaaacgccgtaaaaggatccaacggaagcgacactttgccaatcggtgacaattcgccaaaagaggcgtactgtacggtggaggaaatccaattgggcaaaaggcactcaaaatcgccgataatggacaacggaatgggtaccacaagacaaattcagtggaggcacaaaacggaggagggcgaggggaagtccgagcagggacaggacgagctggaggagaaccattacgaggacggggacgagggcgaggagagaaacagcggaggaagcagcagcagagagcaagcggaaggagggggacggcacgggaagggcacggcacaaatggccaaggtgggccatttggccaaataaatattgacactgctgtcgagctcattccctattgtatggcataatnttgcaattgtttaggccctccccncacgagtgccgcctcttccgccgccccttccgccacccaaactttttgggaatggaaagagcgagatgaagccgaggccaaagtccaatttgacaagggtaagcccgcttggcttatccaccgcaggtgttcgctaacggcatttctgttcagttttggcccgctttggcatttttggcgttctgtctgattttgttgtccatcgctttcctctctctgtgggtagccaacaacaacagcgaaaagaggcacaaaagtcagataaattggccactgaggctggtgccggtgttaaagccatcgtcgacgacccacgcgacgacgcccaaagggcggggaaaattaatagcgcaaagagaggaagaaaatgaggacgaagggaccgatgaagatggggaggaagagggagcggaaaagggagcattggcatcggaggaaagtgatcagcagtcgaagggagcggcggcacggccaatgcaatcggaaacaccggcaccgcccgagggcacaacggcactcggcggggatcagcagcagcagaacgcggtggaaagctgctcacaaatcctctgttcatctgccaaagaaaacgatcaccaatttgtggcacaacccgaggaattcgtccggtggattgccgacggacagatgagaaaacggctgcggttgttcgaagttcgggaaaggaacaggttagcctgacagaagagagagaatattctgactattttcattttgcttttggccattctgatcattttcccctttcttttttagtcattctgatcactttctgctactctgatcacccccccccccattccttttcattagtctaatcactttcacttattttgatcacttttctttcccattcgatcagtctgatcatttcggctactctgctcatcacctttcttcccctttgatcactttcagccatcctccgacccccgtggcattgccttcggccaaagtgcttcttctctcctctctgtcccacaacggcgtccccgtccatccgttgcaattccaacgacttttgcgttctgaggaggtcgaccacggctctgttgtgctcctttacgacgtccaatcatcacaacaattgtgggcccattatgccatttggatatttcgtgttcgtttcttttgtttcgtttcatttttcctctccaatttccccccttttcagctgttcggtttggaccgttcccttttgctaa

SEQ ID NO: 83035 - DNA, 976 bp, Heterodera glycines
  Genomic contig location: Contig_ID=SeqID_18438; Location=514..1489; Strand=+
  SCN-specific regions: Sequence locations=1-326,396-857,880-976
taaatggcttctattacgcacgtggtcttcgaccttgacggtgttctgatcgacactgaacgtcattatacaacggccaacgagcggacgttggagaaatttggagcaaaattcactcgagaaatgtgggagttttgtttgtttaatacgttataataaagcgaaacaacgacaggaacctcaaaattatgggacgcaaaaagacggaggcggtcacggttttgctgaaggatgcggggatagcggatcgcgttacgatggaccaatacattgcggagtacgacaaacacgtccttcaaatcatgcgcgctcttacggaggtgcaattggtgtgccttgctttcgcttttttctgcttttttaaatttttgctttgctacgcttcgcttcgtttttatttcatttaatgaagtgtaaatgcaattgttaggaattgcctggtgccaccaaattgatcgaccatttgtacgcccacaacattccaatggccatctgtacgggatcggacaacgaggagtttgcaagcaaaatgcttaaatttgacgaatggcttaagaagattccgcttcgtgtgctgtgcggaagtgacccaggcgaatgaacgctcaaattccaatttgttttattgtaactgtttcagaggtacgcattggcaaaccgaatccggacgcatacgaagtgaccattggacgttttgctgccaagccgacttcgccgaagaatgtgctggtgtttgaggactcaattaacggagtggaaagcgcgttgggtgcgggatgtacggttcgggtttaaaactgttacaatacggcacatcatcaaatttgtttccttggttcaggtggtgatggtgcctcagcgtgagtttctgccgaatgattggcccgagaaagaactccgttcgcgtccaaattttgccgccttgctcgattcgcttgacaatttttgcccgaagcaatttggattgccggattat

SEQ ID NO: 83036 - DNA, 2529 bp, Heterodera glycines
  Genomic contig location: Contig_ID=SeqID_18440; Location=528..3056; Strand=+
  SCN-specific regions: Sequence locations=1-692,867-1036,1080 -1368,1391-1397,1419-1931,1953-1987,2060-2125,2147-2178,2201 -2412,2434-2529
  Gene Ontology: Mol. function=transposase activity; Biological process= DNA transposition
atgaacgctaataaggagcacgcacataagctattacaccagcaatttaaaaaaggcgaaaaagcggcgcgaaaagtgaatgaatttctcggcgcgtatgtgatctctcctcgtcaagcgcaaaaatggttccaacaattccgggcggggagaaacagcaccaaacgcaaacttgggtctggaaggccgtcgacagtggacaaaaacgttttggcacaacggttgcgacgacacccggaaagttcctgcgcagaattgtcggtgggacattgccataaaacaacagcatggcgctggcttcggaaatctggtcgtcggccgatgaggagcaaatgggtggcacaccgtctgactgatcagcagaaacagcggcggctaaacctgtgtctttcgaacatcgcaagacacaggagaggttatgtgctgaaccggctggtgacatgcgacgaaagctacatctgttacgatggcacagcacagaaaattgtttggagaaagaaggttttggtcccccgactcaacctgcaccaaaaaaagcgcatgttgtgtgtcttttggtcagtacatggcccactgtactgggaactgctggcacctggcactattttggacagtaatagatacataaaccaactgcgggcggtggatatcgcttaccgcatccggcgccagcagggccaatttgacggtcccctactctttcaccatgacaatgctccgccacaccgtctcatttgacaacccagtacatttcccagacattgaattggaatgtgttgccccacccgccttatagccctgacctagccccctcggattaccacctttttctttctctcaaaaactttttacggggtaggcgcttcactgaagacgccgaggtcgaggaagcggtggggcagtacctgacctcaaagatcggcccagattttttccgtcgcggcattaggaaacttccttctcgttggaaataggttgttagggtccagggaaactattttgttgagtgatattgtatttacagttgttatgattgttatttttgatattttatttataaaatttttttttctaaaaaagcgcccttttttatgcaacgaccttaattgtgcaaattgattattcattttttccttccttttttatttttagcacattttcccacccgaacaatcgacggaagaagcagagaaagagcactcattatcggacgacagcgaaactttaatttgcaaggattgtatggacaaatacgcttttttgggcttttatgtcaaagtgccatcgacgaatgaggaggaaatgagcacaagtcagaacagaaatgccgaagaacaaagggacgacgtgtgcaaattggaagcaatgaaaaagaaaggggagaaggaaaccgggaaaagtgtgtggatggaagtggggtggcgagaggagctttgccggtgccaaaaatgcatggtaatgacccataattgagtctttaaatgggagagagtgaagcgcactgtttttcagaatctgtacgaagacttggactgttcgtttctgctcgagcccgaggacacactcgcgcactttgaacaacaaaaccgagaaaaggcatcccaaaaggacggggccaaagacatttaccaaatggtggtggaggagacgaaggaacacgaaacggcactgaaaatgatggtcggctttgagcagatgaagcgccactgtaaggagtttttgcacaagcgagcagacgaaaagagcggactcatcacgggggaggacgtggagcagtgcttcgcggagttgcgggcaaagcgcatgaaactcgaggaagagccgcagcaaaacgagccgaactctgggggggatgggccatggactcaggtggaaaagaaagggtaaagaaaagcatcagatttcgtatttagtaacaaatgtttgcgatttggatgtttggatgtaaagctctcttaaataattttcattcgcatttgcatgtgtgcttcggtggctcagtcggtagagcgtcagtctcataatctgaaggtcgagagttcgaccctctcccggagcaaaattttttgattatattttttatgctgttatatttcgaatttttttctaagtacactaattgcgctgatttgatcattgtaaacgaataaatgattcctggctataatcatgatttcgttatttataatttttaaaaaaacgactgttttgtcgatcagttaatatcggtcctcctttgtttgcttaatttttgatttaattttaaagcagtgactgcttggttctttattcaaatggtttgttttctaattcatttttaaagaattcaaatttataggggcgacacaaaaagactcagaaattccgcaataagcttcagaaactgatcaagccaaccgatgacagaatgttaggatttgaatttttcttaatgattgctaattaatgctggtaataattcagaaaagatgaaatccgcgtgaaaaaacctcccaaagaagatgaaaatgcacttaaaatcaaggaagc

SEQ ID NO: 83037 - DNA, 1061 bp, Heterodera glycines
  Genomic contig location: Contig_ID=SeqID_18441; Location=211..1271; Strand=-
  SCN-specific regions: Sequence locations=1-932,954-1061
atgtctgacaaccgaaacgaagcggagcaaaagatggcgaaagcaatgtaaaattaaaatgccatttttaaaatttcaattttaaattttgttttccttttttcagcttcatttccgccgattgttggctttgtgtgtacgatctgcttccggcttcacaacttggccttggaattgcgatgatcagccaccgttttgacttctacgtggatgaacacttcaagactcgtcgctggaatctgggatcgatgaaaatcaaaatgaagttcgaagcggatggcaccaaggaaatggatgttgtcaatgccaatttggaatcgtttggaattacgcaaaagccgttgccaaagagagtcgtcggattcaaagccatttcattgaagcgagattttgatacttttctgttttgtaaaacgattccatcatttttcacaggtacttcaacaacaatgtcatcacttttctcggccgttttcgtccaattttggccacccgtcccattcatttgaccatcgacgacacatacttcgatgaccgcactttggagtcgatttggcacaacatttggcccatgatcgcgacaaacattcgtggcatccaattgtccaaagaaagtttccgccgtttgcgcaaattcgtgccgtcaattctcaacgactgtccatcgcttcgcgttgtcaatgccaattccaatggtttcttcaccgattttccatgcgatgacagtgccgcagcatcgaatggacaagtggtagccaaatggcttttcactccccgttcggacaatgtgccaaaggtgttcaaatgctggttgaactacggtagctggcatttggagccagagattgaagacttcaaagcggtgattgcgatttgattgttttatttggcatttttacggtctttggcgcgcactgacaaaataattatgtatatccaaattggggcaccaaaccgtaaaattcatttatcatttcgtatttcttaaccaatttttccctattttaggaattttacacggcttcatctcccgtcaatttcatcgctgtcattcgcattga

SEQ ID NO: 83038 - DNA, 933 bp, Heterodera glycines
  misc_feature (829)..(829): n is a, c, g, or t
  Genomic contig location: Contig_ID=SeqID_18441; Location=1557..2489; Strand=+
  SCN-specific regions: Sequence locations=1-177,199-302,324-806,829 -889,911-933
atggcggaggaggagcaatcacttaaggtaaattgccgaaaagaaatgcacaaaacgtacaaagtgatttttgaagaaatttgtcaggtagaaaaattggatgaaagcgacgaaaagaatggataataatgaaaaatgacggagcagcaaccacttttatactaatttattttccaatttttacacaattttaataatcagtcgtagttcgacgccttactataaaagtcatcactagggccgcaacttttagtgactaaaaatctcaaaatagttaactaaaatagtgagtaaaaatgccaaaatagtgaagaaatagtgacaaaaagtccgaaatagtgacgaatagtgacataattttcagacaaaaattaagcaaaaataatttttattcactgattgcagttacaaatgaggtacatttccaaattttgaggcaagaaactcatccggttatcgcataaaattgttttgtaaatagagaaagtccgttcaacatcgcatgaagtgagaggggcgaatttgtagaatggaattacggtgggggaaacatcacaatcaacattttttccggaaagaatttggcaaaatttggcaatttgatcaaacgagggattttaagtcccccatctcgttaaaacagcctttggaggcattgccaaatccggaaacatttggtggtaaatggccgtacgttgaggtgctttaacaaaaacggccttcgtcttcgcgatcaatttgtcggcctttttgaattcatctcgcactttctctgcaacacggtgtaaagcatgacaaaggcacattgtgtgtatgagatttgtataanaaacctgagaaatatttaaaattaagtagtggaagttcccaactaattaccctttagttgttttccagcttttttcatgtaagctgcagcgtccgtgacaagca

SEQ ID NO: 83039 - DNA, 830 bp, Heterodera glycines
  Genomic contig location: Contig_ID=SeqID_18442; Location=664..1493; Strand=-
  SCN-specific regions: Sequence locations=1-114,158-205,237-322,344 -797,819-830
atgcttttcaaaaaaattggtacaggcttgggatttttatacatatttcttacatatttggggattacatgttatacatattttgagacgtttcttaggtataatttgcatccctaattaatgaataaatcaatatatttcataaaaaatatttaatcaatcagtaaactccagcaaaaagcattggtgtaaatcactcctggacaataaattattaaataataaaactaaattaacacaattaattaatggaaaaatacctttgtggccaaaacaaatcaatgaaattctctccagaagatgcgatattgatgacaatttcaaaaaagaagtaaaatgcccaaaaggtaattagactgtgccattgaagtgaccgtaaaaataaaaaataaatttcaatactttgtcctaattgttacaagatacaactgaaaaatcgaggacattggcgcctatctgcgtcaccggccccggacccaataagtcataattttcataaaacattggctcttaattgaaatgtttagtcatttttgacaaaagctaacgaagtattcagaactctaaaatcttcaggcctaatggcggcaacgctggacccctattttaccacatttgttaaaaattcacccaaaaaggcctgtgacaataaaaaacttgtaagcattttacgggtcaattttcaagtcccgaccccagtcccggctatttcgaaattaggaactgccataaacacatatcttccaccaatcagccaatgctggaatatttgttagttagttttcacaatttatacatcaaacttttttcaaaatatctgagtaaataaa

SEQ ID NO: 83040 - DNA, 750 bp, Heterodera glycines
  Genomic contig location: Contig_ID=SeqID_3064; Location=557..1306; Strand=+
  SCN-specific regions: Sequence locations=1-189,265-384,406-635,658 -684,742-750
ttttttgtcagtgccaatgccgccgccggtgttgcgctgacgcatgacgcggtgctgcgcgagttgggcgccgcgctgacgttgcgcaaggagcagtgcctgcgccgtgagcgccgtgcgttggcacgcgcccgcggccttccggacgaggcggcggtgcccgcggaggagttggaccgaacgccattcgcggcggcggcagcggcgtgccgtgacgcgacgaccattgtggcgccggcaacagcagcggtgatgatgacggcgctcaaccaggcggcgttaatgccgagcgccgaagcggtggcggcacagcgggtcgcaattttgagcgccggtggcggcgcggcactacatcagcgggacaagatggagcagttcggggacgatgaggaggacgaggaagaaaatgctgatgatgacgaagcggggacacagaaacagcgatgactgactcataaaaaaacattttgttaccgtatccgccgcgtgtatctctctcttactgtagtgccgtgttcataaaacccgagactcaccacttttgacctcgctgtttttggctgcgttctttattgaacgtggattttatcatatggtctcggcaaatacagtacaccacagagtactgtagtcgccggaaaaaacaaaatttttgtttattgaaaaaacttatccgttgatttgaatttaaattttctttcaatatgatttattttattttgtttttcatttaatatttttgtcaaatga

SEQ ID NO: 83041 - DNA, 1470 bp, Heterodera glycines
  Genomic contig location: Contig_ID=SeqID_3064; Location=2993..4462; Strand=-
  SCN-specific regions: Sequence locations=1-492,514-971,1000-1259,1282- 1386,1416-1470
atgtcgaaatcggatatgatcagccgggaaaaatcggaaattaaaatccgaagcttcaaatttcacgaattggcaccgatcacagcaaatttcgggaattgggagtccatgaatccaaaagtgtcgggaatcggcatgccgaataaaaaattgtcgggaattgcaacccgtcgattcaagaatgtcgggaattggcagccgaaccaaaaaatgtcgggaaatggaagcccatgggttcaaaatgccggaaccggcatatcgaaatgtcgggaatttgaatccatggattcaaaaattttgggaattcattttcagagcttgtggcaataccatttcctcgtgcgcagcgagttcatccgttgtgcactgctcgcactcagccgcgacctccgacgccgcgagcatttggcgttctgtcgcaatttggcgctcattttgaacaccgtacgtgccacaacaacatcagtgccgttgtgcgtccccaatgtgtacggcagaacgagcagcaggacaaatgccaacaatgtgttgataagcagcgccgatttggccgtcgcttcccgggcctcaatgtgccgtgctcagttggaatgggcactggagaggcgagtcaaaattggcatttggaattgtgttcgcgtgtcatgccaatctgagttttgcgcctttctaaggcttcaaccttcgccggacgacggcggtgccgactcagcgtggccgcctccgcccgacgttgtcaaatgcgtggaacaagtggccgtctcacttcggcacgcattggaaggtgccgtggcattccggggcgcaccatttttacagggaaatggcaagcatttgtgggcgccaatttgaatttgcgcccgagagttttggatttttgcccgcttttttggggatttatccatggcgccgtccctcccatttcgaattttacgactgtatggggttggttattcctcgattcaagacaattttaccaaaaagtttggcacttttttaggtgtaacacaaattgccgtcctcgtctaatgtctctcgatttattgtaacagaatgccaacaaaaactgtgcccgccgcaccaattgcccgccgggggcggcgacgacgcttcatttcactggaaaaatgccgatgatgaattggcacaatgccaagcgaaaagttgcggatcaatggtggacaatgaggaggattatcaggtggtagtgattggtggtcgagaatttggcggcgcgaaaattgaattttcgaaacgggaaaattaatttaatttttaattggctaattagagagtgaaggaaattatacaccaatgaaggcgtgataattaggtaattaattaaatgattacatttagattttcgagttggacactgccgctgttgaaaatggcaacaacaacaacagcagaaaggcggggaaacggagaagcatttgcgaggaggaggacgaagtgtgttcaaataaa

SEQ ID NO: 83042 - DNA, 1634 bp, Heterodera glycines
  Genomic contig location: Contig_ID=SeqID_3066; Location=1275..2908; Strand=-
  SCN-specific regions: Sequence locations=1-406,429-438,473-613,636 -896,918-1123,1161-1331,1354-1478,1500-1501,1527-1634
  Gene Ontology: Mol. function=ubiquitin-specific protease activity; Cellular component=intracellular; Biological process=RAS protein signal transduction
gtactgccccaactgcaaaacgcatcggcgcgccttcaaaaagttggacctgtggacactgccccaaatcctggtcatccacctgaagcggttcagctacggtcggtacacgcgggacaaaattgagacggagctggagctgcccattcgcgggctggacttcagtgacaaggtgttgaacccggagcacagccaggagaagtacgacctcatcggcatctccaaccactcgggcggtaagccgcgcgcttttttatgaaatttactcaagaaaaaatctgaaaatttttttgaaattcccaacgacgtctatcggcaccgcctgaacccctccaccatttttctcgtacttttgggaatttgactccaaaacgacaaaaaaatggcatttatcagcgaaaacgtctaaaaaattatatattttttttctcggcgctgaacatttaagaaaaacaaaaagttttaacccgaagggcaaaaaaaacattaggatttcccccgcctaaaacttgtgcaggctacgggcctggtttcaccattaattttgtaaccatttaaaaacagatttcggttgcgtcttccacaaaattgaaaaaaaaaatcgctttcctcctaataaaaatttaaaatattttgtattcacccccccccccccctcaaaaaaaatcgcatttctgatgttggcaaatttgcgacacaggccttggctccggccattactccgcttgtgccctgaacgggttgaactggtgcgagttcaacgactcggccgcccacccattgacccacgatgtgccggatgtgtttaactcacgcgaggcctacatgctgtaagtgtggttttttgtgcagttcagtccttttttattgccaagttttgtaaaattgttatgttacacttttttaattgaaattgtaacaaaaaaaaaattgaaaaattttctttcgaaaggggtttataatttttcttgcgtttttgataggacaataaaacaccaaaatttttgcccattcgtcttgcaccttccccaatccaaaaatgcgggctcatcttcaaatctggcactggcatatcaatttgtacacccaatatacattcattttataggggccataaattggcttaaaaaaatttttttttgaaaattcaaaaaaaaaaaccctgccaccctgtaacaggtactatcgtcgccgaggcgaacaacaaccgcaacaaaaacgccatgggaatgaggaggaggacgggcaacagcctcaacaaatggcaggcgaagaagcacaaatgcagcagcacgaggaggggaaggagtacgggcagcagaagcagaattaacacaaaacaacacacggacagacagaggagagagagagagacattttgctgatgatgatgagatgaggagagatgtgaatgatgacaacacaccaccaccattatgactcattaattaattaattgacggggaccgatggcaccggcacgccacatattttattaaaaatagataatacatacatacatatattcgttgctccatcatcatcattttttttaaatatataaagtgtgacgacacacctggcgacggtccatggaaattcgggattttttcgggacttggttctcctgggca

SEQ ID NO: 83043 - DNA, 481 bp, Heterodera glycines
  Genomic contig location: Contig_ID=SeqID_18446; Location=461..941; Strand=-
  SCN-specific regions: Sequence locations=1-481
atgtcaaaacatcaaaaaagtgctgttacgccaccaacgacgacgacaacggcggcagagagtggcggcgaaggagacggacgcactgagacgacaagcggacagcggaagcgacacagtgcaaaccaaacggactcggcgaacggcgccgctggggggcaaggtttgttttcgggttttgagttctgggaggggtccatgtccacaaaaatcgccacactgttcgtcattggtttgagtttaaaatggccgggagtaaaattatttgttttttcgaaaaaccatatcggagatcattttgataattgacccaggtgcgttttgaaataccccaagtccattgactcgttaagttaccgattgactgccggccaaacaatttgtttgtttagggtcgaataacgccgttgttttgtcctcttctgagtcggctgcaaaggaagcaaaggtcagaaagatgtcgacaacatcgcagaacaag

SEQ ID NO: 83044 - DNA, 126 bp, Heterodera glycines
  Genomic contig location: Contig_ID=SeqID_18446; Location=1616..1741; Strand=-
  SCN-specific regions: Sequence locations=1-126
actgtgcccgaacggccaaaggacttcaatgtgccggaactgccgccacaatcatcaccttactgccagccgatcaggtcaattcgtttgtgatcagaacgcagcaggacgagctcttggggacgg

SEQ ID NO: 83045 - DNA, 2086 bp, Heterodera glycines
  Genomic contig location: Contig_ID=SeqID_18449; Location=171..2256; Strand=-
  SCN-specific regions: Sequence locations=1-32,65-108,133-419,441 -672,694-786,808-1003,1025-1391,1413-1645,1667-2086
aatcccaacaaataaaaggtgaaacgaatgaattttttcctttaaaataataattttgcctttgaatgttttttatgtgcctaaaataaatccgacggaatttaactcaaataaaaataaaataaaatatttcggcgttattttgcggaacatatgggcaaaataaaaagaaataaaaagacatttgaccgggagagagagggaaaatatgtgaaaagttttaatttattatgagaaaaaagaaaagtgaacgaatgaaaaatcggcaaatcaaagagataaacatttgtgcaggtttcgcagaatcgcttcttccaaatattcgccaccatttttgccttttgggggcccgcgctaattatggtaattgtttatgtgaaactgtggaacgcggccaaggaaatgcaacgccaggacagaatggtaaacggaggaaggaaatgccaagggagggaatgccaagaaaagtgccgaagaaatgtcaagggagggaatgccaagaaaagtgccaaagaaatgccaagggagggaatgccaagaaaagtgccaaagaaatgcttaaggaaggaaatgccaaggaaggaatgccaaaaaaacataaaaaaactcactgtatttcaatcagtaggcccaataaatattaaatacccacctgtttggcaatgtcaaagcttgttccttccctctcccctttttaggttctccgatggcaagggatgcaatgccaaaataataccgactcagtgccaaactcaaacggttttcctgctgaaaaggctatgaacaattcgcactcatccgcctcattgttggcaacagcaaacgcacagctgacaaatacccccaggcaaaattaattaggggaaaatgaactgatcagtgatcagaacggagtaaagacaaaactttgaagccaatcaaatcgattggattattaatccaaactaccttaagaaattcgacgcggcaaaaagtccaacggcaaagcattgagcaggacaaaaacaacaacacgagcaacaaagcaaaagcagacggagaaggaagaggaaaagcggacaaaccaagggcatcggcatgttcactaatgaccggtgcaattcgaattcctttggtcggtcaattaaagacaattaaccgaggtcattcccacaaccaaccgtatccccccgccacttggccatactgtacctcttccgtgcctttttttcaccccattttctttctctgcagaaccgtaccaactcaatgagtaccgtacctttcgggatagcatttcattgggataccgtattaccccaccgttgtcttgtcctaccgtacacatgtctctgtctatccctcgtctcttttccgatctcatttttgttccctccgtcagttgggctcctattcctccaccgcctcttccgtagtcggcgtccttaccggcggcggatttggaaaatcgcagcacagtcagtgtgaggacaaagcccgaaagacgctgggcgtgatgatgtcggtgttcctttgctgctgggtgcccttcttcatcttggctttgctcaagtcccagcgcctcgtcctccaagtgcccacttggctcgactcgttggcactttggctgggctactccaacaggtagaccgacctccaatttctgaataaaagaagagtaatttaaagagccaccccatgcctcctaaagaacccgtttacccttccaaacaaaatttataggctgatcatttcactgatttaattaattaatttgatcgacttcttcattagtttggctttatcgaatggattgtctgtcccttatcaattagcttttatcgagttgtcctttgctcggctaatcatctcttatttccatcacccaatttgtgttcccttcttccatcagcgtccaatggtctgaatccgatatggcaggaacgctttgtgttccatgtgcggcacccggagatggcactgctgcgctttcatgtggaagacggcgatttcgtcggtccgaagacggatccgttcattggccaggccgtgtttccgctcgactccgtccgctgcggcttccgctccgttccgcttcattttgagt

SEQ ID NO: 83046 - DNA, 1427 bp, Heterodera glycines
  Genomic contig location: Contig_ID=SeqID_18449; Location=178..1604; Strand=+
  SCN-specific regions: Sequence locations=1-413,435-667,689-1055,1077 -1272,1294-1386,1408-1427
atgaagcggaacggagcggaagccgcagcggacggagtcgagcggaaacacggcctggccaatgaacggatccgtcttcggaccgacgaaatcgccgtcttccacatgaaagcgcagcagtgccatctccgggtgccgcacatggaacacaaagcgttcctgccatatcggattcagaccattggacgctgatggaagaagggaacacaaattgggtgatggaaataagagatgattagccgagcaaaggacaactcgataaaagctaattgataagggacagacaatccattcgataaagccaaactaatgaagaagtcgatcaaattaattaattaaatcagtgaaatgatcagcctataaattttgtttggaagggtaaacgggttctttaggaggcatggggtggctctttaaattactcttcttttattcagaaattggaggtcggtctacctgttggagtagcccagccaaagtgccaacgagtcgagccaagtgggcacttggaggacgaggcgctgggacttgagcaaagccaagatgaagaagggcacccagcagcaaaggaacaccgacatcatcacgcccagcgtctttcgggctttgtcctcacactgactgtgctgcgattttccaaatccgccgccggtaaggacgccgactacggaagaggcggtggaggaataggagcccaactgacggagggaacaaaaatgagatcggaaaagagacgagggatagacagagacatgtgtacggtaggacaagacaacggtggggtaatacggtatcccaatgaaatgctatcccgaaaggtacggtactcattgagttggtacggttctgcagagaaagaaaatggggtgaaaaaaaggcacggaagaggtacagtatggccaagtggcggggggatacggttggttgtgggaatgacctcggttaattgtctttaattgaccgaccaaaggaattcgaattgcaccggtcattagtgaacatgccgatgcccttggtttgtccgcttttcctcttccttctccgtctgcttttgctttgttgctcgtgttgttgtttttgtcctgctcaatgctttgccgttggactttttgccgcgtcgaatttcttaaggtagtttggattaataatccaatcgatttgattggcttcaaagttttgtctttactccgttctgatcactgatcagttcattttcccctaattaattttgcctgggggtatttgtcagctgtgcgtttgctgttgccaacaatgaggcggatgagtgcgaattgttcatagccttttcagcaggaaaaccgtttgagtttggcactgagtcggtattattttggcattgcatcccttgccatcggagaacctaaaaaggggagagggaaggaacaagctttgacattgccaaacag

SEQ ID NO: 83047 - DNA, 680 bp, Heterodera glycines
  Genomic contig location: Contig_ID=SeqID_18450; Location=980..1659; Strand=-
  SCN-specific regions: Sequence locations=1-225,247-309,332-495,517-680
atgagaggtatttttttctctgcactcttttatgcagtgccaactttaacccgtagaataagagagacgaccatggtatttatcacagcggcccaattttgggctccaagtacaattatgctggatttttcgtctcagtggtctgtgagttagtcaccaaaagggggtctcaggttcgagtcctccttatgttgtgtgttaatttcaatttcttcttttaaagaagaaggcagaattattttttcattaataaaagttttcgtgtcaataaaaaatcatattcaaaaagcgttggttacgtacaacatcgacaattttatgaaattttcttagcttataacttggcgaatactagagcaaataaaaccattttatgctcattttgaagggaaaattctagagaatattgttagttttatttgatttggccttaaattgcgcacttggctaaaaaagaattaaatttattgaaattttcactagggtcaaaaaaattttcctcgggtcagattttcttgaaattttgcataggcccatattttgacctcctctatcgaatcacagtttattttttagctgtctagtttttaactcgagatcggctcttctttttttgcaagggaaaatctccggaaaattttaagttttgcaaagttttggcgttctgattactaaataaa

SEQ ID NO: 83048 - DNA, 495 bp, Heterodera glycines
  Genomic contig location: Contig_ID=SeqID_18451; Location=190..684; Strand=-
  SCN-specific regions: Sequence locations=1-209,233-495
atgaatgataaaatcgactggctcggccgcttcgatctctgggactcaacccaccagcaattcaatctctggggctcaattctccggcattccaaacaatgggactcaaatctcccgcaatccaaacactgggactcaacccaccaactttcaatgacattccaatctctgggactcaatccaccagcatttcaatctctgagactcaatccaccagcattccaatcactgggactcaaatctccggcattccaaacacggggactcaacccaccagcatttcaatctgtgggactcaaatctccggcattccaaatactgggactcaacccaccagcatttcaatctctgggactcaattgtcaggctttccaaacacggggactcaacccaccagcatttcaatcactgggactcaaatctccggcattccaatctctgggactcaaacctccggcattccaaacactggaactcaaatctgcggcattctaa

SEQ ID NO: 83049 - DNA, 384 bp, Heterodera glycines
  Genomic contig location: Contig_ID=SeqID_18451; Location=1011..1394; Strand=-
  SCN-specific regions: Sequence locations=1-384
atgacaattgtatctacagtaattatttatgcattaatcgccttaataattcattgtcggaaaggtttttaaatgctgcagcaaatttcgaatttttttttgtttttttttttgccatttttttcagtaccgtcaaattcaagcgcggcacaatttatcaaaagaatttttcgttcactattcataatcgttttctttaattttggtggttatatcatttcaatattcgctgttatattactggaatcaattgacattgatcacaattccatatttttatggaattgtaaacaaattatgggcattttgttacattttagtgctgcttcatgtggcccaattttgtttttgacaaggcaaaaattgaatttattattaatataa

SEQ ID NO: 83050 - DNA, 345 bp, Heterodera glycines
  Genomic contig location: Contig_ID=SeqID_18452; Location=446..790; Strand=-
  SCN-specific regions: Sequence locations=1-193,216-224,247-345
atgaatttaatgactacttttttgacaacaaaaagaaaatcttgggttcttatttcatttcatttccagtgagtcacaattaaaatttcccttaattgacccaattatggctaattaaggaactgtggacccgagcaaaggcttttacgacaaaagtgaggacaaagcaacattggtcatcgatttgacagtgaaagaagcaaaaaaggagcacaaataccaacataattttgtaaagtaaatgtttcggtttgaaatttacttgacggcatatttttattccgaaagttattagagtaaatgttctcacattttgatggcttattttatttgagattcaataaa

SEQ ID NO: 83051 - DNA, 649 bp, Heterodera glycines
  misc_feature (476)..(476): n is a, c, g, or t
  misc_feature (640)..(640): n is a, c, g, or t
  misc_feature (649)..(649): n is a, c, g, or t
  Genomic contig location: Contig_ID=SeqID_18454; Location=32..680; Strand=-
  SCN-specific regions: Sequence locations=1-14,36-251,273-493,522 -591,613-649
atgccgcaaattaattttgtgattattttattcatatttttattcgtgctaattgatggaattgatgaagatttatttgatgatttatggaaaaaccaaaagccatcgacctcaaaaaacttcaaaaaacaaaaattcggtaaaaattatgcaataaaggaagaaattgttgataataatgaaattcatgaacaacaaaatttcaataaaataaaaatggaagatataaagccaaaaaaattgcaaaatattaaaaaggaacaattggaggatgaaaataacaatttaaaaataaaagtgccaaaaattgaattggacaaattaaacgaagatccatttgaaaaagagtttaatgaacaagttgatcagaatatttcgtatgctgaacaaagcaattctgccaatgaagaagcttacaataatacggtaatatgaccgataaaagaatatcatacctagaaaataagtatttttanaatcgataaattctaagattttaattaaaaataaatgattttttagaatcgagaaacaagaaacaaaatggagattttaaacgaatttaatttgatgaaaaggaatttgcgaaagaaagtgtttataaaaatttgtcccattctccattgggaatgtgaaattngcaaaaaan

SEQ ID NO: 83052 - DNA, 1110 bp, Heterodera glycines
  Genomic contig location: Contig_ID=SeqID_18454; Location=936..2045; Strand=-
  SCN-specific regions: Sequence locations=1-59,82-112,134-218,242 -293,316-615,685-775,797-875,898-1065,1097-1110
atggatatttcaaacgaatttaattttatgaaaaaggaattacggtggaattataaaataatgccaattattaaatttgaacgtgaaattgcaaaaaagttggtacaaatcgtatataaatttattaataattgaagcaaaaattaatattgacaatcaatttaaattccaattccatttaagggaaaatgaaaatttacatgtgcaacaacaaaagcaaaataataatttaaaaataaaactgccagaaattgaattggaacaatttcaatgcttttcttttttctgtattctaaataaataattaattatttagttcaaatttatcagtttccgagactaaaaaccgcggccgagaacatagaccgagaagcaaaaacccgacaaatttctcaaaccgagaaattcgagtctcgcacatccctaataaacgctgtttttttatctaataaaaagaaaatgatagttggccaaaattaaaaggataaaattttttaaaattgcaatagaatttaaaattttgaagcctaataaatctatttgttaccccatgtcaaaaatactaaactatgacgaagcggcaaataccttgaaggaaggtactgtagttaatagaattttattatttaaattaaaattctctaataaattaatttttttatttagtttcatttattaataaatcgagtttttttttattcatttcgattttgatggttataatatttttatcccatcccttagcaattttctttccaattcaaaaagttctgagaatatacatacatacatatctctaatattttcggcgttttttgggtttatgtgaaatctttttactcaaattaatgtttaattaattgaaaaaagagcgaaattaataaaatgttgataaattaccaaattatgttaaatataaacatacaaattactaaaaattgaccctaaattatattaaccacattatcttaatctgcacatatgtctatttcaggatttattctgtaaaagaggacttaggtgtccaaaattccgacggtgccattatcaaattttctgatgcccaatttaatttaattttttatttaatataaatcgaggatcaataaa

SEQ ID NO: 83053 - DNA, 919 bp, Heterodera glycines
  Genomic contig location: Contig_ID=SeqID_3067; Location=1770..2688; Strand=-
  SCN-specific regions: Sequence locations=1-121,155-301,324-514,536-919
atgaaattaccgttaccggtttgtctagtaccggtaccgccggtaaaaatttgcactggtaagaatgggggtctggtcgagaaaagagtaggaaattggtgaagaagaagaaatttttgagaaaaaatttaaaattttaattttaaaaaatattccaacttttttctttcatgttaagcatcctaaaaacccaaaacttaatcaattgttcattttttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggccgctgattattcaaaaaaccgcatgtttctatgacttataccggctgaggtatgggcacttcaattttgacgtagtgtaaaatgcactattttcttaagaaatacagtactttttataggcaccgaaataaaagtcgacgtatctcagcgggcctaaatcgtagacccactattccaaaggcaattcggtagcaaattttgtgctctataaaatgggcctactcaaaatttccagaaaaattttcccaaccccctagaaattttttttgaaatttacccctcgttcccagccaaaatgggctgatcagatcaccatgaaggagtgatctgatcaacttggtgttgctaccttttttgatcagcatccaaagttatgcttacctgaatttttttagatttttttaatgctgatccagagaagcaatattttaaaaatgaaatgggacttgaccacctatattttgatcaaattgtgaatatggtaaaataaatcaaataaa

SEQ ID NO: 83054 - DNA, 62 bp, Heterodera glycines
  Genomic contig location: Contig_ID=SeqID_3067; Location=1762..1823; Strand=+
  SCN-specific regions: Sequence locations=1-62
cataaacatttatttgatttattttaccatattcacaatttgatcaaaatataggtggtcaa

SEQ ID NO: 83055 - DNA, 757 bp, Heterodera glycines
  Genomic contig location: Contig_ID=SeqID_3067; Location=3477..4233; Strand=+
  SCN-specific regions: Sequence locations=1-3,72-578,681-757
atgtcctttcttttcggccattgtcctttttctctttcccttttttgcttcttctttttcctctgcttttcgctgctcgttttggctgatgaatttgccgaaaatggccaaaacggcgctttaaaaagccaaagtcagcccaaggaaagacggctgcgaaatcgcccacgcgactttctgtcggaatgtgtgacggggtaccgggaacggatcgaattccattgccaattcccgaacatggacaagccttgtctgcgcgaaaatgccgaaggtgtgacgacgttggcactcaaattcgttttttaatggcgatggggcccatattgtcctcaaaatgatctctttcacccacagattccgtccatcagttggacgtgttggctgccgagtgctgtgcctcccctcgcctttgctccgtcgatgacattgagtcgttttgctgtcgtacgatggactgcttgggcctgtgctatggcgactccttcttggcacaaattcaaagccgcttccgttatgcggacattttgctgaaacggcactcatcaaaaggggcggaaaagaggggacgaagaacgacggaggaggaggaggaagaaaaaagagatgaagaagaagaataatgagatggacgatgaagaagatgatgatgatgatgatgatgatgatgaaaatgatgatgaagaagaagaataatgggacgaccgagtgaattttgaggggagatagaaaagaaattttgcagatcaaaatttacaaa

SEQ ID NO: 83056 - DNA, 1639 bp, Heterodera glycines; identical to SEQ ID NO: 3069
  Genomic contig location: Contig_ID=SeqID_3069; Location=1..1639; Strand=+
  SCN-specific regions: Sequence locations=1-217,240-502,524-996,1030 -1356,1394-1639

SEQ ID NO: 83057 - DNA, 771 bp, Heterodera glycines
  Genomic contig location: Contig_ID=SeqID_3071; Location=147..917; Strand=-
  SCN-specific regions: Sequence locations=1-230,252-731
atgacgaggaaccgaaactccttcaacaataaaatggaagggaagggccgtacggaacttccgttttttcgggacttattttcccggtgttacgctcaaaaaacggggccgtgagtcccggcaaaatcccggcggagccccagtcccgtcctgtctcaattaattaacaaggcaatttacaattgatacacctttaagtacatttcctccgcttgttcaaactttgcgtcgtcttccaatttctccgcaaatttttgttgtaccaatggaaatcgatgggaagcgccaaggcgacacaattcgaaagcaaagtcaaaatcactgcgaaaaaatagaatttattcatttttttataaatgttgcactttttggaaactgccatattaatggtctcctccaacaattggtgcttattcaacaatttgacagccgaatcgccacccaaacttttggcccattggtaagcaacctgaaaatgcagtaaaaagtcattaatactaattactaagtggaaaaatccgatgctggatgaagtcaaaatcaacgacgggcgaagctcggcttaacatttgatgtcgaagctcgaaaccaagcccaattttttcgcagtatgaagtactagccccaaaaatgcgaagttttcgaagtacgaagctcgaaattcgaaactcacccgtccctggtccgaattaggtggccaaaatttagtcaaatgggtcaacaaggcgtagtttataaaaaaattaaaattactttaattatttaaataaa

SEQ ID NO: 83058 - DNA, 1711 bp, Heterodera glycines
  Genomic contig location: Contig_ID=SeqID_18457; Location=1..1711; Strand=-
  SCN-specific regions: Sequence locations=1-126,148-175,198-243,285 -365,389-439,461-507,558-680,702-765,808-819,841-944,1170-1200,1222 -1266,1309-1362,1401-1545,1597-1612,1635-1711
  Gene Ontology: Mol. function=protein binding; Cellular component =nucleus; Biological process=muscle development
caaaatgtgtgatgcctatgcttcatcctctcatcaatgtgccctaaatttcaggtgactttcacaaaacgcaaattcggcctaatgaaaaaggcctatgagctgtcggtgctttgcgactgcgaaattgcgctgatcattttcaactcgtcaaatcggctttttcaggcaaaataattttaaacatttattaaattgcgtttcgattcactttttacttgtacagtataccatccccttttacagtacgccagcacggacatggacaaagtgttgctgaagtacacggaatacaacgagccgcacgagtcgcgcaccaacacggacattatggaagtgagtaagcgatgcggcgaaaagaaatgttaaaaatattaattttttttttgaaatttcgcttttttgttttaaattttgaaaccgaacttagcgttgttaaatactaagcaaaattttataaactaagctaaaattgtggaaattttaactataattcccatatcttccaattttataattaaaataaattaaaatttgtttttaaataatttatttttgattgattttttgcccccccccccttcagacgttgcagcgcaaggagggcaagcagggcgtcggcgccgactcggacgacgacggcttcagtccccccgcgagtccgtccgctttgcccgccaccgtcggcggcggcggtggcgtggcacaattggctaacgaccaccaaaacggaaatggtgggaaatgtatttttttgaaaatcgaaataaattttcaaaaaattttcaggcgctttggcctcccaaatggcggcactgagcggctcggctggcactgcggccgccttcacacaatcgcaaattgcgacgctggcggcgaccgcggcacagtacgccaacggacaacaaggcgagtgccaaaacttgaaaaaaaaaacaatttggataattaaaaaaaaattattatttatttgcattgaattaaaaataattttttagctttattaagtgaactttatttatttaaatttaaagaaaaagtcattttaattaattacattaagctgagattttagattaaaaataattattaatatttgcatattaattaaaaattcttacaatttatgctattttaaattaaatatctctttaacttttaaattaattgtccaaatatataaatgatttaatgttgggattaattatcatatttaatttaattatctatttcaaaagtaccaatttttctatttatttgcaaacgaataaattagttaattaactaattattatttttttaaataatcgacaatataaattgaatttttaaattcatcttcaaaaaacaattttcccattgattttttaactatatttttaaaataattaacataattagcaattttactgtttattttgcgcctgtttaggctcatccggcgcctctaccgcctccgttccgtacgccgattttaacggcgtccaaaacattgcgcaacaaatttttgggccaaactccgccacgaatatgttcttgcaacttcaacaacagcagaggcagcaacagcaacaacaacaacaacagcagcaacaagctgcaccaaaaattgtacaccaccagcaacagcaacaacaggtggaaaggaggggagaccgggaaactttgatcggatggggatcccgaccaaatcccgcttatatcccggtca

SEQ ID NO: 83059 - DNA, 1152 bp, Heterodera glycines
  Genomic contig location: Contig_ID=SeqID_18459; Location=543..1694; Strand=+
  SCN-specific regions: Sequence locations=1-229,265-267,289-991,1013 -1152
  Gene Ontology: Biological process=embryogenesis and morphogenesis
atggccagaacagcgtattatggagttgtaccattttatcagcatggtgttcaactgtttgctgtccatacggcactgaattggaccaccgattttgatgcacggaatagcagtgaaatttatctaacggaatgggatttgaagagcaaatttttggattttgctgaaacatattgtgtgccaaaaaagtgagtttggctctagtaatcaataaatcaaatctaagacgaattttttttttaaatttagaattttattatttttgaactcattttattttttgaaaatttgcacaattccttatcatatttcatcgaaatttgcacaaaaaaaaaaaattccggcaccgctggaccccataacacataacattctttattgataatgtgaccctaaactacatattctttttatcaccccggcactccaaattaaaaaaaaaacaacattggataaaaatgtttttagcccgaagagcaacaacaaaagttcttcgggtgcatccccgattttttttctggatacgggcctgattatagcccaattaataccaatttgaactgataaaaaataaaatggttttattcctaggaaatacaatattttaatttattatttctgaatatattcaaaaaacaacaggtggactggcaattgcgacccatacgacccgaaaatgcgtgcctggtttgcggcaaagggttggacaaagcgtttggagtcttggctgcctgtgactgtattttaattacagtaatgcaatcctgaatttttggcctgttggctggctgttactgtatttccgttacagtagtttactcaatttaatgttagcaattttttttacattaagccggttcaacttattaatgaaatagttcggtcagtatagtagtatatgaattttctttcattttccgggtctcattccattgttttcttgcctttttaccaccaccgtttgtctattttacatattatatgtatgcacataattttatttatttttttacgccaattacattgaatgatggcaaatacttattcaaaatggcatatcttttcaaacatttagtctggttatatcaaatctcttattgttacatatgcatatgtgtgttagcttctttgtttttttttcatttgaagaaa

SEQ ID NO: 83060 - DNA, 177 bp, Heterodera glycines
  Genomic contig location: Contig_ID=SeqID_18461; Location=25..201; Strand=+
  SCN-specific regions: Sequence locations=1-46,75-99,122-177
atgcggccgagtgagtactttaagctcaggaaaataattaactggggttcattatttatttattttttgcaaaattaattcataagtattttttcagaaagtgctctgaaacacaccaaactttatttacaggttaattaaggctctctgatgctttttctatcaaaagggagatga

SEQ ID NO: 83061 - DNA, 1100 bp, Heterodera glycines
  Genomic contig location: Contig_ID=SeqID_18461; Location=401..1500; Strand=-
  SCN-specific regions: Sequence locations=1-78,100-480,502-607,643 -712,735-777,815-939,966-1012,1048-1067,1089-1100
aaaaattttattcatctcccttttcgatagaaaaagcatcagagtgcctaaactaacatgtaaataaaatttggtgcgtttcagagcattttctgaaaaaatatttatgaaataaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaaatttttttgaataaaaattatttaaatgaactgactagataatatttaaaataggttatttctcttcctttcagtatccctgcaaagtttgctgcgcttctgatcagtttctgaaaaaacgttaagcctaacatcggttcagggggactgccccgaaaacccaaaaaaaaattttttggataaaaattatttaaaaaaactgactagataatatttaaaataggttatttctcttcctttcagtatccctgcaaagtttggggcgcttctgataagtttctgaaaaaaaagttaagcctaaactttttggcctgtttaaaaaggaattaaaaattttttaaatatttattcatctcccttttgatagaaaaagcatcagagtgcctaaactaacatgtaaataaaatttggtttgtttcagagcagtttctgtaaaaatacttatgaattaattttgcaaaataataaataattaatgaaaaagt

SEQ ID NO: 83062 - DNA, 1236 bp, Heterodera glycines
  Genomic contig location: Contig_ID=SeqID_18462; Location=969..2204; Strand=+
  SCN-specific regions: Sequence locations=1-718,743-883,926-946,1005 -1117,1178-1236
atgattgtttcaaagaaaatcacgttggacgacggcacaactattaatggcaccagtgctgcgaccgtcgactcgggcacttcgtttctgatcggtccgtttgatgaggtcaacaacattttacgccattacggcgttgacccggaaaacagcacaatgccatgtgatcaaaaatttggccccatcattttcacgatccatggccaggaatacaaagtggaagaggtgtattgtggttgattgagcgttgcttttttcttgagatttattaagcaaaatttgtagtttatttatttgtttttttgatatttcactaactatttaaggaaaagacgcagatttttcgttttttttttaatatttccttttattgagccctcctgaatttgtgccctcttatgattataaagtttaccttttgatcaaagttggaaaataaagccccgggggatttaatttcaggaaataggcatttaaaaaaatccttataatttcatttgagatcatttggttttaataacaaagacccagtgaattattatcatatttaccataaaattttcctctggaactatttatcaaatactatgaaatttttaaattttccagctaaaaaacatgtgtaaaaaacagtttgaaaaatcacacttttaagtctggtccgaacggttttctaattaagaatgatttattttttttaattatcatgccgttcacgtaaatataaaattttaaaaaatttcaaacaaaattatagaagacgctgctctttgataagggcgatggcacttgctttgtcggcctgcgcaccttgaactcaatcccattttggctgcttggtgacccgttttgccgtgaatattgccaagtaaaatatccacacttttatttatttttatatgtaattttaatttctaaataatttctctaagtaaaaagtgaggagaaataatttttaaataataattattttttaggaaaattaataaaatttgattaattttgcattttcaattttttgctctgtattatatttttatacaattttaatcaattttaccatttaagattcatgacgtcgagaaaaagcaatttgcattgccgcaagcgatgaaggaaaaataaattttttgaaaatttacaaaaatggaaaataattattaaaaacattaaatttgtcaaatgctacctaaatgataaaaatttattaagggtggatattgactttattttgca

SEQ ID NO: 83063 - DNA, 668 bp, Heterodera glycines
  Genomic contig location: Contig_ID=SeqID_18463; Location=463..1130; Strand=+
  SCN-specific regions: Sequence locations=1-246,268-343,367-425,449 -531,582-668
atgatgctgtgggaggacgctccgaacaatgcgaacagagttttgctgttcaatgcgttggcaatttgcatcaaaaaggtaattggcgaatatgacgccaaatcaatgaacacaaatttggacaaattgaaagaatttggggaaaaaacgagccaaaacatgctgaagtgtatggcaagattaagctcaaaaaaccgccaaataaaagaccaatttttggccaaattatatttggacaaaattaccaaattaattgaggaagacgcaattagtgaacagctggaaaaagcgctaagagaaaagagtaatatttttttattgaattaagagaaaaataagccaattaaaaaataagaaacaaaaagagaagcatttttatttagcaaaccgcaaaatttagtttaaaaagctaattgatcccttaatgtttcttgtttgtattttaaaacttcagatgagttactatacgaactaatgggttcggaggatgttgacaaacttgagcaactctataaagtgatttttcaagacttttatttaatatttatattttccattaaattaattaataattttattttcagcaaaatcacagttattttttgccttctgaaaattttatatcgtcggacgaagaaacttttcatgatgcagtcgatgataaatga

SEQ ID NO: 83064 - DNA, 2082 bp, Heterodera glycines
  Genomic contig location: Contig_ID=SeqID_18464; Location=230..2311; Strand=+
  SCN-specific regions: Sequence locations=1-166,189-624,650-878,910 -1055,1077-1235,1289-1305,1327-1643,1668-1714,1750-1776,1798 -1801,1831-2082
atgaacgaaagtgaaggccaacagagcaatttgaacaacgaaagcgaatggtcatcggaaaagaattcgtcgaaaatttgggagcaaaatttgtcggaagaaaacgccaaaaaaataaaggacgaaattttggggttaaaaacggaaacgaatttgtggacacagacggaccaatacagaaaggggaagagcaaaaagttgaagaaaatttacaaaatggaggacaaaatgggaaaaagtgaggaagaaaattcatcaaaaaaggacaaacaaaatttgaactcaaacgccgaaacaaaaggccaaacatccaaaaagttggaggaaaattcaaatttgaacccttcaatgctaataaatactgaaaaaacacatcaaatgctggagggaaaaaatcaaagcgaggcaaagagtcaaaaggccgaaaaaaaattgaaaaaaatcaacaaaaaacaaccgaaaagtggaaaccatgaggaaaaagggcaaaacattagcaaaaatgacgacatatacccaaccgattgcacaatgttaatgggacaattgggaatctacaaaatcaggggtaatgttgaaaaaggctaatatgttcagtttatggcccaatcagatttatgcgtctaattataatataatttatttatttctgtgcattttaaaaatttcactgttattcactttttatcttttggcaaaaaaacagtaaatgtttgttgttggccgtgttgactccaacccaaggcttgctattaacaaatcacaaaacaaacgtacaaaaattaacatgattctctctctggccgattaagtgcatcattttaagtttcttagattgtcttaaaaaaacaattggacgcataaaaagaattagagccataaataaataaattaattaattaaaaatatgcaaaaaacaatcatttaaattcattaagatttatttaacgattcattaatgagaaaattgcacataagttcattggaaaatgttttttacaatgaatgtgaaaaatatttgggcatttctgcatttgcactcgcaattgaggcaaatttggaatttaataaattttgccatgaaaattatgcacagaaaagtgaatttgaacagttagaaaaaagttgggcaaaatttattacaacagaattggatcgatttgaaggaactcaatttttgttggagaaattatattttgtgctgaatgagctgatcgaattttcatttgagtaagaaaataattaaaaaaattaattaaattaaataaaaatattacaaaatataattctcgttaattaatacttaagcccttctaacaaccaattcattgaaaagggcttagcttttatggaagagcctcagcttagactaattggcaaatgtaaagaaaatgaaatggataaaattggcaaaaattcaccaaattcggaaaaggaaacgccaaaaagggaaagtgaagtgaaaagctcacaatttggacattactcaactgacaaattcgaactaatgattacagttttgcaggaagatatttttaacataataaaagcaaaaaatgaaattgaaaaattggaaaaaaaggaaaatgaaacggaaaaatgggaaaatgaatggcaggaaaaatttggtgctaataaaacgtttaataaaaatttatttgacttatacgaaaaagcaatcaaacaaatcgtggccatgcaaaaattaggtatcattaagcagttaataatttattttattcataaattgacaaattaatgatgctggctggggctttaatgcagccaagggtttccaacgtaaatttttttttaaattaacaaaaaattgaattcacgggtttttttcgaaaaaataagacaaaaataagagatcgtatttggaatttattaaattataacaaaaattagaaacctgcataaaatttaaggggataatttccgttttacattcggtcaacacaaagacttggcctagaaacctaaaaccaagttcgaaatcggtttttcatgcttattaaagctcaacatgcaaaaaatttaagcatttcttcaaaaccatccctatttttcaacaaccaa

SEQ ID NO: 83065 - DNA, 1246 bp, Heterodera glycines
  Genomic contig location: Contig_ID=SeqID_18465; Location=559..1804; Strand=+
  SCN-specific regions: Sequence locations=1-99,132-674,697-705,727 -775,799-1006,1028-1039,1061-1246
atgactgttggatatatatctgttagatgttttgaaggttaatttcgaggtggtcgttattttcgggcctgcgtgactctcgagaatgaatgccattccattttcgcacatttgtccattgatttattgcattcgtacaattcgttgtaaatcttttgattatgcttttagtcagtcatttgattcgcattttatttcttataatgcattatcttttttactcacagaaaaatttacaaatgaaaatttggcagcatttaacacttatttttttatttttgttcttacaaaaacccacatcaaatgccacgactgaaattcaggcgaagggtatgttttaaattttgcagattttgcatcaaaacacaacctttctgttctgattccgagtagcgaattggcaaattttaagtgccgttctctagttgtggactttgaactgattattaaaaaatatggaatagatcttatagtagcaacaacaggcgccgccagggataaattggcacggctccttgttagattttgttcgggttaaatatttagaaaaaagtaatttaatgaaccaacgcgctttttaatgaatttgttaagaaaaacgaattaaatttaaaacaatgcactttagtaacaactttttttatttagacctaatagcccaatttatctcgtcattttttcagactcaaattttgcttcaacgataaggaaatttatggagaaaaaccgtgacaaaatgagtcaaatttttgcggatttggtaatttaaaaaaatgttttttattattctttttcatttggcaggaaaaagagaaagaaaaaagaaaggaccaaatgctttctgaagaagaatcgctgcaaattgtaagctcaaaaaatgtatacaaaccgccaggttaagtttttagaatgccttgaaatttgtagttaagattttgccataacgactatgaaaaagtgggagttatttctcaattacaaattaacaaaggtaacatcgatggaaaatatttttctgcatttaattaattttgaaaatactggaaaacgagctaaaaatcaaacatgattgaaatgcttttttaggtttattcatattcatcttttttcatttctcctatattagtcatttaatttttgttttttagccaaatcgttggagtgtaagcaaatcgcaaatcggtttactgattttggagcctgactatcggaaagcagcagtcattggaaatattaacggttaata

SEQ ID NO: 83066 - DNA, 671 bp, Heterodera glycines
  Genomic contig location: Contig_ID=SeqID_18466; Location=613..1283; Strand=-
  SCN-specific regions: Sequence locations=1-407,429-671
atgggcaacttttgggcctgtgtggcgactgtcatgcgcagtagggctgttccctggtgttggtggcacaaggtgtgaagcagcttaattacaattaattagggtgcaataaattggatgtggattgaggagggaggggtgaattcggcatggaaaaggcacaaaaaatgacaagatataaacaaaattgcacaaatttttgcattgattcttttttaatctagcttaattgcatttaattaggtgacatatataaattagatttcagaaatgtgtgattgattagtcgtggattgaggggggggggggggggggtgaagtcggcattcgaaatgattttccaaaaaaggcatgcccgagaaaaaaattggcattttaaggctaatgattaacaaaatttggcgcaaaaaatgactgtcaatgccacctttttttcttatagaaaagtttcagcttaattattagcctggctttttatttccgatgtgaaaaattagcaatttatttttttaaataagcataattcaccagcagatggccgaggtttgttgtcaacgttctgcaccacatttgaaactaagaaagatttgaattagtggttttatgtaactccaaaaaatgacgctaatcattatgttaatttgagataaaaaaattttcatttgaataaa

SEQ ID NO: 83067 - DNA, 1264 bp, Heterodera glycines
  Genomic contig location: Contig_ID=SeqID_18466; Location=93..1356; Strand=+
  SCN-specific regions: Sequence locations=1-66,89-150,232-375,397 -763,785-1222,1244-1264
gacaaacgccgcctggcagtccgaaaggtgggcacggcaacaacaaatcgccaacgacgccgcacagtacaaaacgggaaacagaacttataattgagaaaggtaaccaacagaaccatgctaccggtaacacatttattcagcaatcacaaaatttttatctaaaattaacatgaaaattagaaaattttataaatatatttaattattttatataacatatatatttatcagaatggcataacattttactcaaataaaagtgaaatttctgttatttttttttgtttcgctccaaatgtgtccaggaccaaaatggcggtgcataaatggcaccgaatcattaaaataaaatgtttaacggtgttagttgaattttcaaaaaacaataaaaattggttgttagatagtaaacatatttttcacgattttaggaaaaccgtcgccagacagtccaaaacgggaaacagaacttataattgagaaaggtaaccaacagaaccatgctgccggtaacacatttattcaaatgaaaatttttttatctcaaattaacataatgattagcgtcattttttggagttacataaaaccactaattcaaatctttcttagtttcaaatgtggtgcagaacgttgacaacaaacctcggccatctgctggtgaattatgcttatttaaaaaaataaattgctaatttttcacatcggaaataaaaagccaggctaataattaagctgaaacttttctataagaaaaaaaggtggcattgacagtcattttttgcgccaaattttgttaatcattagccttaaaatgccaatttttttctcgggcatgccttttttggaaaatcatttcgaatgccgacttcacccccccccccccccccctcaatccacgactaatcaatcacacatttctgaaatctaatttatatatgtcacctaattaaatgcaattaagctagattaaaaaagaatcaatgcaaaaatttgtgcaattttgtttatatcttgtcattttttgtgccttttccatgccgaattcacccctccctcctcaatccacatccaatttattgcaccctaattaattgtaattaagctgcttcacaccttgtgccaccaacaccagggaacagccctactgcgcatgacagtcgccacacaggcccaaaagttgcccatgttgccgccgccgccaatttgggccaaggacaccaagaaagtgccaacgtgtcgcgtgttgatgatgtaaccg

SEQ ID NO: 83068 - DNA, 198 bp, Heterodera glycines
  Genomic contig location: Contig_ID=SeqID_18466; Location=1691..1888; Strand=+
  SCN-specific regions: Sequence locations=1-59,95-198
ttgttaaataccacgagggttggcaaaaatctggatataaaatcgcaaaaatgtggccataaaatcctttaaatttaaaaccaagataaaaactatttttttatttcgtgcctttcacaccctcccagtgtccagggaaaaaataatggattgctgccatataattaattgccaaccatataaatcacatttttttaa

SEQ ID NO: 83069 - DNA, 1029 bp, Heterodera glycines
  Genomic contig location: Contig_ID=SeqID_18467; Location=1245..2273; Strand=+
  SCN-specific regions: Sequence locations=1-108,176-205,228-241,284 -361,383-878,900-957,979-1029
atggccaattcgtctctgatgttgccaattttcagtctgttcgtcgtgctcattgtgattcaattttacgccactgagcaaagttcaatcagcgtagacctagcggtgataaaatttttgatttaaattttataattttctgttatttatatgtagtattatttaatgaattaaagtgaaaaaaacacgataaattgtgtactttttattattttgaatttttggtattataaataactggaatttaattgaatttttaaattttcaaactaaatttatatttgtcctaaaatttaaattttatgggaaattttttgacaaaaaatatatatggaataaaaattgcagcaattggatcgccaaattagtgagaaaaagcaacgagcggaccaattgcgacaacaaattgcaagtgaaaagaacccggtgattaagcagtcggacacgcgcacattgcaagcaattttggaagagatcaacaaattggaagcgcaaaagaaatcgtttcaaaacacggatcaaaacgcaaggaacaatcttggatgagagacacagcaaaaaatgaaacggagatttggcaaaagtgatcagcagtgagcaaaacgattgaaaatgtctgagtttgatcgatcgattgcgattgatcagaaaagagtgattggtcgatctatttatgtctttaaaatgtttttaattgtgatttaaaaaagttcaatatcagagaatttaaaaatttattatagaaacaaagtaacgacctctaaacattagcatggtttgttacccatacgttaccgtaatggaaaaggacagaaatcagccggtcaacgccaacaaagaaaatgacccaaacggaggaaaacaggccaaagattgacaaaaactgaatgaaaaagtagccaaaattgctgatcatgttctggccaagcaacgaaagggcaaagggaccaaaaatgagagcaaaaagagaaagttaaatgagccgatggccaaaagagcggcacaagtgccgcgctgattcctaaaata

SEQ ID NO: 83070 - DNA, 525 bp, Heterodera glycines
  Genomic contig location: Contig_ID=SeqID_18469; Location=411..935; Strand=+
  SCN-specific regions: Sequence locations=1-525
atggctgagaagcagaaaattgggcccgttttggctgccattgtgcgcggaatgcaacgcgaggagtcgtccgtccacgtgcgcctggctgcggcgaaagccctctccgaaatcgtcgattgggtcgccacgcgaactttggaagagcacgtggacgcaattgtggacgcaacttgcgcatttttgtgggtgtttttctcacacatattcaacgggtgtctcagacaaggccatacgacggagcttgggatggatgagcagatctgctagggagtgtctcggcagcaaattttcatacggcggtccacttttttctccggcgtcgaccttttctttacttttacaccacttttcttgaagtgcgctttttccaaaaaacctggggagcaagaagggtttgtcgtatccaagcccgtagtcataaaaaaatttcggagggtcgaacccggactttttttttgttgctcttcgggccaaaaaagtgccgccggacaaattttattaacttttatgaattgttaagaa

SEQ ID NO: 83071 - DNA, 2730 bp, Heterodera glycines
  Genomic contig location: Contig_ID=SeqID_336; Location=1389..4118; Strand=-
  SCN-specific regions: Sequence locations=1-1,23-77,122-292,314 -338,367-489,545-786,827-1091,1129-1457,1480-1506,1528-1566,1589 -1774,1796-1954,2015-2077,2099-2209,2232-2308,2331-2423,2459 -2654,2677-2730
atgactttcttcactgctcttcaaaatattgccgcaattttggtttcttttgcttttctcccccatttttgtggcggtattttttattttgcttttttattaaattaataaatattttaatgaaaagcattgaaatgtgcctgggggtcaaccggagttaaggatgaccttccatttcgagttcaagactgtccatctgccaagaacctctattgctacaaaggaaattgtacagccggtaaaaggcgatcgggctgggtcgtttcttaaatccgccaagaactagaaaaccaaaaaatggaaaacatataaattactaacttggctcaatttcaatcaaattaatattttaatgtatatttaatagtttaagttatctaccagaataataaatcgaaatttttttacaataaaaaaaagttatggtcataaagtttcaataagtttttaatcatgattttttattttaacttttttgaaactcaatagttttttaatttattaattttaatagattattacaatttaaaaagaaaattttaatgttattgcttaaaagtagagatcgaccacgggacagacccgtgcacggggtttacggaccccgtaccgcgtaacccgtgtttttttgggctgacagggtttcactgggtaacggggttttagcccgtgaccacgtaccccgtgttgtttccaaccccgtaacccgtgcccgtatatttcgggacacgggctacggggttttttcctccagctaaattgtgtttttttttcatttcgccaaaataatcatttaaatgcataaaatttaattaaattttgaaagtggaagtgaattcgggttgtatctgttcattattttgtaattttactggcaataaaaattcagaattcaaaatcaactgcaataaaaagggtaatactgccagattcttaaaaaacggcttaaaatttcaaaaattagaaattttaaaaagttctatgtattttccgtttttattactgttttcgtcaaaattttacaaagaatgtcaattaatcacaaaaaatgcactaaaatgctaaattaagcacaaaaaaattagcccagcattttataattaaataattattcaaaattgtatttttgaaattgatttttacctgaaaaaattatttaaagaaacccccgtgccagtgtacggaccccatgtcactgttgaacacgggtttccaaccccgtagcccgtgcccgtgtatgtggaaaatgccgatctctacttaaaagcattaaacatgctatgattaccatgattatgcatacatatataattatagtgattaaaaattttaaatcatttaaacgtaaattgagccgaactaatttttatattcggtagccttaaaaatcttgatttaacgttagactttaaaaaattcattgattttaaaaaaatcatcatgaaaagtttatacctagaagcctctaaccatgttagaaacgcgtttttcatgcttattctcatgagttgtacagtacaactcctttgtcagcagggagacagaattttaatctattagaattaattattttcattttatttcagctgattcacgcttctttgttatgggttgcgaggatttaaacaataccgatagcatcaatgaacgcatggttcagcaaatttcaacgccgaactttgccgcaaaatgggagtgccatgtcgtagtaggggataccaacgaaccaatgcctttcccaatgccaggtgatttattggaagggagatatggatataaaatcatgaatatgtaccaaatcacgaaataaggatatttggtttttaaacttttttgtgaatcgccccgatttcattatttgtcaatcgcctaaattagcaccttttgtgaatcgaagaaccaaggatagcttctctataactgagtgaaaattatttattgaagcgattgtttctataaaaaaattttttaaagtaaatttttgtttatttaaaaaaatagatttattaaaattggattctttttctcaaaaattcttcaaaattcgggtttttccccgtcgactgaccaaaaaaacattaattttctttaaaaaattgctctaaattacaaaataggtaggcactttttttacacaatctttaacaaaattgcactcaaattcaaatgtttccaggcggcgcctatcggtacctccaaacctccccctccccttgttcccaaaattttttagaaatagcgcgccattaaacgatttgaaaatcaaaataatcatatttatgttcttatccttttttgtcaccccttgaaatttttttaaaataatttttctgggtaattttgaatctaacattaatttagaccgattccgagccctggacctaaattcgaacaaaaagtcgaagttttatcaattttagaacaaaaattaaaaattttaaaaaatttgaattttaaacctccagggaaggcgttttacacgactttttgaaaactttattttttcgaaaaatcggggggggggggggtcaaagcacattattaccgacgaaattctgtagttgactagtcaaaaaatttcacgtaacacacgtaaaaacataacagctaaaaataaacgtcatatatttgttcagcacataaaattaccctagaaaatataatttaaaaaaatttcagggggggtgaaaaaaggataagaacaagggatgggccaaattgaaaaataaa

SEQ ID NO: 83072 - DNA, 186 bp, Heterodera glycines
  Genomic contig location: Contig_ID=SeqID_336; Location=1040..1225; Strand=+
  SCN-specific regions: Sequence locations=1-14,37-126,148-186
gtcaaattgatacgaaaaaacaaaagcctaaaataacgcatgaaggccagcttcggccggtgggctgatcgaatgaaagaatgtttcggagacggcacattctcattggcacctccaatgttctaccaaataaattgtttccatttcttcattttgttaattattatatttaacgaaaaatttcat

SEQ ID NO: 83073 - DNA, 892 bp, Heterodera glycines
  Genomic contig location: Contig_ID=SeqID_336; Location=6003..6894; Strand=-
  SCN-specific regions: Sequence locations=1-715,757-770,792-811,833-861
atgggtctccccgaatcgcagaaacaaaagccgtccaagcgagtcgctgaggaccgaactgccatctcaggcgttctcgataagcttggtatcgagagcccaatcactgtttacagaatgggttccccagaccaaacaaagacaggtcaaaaccgcccgagattgatgaaagtaatttttggatgctccaaacatcagaaacaaactttggcacaatggaaggcacaatggaacaaagtgcgcgcgcaaatcaatcaaaaaatggggatgagcaacatccgaattcgcccttcgctcagccaagaggaactcaaggcccgacgtgtgctgcaagaagagtgtagcaggaaaagaaaggaagatggcggcgagtgggtggtgtacgcggacaaagtgatgctgacaaagggaggtggccaagtgtccgtgggatttcaaaatgaaacttggttaggtggatagagcaccaatgggttcttaagaaaaatggttttattttctgccaaatgagcacgagtgccgagttatgacgtgccaaagtttttagttttttataattaaagaaaaggaacaactatttcctttcttcaaagaaattgttagtgtagaggtaattcgttagtcaaaattttttttgggtcaaaagttcgaatcccctatgtgtaaattcattttgtaatttttatttttgctttttgtgagcaattcaattatcaaattttatttctttatcaaaatatttattttaattttattccattaaaaatcaaaaattgcattaaacataaatgtaatacatacatattctgtcaaattaaaaaatattttttttggcgaatatttttattgaatattttgcgcattaaaaaatttaaaaaaaattaaaaataaa

SEQ ID NO: 83074 - DNA, 799 bp, Heterodera glycines
  Genomic contig location: Contig_ID=SeqID_337; Location=1470..2268; Strand=+
  SCN-specific regions: Sequence locations=1-135,162-162,188-256,278 -333,360-799
atgtcttcgcaaaagcccaacaagcaggacaatgacgtgatgtttgttgtttctgagccggactgggcggtgtacgatgaaaatgagaggagaagggcggaacataagcgcctacggcgtgaagaacaatctaggtttaggatacattcattatatatttgcttattgtttgtttgtttgcttgctgctcaatggaccgcgttatggcaactgattggattcacaacgcctaccctgaatataaacagtctggagccggaggcggaggaggagacgaaaacaacgaatcgagcaacgttgccattgctgatggcatcaactggctaagagtcaatgacgaggacgaggaagaggaggaaaacaaaagatgcaatggcaatgaggaggcggaggcggaagtggttaattcttttatgttgctatttaggtttttttaagacaaacaactataatttcaaaaaatgtaaatgtgggcacggcgtcccataccagcagaagcaacagcatgaagcgaaagaaattgaaatgccattgattgagcatttgtgtcaacgctcaaagtgcacagccatggaacttcaagtgttattgcaaaatttgacgacacgtcgccagatactgcaacatatgcgtttcaatatccgcctccgcacaaactatctcaggccggccatccgaaactttgtcgtgcaatgtagcgatttgtcgaccctttccgctagtgatacttttgcaatgcgtggctatttgggcattacggtttgcttgttttttgctaatgcatttggtagttgtataa

SEQ ID NO: 83075 - DNA, 83 bp, Heterodera glycines; identical to SEQ ID NO: 69364
  Genomic contig location: Contig_ID=SeqID_337; Location=247..329; Strand=-
  SCN-specific regions: Sequence locations=1-83

SEQ ID NO: 83076 - DNA, 1088 bp, Heterodera glycines
  Genomic contig location: Contig_ID=SeqID_338; Location=268..1355; Strand=-
  SCN-specific regions: Sequence locations=1-168,190-202,224-229,251 -1059,1081-1088
atgacattcaaagcggaaatcattgtgaaaaacaagaagaaagagccaaccatgtaattaattaatgattaatataatgtcttttaaatttaatccatttttagtaagtttcaagcagaagacaaattaatggttaatggcaaagttatgaatgtgaacaaatatgtaagaaatgtgaaaatttaaatataaaacttaagaattattctttttagcttttggccgctcattcggtgtttttcaaaattttgttttttgaatttaacgaaaaaatgccaaaaatagaaattgacaatgataaaaatgcagtgggaaattttgaaaaattaatttccttcatgaattcaccgaatgccgaattggagggtaattttgtgggcatggaattcccatcgaaaatcgatatatttttacggttttaaatttgcacaataaaactcttaattgtattaaattataattaagatgattgtgttgaaagggtccttctattggctgatcgttttcagttgtattctgttgtgaatcgttgtgcacattttttggtccaaaaagcaaaaagccattcattcataaatttctgttggcacatcaatacaacttcattggcatgaaggtaaagaatataaccttaattaaataatttgcaatgattcagaagaaaatttcggaagaaatgtcttggcacattttttatttaactgttgaagatatctttccaatattaattatctcgttgaaaaattcctaatcactcaagaaacaatgatagaaaataacctttacaagatctatgagtataaagataaatttggcaaagtcgaacgaaaagttttgcttcaaaaatgtcatttttctgttcgatcatttcaatgaatacgctgatttggtgaaggaattgaaagagaaattccgttattactgcggatgatcggacagtggacaatcggacagttggacaatcggacagttggacaatcgggcagtggacaatccgacagtaaaatgcataaaaaagatatgaaaatgccgtcgccggagaggatcgattgtgccatatgaagaaaaagggaaaacaggcaaataaa

SEQ ID NO: 83077 - DNA, 1135 bp, Heterodera glycines
  Genomic contig location: Contig_ID=SeqID_338; Location=2869..4003; Strand=-
  SCN-specific regions: Sequence locations=1-129,152-272,297-816,841 -966,988-1031
atgtccgacttttccgcatttattgcatttgtcagttttctgggacggatattcgcacatgtatgccttaccacggcggtaatatggcttactgtcggcatttttgctgttgcagggccctttggcacgatcatttcctcctcctcttcctgaaattttggtcacattgccttacaatgaatccggtccgatcacataagcgtccaccagggatgggccaaattgatcatttataaacagtttttcactgaaaattagccaatttataggtaaaattttgaaaaattttatgggaatttaatccaattcttagaggtgtaaaagtcgcatttcgcgccaaaaagcgaaatgcgaaatgcgaaacgccaaaaaatgcgaataatgcgaaaggcgaaaagcgaaacctcggcccatccctggcgtccacattcgattttcccgaacaactgccaattgggtggcacattgatttgtgattcttgtttctttttttagaaattgtaaaaattgtcaaaaaaaatccgtttttttccaatgaacatgtccctgacagagtggtgcgacttttggggatttgcaacttggggagtttggcatttatttggcaactccgttcacttcaccaattctgcagggacgccggacttttcgacagaaatatttgaaatttgaggaggggacttttcacagtaaagagtaattaagtctcaatttttggcgtgtaaagtcataaaaatttatctaaaaaccaacaaaattaagccagatcagtattagatactgtacagaattttgaaaatcaaaaattcttgtcaggaaaataattttaaaaaatttggagacataatttttgagttactaaactgccaaaataattattttttagattctaaaaaaattagagtggtacgggaccgggaattttgggtgtaaaaccgggaccgggacctgccgggatccgagaagccaggaccgggaccgggacctcggtttttgtccgggaccgggactggaaaccgggaccaaccgggaatattaaaaattcaaaaaaaaatttaaaaaattaaaaattctaattaaaatcaagtgaaaataatactaaattaaatttttattttgttttttatttaataaa

SEQ ID NO: 83078 - DNA, 600 bp, Heterodera glycines
  Genomic contig location: Contig_ID=SeqID_3072; Location=77..676; Strand=-
  SCN-specific regions: Sequence locations=1-414,436-536,558-600
atgtacttgcttctcataaagatattatcaaatgctttaattatgtttatatttgtttcagccttacaggctccacaaatatttgtgtgcttcaaatgtcgggacacgtgtattaacgcgttttatgttgttgccccacttttgcgcagatacatcgaccaaactgtcatcgaatttttccgtttaaacaagcaaatctttgaccgaaggggcaccaaattgaaattgcacgcgtccactggaacagcgatttgggatgtgttggtcagggagatttggcccatttttgcgccaaccattcgtcatttggccttctattcgcctgcaaatttgaacaatttgcgcagtttcgtttccccgacaattctcactgatctgacgcaactgaaatcgatcaattcctatcgtctgttccccgctccaattgcttatgacggaaaaaatgcaactgctggcgaagtgttgtccaaatggttgcacacgccgacaaccgatggccaaccaaagcatttgctttgccgcttcacaggcaattatgcatcaaggggacaagaattggtcaacaagttcaaggaggtcgtccatcttcttagtccgtga

SEQ ID NO: 83079 - DNA, 3299 bp, Heterodera glycines
  Genomic contig location: Contig_ID=SeqID_3072; Location=521..3819; Strand=+
  SCN-specific regions: Sequence locations=1-430,452-479,502-842,865 -1456,1480-2531,2553-2700,2722-3299
gatgtatctgcgcaaaagtggggcaacaacataaaacgcgttaatacacgtgtcccgacatttgaagcacacaaatatttgtggagcctgtaaggctgaaacaaatataaacataattaaagcatttgataatatctttatgagaagcaagtacattccatggaaaattttgactgatcaagggaaagaatttacagctcattcagtaaaaaatattttgatacaaaagatgttgaacatttttgcatgctgacttcccctcaattccacgctggtatggctgagcgtgccaatcgtagtataaaagaacgtttatatcgttacttcaccgaaagagacacttacaaatggattgaggtagttcaggacattgttaagggcattaatcagtctataaactcctccattggaatgcgacctgctgacgtaaattttgaaaatgcagaggaactgagacaaaagttatataatgaagcgaaaaaatttccaaaaaagagtcctaaattcaaagtgggcgaccgtgtgagaatagaaaaatacaaacatgtattccaaaagggttatttaccacgatttaccgatgaaatatttacggtagcagaagtacatacagaacgctcgcccgttgtctacagattaagtgacgatagcaacgaaattataaagggatggttttattccaatgatttatgcaaaattctcaaaaacaaagaatcactatatgatattgaacaaattttgaagaagaaaaaacaaaatggtattgaatacgttctggtaaaatggaaaggatacagtattaaattcaatagctgggttccattgagttctatctccgagaaaaatatataaaaactttattgcgctttatcttttaaaaaaatgccatccaattctttttacattgttcttccttcaaatacaaatgttgaaggtatcaagacaaattcattccgggttcgtttaccacgaaaactacaattcaactccgaatgggaagttggactcgctgttattgtatatcctcatacttggccttcgattggtactgttgaacagcaatttgtagaagttgaatggcaaacaggaaatacggtgcgtattgaagtaccaccatcgaatgtcacaaatccaattgacttgggtaaaagtctgtataggctcttagacgaaggaagtgaaccgttagcaaaaaaggtacgaaccgcacagaattctttttcgcatgctacaaactctgctcgtcgtggggctagagaagaatacataaaacgaaaaacgagagagaaacgaagtattcgagatgaagaaaaacttctagaagccttattgacggacattgaaacaatggttgacctttttggtgtgactcaaagtcttttagcgcgtgagaagcgcgcggagacgagcaaaattccgttgagaatgtctgctgatgacaatgaatcataccaacataaattggatgaatatttttcaaatttaagtggtcccgatttggacatactcgaagaaatgatcagagcaaaattgaacgaagaaattaaaaatatggtagaggaggaccgtacaattcttgatgcaacgaaagaaatgggaatggaagcgtgggttcaagcgtaccgtaaagttaggctcgtttgccgatttatttttgatgtcaacaaaaatcgtttcgagttaatatttgatcagcgatatgtaaggagggttaaaatttcttcacaacttgcgtatatcttaggctttgacagtacagattttacgacatcggaaaatgaagcaaaatttatgccagatatgaatggtggcgtatcatcttttcaagtttatactcccgatctcattgaaccaatgatgattggtgatgtcacagcaccagtgttacgcatcgtcacaattcgaggaaaacctgatgaaatagttgaagaacaatttttagcaatacaatatcacaaaattttaattaaggaaatttctgaactcctgatcgaaattcgcacaaatagcgggagcctaatgccattccaatatggaatatgtacattaactttacatttccgaaaactgtcctacttctgaagatgaataccttggaaattgataaaattttatcgacaagcccactcacaaaacagacttatatcggctgttttgcggctgaccagataccaaatatggaaatggtaaaatttccaaattgtctggtaatgaatattgacccaatcacctctaaaggatcacattgggtttgtgcttacagtccttctccgtcacacattgaatactatgactcgttgggcatttggccaccacctagcatacacattgcaaattatttgtcaagattcaaacaaattcgttatagtataattctacttcaatctcccaattcaagtgtgtgtggtcgtcatgtgctcttcttttacgtttgttcagcaattaaaagtgaccgttggaaacactgaagtttacgatagcggaaatttatatccatacaaagcctacattaccaatgaattgagctttccagtaaatgcaaaaaagaactttctcggctcaacgggatattatcacacggaacgtcacgatgatccaacggatgatggatttaaagaacgttgtaaagtttttaaaggtggtaataatgcacagttcctctctcgccttgactttgacttgggaaaccaagaactctacctgttaaataatttggatttgttgttcacaatttacaaagcgaaagacgcatttcttttgaaaacacttaaagctaatgacgacacaaagtaccgtttgaccgtgcacgatgttaaaatttacgctaaaatgattgaggttcagccctcactcaacatgaatctttacaagacactagaaaagcagccggctacttatgctgttcgtaaaaccgaaatcaaatcttcatacattagcagtgggcgctacgaatttgaatacaacgtgttcagctcgacaatacctcgtcgtgtaacaatagcgttggtcagtaactcggcttttaatggtgattacaaattgacgcccttcaagttcgatccatttgctttgcgagaaatttcagtacatgctgggggcatggtctatcccgttgtaccacataaattaaatttttcaaagaattactatgtaagagcattcgtggagatgtatgaagcgttgggcatggctaattcagaacgttcatttgacgtttcaatggatcaattcaaaaatggatgggccttttttgtcatctctttgaattcaaccttagacgatagctgtggatttgagct

SEQ ID NO: 83080 - DNA, 413 bp, Heterodera glycines
  Genomic contig location: Contig_ID=SeqID_3073; Location=973..1385; Strand=+
  SCN-specific regions: Sequence locations=1-413
atgggccgctgcctttttgcagctggagggcagtgtgaaaaaaccgtgttgcagacaaaaacggcaacagttgcttcatcggtcgccaggatggccacaccaagggccactgctccaacaccaaattggtggccgaatttcaaaagttcaagttttttttcaaacatacattgttgccacggaaacgccgaagaaggaggtaaaaaacatataaaattcaaaaaaatttacaaaaaacaattttgttagccaccggttgccggctacgacttcgtgccggcaaaaaaggctgaggaaatgtacaagtgccatggccttacgcagttcctcctttgcatgtacgttttggcaattttttcgatttttttatgatattcaatgcaaaatgtgtatttacaggggtacccttgtaa

SEQ ID NO: 83081 - DNA, 571 bp, Heterodera glycines
  Genomic contig location: Contig_ID=SeqID_18470; Location=1318..1888; Strand=+
  SCN-specific regions: Sequence locations=1-73,142-407,429-571
atgaataattgtttccttttgtatttgggggctcccggtaaattggacactggaaaattggacactattgtacataaaataaataagttaaaaataaataaacaaaaattttaattgaaatatataatgttattattatttgtagcatcagcagcagaacgccatcatacattcataacgaaaaaagttttcattttgatcgggttcccattttttgcgtatttttggcacattgaacaaccatcgccaattttctacattttttggcatcttaaccaatcatcgcctaatttcgtacactttttgccacatttgatcaataatcgtgcctatttaatgtttgatcgactctaaatgccttaatccatttatccacaccaattatttttcaagctaattcctgtgtttattttttaaaagaggaatttggtgtccagttttccagtgtccaattttcctttggtgtccaaaattccgacggtgtccagttttccgcttggtgtccaattttccggtgtccaattttctggtgtccaatttaccggtccccatttttgggacaagccttata

SEQ ID NO: 83082 - DNA, 1447 bp, Heterodera glycines
  Genomic contig location: Contig_ID=SeqID_18471; Location=368..1814; Strand=-
  SCN-specific regions: Sequence locations=1-97,120-177,209-219,243 -366,388-593,639-970,993-1447
atgaaactgtttactccattgtacgttggaccaattgttctcaactttttattgaaattaatggtttgccgttcaagtcgaacaagaaggacccgaataatgtaagtgatgcagtttagtattcgaacttcggtgcaacaattgcagaacgaacttagtgcctgccgatatttcaagattaaattttgaaaaattttaataaaattatcaacttggttgtttaaataataataattttttatgtgatttttctatttaaccgtattgaaaacctgaaaaattcatatataaatcttttcacaaaatttttttgaacatttggctagcgaactacgtacacgaatagatatttttaggtgttgaaataaacataaattaatttttatttcggccgattttcaaatatgatactcagataccgtatgctaagttggactcattcagggtactgtatgaaagataatctacgcaatttactcaggtcaacaagatgcttataaaggtgtttaaaagcgtgtccgctttctgcactcaaacaactgttgatgatttgcaatggctgcaaaaatgtaaaattaactttttacatttgctttaatttaatttaatttcaactacattttattaatttaatttaaaatgcacataaaagccaatgtacaccattttttagatctgtccgactacgcatttttcttctgctacaaatacgcttctctgctttttggccgctctccgccgagttcaaattctgtgaattaaacttcattattggtttttagcttgaaaaaagggataagttgatgattgatacgttttttggttttaaaaattcaaatttcaatgctttttttaaataaattctttaaaaatgtcaaattttcttcgggcggcgcttaccagcagtgccggaccatcaatttcttaagattttaaaatacttaggtcaaaaacagaaattttgtcttagttttataccgtttaaaataattatttttgcatgttttttgcattttcgaattttagcagtggccccactgggtcaacaaagtgctcctatcgtccattgaagttgtgtcccattgtggcacttgtgccaacaccactgctgacgaattgcgatcaatgagaatttgtaaattcaaattgaaatctatttattgcatttatttattattttttcatattttccgctaattaatgctaataatgcgcaactttttcagttctttgctgccatgcgttgaagagactaaacgaaacacaatacataatatacgattttcatcaattctgatcaaagaaagagtgatcataataattgggccagggattcgatcgatattcacttattggtacaaaattttgcaaaaaaaaaatatggaaaaattaggaaccgccggcggtgcatttaggcgccgcaaattgtggaattttgattaataaa

SEQ ID NO: 83083 - DNA, 659 bp, Heterodera glycines
  Genomic contig location: Contig_ID=SeqID_18473; Location=477..1135; Strand=+
  SCN-specific regions: Sequence locations=1-11,33-294,319-386,442-659
gtcgatgttttctctgagaagatgaatggcacattaaaagcgaaaaatgcgattgccgatgccaacataacatgcggactgaattcaaacttctacttgtacgtttgtgtgttagttcaataacaacaaaatgggattatgattatgccaatcacaaacacaatgccgcgaactattggcatttagcattgaaaaagcggcaaatgcaacgaaaaacaaaatttgccgggattcaatttcttttaagggtcgttgctttatctcttccttatgcccttttgcatgccaaaattctatttttaaaaaataaatttatatgtaaggcggatatgttttaattacgacgcaatagtgccgaacattttgtccatttcttgttcaatgggaaaaataaaatatttaattgttatcaaatatttatttattttttatatttaaattgtgccccattttcagtggatggtccacctgcatgaaagtgaatttgcttctttttatgtgcattttttttttgattttttgtttcttttttcagattgcattctacggggatgacggctatgaaaagcatgccgcaaaatacggtctcgagcaaacagaagggccggaggaaaacttcaagaacatgacccagttcgacaaatacggcttcatgcacg

SEQ ID NO: 83084 - DNA, 950 bp, Heterodera glycines
  misc_feature (751)..(751): n is a, c, g, or t
  Genomic contig location: Contig_ID=SeqID_18474; Location=109..1058; Strand=+
  SCN-specific regions: Sequence locations=1-169,191-240,272-380,402 -498,521-637,659-692,715-754,780-785,824-861,883-950
atgctggacctgaccaacaacgacaattacgacagaagcggccagtacattgatgccaaattggtcaaaatggagcctaaaatagtgagcccaccgaagccaacggtagggtgccatacaacaaaaccaagcaaaattatttagaacaaaaaaacattaaatcatttttaggaaaaaccagatgttgtggagcctgtggagccagtaagtctctttttatctgaacaaatcatttgtgagaatataaattattataatttattattattaacgcacatttgcaaaaattagtcatttaataatgcctttcatttagacaccggcggggaatcaaacagcagaggttaagaagaaggaaaaggtggagtcaaatataaaaagaaaaagcaattattttttaaatggtattcattaaaattccattttttaagaagtcgaaggaagaagagggcgaaataatgttcgacgagaagtcgaagtcggaggatgatgagttggaggagaagaagaagtagaaggatgggatggaaggatgaaaagcggtggtgaagaaaacaaacggacggatcagagaaaaacccaaaaaaaatgcacccctcccaagcccattttaatcatcatttgtgtacccctccaattcctcgtcccccgccccaaatttcattagccaattgcccccatcaacctgtatcatcatcaccaacccaattcaaaattagccattgccccacccaatccacccctatcgtcncagtctcccctccctctccctccctttgttttggattaattttttgaatttaatttgtattttaatttatttggaatttgcataaatttaatttaaaatgcggtgtctttcaatggaatgaaccatacaaaaattaatcaattagacgcctaatttaaaagcttttaagacaaacaaattccttaaagttgggctacaa

SEQ ID NO: 83085 - DNA, 608 bp, Heterodera glycines
  Genomic contig location: Contig_ID=SeqID_18475; Location=61..668; Strand=-
  SCN-specific regions: Sequence locations=1-185,207-257,279-389,411 -445,467-534,571-608
atggcattttgccttataaacgatgatgacgacgatccatcaccaaaaagatggggagttttactgctcgggattaggcaaaactgtccaaactttgttttgctggggtggcattatgaagaagaaatgccgaaaatggaaaggtcaaaaataaagttggaaagaaaaaaacaaatgacgacaattttctgttggtgagagagtaaaattaacaaaaaaaaaagaatttgcacggcatggtgatctgatgatcaccggttgcactgttgactttttcatggtctaattacggaacgggccaactctgtcccagtcaactttgaaaaatatacaaaaattgagtttttttccagctttcaagcgagaacttttttgtgagctgcttaatcaattaaaaaaggcttacaaatatcttctagatatcaagagcttttgagtgatactaaggttgttatgtttggtcaacaaaaaaaaagttatggctttttaaacttgactggacggagttggcggacggatttgacccattccgtctaattaaattataaaattaaaaaaatatatattttagtttacgtcaaagttcagtatcattgtttatttgttga

SEQ ID NO: 83086 - DNA, 379 bp, Heterodera glycines
  Genomic contig location: Contig_ID=SeqID_18476; Location=1093..1471; Strand=-
  SCN-specific regions: Sequence locations=1-25,59-151,173-379
atggcactgttggacacggaaatgaatgataatgatgatgatgacgatggtgatgatgcaggcattttgcgggcggtgtactgctccaaaatgtggtgtgatatgtgccaaaatataatttaaaaaatgcactaagtttggtggtgctggatgaatgaaagaatgaattaaaccgatttggttaacgaaagtatatatttagagaccaaaaaatcgagaattcgtgtttccgagttttttttttaaacttgtaaataaaaaattccagaggcctatttcaatttccgtcatgtcactcaatattctgacgtcataaatttgacggatttgaacatttagggaaatcgaatgaccatattttcgattctgaaaaaataaa

SEQ ID NO: 83087 - DNA, 176 bp, Heterodera glycines
  Genomic contig location: Contig_ID=SeqID_18477; Location=77..252; Strand=+
  SCN-specific regions: Sequence locations=1-176
agaccggccaggatcgggatccgagtttctttggatctgactcgggaatccgaccggttaagaagcaaccgaataggaatgccgaaaattttctaatttttatcccaaaccctgttccggaagcaattctcgaagaatgatctctgagctctgaatttcaaaaaatccgatctcta

SEQ ID NO: 83088 - DNA, 1707 bp, Heterodera glycines
  Genomic contig location: Contig_ID=SeqID_18477; Location=890..2596; Strand=-
  SCN-specific regions: Sequence locations=1-200,222-349,372-766,788 -874,897-957,979-1564,1589-1707
atggtacaaaatcagttgcaaaatgatccggcacttttatacagtttggaaaaattatttttcatttatcaaatgctgaagagcttaaaaattggtacgtttcgggcttaatggaatttaatcgaaaaccgcacctaatattatgttcattataattaattacttgctgattctttctaagattggcaacaaattattgcaatatttttgaataatttaattcaactttttcaaaattttcgggactatttttttttttttgcctttttgttgccaattttcaattttcgatggaaaggtggaggtaaaagagttttggggtcaaaatcttaggatcaagcatatattattaataaaatctacttaaaaaactatttttagatgccaatcgtcatgaaaactatttgaccgcctcattagaacattctatgaccttaatggccaaccgttttggcattcggttcaacgaaatttcgaatgttgttgagccaagaaaaagtgcatttatgcttaaagaaatcacaaatttgttaaatgatcaatttgaaaatgataggactggaaatgagcatgaaaaagaagaaaatgggcaggacggatatcggaaaaaccaaaaatgggcatttcgccaactcagcaacaattcgaacaatttgtttgggaaatggtttaattcatttcataaaggtaaaggggtaattaagaaaaaaatgtgttagatggcttaacaatgtaaacatatacaaaattgcatttttatgggtttaaaaaagaaaatggttatttttcgctaaatccaaaaatcattaccccttcggagaatggcaaatttggcttttgcgcgccaatatatttttgaagcaataccaaattgttttttttttaaattaaatatacattttctacctagaaatgcagcgccgtcgtcgtcgaaaaaagcgcagagattttttcggcataatgggtattttaattatgttgggattagttatgctttgtcaatggattgtcagaatcgttactttttgttgcacttggcattctgacgaagaggcagaagaacaatttgcaacagaaacaacggcatttatactttcaaccgaaattggcgaagctcgtacaatttttaatttattttagggttaatcgagtccgatatttgtgaaaagccggattcgggaattgcgaaatccagaaaagccgagttcgggacttgcggaatccagaaaagccggggttcgggacttgcggaatccagaacagctggcgggaattgcggactctaaaaaagacgggttcggaaattgctgaacctaaaaagctgggttcgggaattgcggagtcagaaaaaacgtgttcggaacttgcgaaatacagaaaagccgggttcgggaattgccgagttcagaaaagccgggttcaggaattgctgagtccagaaaaaccgggttctggtccgggtccaagttttccaaccgcctccaggtaccgggtccgggtcttggaaaagccagatatcggggtctggaccagcttgggtacccagacgacatgtaaccctaacatttttaataattttttttaaattgtgtctcttaaatgctaagacatgacggcattcgaccaattgtccggcacaaaaattggaaaacgaagttcggcacaatctgggccggaaacatgcagaatttgtttggacgaaataaa

SEQ ID NO: 83089 - DNA, 1199 bp, Heterodera glycines
  Genomic contig location: Contig_ID=SeqID_18478; Location=771..1969; Strand=+
  SCN-specific regions: Sequence locations=1-47,72-165,216-679,701 -728,750-1020,1041-1199
atgggcatttttgacgaatttgttattgttgacgaaaaagcattcaccaatttgctgattgagaaaggaaacacatgccaccttcacatcaactgtcttggttgtgcaaatggccgcacaaaaaacgtcacaaaattcagtgatgtgactcaattcgcggcactgtaaaattattaatttgcaaaaaaaaattgtaaaattaaatctaaatttaagcgaatttcaattccaaaatgcgaattgcgcattggaagtcaaggacattggcaatgcttccgagtcggatgtgccgttggcacaaatcattgtgtggcggtggaatttgaggggggcacagacggtcaaaaatgtgcgaacgaactcatatatttttttctaattaaccctcgagacatggcccaaacaaaaaaaaaccaagaaatatttggatgaccccctttttaggcaataaattttcaaaatctctgtgttaaaataaggattttcggggtcggaggaaaacccgctttcggcacttaaattttgaaggtatgccaccaaaaaattgtaaaatattagcgtggtctccgtaaatacgaaaaagaaattttttccaaaaaaaggggggggggggtccatctaagcatagtattaccgagatttcccttcttcgagactctcgaatagaacccagaaaatattttttgtccctttaattttagcggcaaactttgaacattggtggcactttatttttccatcaattttatgccagttcttccattatcattcgaattctcaaaaaacggcaaaaggacggaccgaagtaaaaaaaaatgatcatttaaaatttgggcattttaatgttgtttttttttgaattttcagtccgactccatcatttctcggctcaccggcggacgacgatttgacagttcaaatcggcgacaaaaaggtgaaatcggcaacagtgcatgcaattattgagtttaaaagtgccgaaatgaattaaaaagtagccaaaccgttcgcttttcttttggggggggggggggggggggctctatccaaaaactatttgatttatttactagagaccggacaagagggtcggtcgaacggtttcggttaaaaaaccgaaaaaaaccgaagaaaaattttcggtataccgtttcggtttcggtttttttgaatttttttatcttttcccaaaaaaaaca

SEQ ID NO: 83090 - DNA, 225 bp, Heterodera glycines
  Genomic contig location: Contig_ID=SeqID_18479; Location=1328..1552; Strand=+
  SCN-specific regions: Sequence locations=1-145,167-225
atgtctgaaaatgagcattcaaacgttggtggcgcatctcaccaagatgaagattcttcggatgatggactttggaacgagttcgaaacttgcgccacttcaggttccgaaagtagctgtttggcattgttcgaatttggattgttttcagtgactcacctttatcgcaattccaattggcgcacattgcaacaagcggccgcttcggctacccaattgtacaag

SEQ ID NO: 83091 - DNA, 204 bp, Heterodera glycines
  Genomic contig location: Contig_ID=SeqID_18479; Location=1..204; Strand=+
  SCN-specific regions: Sequence locations=1-43,93-204
atctctcaatctctaggctagggctcaatacatacacacctatttattgatttgtttttctttttgaatgacctcccccacccctcccgaaaattgttttttgttccgccgtcggttaacctttgccctttacacattttcccaatatttgtgacattggtacgttcaattcaacagcaatgttttttgatacataattttgtc

SEQ ID NO: 83092 - DNA, 1634 bp, Heterodera glycines
  Genomic contig location: Contig_ID=SeqID_18482; Location=170..1803; Strand=-
  SCN-specific regions: Sequence locations=1-78,114-248,332-380,458 -723,746-864,890-1044,1068-1127,1154-1161,1183-1188,1210-1227,1308 -1370,1478-1634
cataacaatgccaacaacactgttggaggaccaattatggtaattttgaaaattcattatgcatattttaaatgttgcataaaataaaatcatttaaatttattatttattaagccgaatgtgacaaattccaacaacaaaattcgagagccgattaatgtattttgatcaaaagctaaatttacctaatagttttaatttaaagaccaatttgtcaaatgccaacaattcaacccgaggacaaattgtaattaatgttattttagataatttaattaattaaaaaaatatttaatttaaattaaaaaattaaaaatttttattattatttcagcaaagtccggcgaatgcaacaaacccaagtcaagatgcaattttggtaattattatttaatgtaaaaaaaatttttaaaaatctatcaaactttctataaaaaataaaaatttcaaaattttagcaaagtttcgtaaaaaacgacacagtgcgtgatgtaattatggtaaatttaagagaattaataagcaaaaatattattttaatcatgatttttagtatttgtacagcataattcaaaaaactcccaccgaacaattcaccaaacactaatgattagtaattattaaattgttgtaataaaaaaaatctccaaaattttcagattattccataatgcacatagcgccaagaatgattgggcgtagccgaaagaatgccaaaatgtgaaaaaatgctaatttaaattaaattccaaatatccatttaatgcttcgttgctttttatcccaaattttatttactcgcattattattatgatttggtcattaataaaaataaaatttgattcactaattaatgtgtcatccaattaaaaggaaattgaaaaaataattattaattaacaatttggccaatattaaacagcacttcataaaatatgatggaatttaattttttgtgtgacgtaaaacatttattatttggcgatttgtttgctccactaatcactcattcacccgccactgactgactttacatgacggaaaatttggaggaattaaatttggaaccaccgaccgccccatttaaacccataatttgcagatttttgatgaaatttcattcgtcaattaaattaaaataattaaaataaactttcaaattctgcaactatttaaagaaaatttggtgttaaaatttatttataaatcactggttcaattttggcttattttatttataaaaaatttatttcagtcaaataaaaaactattaaattattttaggctaaaaatttatttaaaaaaacctctaaattagtttcggccaaaagtattattaaaaccagtcgtcttttaatgagtttttagctatttaaataaaaaattaaattttattgttttaattttaaataaattaattatattgctttttaatccttaaaattaaatatactcaaaattatataaataaatatactcataattatttgcagaattatatggatttatattcattttatgatgacaataaccaattaaatgcattgtcattttggcattatcaaatgaaatatgggaacgaagtcacttcaacattgttgaccaaagcaattgatcgggaatgcgttgctcg

SEQ ID NO: 83093 - DNA, 970 bp, Heterodera glycines
  Genomic contig location: Contig_ID=SeqID_3075; Location=2629..3598; Strand=+
  SCN-specific regions: Sequence locations=1-77,158-293,366-379,495 -519,557-745,786-799,835-970
atgaataaattggtgaaaggttcgagttaatataatgagcatagttctccaagtttgactatttacgtaatcttatgataattaaaattaaattttattccatttttattgtaattttaaatgatataaaaaatattaaatttttatttaataataagaacaattatcttaaaaagtcttttttgccattttaaatgcattagaaaatttgccaaaattcgattttgtaaattgacaaaattcacaaatttgaagatattcaatttctttgatgcttgatagtttatttcttgtataaaaataaatataaattgttttcagaaaaaatatttttaaaaaaatattttaggtttataatatttttagtgacccattagggaaaaaattaaaattctataaaaatgtaaaatttaaaagattgattttcaatattctttttattttttcacttatcatattattattcattttaaaaattttctaataattattttccaatttcttatccacaattgccagtaaaaaagaatttttttaaatctttaaattttttaaaggtaacgagggatgcctacgagcagcgcattgagcgtgtcaacgtggctggcggaaaccgacgcgtgatttcccgcgaggagaaagccttgcggccgcgctcatggtggaaggccacgagcagcgcacctactgatcggatgtgaactgcctgagcaatgagtcatccaacattgcaaataacctaaagaattattaatatttaatcatttttatagaatttattttttcagaaatagttgggttaatttttataaaaatgaaaattaatatattattgctatgcctattactgattaaaaacactatagatcagattgtctcaatgaaaataaagcaaccgaaaggatttgacgaaatatttggccaaagatgggacgaaagagcagaggacaatgaagttgatcaaacttga

SEQ ID NO: 83094 - DNA, 461 bp, Heterodera glycines
  Genomic contig location: Contig_ID=SeqID_3076; Location=726..1186; Strand=+
  SCN-specific regions: Sequence locations=1-98,138-151,180-384,446-461
atgccaacaaaaatgttagagaaagaaattgccaaaactttaggcgtacatgaacgaacaatttatgattggaagaaaaagtttggagtaaacggaagtaaattttaataacataaattaaataaataaaaatttatgctttattaatcattgaattaagaaagcaaaattaaaagatattccaaagaacaaaaattcaaaattgtacaacaatttgacgaaatcaaaagtcgaaagaaaggtaaatcaatcgcaaaatcggcaaatgaaatggaccatcaaatttctaaggaattgggagttagccgttcaatgatttgccaatggaaaaaggatttttgcatgacaagtacttttgtgaacaaatacgttttctcttcttggaataaaatatttttaaattttagagtataaaattttaaactttttttatttgtaatttattgactatatttttttca

SEQ ID NO: 83095 - DNA, 1006 bp, Heterodera glycines
  Genomic contig location: Contig_ID=SeqID_3077; Location=711..1716; Strand=-
  SCN-specific regions: Sequence locations=1-257,348-1006
atgtggaagaaggcatttgggcccaacttcagcatgttcttcgtcctcgaccaaaacagagtgccgatgggttgcattagcatggcattgtacccgcaggtggcacattggagcatgttctacgtgaaggacccttatcatggccaccaacttggccgtgcgctcgctcgcagagcgctggaatttgcaggggacagacccgtatttggttatgcaggtcagaaaacatacggcagttttgcaaatgcttttttgccgattgattgctccgtagaatgattaatcgattgatggcccatcgatcgctttgccgactgataaattgattgatggccaatcgattgattttgtcagtatccctgttcttttcaagttcctgaaatgtggcacaaatacgaggaagagtacgcattccatcactatttggactggcgactgtggtcattcggtgcgaaatgtgctgacgtgcgacccgaacggttggatcacgactcgagcgtggagctgaaggactggcgtgaagcttcgttcgacaaactgttgctttttgaccgtcagcagacggtgggcattgacagatcggcgtatttgcgggaggcacttcgccttccccaaagtgccgcaaaggtcagcagcgactagtttttggcattcgctgctattttaatgacttaaggtagccgtgtgcagggagacgggcgacgtggtcggcttatgtcaagtgcggcatttactcggcgatcggctcggcatcagtctgttctatgccaacagtgaggtcagtcggtctttgcccccgctttacgctcctccgttttgcttcagtccatcgcctcggctcttctccgtgccgttctgctccaatttgcgggccccgatccctccgccaagttcgactcgttcatctacaaaactccgtccaccaacacggagtccatccgtctcttccgccaactcgtccaaaatgggccggtcgaacgtcggcttttctacccgcaattctcgc

SEQ ID NO: 83096 - DNA, 1508 bp, Heterodera glycines
  misc_feature (1287)..(1287): n is a, c, g, or t
  misc_feature (1341)..(1341): n is a, c, g, or t
  misc_feature (1428)..(1428): n is a, c, g, or t
  misc_feature (1439)..(1439): n is a, c, g, or t
  misc_feature (1444)..(1445): n is a, c, g, or t
  misc_feature (1456)..(1456): n is a, c, g, or t
  misc_feature (1506)..(1506): n is a, c, g, or t
  Genomic contig location: Contig_ID=SeqID_3077; Location=3559..5066; Strand=+
  SCN-specific regions: Sequence locations=1-178,200-528,565-606,666 -1079,1103-1254,1279-1363,1385-1508
atgcatcatactttgaccattttattgtgctcattagtctcgacggttgcttcgattgaagaagcgaaaattaaaattgagccgaaagaagaacaatttacagcagaaattaagaaagaatttgctccaattacaacagtaaaagttgaactcgaattagagcaaagaaaagcggtgaaaaaagagccaaaagaagaagccaattattacggtttaatggaaagcaaaagcaaccgatttagggaaattgaagagggaaaaaacgattcgtcttgtgttgatcactctgacgaagattcagccaaatctgatcagtccgaaggaggtttaaccctatctgatcggcatacagaccaaaatgggcaaagcagaaagcgaatgaaggaaaatgatcgaaaaagatggaaatttacaaggaatatcggaaaatgaaagaaacaacggcaaaatctgaccctgaaatagcgaaaataatgggtgtaaatattagcatgattcggaggttaaaagaaaagtttggacaaagtgaaaaaattaaatttaaaatgattataaaattaatttccaaatattttcagcaaatttaaaaaaagcaaaaaaactcgcttttttattttgttacaatatattacattataaataaaaattaattttaaagatttaaagtccgaaagaaaaaatgattgtcagcgacgtgaaattcttagcaaattttttaaaatgaaaaaggagcgttttttatgtgatggaaaaaataaaactgtccataaaattgaagaagaaatatcggaggaattgcaagtcacacgaaagtcaatttacaattggataaaaaaattcggaatgaaaaacggtatgatttagtcaaataaaattagtaggatgattctgcatttgaaaatcactatgggatttaaaaacaaatttttgtgggttatttgttttacagaatttctcagaaatacctgagaatctaagagaaatcaaatgcttctaagttgagcttaggtgatttttttactgaatattgtatacaaaacatttatttaatttcggggattaatttttagatttcagactaaaaagataatttcttaaatttaagcctctaaaatatattccgacgaagacaaaagaagcattgtgaaacagtttaagaagctcagaaatgaaaagcaaaaagttaaagaaataccaaaaatgttgggaattggcgttgggaccttttataaatggaaggatgaattttccggtaaatttacaaaaatgtcatatttattttcttanaaagagtaaaaatttcataattttcattagtaaaagcttcttttaagttaattntgttttagatgaagaagacagtgaaaaatcagtgcaaaatgactctaatgaatctgatcgatcgatactacccgaaactgatcagtncgaggaagaanaattnncagaactcccnaaagatgatatgattctgctgatgatggaccaccacccgttgatagcaangc

SEQ ID NO: 83097 - DNA, 1066 bp, Heterodera glycines
  Genomic contig location: Contig_ID=SeqID_3078; Location=467..1532; Strand=+
  SCN-specific regions: Sequence locations=1-196,218-351,375-526,572 -635,657-1023,1049-1066
atgaaaaaggagcgttttttatgtgatggaaaaaataaaactgtccaaaaaattgaagaagaaatatcggaggaattgcaagtcacacgaaagtcaatttacaattggataaaaaaattcggaatgaaaaacggtatgatttagtcaaataaaattagtaggatgattctgcatcactatgggatttaaaaacaaatttttgtgggttctttgttttacagaatttctcagaaatacctgagaatctaagagaaatcaaatgcttctatgttgagcttaggtgatttttttactgaatattgtatacaaaacatttatttaatttcggggattaatttttagatttcagactaaaaagataatttcttaaatttcagcctctaaaatatattccgacgaagacaaaagaagcattgtgaaacagtttaagaagctcagaaatgaaaagcaaaaagttaaagaaataccaaaaatgttgggaattggcgttgggaccttttataaatggaaggatgaattttccggtaaatttacaaaaatgtcatatttattttcttaaaaagagtaaaaatttcataattttcattagtaaaagcttcttttaagttaattttgttttagatgaagaagacagtgaaaaatcagtgcaaaatgactctaatgaatctgatcgatcgatactaccgaaaactgatcagtcggaggaagaaaaattcaagaaactcccaaggattgattatgattctgctgatgatggaccaccaccgtttgatagcaaagcgtgggcatggaattttagcgtggcaaaaaggaaaaatcatttaaaaaacggaataaaaattaaaatttagaaactgggaaaatgaggcccaaaggcaaaaacatacaaaagtttagtttttcgaggttgtggaaacgataaaaaaatcaaaaaaaaaatgcagcaaatgtttaacagatttttgaacaaaattatatatcagtggatagaataagagtgatttgtattgtgaaattttttccttttataaatttttttttaatatatggaaacaaaattaagtta

SEQ ID NO: 83098 - DNA, 77 bp, Heterodera glycines
  Genomic contig location: Contig_ID=SeqID_3078; Location=1757..1833; Strand=+
  SCN-specific regions: Sequence locations=1-77
ggattgctggggtcgtgggttcgagtcctaccgggcgagttaccttttatgttctacatatgactgtaccgaataaa

SEQ ID NO: 83099 - DNA, 882 bp, Heterodera glycines
  Genomic contig location: Contig_ID=SeqID_18483; Location=610..1491; Strand=-
  SCN-specific regions: Sequence locations=1-323,346-882
atgggtggtcgagtcgcgaatttgccagagctcgatcaagttcgaagctatcattggctagagcgagcaaggatcgggaaacgttcgttccgagattgtattgcggcacaagagggccagttaaaggcacgggaattaaagtgcccgcacatgagcgcgagagctaagtggtgccggaggtgtggtgatccgcgtgtcgagaccgaacagcatatccttagtggatgtgcttggtcccgaactggaactatgctagataggcataacggtgtagtacgacaagtacacacggctctctgcagaaagtacgggttgcccgtgtcttcacatactgtgcccctacacgcagtacttgaaaatgaacgagccaagatcctctacgatgtagcgttacacactccaccagcgagtgttcttcctcaggaaggcgggagtactggttatattggtctgcgaagcaacagaccggatatggtagtatttgataaaggaagccgcacgatcagaatcgtggaaatttcagtgccatggcgagagaacctgagaaatcaggaactcatcaagtggcggaaatatgcgatcaattctatgattgaaccattggaactagcggaagttgaagtaccaggaccaaacctgcaaaatgtgttaggtcgcgcttacggaaaagacttcccaatagtgaaagtggtgccgattatagtcgggtcgtgcggtgaagtactaccgaatataactggtaggttgagcgagcttggtatttcagcccgtgaagtaccgaacttgcttgagtcaatacagcgagctgcgattatcggttcaggacatgtgattcggacccatttgagtgtgccgaggaacgggtccgaaactgacttgtag

SEQ ID NO: 83100 - DNA, 224 bp, Heterodera glycines
  Genomic contig location: Contig_ID=SeqID_18483; Location=1..224; Strand=+
  SCN-specific regions: Sequence locations=1-101,158-158
tttggggcgcactcccgttttaccgattaagtaaggaatcgatgaaagtagtggtatttcacgggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgt

SEQ ID NO: 83101 - DNA, 992 bp, Heterodera glycines
  Genomic contig location: Contig_ID=SeqID_18484; Location=1..992; Strand=-
  SCN-specific regions: Sequence locations=1-214,247-728,750-932,954-992
  Gene Ontology: Mol. function=RNA polymerase II transcription factor activity; Cellular component=nucleus
gtgcgtggtcagcatacgaaaacgaccggacgtaaaggacgcactgtgggagtgtctaagaagaagggaggctaaaacaaccgtttggttaccgatcatgaagtcgatcagttggaattgttgttgacgttatttgatgaggtctatgtaaaatgttattgttggttcttacgctgttttttgtttttcacttttgtaatgtgaatgaacaatatttttagttacttttttctttgctttgaaaaatgaccactttagcataattcagtgatgatgtacagcctggggtctttctatggtgctcctcccattgcttacaatcctacaccgctcgccgccgccactcctggcgttggtccaatgcgtccgccagttccaatgagtgtccatggagcatcgcctcaacagatctatcagttcaagccaccgacttttgacccgtacctttgcgatcagtttttcccacgaagcagcacagaggctgaggaaacagctcagacacaggttcatccaacactaatggcaatcgtaagaatggtgggcccgtattttcctttgtgggcgttaaataattattcattaacaatcaaattttttttcgaattttagttcttattggccaaacacaatgacattctgccttctacggtggaacaatctgctatttcggcattggttggaaaagtgaagcagactttggacaaaatcattgttgctccggaaacatttaactctgtggtttgttttttaccatatttgtaataagcattgattaaaaccatcttttttgattgtaaggccattgaggaagtgcgcgaggtcggctcttacaaaaaggggacaatgttggccaagcacaatgtggccgatttggtcattgtgctgaagactttgcctctaatcgaagcggttaatgcacttggccagaaaatagtgcttgatctcaaggcagaaaaccatgccgatagtaagaatgaatgaagaaaggacag

SEQ ID NO: 83102 - DNA, 1258 bp, Heterodera glycines
  Genomic contig location: Contig_ID=SeqID_18485; Location=66..1323; Strand=+
  SCN-specific regions: Sequence locations=1-213,272-449,501-572,652 -936,960-1218,1240-1258
  Gene Ontology: Mol. function=protein C-terminus binding; Cellular component=synaptic vesicle; Biological process=synaptic vesicle priming
cgactgtgtgaagaggaatgcgagcagctggtcggcattttgccatcccgatatttgaaggcggaaaataattgtgcaaatagcaatggcattatggcacgaaaagaccccaacaaaatgttgagcgaaagatttgctcaattttcactaaaaaatgcagctgaacgcaaaaatgagaagccggaggaactgaaaaagcaaatcaatgtttggaaataatttttatttaattaaaaaataatattaattaacttttatatgtaattattttgaaagttttttgttttttaggacctttatttggagacactctatacaattttgcataaaattggtaaagaagctgttgccaacgaggaccaacttgcgcaatatgccaaatcagctttccaagtcgaagaacgtactcatcaaacactgatggaaaaagcacggagcgaaaaagtggcattttaaaataaaatatcctttattaatttaatattttttattttaatttagccgccaatccttttgttaaatgtccttttgctggaggcccgtgatttaatcgccaaagatatgtaagagtgaaaataaattaagataattaataattatgcataaaaataataattgaaataatttatcaaaatttaatgtaataatttacgtaaatttgatttgaaaaagcataaaatataaatctcgaattagtaaacaataagcttagaaaagtgccttttatattcttaggttgagttagcaaaaaaaatgacaaattgctgacaaaagccgcttcgaaaatattctaaaaaataattttctaattatagtgacggcttttcggatccatttgttatgcttggcttggtgccaaggggtggcagtcaaaggagccctggcgcagatgatcagaattcgccaaccaatgtgattaaattaagaaaaaaaatagttttaaagattttaattatccactaattttattttaggaaatttcggaagcggattcgtctgcttcagctgctgacggtggtgccggtggtggtggcaattccgcgcgaaaaaatccgctcctgcaacgcttcagcggctcatttcgccgcaaagcgcgcaaggcgcgcggtgagacgcaaacatttgacgccgagaacggcattccggcacgcatcatcaaagcgtcatcagtgcagcggaagacgctgaacccgaaatggaatgagaagttccaatttgtgattggcgatgtgactgatcgcttccatttggacatttg

SEQ ID NO: 83103 - DNA, 575 bp, Heterodera glycines
  Genomic contig location: Contig_ID=SeqID_18487; Location=372..946; Strand=-
  SCN-specific regions: Sequence locations=1-108,131-155,177-357,439 -454,476-482,506-575
atgccggcacaaaagtcaaaccgttgcccatctgtaaggtgtggtgccatttgaattgaacacattaaattaatcattttgtgccgatttagcatatgttccacaacgaatgcattgaaatgtggtaagcaaaagttattaggggaaatatagttaattaattaataaatatgctttaggatcggaggcggtcataatggttgtccaatttgtcgacaagaaatattggacacggacatgttgtcaacaacaacagaaaatgcacgtaagagcataataattaattacttaaatttatggcattaaagcataattattaattaaatcagttaaaataccaccaattatttagaagcaaataataacaacaataataattctaatggaggaacacaaaacgaagtgattatagaaataaatgataataattataataatggaacagaacaaaatgaacaacatcagcagcagcaaacagccattgaaaatgataataataatgatagattatcagaaaatgacagaagagcataataaagcagtggcatttttgattttattaacacattaataaa

SEQ ID NO: 83104 - DNA, 443 bp, Heterodera glycines
  Genomic contig location: Contig_ID=SeqID_18487; Location=1121..1563; Strand=-
  SCN-specific regions: Sequence locations=1-24,46-443
atggtggaaattgctcaagttgccataaaaataaaagaaaaggaaggccaaatgatgaagaaaaattccttagatttgcttttagagctaatcaaatcgatttggacgaagccgcactttttaatgggcgaaagggtaattaggaaaattagtaagtgttaagtctaattaaccattcagacgaaaggcgacgacggaggcgcaaacgaatgattttcgcaaatttactttgttatttgcttttggctatgtgcgtgctaatcattctttgcctgtctttgatcgcttgtcataacgcgcaaaatatcgcacggaacattaacagaaacaatggacaaacagaagcaaacggagcaatgagcaacaaacgatgtaataagaaggcattataatattaattaactaattagttaattaggtgtcacaatttttcaattaataaa

SEQ ID NO: 83105 - DNA, 613 bp, Heterodera glycines
  Genomic contig location: Contig_ID=SeqID_18487; Location=1731..2343; Strand=-
  SCN-specific regions: Sequence locations=1-41,64-165,187-220,293-613
atgtctgctgaattaccgatttgtctgcttttgctgctgtttttatccttttctttgtcggcatttgccactttcgacggccaacaaaatttgagggatggccaatttttgggttgccaaattaagaatttaaagctgctgcaaacaaaatttatggacagaaaattaatggaaaagtttcactttgagctgagcaaaaagcagcgaatttttgaggcactttttgtgggggaggaaaaagtaaaaaaaagaaaataaaattaacaattaattattgtcaaaaatttttaaagcatttgctccgctcggatgcttttcctcctcctttaattgctgccgatgaattcgaatgtctgaaaacaaaactgaattcgatccatgctaatgaccccgctttgagtcaattgctaaacggcttatttgctgctgaaatgcgcgcaaaacgaaaattggagtcattggcaggcaaataattaaatgcctaattaattagcatttaattgatcatatttttttaggtttcggtgatatttctttgttgaaagaattaaagcaaagcgtcgcttttgctttgcttttcgtggcaaaacgtcgccgaattcagctgaataaa

SEQ ID NO: 83106 - DNA, 1151 bp, Heterodera glycines
  Genomic contig location: Contig_ID=SeqID_18488; Location=721..1871; Strand=+
  SCN-specific regions: Sequence locations=1-184,208-227,254-315,353 -487,509-1038,1061-1151
atgtttgtcgatggttgcgccattctttggagttattgggatcgcttcaaaaaaccaaaaaagaaaatgtaaaaaaaacgctgacccacgaaatgtccaagtctcgaatttgagttttttattattcagatggactaaggttaggcaaggggtaatataaaggggatattcgtattcagcgaccccgaaaaccctaaaaatcctaaattagactcattttgtttttataaattttgaaaaattttggacatttcgtgggtttttactcttttggacattcgtggcttggacactttgtgggggtgccaaaaaaacaataaaatttgaaaaataatttttcagctttatctccgccgattgttggctttgtgtcttcgatttgcttgcgccttctcaacttggcctcggaatttcaatgatcagccaccgttttgattattacgtggacgaacacttcaagacacggcgctgggcgttgaaatccatggaaatttggagcaaaattgaagagaatggcacacaggaagcggcaattgtcaatgatcgaaaagcattgccaattccgaaaattcgaatgccacgcaaagtcatcggattcaaaaacattataatagggtaaaatggattaattgtttgctttctttatgctatcatttaatttcacagatacatggaccacaatgtgatcacttttctacgccatttttgtcaaattttcgccgtctgtccaattaatttgtccatccacacgaacagcaatcgcattttggagttcgttttacgcaacatttggccattgctcgggaaaaacatttgtgccatggaattgtccgtcggagttttccaccatttgcgacaatttgtgccgtcaattctcaatgatttgccgttgctacgcattgttaatttccaagtcgccgatctcttcaccgaatttccggccgatgacagtgccacggcgtcggatggacaagcggtgaccaaatggcttttcactgcccgtccggacaatgtgccaaaagtgctccaatgcgcgttgctcatggacatggatgatgggaatttggtgtcgagggttgaagccttcaaagcggtgatttcgaattgatttatttggcacttttacggtctttgggattcgcttatttgaa

SEQ ID NO: 83107 - DNA, 223 bp, Heterodera glycines
  Genomic contig location: Contig_ID=SeqID_18488; Location=806..1028; Strand=-
  SCN-specific regions: Sequence locations=1-101,125-223
tggcacccccacaaagtgtccaagccacgaatgtccaaaagagtaaaaacccacgaaatgtccaaaatttttcaaaatttataaaaacaaaatgagtctaatttaggatttttagggttttcggggtcgctgaatacgaatatcccctttatattaccccttgcctaaccttagtccatctgaataataaaaaactcaaattcgagacttggacatttcgtgg

SEQ ID NO: 83108 - DNA, 225 bp, Heterodera glycines
  Genomic contig location: Contig_ID=SeqID_18489; Location=38..262; Strand=+
  SCN-specific regions: Sequence locations=1-162,188-225
atggcacaacagatgacaaacattggcacagcgatcagactaaaaaatgagaaggaaaagtcgagaaaaaatgcgcaaaagtaaaaaataatattttgaaggtattttcagggagaaaaagtcgaatagagagacgaaaagaaataaatggcgagagcgaatgaaagagaatgggagaggagggaaggcttttattgcaaaactgcgtctataaacgaccgttta

SEQ ID NO: 83109 - DNA, 792 bp, Heterodera glycines
  Genomic contig location: Contig_ID=SeqID_18490; Location=275..1066; Strand=-
  SCN-specific regions: Sequence locations=1-72,102-300,325-352,374 -619,643-792
atgccaaaagtaccaaagcataggtttcaaatatcagtaagtggacaatacgtcagtaacaaatccataagcaaatttatttttaaaacaaaagaattaaatgataatttttcgagatcgtcaattaaacattccatttgagtttttgccgtcatatccctcatcctatccaaagtccatccacattgtgcaagtatataagtccatataatttccccctcggtggctgcgagctggagctgtttaaaacggtaaaaattgcttaaagccttaactccggggacacaaaagaaaagttacgaagttaaggcatttgttgattttggacagaagttgtatcctatgttaaaactttcacacaagttaaaacaattgttgctatttttcgatctatcttattcaaatttaaatttcaaccttggttttttaatttttccatttccgctctttttccgtctctttcttattctctcttctattttctctcttaattgtaccctctctatttggggatgttttaattttctctatttttttcttttagttcattaacgcttttctctcttgctcactcacactctgttttcactcatatgttttattccttaacttttatttccataaaatcttaaagaaattgaacaaaccaattaattgcagttccccttatttcagagggtttctttcttcacgactacagcaaatgcaaaattcatattgttgctgactgaccatgagatagggcacttggtagccaacataatgtgccctgatgggtttaaatttttaaat

SEQ ID NO: 83110 - DNA, 342 bp, Heterodera glycines
  Genomic contig location: Contig_ID=SeqID_18491; Location=1192..1533; Strand=-
  SCN-specific regions: Sequence locations=1-119,141-144,166-342
atggccttttgtcagcgcttcgactccgccgatcagtcgtggtctctgctcgttcgtccccatcaaaagaagcgcagcggcgattacgcccgatcggttgttgaggtgaacagacaaataatgaggggaaagaacactgagtgacaaccccttttccatcataccgtacttttcgtgtgtccttctacagtaagctttgtccttcagcgttacactgccattccgcttctgactctcgcgccagttgaccttgcgcatccgagcaatgtgttctcggtgatcgaaatgtacgaggcgaacggacggagggaaacgccggacaaagtttactttgtacgactc

SEQ ID NO: 83111 - DNA, 1479 bp, Heterodera glycines
  Genomic contig location: Contig_ID=SeqID_18492; Location=1436..2914; Strand=-
  SCN-specific regions: Sequence locations=1-107,129-293,315-374,396 -419,441-444,466-815,837-1040,1067-1269,1292-1444
atgggagaacaaatgttgaaaaaactgaaagaaaaactgaaacgattattcgcagtgaaaaagaatgatcaagtaatggcacagataatggagaatttattttcttttataaagaaaataataaaaggtaaaatgaatgaacaaatttggggggggggggttctcgagtttgttcactcaaattctcgagtttgttcactcaagcatataaagtttttaaatttttttatcatatctctccacccttttatttatttgtcgaataaatcacattaggaatggttcttcccatcaagaaaatgagtaaattttctattaatttcacctatcaattggaccaattgttttttatattgagtttttaggccacaaatttagcaaatatgtttttaagcttctattctttgttttttttttgttattctgtcgaaatttgtgagattgaaaaaaattaataaatttaatccgactttttaaaagatttccacctaaactactatagttaggagatctgacatccatagactttgttgagaatactggaaaattttaaaaaaatgttgaaatagcgaagaaaactgagatttctgctcttaaaactcacattccgaccacaattcgccgggaacgggatttagggttggaattaggccgggataggattagcgggattgaaatcccgtttttgctggaatttcaatctcgataccgggattcaaatctcgatttaggcgtgatccctaacccggccttttttgcaaaaaagacgggatcggaatcccgggaaaatcccggcgggttcccgttccgatccggctctaatataaaatagaacaattgtcagtttcaaaaaaaaaagtttaccaaaaagcttaaagaaaaggaaaaacggtaaaacttaaaaaaaaagtttacatatgaaaattagtttaaaaagcattcctattcttaaaattacatttatttcaattcattaaacccaaaaaatcagttgatacaaaaacgaattgaatttcgtcgtccgtcccaaaaaacatcggaaaattttaaattttttttaaattttgcgattattaattgttcattttttcacaggagaaagcccgcaaacggttaagcactatttgctgttcaccatcgaaatttttgcattgagagaacgaatttcgttgtccgaaaatatgacaaaaaataaaattgaaataaatcattcgaaattatttaaaatggttttggaggaaagcaacgaacagaaagagggcaattccgagagaaggaaaacaattttgacatctttgtacactgaagtgggaagtttggaagttccttccggcattgaaattaaaaaatgtaaaatatcaagcttagggagtgattaaagccaatctaacaaatccatgttaattttaacagaatttttaatgaaatactttgggttttgaagttttattattattaatttaattatttattattaaa

SEQ ID NO: 83112 - DNA, 1239 bp, Heterodera glycines; identical to SEQ ID NO: 18494
  Genomic contig location: Contig_ID=SeqID_18494; Location=1..1239; Strand=+
  SCN-specific regions: Sequence locations=1-190,223-712,735-841,863 -895,917-934,957-1189,1216-1239
  Gene Ontology: Mol. function=pyruvate dehydrogenase (lipoamide) kinase activity; Cellular component=mitochondrion; Biological process=glucose metabolism

SEQ ID NO: 83113 - DNA, 90 bp, Heterodera glycines
  Genomic contig location: Contig_ID=SeqID_18495; Location=1..90; Strand=-
  SCN-specific regions: Sequence locations=1-90
gactcaaatcatttattattgttaattgtttattgcattctctaaaccattgccttgttttgtatgtattcactttgacatgtttgtgat

SEQ ID NO: 83114 - DNA, 479 bp, Heterodera glycines
  Genomic contig location: Contig_ID=SeqID_18495; Location=738..1216; Strand=-
  SCN-specific regions: Sequence locations=1-169,191-369,392-479
ggtgttgcaccattacatcacctgcgttctgtgctgcatcactttgacgtggagcggcggcgactgctacgagcacatgcgtccgacctttgttgtgctcgtgtgctatgtgagcagtgtgcagataatccagtgaataaattcattgcatagtacaaatttaaattcgactttattttttccttttcatgtacaaataccaaacgggctgtttgcgcagactccgtaaacatttcgcctccattttctgctgaattgctctattttccccgtttttagatgccttgggacagcgtcactcaatggacattaccgttgaaggtagagcccggaaatttcgtatttgcggaaaataaaatttacctccatgttttggggccaaattcggggttttgagtaccgaaaaattttggtcttaaatatcgctaatgtacattccctccttttcaggtttcagcagttggatgttcaaaggattg

SEQ ID NO: 83115 - DNA, 569 bp, Heterodera glycines
  Genomic contig location: Contig_ID=SeqID_3080; Location=1488..2056; Strand=+
  SCN-specific regions: Sequence locations=1-569
atgttttcttctttgtgcccttccgttgtccgtcacaaatgccttcgctgttctactcgcactttggcattttctggccataatttgtccgattatttgcccgctgctcagccgtcttctcgctctcaaaaagcacgcgaaattttgaaacgccatcagtacgcgttgaagcgaaggcccaaaaagtggaagggagcggagtttggcacatttgttgaacaaatggactcaatcgcagcaaaatgctatttggggtgagcacaatttgcattcgaggcaatcatcaagaattggtgtcccgacgaaaaaaatgttaaaattttggcaggtattttttctaggcttaaaaaatgcgacgatcacgaatctgagctcagattttgaaaatcattgatttttatctaagatttttcgtcaactacttgatttttttcgatttttaaagttattttttaaaaaaagtttagcaatgaatttgggttaaaaaaatattctgatcacgaatctgagctctgattatgcatgaaccttcattttgtctatgatttttcatcaagtgtcataaaaaa

SEQ ID NO: 83116 - DNA, 76 bp, Heterodera glycines
  Genomic contig location: Contig_ID=SeqID_3080; Location=732..807; Strand=+
  SCN-specific regions: Sequence locations=1-32,54-76
acgagatttggcacacacagatcacttttttccacatacatttctgattttttgtggcgtaagcaatttggaggac

SEQ ID NO: 83117 - DNA, 1445 bp, Heterodera glycines
  Genomic contig location: Contig_ID=SeqID_3081; Location=2000..3444; Strand=+
  SCN-specific regions: Sequence locations=1-451,473-519,541-924,953 -1341,1363-1445
atgctgaggtcggccttcagtaccaccaaacatccgaaatacgttgtgctccaagggatcatcggcagctcttttcgggttcgcctaacatcacttgcctacaattttgctttcattttccaaggaatgggaagagaataaacagcccgtgtccgtggacaaaaccatcaaatacttcgatgggcaattggaaaatgccgacgaaattgcccaaattgagggcaatggaccgaaaaagcggcccaacatgaacctcaacgacttcaccttcaaactgggcaattggtgcttcgacaccccgggcactgttaacagcgaacaggtcgacaaccataatttgttgtgagggcggtaattattgttgaggcatttttcaattccaatcgccgaaggcccattttacaatatttatgggatcaataaaccgattctcccccgcagttttcatttgttttaaacttctaggattttcaaaaaaaaaattaattagtttttattacgactatttccgcgcctttcatttgcccatctttcttttgcagttgttagatttgttcaccttagacgaactgatcaacgtcgtcccccgttccatcataacccctcgcattttttccctgaaaatgtgccattctttgctgatcggcggcttagtgcgaattgatctgctcgaaattgacacacaatcaattacacatcagccgacagtttttgtgagttcactcgcataatttaaccccctttttttgcaaaatatgtaattaatttattgaaattcacttttcagcttacagtgttcgccagtaaccgtctcagaattgagctgatggacacggcccgtgtggatggctttttgcgccgtttcaatggccatccttcgcttggcgcgcccattggtgggccgaaacgaatggacaaattcccaaaggtttttcccattcatttgtcttttacgatttgttgtatttgcctatttcagttggaaccttgcgactttgtcgtccaaaatgagggggcgttcaacgaagaagagtcgggttttgcggacgttgttttctcctcagtcggctgggcgttgctcacttcttcggcggattcggtgaaggtaagcggactgacaatgaggaaaggcatttgacacattgtaacagttaacgcaacgaagtatggcatggcatttccatggctcttttcagatccgtgcctggacacccgccggcaaaggtttgctgctccgacaaccgccgctgctgccctacgcggcgaagtatcgcggacagcgacagccaggcacggacatttaccggatgcgaccgttacagcactgcgagacgttcagcgacacgcaacggagcgagcgaccgaaacgaattgtcggagaaaattacaaagcaccgccaaccgctggccaaattatggaatatgtgaacttcgattttgattaa

SEQ ID NO: 83118 - DNA, 629 bp, Heterodera glycines
  Genomic contig location: Contig_ID=SeqID_3081; Location=1876..2504; Strand=-
  SCN-specific regions: Sequence locations=1-33,55-629
tagtcgtaataaaaactaattaattttttttttgaaaatcctagaagtttaaaacaaatgaaaactgcgggggagaatcggtttattgatcccataaatattgtaaaatgggccttcggcgattggaattgaaaaatgcctcaacaataattaccgccctcacaacaaattatggttgtcgacctgttcgctgttaacagtgcccggggtgtcgaagcaccaattgcccagtttgaaggtgaagtcgttgaggttcatgttgggccgctttttcggtccattgccctcaatttgggcaatttcgtcggcattttccaattgcccatcgaagtatttgatggttttgtccacggacacgggctgtttattctcttcccattccttggaaaatgaaagcaaaattgtaggcaagtgatgttaggcgaacccgaaaagagctgccgatgatcccttggagcacaacgtatttcggatgtttggtggtactgaaggccgacctcagcattagggactcctaaatacaaaaataagatgtagtaattgccctcttggtcggttgtaactgtcaggtccaaggcggacttttcctcttggcatttatcacggtctctaaatgtttgatggactgt

SEQ ID NO: 83119 - DNA, 1276 bp, Heterodera glycines
  Genomic contig location: Contig_ID=SeqID_3081; Location=3753..5028; Strand=+
  SCN-specific regions: Sequence locations=1-65,87-440,462-521,543 -1113,1135-1276
atgagcatcggaggggccctcttctgtttgttcgtcgctttatgggcggttggcattgagtgagtggggaaatttgaaattgaagcagggccatgacggaattgcaaatgattttggaattcaaatctttcccaattttctctgttgtctgaccaatgatcactctcgttgtctctttgtcgtgtcgttcgttgcccactctcccccttttagcgtcgtttttcccctttctctgcttctgtccgcttctctcggctttctgtccgcttcttcgctcgtccacaatgcccacctgtgcttcggtgctcaaattgtactcgcccaacttctcaatttgttgccctccgccgatgactccgtctcaaaagggcaaacggcggacgaacagcagaaaaatggtggagacgaagagaacaaagggcaacggcacttcgccactttcaaggggagtggccatgccaatagaaattacattgtaccaccgtgggaacgcgttgaactcgacgcacggctaaaccacgagttggaggagctgtttgagacacttttggagagctatgtgagcagttggtcagttcttttctgacaatttgaccaaatccgacccaaaaaacaaacgacaaaggtacaacgggctgatcagcacggacaccgcctttctgctggaagtgcgtcatctgatccgccattcctccgccaaactgatcaatcgtttaagcagtgtcgacctgcgctcgcttctcatcaacgaactgttcccactggtgttggctcatgttgaacgcatttgtcgtcttacaaatgcaatttttgggcatgaaaatcatcaagaaattgcacaattggtcatctcacatacgcaatgattcagcaatcacactttttgctttggttttagcccgtctctctcatcgaattcaaagtgttcgaccaatgggccgacgacgtgcactgggcgatgcggtcggaggccaaccgcgacgcgtacttgcgaatggtggccgatctgttgatccgacagtttgtggacgacattcgaatcggcggatgctttgtggacgaagagcacgcgaaaattgtcaaccgaaacggggagggcaccgacaattatgccggtgccggcggcggtgctgcagcaatgcccccggcgacgtcgaaagtgttttgccattatttgcgcattttgccactccctcccatgtcagtggtcctgccacagttcgcggcactttctgcgcgagttgctcttttcctctgcgcttctccccactcttga

SEQ ID NO: 83120 - DNA, 581 bp, Heterodera glycines
  Genomic contig location: Contig_ID=SeqID_18496; Location=1..581; Strand=-
  SCN-specific regions: Sequence locations=1-7,30-285,307-366,389 -553,575-581
ttttggcgttccgttttgtccttttctccccaactctcccccccccctttttccccctcagaaatgtctgtgcgtttctttggatgagttcgtttgggacatcaaattccgtcttctgcgctcgttgccccaaaaattggacaaagagttcaattttggcctttttctgccgccctgcgacggaagggccggcaaatttctgctggaggaccggcaaattcgcgaatatccattccacgactgtgtgccttatgttgaactgaagtacaaaaagagggtgagcagaaacggggaaaatagggaaaattggagaaaaaagcatacggtacgaaacagcaatacggtaatggcattgagtaaatgagaatgaagtactgtaatgaattaaaggaaaacaattggtaaaatacaacagaatattgaccaaaggtgtacaaaatgttgcgattggatgagaaggcactgaatgtggtccattcgcgcaccaatctgagaaaagtggcggaggcggtgcagggacgaaacgccacaaaagtgagacaaattggaaagccaaaagaatggcaaattcaattcaaaaa

SEQ ID NO: 83121 - DNA, 213 bp, Heterodera glycines
  Genomic contig location: Contig_ID=SeqID_18499; Location=171..383; Strand=-
  SCN-specific regions: Sequence locations=1-145,167-213
atgatgagtaatagtgccgccgtcgccccttcctcggcggacggtctgctgcgcaagtcggccaccagtgcgtcggcactgtacagcagttctccacaacatggcacgacggccaaccatttcccgacaattcctgaggaccagggcctgaccatgtcggctggtcgtgacaaaatgccacagacagccgcctccgccagtccgccgaaatcg

SEQ ID NO: 83122 - DNA, 1267 bp, Heterodera glycines
  Genomic contig location: Contig_ID=SeqID_18501; Location=112..1378; Strand=-
  SCN-specific regions: Sequence locations=1-172,195-536,562-878,901 -1113,1136-1204,1254-1267
  Gene Ontology: Mol. function=MAP kinase kinase activity; Biological process=signal transduction
atgactgatgttggcactttgaacagttttttttgttttgttgagggcggtcagctgggcaccggtgccagcggaagtgtgtgcaaatatcggttcagaagtcgacccattgcagtgaaggtgtgtgattgaaatttccaaaaaaaattttggtcattccaaaaaaaatgggcatttttggtgaaaaatggctaaaaaaggcactcaaaatggagtaaaagaatttttgacctgaagagcagaaaaaagcttcttcggattccgccttcccaaattattttcttgctacgggcttgtccatgagaacaaaacaaattttcagcaagtttttgcaccgttacccaacatttgcgccccggacatttgcgtctttgtccaaaatagggttcaaacttacattttttcaatcccggagggcttaaacagctttaaataagcgattgaaagtgattgtatgggatactttgatcctcagcaactttttgaaaaaacaattaatttttcaaacaacatttaattattgttcctaataaaccaaaaagaacaagttttcttaaatttaatgctgtttaagacctctaagattgaaaatgtatgtttgaacccaattttggacataggcgcaaatgtctggacacattttgcaaaatttggaacttttaaggatttgtggcaaatttgaaaaagaatcaatttcatgaataaacagttaattccctgctttgtttggctcgtttttgcgagaggagatttgtacaatttaccacaaaagtttttcacccttaatttctcaaatttttgggttacgcgttaaagaaaagcatttttacaattaacaaatttagggatcaatttttgagcaattaaaatgctttatcaattttattaaatattaaaaatcccgtaaaactaattttaaaaatcctagggttgtcctccatttacaatattttcttagcaaatgaagcgcactgacaatgtgacggagacaaagcggattttcatggatttggaggtgatttccaagtgcaaggattgcccatacattgtcacttactacgggtacatcatcacttttgtgagtgttttgtaatcatgccaaaattgccacgaatttattttttgccatttttcaggaatatttgtacatttgcatggtgagtttttgctgcatttttaatatttttttagttcattgtcattcattaaattaaataccttaatagataaataatttattttctttttttaatcgtcagaaaataaa

SEQ ID NO: 83123 - DNA, 883 bp, Heterodera glycines
  Genomic contig location: Contig_ID=SeqID_18502; Location=462..1344; Strand=-
  SCN-specific regions: Sequence locations=1-46,68-327,349-379,401 -515,537-883
atgaaccgacggtaaggcattttttaaaagtcaaacaaattagtcatttatttagctaaactgtttttccataatttcagttggatttgcaacgacgtttggatggacattttccccagttttgaccattctcaactcggcctcaaattggcacttctttcgccacgttttatactttcgaatgataccaaaaagatagggtttgttcgaacatgaacaaagttattgtataaaaacccgggattgtcaattgattggactcataaaagtcgattggactcataaactgcaatagagccaaaatccgttccctaatcatgacacataaacaaaaagatacaaaaacattcatcaatcccttttcatgtctataaaaatgtttgttttttcgctttgtctcgcatttgaaaaaaataaaaatttctaacgcaattaattattctgctctttgttgtgtgacatcattcggaactcggccaaaattgtgctaattgccacaaaaatgaaacgacggtaattaaattaaaagtcacaaattcgtcgtttatttaactaaactgttttcccatttcagttggatttgcaacgacgtttggatggacattttcccatcctttgaccatgctcaactcggcctcaaattggcacttctttcgccacgtttcaatgcgttggtggacaaacatttcgatggcaaaagcgaattgacaatttggagaacgatcgaaattcgcaaggacaaaggaccagaaccgaaactattctgtacgaatcgattacaaatttgtggaatttccattgcccgaccgtccgttgcccagcaaaatccgttttaagcgccttcagattgagtaattcggaatcagagatttatggcaataaa

SEQ ID NO: 83124 - DNA, 1043 bp, Heterodera glycines
  Genomic contig location: Contig_ID=SeqID_18503; Location=1338..2380; Strand=-
  SCN-specific regions: Sequence locations=1-331,353-410,432-722,744 -1043
atgccaattgaaccatttgaattggtgaacgaacggaccaatgagaagctgacactgacgaaggatgaaaatggcactggtgaattcaattggctgttggagagatgcccaattattggggagacggcggcggttcagaaacagcagcagaagagggacgaaaattcggatgccaatttgaacaaagtgttcttccgtctttacgatgacattgggtgagcagaaaggaggcctttttgtataaaacacggatagtggacggtagttggggtgccaatgccaatttgaaccatatccgatttgatctgtggagtttcagtcaatccattgggtgagcagcaaaaacagcaatttttgatttgtcgaaaaataaaaaaacttaattaattttaggccattgtcaccaccagcggaagaggaagaagaagcggatcaaagcaacggagattaattgcttttaagaaatgatgagaaacgacagatctcaatttgatgcttttattccctgtcacaaatgcttttgttgattctttcgttccaattatataaaacatacttttgcctcaaaatggcattgaagaccaattttgtttggatttttgctgaaaatttctgatgtaacgtcgcgcatgaagtttttcctgtcagttagtgttttgtcgtctaagttcatttgaaaaatgatttcatgcccagtaatacgaaaacgcgaatacattaaacaattttaaaattttcacattcgaaaaaaacttgttttgagtgacaaatgcgctcactcgaaaaaagtgccattgtaaaaaccaattgtttgtcttttgccatcgggtccactgcgtttcggcgctcccgtttcggcgccagcatgtttttggctataacttttttctttgtaaaccaaatccaacattgttggtgtcgttcgaaagctaatcaatttagaagctttttctaagctattgctttgcgattagacaattatcaaaaaagttatgcatgaaaattgcgaaaagtcaaaatttttgaagttttttcttaataaa

SEQ ID NO: 83125 - DNA, 1538 bp, Heterodera glycines
  Genomic contig location: Contig_ID=SeqID_18504; Location=203..1740; Strand=-
  SCN-specific regions: Sequence locations=1-399,422-446,481-646,668 -997,1019-1538
  Gene Ontology: Mol. function=structural constituent of cytoskeleton; Cellular component=cytoplasm; Biological process=microtubule-based process
atattcggatttgctcgactcggtcaatgctcgccatcaacagttggaggacgcgctcattttgtcccaggaatgggctaaacagaagcgacaattggccaactttttggacgagtcggaacgccaactgcacgcatttgaacacattccaactgatgcgcaaaagatggaggagcaaacgcaattgttggaccaactgcagcaggccacggatcagcaacgggccgactttgatcggctggtcgaattgggcaccgaattggcccaaatggtcagcctggaggagggccaagagttggacgccgacatgcaccagctgatcacccgctacgacacgctgggcacacggcttggccaaatcggccaactgatggggtgggtttatgcagaaaactgtagagcattattttatttttaatcatgggattctgtctaaaatcaatcaagatgagataatctctaaattaatatgattgaatactgtaattaagaaagggaaactgtaaattaaccagattgggtactgtaaattacgaaaagaatatggtatcgtgcgtatctcagtattttccttgtgcatcgttttgtgtttgatcatgagatgagatgtcctaaaccaacatgatctgtaataataaaaggaatctgtaaattaatcactggaatactgtaaattacgaaaataatattttatattgagcttatctcagagttttccttgacgtatcattttttgggaaatttgtttgatcaatccattctgataatgatcatggattacccgaatttgtttccattttcgatcactgattaatctatacactttgctgatctttcagaacgttggcggaagacatttcccaatttttacaaagcacggaacagctgttgaattggctgaaggaggtggaagatgaaatgcacaaatttgacgacccgtcaacagagcccgaagaattgggcagacaaagtgacgaattggcggtaagggaaaagcggacaaaaaataaatatttatggactgactgatcagcagaaatgatttgtaaaaggcgtgatttattgatcactttaatatatgattcaatcgcttttgatcaacttagtgaactgtaggaatttagatctctgatcaaaaagaattaataaatcttataaaaagtttattagtcaccaaaaaatcaattttcaatcgatcaatcaataaatgcctttgattatttttggaccaccaatccagtcaatgccattgattgctttgatcgactatcaaccaatgccatgctttccccattttccagactctggttgcctccattgctgatcaaggccagctggtcactcaagtggtcgagatcagtcaagagttgtgtgcccacacgagcggtgccgaggcgctgtcgctacaattccggacggacaatttgcgccagcgctaccacccggctggcggacgaagctgcgagccgcatcaccgtgctggagaaggcgctgccgttggccgaggacctcaaggagggcatggccgaactcgttga

SEQ ID NO: 83126 - DNA, 273 bp, Heterodera glycines
  Genomic contig location: Contig_ID=SeqID_18508; Location=77..349; Strand=+
  SCN-specific regions: Sequence locations=1-28,50-273
gaaatttttgttcggctctgtgagtccggcaaatgttctcccaaacattacggtatctgctgaacgacacggaatgcaagtcagaaatgcgttgggtgaaaatttaattgtgccgcacaccgcgcaaatgtaccaacgccaattggcacaaagttggggccaaaggccaagcccagcggcaacagcatcagacaatggccaagtggacagaagcggagcaacaagccaactgcagaggatggcaagttttcatttctggtaaaagtcaaatta

SEQ ID NO: 83127 - DNA, 612 bp, Heterodera glycines
  Genomic contig location: Contig_ID=SeqID_18508; Location=832..1443; Strand=-
  SCN-specific regions: Sequence locations=1-41,63-74,102-157,179 -322,398-432,454-612
atgaccaaatttaagggttataaattatgccagaggcaatttttatgggtgtttttgtctaaatccagggtttctatctcaaaattttcaaaataaaaccaaaggccaaaaaataagattttagggtcaaaaataagaacattttgcaaaattgcttcaaatatttttacattttattcgatcaaaaatgtattctattattatatttttcataaatttcagtgcattcgggatcactaaatcagatttgggctaaatggataaaaatttgtcgcttgggtattcaattcccaattgagaaaggagattgttcatattctcgttaaattattttaattgaatttaattaataagaaactttgtctatctttaaaaattatttttctttaattttaaacatccataaacccacaattaaccaatgattggtcattttttggacaaaatttgttaacaaaattcactcaaaatttcaaattttttctcggctgagcctatcggcacccacggacaaaaaaaaattaaaagattttgtcaattagttgaaaacatagaaaattctttaatttttttggcactggatcttttggattttaaaaaataggtaataaa

SEQ ID NO: 83128 - DNA, 1489 bp, Heterodera glycines; identical to SEQ ID NO: 3082
  Genomic contig location: Contig_ID=SeqID_3082; Location=1..1489; Strand=+
  SCN-specific regions: Sequence locations=1-8,31-457,481-1303,1325-1489
  Gene Ontology: Mol. function=transporter activity; Cellular component= integral to membrane; Biological process=negative regulation of locomotion

SEQ ID NO: 83129 - DNA, 818 bp, Heterodera glycines
  Genomic contig location: Contig_ID=SeqID_3083; Location=625..1442; Strand=+
  SCN-specific regions: Sequence locations=1-242,264-384,406-420,442-818
  Gene Ontology: Mol. function=hydrogen-transporting ATPase activity, rotational mechanism; Cellular component=integral to membrane; Biological process=negative regulation of locomotion
atgcaggaagacggagctgaagttttgcaccacgaggacacttcgacaacccacaaaaaccacgagacagcgacgggcggagagaagggcggaggtcaaggccaacaacacggggacggctcttttggggacataatggtctaccaggcgattcacaccattgaatttgcgctcggctgcatctcgcacacggcttcctatctccgtctttgggccctgtccttggcacatgcgcgtaaggaggccaattggatgggggaagaaagcgcattttgaatttgaacagtgtatttttgcgttttttagctgaatttctcatttatgtctattttctaaagcccggaacgaaccctggaacctttaggggtttccgatgacttatccgaaaaagtttttgaaaacataatccttgatatggatcgggaaattttaaacgggtttgtgttctttttccattattgcttcgtatggttgtactctgaccacctttaagaattgtccgacgtcctttggtcaatggtgctccgcaatggattcgtccaaagcggttacctcggcgccgtcatcacttatctgatcttcattgtgttcggcacactcactctgtccatcctcgtgcttatggaaggactgtccgcctttttgcacgcgcttcgtctccattggtcatttcttcattttagatgttttgtttactttttatgcatttgtttagggtcgagttccaaagcaaattctacggtggaatgggccaccctttcgtgccgttttcgttcgagaaaattcttgaggagtcccgtcaaagtgaagacagttga

SEQ ID NO: 83130 - DNA, 557 bp, Heterodera glycines
  Genomic contig location: Contig_ID=SeqID_3083; Location=2077..2633; Strand=-
  SCN-specific regions: Sequence locations=1-322,344-372,394-557
  Gene Ontology: Mol. function=purine nucleotide binding; Cellular component=cytoplasm
ccgaatgtcgtctccacattgccttaccctgtcaaattaaccgcacggcatccgatgagatatttccgagtgcgcgaagaatggcgtgtcactgacgtgttgatgaacccgatgatgctgatgatgggcgccgcatttatcctcgttgtgttgatggtcagatttaaatccaattaatcacaaaattgtttttttaacaattcagcccaaattagccgctcaagacccgaacgtgcaaaaggtcggttttactttcttccttgattccattttttgtcgaattttctttgggcttcctcttcaataaccttatgacttttccctttctttgtatttcaggaaatgcaaaatatgcagctgccaaaggttgacatgccaggtaaaacactcactggacgtaaaataaaaacgaatttccagcaaatgttaagctattttattgccaaatttcagacatggccgacatgctggctaacatttggtcatctggtagcaacaagaaaggcagccgtaaacagatttcgtcgggccagaacacgaaacgtgtcacacgatga

SEQ ID NO: 83131 - DNA, 129 bp, Heterodera glycines
  Genomic contig location: Contig_ID=SeqID_18510; Location=80..208; Strand=+
  SCN-specific regions: Sequence locations=1-78,106-129
ttctgtatcaaacgaatattacagatgattgaaaaagaatcattcatttctccacggattcattttttcagaattgtcttttaatttaaaaaataattaatttatcactaaatgaaggttgttttttaa

SEQ ID NO: 83132 - DNA, 1547 bp, Heterodera glycines
  Genomic contig location: Contig_ID=SeqID_18510; Location=1150..2696; Strand=-
  SCN-specific regions: Sequence locations=1-556,578-1170,1208-1547
ttaatgccgaattgactgttattagtgcactttctggtgaatgccaaagtaatgactcgcaacaaaaagccaggagtaaaaagcgaaatttggaacagaaagcaaagatcgacgatgatgcgacaacacaacggttaaagttttacaggggagggaaggactcgtaaagacggaaatcttctaaattcaaacaccgccgcacccttagcgcattctgttgcgactttttccagtgactcatccacctgaaactcggtcattcaattggtttctcaaaatcagaacctttcatcaggctgctggccatggtaattgtgcccgagtttcagggctcagaatttgtcccattccgctgatgctaacggattgcgcaaccgttccagaatgcttccgggcgaacgaaatgatgtggaaggagcagaaattccattgcgggcgaacgaaaacgaaggaggacccagcggaacggaacagtcagcggaactcggctcgaatccctcagcgtcgcaattgctttcttggcggaggatcctcctgctgataatggcagtgacagtgcacaattttcccgaggtggtgtttttaaaacgcacgagtttccatcatagatggacaggggatgcgccagggtgaggcccatacgacggacgattggcgcagggggggggggtgtgccaggaccaaattttcgtatgaaggccccccaattttctccagcggcgaccttcttttttttgctattcaaagcacctttttttgcggctagcctttttcaaaaattatgtggaaccggtgcggggtcctgccgataggcgccgccgggaaaagttttagaattttctataaatttcgctaaggaaattgttcaaattttaagtttttcccccttcgttactacccccccccctcctttacagccgccctccttacgacgaacgagggggggggggggggtgccggcacaccctttgttcacctatggtttttccgtcatcctcattgactgttcaggattttggctttggggggaggaggttatggtggtgaaattaatttaacaatttcaagacgagctgcgcatttaaggtttacttttcagggattggccgttggtgttggttttggcggtgttgggaaaacgccttcggcaacatttgaaaaagcgttcaacttagcctttggcataggcctgcagaatttcccagagggtttggccgtttcgttgcctttggccgggttcggctactcaaaatggcgcgcctttctctacggccaaatgagcggaatggtcgaaccaatcgccgctttgctcggcgcttcgctcgttctgatgatggaatttgtgctcccttatgccctttccttcgctggtgtgccttagaattgccctttgctttaaatgtttactcactttagccggtgctatgatttatgttgtgttcgactccattatccccgaggcgtattcacacggcaatggcaaaatgtcctcgttatttgccattctcggcttcatggtgatgatgtccatggatgtcggcctctga

SEQ ID NO: 83133 - DNA, 357 bp, Heterodera glycines
  Genomic contig location: Contig_ID=SeqID_18511; Location=2094..2450; Strand=-
  SCN-specific regions: Sequence locations=1-244,275-357
atgccaattgaaccatttgaattggtgaatgaacggacgaatgaaaagctgacactgaaacagaagatcgacgaattcggcgtaaatgtgtataattggctgttgaaacggtgcccaattggggagacggcgacggcaattaaatgggaagacagcgtaaatccgagtgccaatttgaacaatgtcacttttgatctgtggagtttcgataaatccattgggtgagcagcagcaatagcatttgaattttatcgaaaaataaaatatttaattcattttaggccattgtcgccaccaacgaaagaagaaaaagaagaagaagataaagcggataaacgcaacggaaatgtcgtctga

SEQ ID NO: 83134 - DNA, 89 bp, Heterodera glycines
  Genomic contig location: Contig_ID=SeqID_18511; Location=49..137; Strand=-
  SCN-specific regions: Sequence locations=1-89
cacagtttttttttgccctttgtgacacacaaattaaattgaaaaaattggtgagacctgtgctcattgaaccacaaaatgaaccgacg

SEQ ID NO: 83135 - DNA, 1479 bp, Heterodera glycines
  Genomic contig location: Contig_ID=SeqID_18512; Location=753..2231; Strand=-
  SCN-specific regions: Sequence locations=1-369,391-415,437-511,533 -772,794-1479
ccaatttaggccagtttggctgtgtccgatttgcttctcattttcgtcggcatctcctttgacttgttcagcctttggcgtcgtcatttgaatggatggaccgcatttagtggattttgcgaagccacgagtattattggcacagtcacaaagcgattcccaccttttgccccccccccctcaggcacttcgatcagttggttcactttctgctccattctcaccattgtcgggtacagttgctcatttgccccctgcggctgatcccccccccccaattagtctcaccggtgagcgtttagtggccatttgctacccattcagcctcaggccgtatttttaccaccgctccatggtaattggtgctgctgtccccgttcttccttctttttgcccacttttccttaagttgtggctcatcgctgtgctgtggctcatttccttcttcccttcgctttacattggccttcaagtgagtgatttcttctcagtttctatgctttctgagttaaagttcaaaacagttgtgagagatttttgtggtgagtttttggcttttacgatttatggcggcttttccgataaaggaaaaacgcattcgaacgtttttggcaattgtgactttgttggatgggacgaaaaacagcagaacggcgacgaccatttgacctttgaggtgttcagcccattctttggccatgactttcgtttcccctttatttaaggcacagcttctgctcactttcgttttccccgtggcattcggtgtgccattgttttatttcgtttttctgtcccttccccgccgacttttgtcccttttcagttatttactgttacatcaaaattctgcaaacacttaatgaggccacttccaactcgcatcagctgaccgcggcacagccaaagcgaagtgaaaaagcggcggaaggcaatggcaaaggcaaccgccgccagcagcagcgattgctggcggtgggtgcgcctggcggcgcccctcgcgagtctttgccgccttcgcccgatgaaaattgggccgaacggcgttttttcgtgtggtcgaaacatacggcgaattcgacgccacggcggaaattgacgcgaaattcgtccgggcgagggtcagtccgaagtcagcaggcgcacaaaaccgtgctcaaaatgttgggttcgtttgtctccccccgccggcgtttgtccgttccccccccccccctttagtgaccattaccattctcttcttcatctgttacttaccgtaccatttggaacgactcgtcgttaagtacgccaggggatactgtgcccgcgtctgcgccattctctacccaatcactggcctcctccaatacattagcgcaacacttaacccgattatttacaccgtaatgtcgcgcagatttcggcgcgaattcctgcgtatttttcaaaaaatgtgcggcagagaaatgacggcagaggaggacagaaacggggata

SEQ ID NO: 83136 - DNA, 484 bp, Heterodera glycines
  Genomic contig location: Contig_ID=SeqID_18515; Location=1823..2306; Strand=+
  SCN-specific regions: Sequence locations=1-117,214-484
atgccaggttatctgttctttcatcttcgttgccatattttgctattatttgcattaataaatgaattgttgttgaatttatgaccttggtccaaccatttcttatgtagcatgtctcttttccaattcactttgtttcttcccttttcctttctttctctttctcattgaccaactcttctccatcacttccctttttcctcctttctcttttcacccaaaagtccatcagtcgacgcggcgtatcaggtcgcaccatcgtcagtgtcgtcgtcactaaaacgacgtggaataaacacaaatgagtggtggatgaatgagtgggaggatggggaggatgtgaaggacgaagcgggggaaggcggcagagggggtaatttgggagtctgcgcttttctcaatttattggcgagcagaaaattcgctatcattgtttgtatgtacatttagtgaattgaataattgtaatattcctaagaaagaa

SEQ ID NO: 83137 - DNA, 199 bp, Heterodera glycines
  Genomic contig location: Contig_ID=SeqID_18515; Location=2569..2767; Strand=+
  SCN-specific regions: Sequence locations=1-70,93-160,182-199
atggttttgcttctgaattttgccttcatattctttgcatttttggtgagttctgtgtaatttatccatattttttgttttatttgtatttagtcttcaatttatgccgaggaagaagatcccaaagttacgcataaagcatttttcgacatttcgattggtggcgtcaaaaaaggaaggattgtgattggtctctttg

SEQ ID NO: 83138 - DNA, 509 bp, Heterodera glycines
  Genomic contig location: Contig_ID=SeqID_18516; Location=516..1024; Strand=-
  SCN-specific regions: Sequence locations=1-113,143-509
atgcctctgtcggaggtgggtccgtcaaagcctccgatgggtgccggccaatttttgcgatatgtaaaccatatgagggacctcgaaaactccttgatcgcttcaatatctgcaaataacaaaaaaggaattaaaaaattttatgtcgccacttaaaccatcaaaatttcaaatccctcagcccatgaaaaatttcatcaaaatttccatgaaaacaaagaacatagacattgcaggccttaaaatttgttaaattttagacaaattttgtctcaaaaatcgtcgaatgtcgtggtggtgatgggatcccggtaatttgcatgccttttgacgaataagtggtgcccagcagatgcacagagccgccggccaagtcgagaaatgccaaatcttcaagagtggaaaagcctggttccagcgttagacaaacatcgaccatacttaagagttttatgttgatattgtgccgaagtttcagtttcagtcagaaaagggcaaaaaaaaataaa

SEQ ID NO: 83139 - DNA, 2116 bp, Heterodera glycines
  Genomic contig location: Contig_ID=SeqID_18516; Location=568..2683; Strand=+
  SCN-specific regions: Sequence locations=1-315,345-473,495-601,623 -980,1002-1051,1081-1154,1176-1720,1757-1877,1910-2116
aacataaaactcttaagtatggtcgatgtttgtctaacgctggaaccaggcttttccactcttgaagatttggcatttctcgacttggccggcggctctgtgcatctgctgggcaccacttattcgtcaaaaggcatgcaaattaccgggatcccatcaccaccacgacattcgacgatttttgagacaaaatttgtctaaaatttaacaaattttaaggcctgcaatgtctatgttctttgttttcatggaaattttgatgaaatttttcatgggctgagggatttgaaattttgatggtttaagtggcgacataaaattttttaattccttttttgttatttgcagatattgaagcgatcaaggagttttcgaggtccctcatatggtttacatatcgcaaaaattggccggcacccatcggaggctttgacggacccacctccgacagaggcatcgttttttgttgaaaaattggaatttttaccaaattttattataaaataacgaagccaaccaattttggtcccgaaaattctccaaaattcgaaaaaaaaaattattttaacaaagtcttagttgagatgaaaattttttgcgctaaaatgaattttcatttttaggctggggctgcatgatccgagttggtcaaatggtgttggcacaggtaattgaaaaaaatgttggctcaaaattccaatttacgcgtccaaagtgaccatcctcagtttattagggctatgactgtttgttttttgatcagggtcatcattattggtataaattcaaagcttaaagtctatagaattgctttttcaacatttcctatttaaggcactcatcaaattccatttgggctcgaattggcgatgggccaatgaattggtggaccaacgggcggacaatgaacaggttttgacatttgctaggaccacaaattggtaccacctgattctaacacggtttttggccttcatgatttaagaaaaatgaaaagttttttaggaaatttatgggtttcatactttttaatagaggggaaaatatccggaaatttacaaaaaaaaaaaaaaattttaagtttcaagcctatctccgcctgttgaggatgttccaggacaaacgaactgcacaattctccatccaccaaattggtaaaaaatggtacaattttttgaatctcatgaccaaaaaggggaacccattagaattttaacaaattaaagcaagaaaattttggggtttttttttcattttttcgtgcctgggaggtaaaaaaaccataattttcatgttttatgataatcaatttcagcacagtttggcgtttcggaaggcaaaccaattggcgaatggttgggcccaaattcaatggcacaagtgctgaaaaagtcagtaaattttagggggaggggggaggcgcgcaaaactccaataattttgctcaaattaaggattgtcgtctacgatgaatggttttcacgcataaaaataattttctgttgtattttttgcattttttccaggtccaatttggttgtacatgttgccatggacaatgtgtgaggcattttcaaaaattcaactgacacttaccaaaaaaaccgaaattaaaaaaaagattttctaacgcattttgcaaaaattactggtttccattgttttagcctaatttcggacgacgttcacacaatggtgtcattgccgctgaaaacggttatttattcatttttatttttttttaatttattttattccgtcattaggaaaatgggcaaaccgacgaatctgccgaacgtgaacagcaaacaaattctcccaccaccggtcaatggattcgtccgttgctgctcattgtaccacttcgacttggtttgatttaaaaaaaatttttttttttgaaaaatttcattggattttccacaaaatttaggcctaaccgcgatcaatccctgctatttcaatgcgattgcggtaagtggaagcgattttcggtttgtaacacatgtcttaatgaatgcacattttaggaatatttcaaattgccgcaatgcgttggcattttgggcgggcgtacgcggcacgccgtttatttctatggcactgcggggaaaaa

SEQ ID NO: 83140 - DNA, 344 bp, Heterodera glycines
  Genomic contig location: Contig_ID=SeqID_18516; Location=2231..2574; Strand=-
  SCN-specific regions: Sequence locations=1-98,131-251,288-344
atgtgttacaaaccgaaaatcgcttccacttaccgcaatcgcattgaaatagcagggattgatcgcggttaggcctaaattttgtggaaaatccaatgaaatttttcaaaaaaaaaaattttttttaaatcaaaccaagtcgaagtggtacaatgagcagcaacggacgaatccattgaccggtggtgggagaatttgtttgctgttcacgttcggcagattcgtcggtttgcccattttcctaatgacggaataaaataaattaaaaaaaaataaaaatgaataaataaccgttttcagcggcaatgacaccattgtgtgaacgtcgtccgaaattaggctaa

SEQ ID NO: 83141 - DNA, 354 bp, Heterodera glycines
  Genomic contig location: Contig_ID=SeqID_18519; Location=264..617; Strand=+
  SCN-specific regions: Sequence locations=1-108,130-138,160-183,224-354
atgatgagcatagaggtaagtgcagaaattcagtggcattttgggctcggaatttggatattaaaatgaacaatttttttggtttaaatataatttaatttacccacgaaaaaagaaccaaaaaatgtctgattcaaaaattcaaattttagaacttttaggccactttcttttatgttgagcttttgttcaaaattttttctaattttatagatatttttcaccgggattagttgggatcgtgatttcatcggggatccaacgacaattcgccaattccgagggtcccgcgggattggagtcattaaatttttcgaatattttcaaattacttataaagaccctaatagataa

SEQ ID NO: 83142 - DNA, 375 bp, Heterodera glycines
  Genomic contig location: Contig_ID=SeqID_18519; Location=703..1077; Strand=-
  SCN-specific regions: Sequence locations=1-91,113-114,144-173,195-375
atgaaggagaatagaggcccgaatattaggggtgaaaaacaaatgaatatccgaaatgtatcaaaggtggcgaacttaaaaaaccaattaagggcggggggagtgttttcctaaccttaaaacattttaaattacaattttttagcaaatcattgcaagtaatatgaatgagaattttttcttttgcttttcttgtccctttctcacttccgcagcgctccaaatctcttccggtgacgtcagtgccgtaattggggtcaattggctatacggtactggaatggtactggcgctatggtacgttatggacacattaaaataatcgtccggcacattttccatcttttcgtaacaccagtagggagactgaataaa

SEQ ID NO: 83143 - DNA, 1102 bp, Heterodera glycines
  Genomic contig location: Contig_ID=SeqID_18519; Location=1098..2199; Strand=+
  SCN-specific regions: Sequence locations=1-237,259-402,425-425,450 -455,477-901,927-1032,1056-1071
  Gene Ontology: Mol. function=glycoprotein 3-alpha-L -fucosyltransferase activity; Cellular component=Golgi trans cisterna; Biological process=protein amino acid glycosylation
atgtcgcgcaaaaaacgatttgccctccaaattgtgtcccattgcggggctccctccggcagagacgtgctgacaaagcaattgcaggagctcatcgagttggacatggtcggcgagtgcagcggaaaagattgtgatcaaaagtgttatgagcagcaaatgggtgagtgaatgacaaccgaccgtttgattgggcggcacagttaatttgtgaaaaagttttttggatgcgcatcgaggatttggagataaaacattgatgggactgaaggaatcggagtcctgttaaaataggattttatctcctgatcatattcggatccgcttggaatacgagctctggtccgggtttgcgcaattacaaaattccgggccctattattaggcagcgctccgatcgctaaaacacacaaaaaatctgatcctatttacatatatatgaaaaaataaaatccaattttgtatttttggtttttatgagccatgtttataaattagtcgctttttactttaattgaaatatagtttgggcacacattttccctctttgacacatttttaccagccgcttaggaaacttctaaaaatattttctcctacagagtcccactttttctatttggccttcgaaaatacggtgtgctccgaatatgtaacggagaaattttggaacgctttgcgcagtttgacagtgccggttgtgctgtgcagggaagtggtgcgcgagtcgggcattccggacgatttgtacatcgcagcggacgattttgacaatgccacggcattggccgaccatctgaaggcattgcaaaaggacaaggaccgatatttggggtcagtatttaatgagcaaaagggtcaatgacacgtgcaaaattaattttaaatccaatagtatgactaatttaaaaattaaatataattttgcacgttttgagttttgccatggcaccgccgaccaaaaagcgttggattaagttttttatttaaacatacctaatgccattaatttccaacaaatcttttgccaaattaccttttaatttttaaggagggttgtacggaaccgggaaatttaaatttaaattttgttttttattta

SEQ ID NO: 83144 - DNA, 679 bp, Heterodera glycines
  Genomic contig location: Contig_ID=SeqID_18520; Location=1573..2251; Strand=-
  SCN-specific regions: Sequence locations=1-572,594-645,669-679
atggcaccgccaccgaccgcggcactcggcttttccgccgttacatcatcgtccatcatcggcggcgtcagtaacgggcaccaagcgacggcggtggcacaaatgcttttctcgccgccgaacattgtgccaattgcggccgatcagcagcagctgttcatcgccggcaacaatagctttgttggccatggccaccacaatccgtcgctggcggcgatgccaacgcacggtgccggcggcagccttgacttgaacaactacaagtcagtggtgtaaatggggtgcctaatttggctgttatatggtatgcatccttggtcgggttcggcattttccgtgagacaatgacagtgacgaaaagcctgtccaaatttttttttaaatgtcgaattttggttaccaaattttcctaaatttcaatctctattaaacaaagaaaatccaaatgctagtttgtcacaatattgtacaacacaatttgtacacagggcttgcttgggattctaaccaagattttccaaaaaaaaaatctcaattttttagggttcctgtgaaagcggctggcgacgtgtcgctcaatggtcttcagcttgcggcttttctcaccaaggcgacgctgcttttacaaccggttgggctggcacatttgaggacaattaaaattttaacggaaatttaa

SEQ ID NO: 83145 - DNA, 99 bp, Heterodera glycines
  Genomic contig location: Contig_ID=SeqID_3085; Location=397..495; Strand=+
  SCN-specific regions: Sequence locations=1-99
atggcacctaatcaggccaatatctgggcaacaacgtcatccggggctgcttctcttccgtattcaaatatggcgatgcacccattgatcagctcgtcg

SEQ ID NO: 83146 - DNA, 1736 bp, Heterodera glycines
  Genomic contig location: Contig_ID=SeqID_3086; Location=1424..3159; Strand=-
  SCN-specific regions: Sequence locations=1-1644,1666-1736
atgtcccaagtgggagccggagaaatggccgagtcgaacagttgccgcttcgggggcagccaatacagccgagtgactggcggtgcctttggcgttgaggaggacgaacttggcacggccaatgacaggcaattgggccgtcgtccatctcagagggaatgccgtccttcagcaattggcgctgcgttcccttcccaattcgccacgccctcgcccaaatggtcgacttttcgcttctgtttgagcctgtcatgtgcatcatttgcgtgtccaacattctcgcgatgctcggcttttacgtgccttttgttttcctcaccgatttggccacttccaaaggcatttccaacgccgaggcaactttccttttgccgttcatcggaattgccaacacttttggtactttgtgccaatgccgtgctattcgccgtcggttcgtccgtttctgattggtccctccctccccctttaggccgcgttttcttcggttggatggccgaccgtcgctgggtgagtgccctgtccatcaccaactgttctttggtgctgtgcggcttgctcaccgccctttgtcccctgctgccctcctttttgtccttgtctctctacgcttctctgttcggtttcatcgtcggtcgatgccattcttttttctattgtccaattgcctctcattttgccacttttagctgcttatgtttgccttacttccatcgttttggctgatcttttgggtgtcgaacgtcttacaaattcttttggcctcgtggtcgtttcgcgcggtttcgcctctttgctcggcactccgatcgccggcattgtctacgacttgagtgattcgtacggcgcttccttcatttacgcgggccttctcatttttctgtccggcttggtcagctgtataattcccatggtgcacagacaccaacgaagtcagctgaagaacgaaggttcgcaaattggggatcattttggtcgatttgtcagtcatttcgaaaagggaaaatcggcggattggcaattcaaatttcaccttatccgggataatccttattctgtcaggtgattatgaggacaaagtgaagaggcccaccacgactgtcgagcagcaacaggacgcacaaagtggcaaattatccgtcctaacggagcgcagcgaggaaaatctgacggaataccaacggacaatccaatcgatcaatcagcagcgtacgaatggactgggcaattaattagtcactaattaaccactttttggttttatttatttttcaggtgcactaatgtacgaattggacgagtacagaaagaggagtcagcgattggatgaaggatacgaagaggaaacggaggaacaacagacggagggcggaggagaggcacactgccgcggggcagagacggaaacgcacgcggcacaaacggaagcgaacaaagcggggcaagaggacgcggaggcggagaagaaaaacacggaagcggaaaacaaaaacacggaagcggaaaagaaaaacacggaagcggaaaataacgacgcggaagcgaagaaaaaggacgcggaggcggagaagaaagacgcggaagcggagaaaacaacagaagcgaggaatatgcaaatgagaaacgcggaggcgacagacaacgacccacagcgggagcagcagaagggcgaaatggccgaggctaacatttcgctggcgggcgccataaacggaggaaatgccatcccattgcaa

SEQ ID NO: 83147 - DNA, 871 bp, Heterodera glycines
  Genomic contig location: Contig_ID=SeqID_3088; Location=722..1592; Strand=+
  SCN-specific regions: Sequence locations=1-536,558-635,658-682,707 -753,775-871
atgccaacaccaaaaatgggtggccaaaccaaacaaaagaaggtgaggggatggaagtgaagccgttcagaaacagaaccgtactgaggagaaaagagcaaattcaaataggagaattaatataaaaggaaattgtgaaattaattagtcattgtcatttgttaattatgctttaattgccttttgctgactaatgaatcgatgcgattggactgactaatgacagacattcgaaaggcaaaaccgaacaaaaaagcagaataaatacaacagtgggcagaactgttggctcactcactattcattaacgttttatttgccaaatcgatcggtggctttggatttgcaaaacgcagacggagcaaatggggggggggggatgacagccgaacccgcgggggcagcagcttcgtcccacgtttattattagtaactgcgcttttcgcttctccgcgggattaaaccaattttgccttaagcaaaatttcattggcaattcgttggttttgtgcctttgcgaacgatgaaaaagccaattttaaattatgtgcagatgaatgatgatgattgacgtgaaaaagaaggctcatttatcagatcgttgagatggaaaaggcttttaataatgggaggaaatgaaaaaatgggaaaagtgggaaaattgcgaaaagcgaaacgcacgacaataaataaacaattaataattgcaggaatttcccatcctatccatcgaatttggaaatgctataaaagaaaagccaatgaaataaatggggaggcaatgaaaggaaaagaacactttgggaacgaacgaatggcctttgaactcggagttaaacggagcataaatttggaaacaaacatttcaaaa

SEQ ID NO: 83148 - DNA, 1033 bp, Heterodera glycines
  Genomic contig location: Contig_ID=SeqID_3089; Location=546..1578; Strand=-
  SCN-specific regions: Sequence locations=71-1033
  Gene Ontology: Mol. function=cystine/glutamate antiporter activity; Cellular component=integral to membrane; Biological process=protein complex assembly
cctccccctccccctccccccctctctctctctctccccctcttctttctcttcccctctctctccctcttttatcttcccatgtccattcattctttcgtttgccttacaggaattcgccaacaaaatgtacggtccgttcgcctttacaatgcccctcttcgtcgcgtgttccacgctcggctcagccaacggagtgtaaggctaacagaagcattcccctcccacatttttggcttttcttcccatttagcattttcacctcatccaggtcggttttgtctttctgactttggaatggccatgccattctcatcgttgtcgtcgtctccagacttttttacgttggcgcccgggaggagcaaatgcccgtccttctcacaatgatcaaccgacgaacgcgtacccccgtgcccgccgtcgtttttctggtgcttttcttcgttgccattcagctcccttccaccgttccccttgtgtttagggccttttgtcgttggtttatctcgcctttggtgacaatgcgctcactctgatcaattacattgcgattagttattggcttgccattggcttggccattgcctcgttgttttatttccgtatgaaaatgccaaacgcaccgaggccaatcaaagtgagttcaagtgattagaggctaattaatgctccaatgggattttcatttgattttctgtaaggtcaatttgattttccccgctatctttctgctcggctgtgtcgctttggtggttattccaatcgttggcaagccaaaagacacgggtcagtccctttttacacctaaagccagaaacaatgctaatttatgtaagcaattggaattgcgattatgctcacttcggtgcccgtttacctcgttttcatttgttggaaggaaaggccttcctttttcaacaaagcgtccggtcctttgtttgaacattttttgtttaataattctcaaatttcagcgtccattaccatcttttgccagaagcttttcttagtttcgaatgaagcagaaaaatag

SEQ ID NO: 83149 - DNA, 892 bp, Heterodera glycines
  Genomic contig location: Contig_ID=SeqID_3090; Location=363..1254; Strand=+
  SCN-specific regions: Sequence locations=1-3,25-366,388-687,709-892
atgagggcaaaaattttagcaagtgtaaaagtgtcttggatgaaagtggccaatttgacggaaagacaattgagagcagtcagaaaaactaaacggaagcatttgcaaatgaaagcggcatttgaaagtgccaacttatcagggcagccgcaattatttgagcagaaccatcaggggttttgcaatttgagaagaacgggtgcaaaatgtatttggcaaaagttaaagcgacaattgtgcaagtgcacggtctaaagatgtcataaattcgcgtttaaattcaaatggacaaaattttagcagccgtccacctgacgacgaatgcttcgacccaaagtcgtacgaatgccaaaaaaggaccaaacgcctccattatgtaggcatagtcgccacccgactttttgatgagagtgccaagttcggcatagcaataggaaccgagcccaacgaagaggccgcaaaagagccaaatgagcagggaaaggccgatacttccagcatctaaagcgttgatttccaatcgcaagttaaacaacggaatgtgcacctttttggacacccgttggtgacaaaaagatgccggagccaataatacaccttaaatgacacatgttaattacatgtttaattattggacaaatgacttattcttcccgaattctcaaattcctcttcagttgatttggaaaattcttttttgagtttgtttgagtcagcttttcccccactgtatgcatggtgctagggcacttcgcgaatcggcaaataagagggattttcgaatttgacaaaataattaacaaaaagagaccggccctcatcagtacggtgtctctttgtgtacaaagagccactcgtaaaaaagcaaagaaaagcattttattatgccaaa

SEQ ID NO: 83150 - DNA, 417 bp, Heterodera glycines
  Genomic contig location: Contig_ID=SeqID_18523; Location=135..551; Strand=+
  SCN-specific regions: Sequence locations=1-48,72-133,155-215,269-417
atgatatgcgtccatatttgtgaatttatatgtgatttgaaggtaattaaaaatttgtcaaaaaattttcaatttaaagcaatttccgcgcttacttttctttgactcgtggccccgtacaattccaattgcataccatttgcccccactcttgcgcagcagtggtgaaccgctgtcgccctcaaacaaaaataaatttaattctacttttttggttataattaatattttgattttttttaatatgtattttagaatattttataaacacataaaaagcatacatgagacgtcttgtggatgccactcagctggcaaaaaaatccttgtggacacacagaagccaaatgcaccaaatcctgtcgtaacatcttcgggtcgatctgctccgcgtctgccgaaatattatctaagaaa

SEQ ID NO: 83151 - DNA, 1528 bp, Heterodera glycines
  Genomic contig location: Contig_ID=SeqID_18523; Location=60..1587; Strand=-
  SCN-specific regions: Sequence locations=1-329,354-366,421-639,661 -800,843-1025,1048-1185,1239-1299,1321-1382,1406-1449,1471-1528
atggccctttatggcgtacgtgacgatcgcctgtaccatcaacggacacaaacggacgatacagtactcgtggaggaccggtcgtacaaaagagatgggtcgtcacagcagctcatcgtgccgacgtcaatgtcacattgtttgtcgagaacaaatgcgacgaaacgaaacaacttcttatggaccttcatttgcgttacaaaccggacgaaaggtatggcagtttcactaaaatttaaaacgaattaaattattctgataaagcgaaaaacacaccccctaaggatcgagtttttggaaattaattaaatacacccttaaaaatcgaaaatttgtgatttttgtaagaaatttgttgatataaaaaatgtaattttgtttagcataaaagtaaacttttttaaaaatcgaaatatacaaattttgaaattctctaaaaaaacttttttggcatttttaatggttaaagccttttttagcagttttaaggcatattttactgcgtaattgtgtatttttcgggtttttatggcattttgaggggttttattttatattttatgcgcatatttggcattttttagtgcatataacttataacccaattatcaccttttccttcattcagaaatgacgtcatgcagaattttgttttgccagccaaggcgtccgagatgcgcgtgaccgtggggaacaaagacagaacatttgggactgtgcacgaggtggcacgcatcaaacggcacgaacattacaggctgacgtcatcggcaaatgacatagcattattagaggtacagttttaaattttaaacattaatgaatttaaatgaattttatttgtttagctaaaaaatttgttggagtttggtccacagatcaacagaatttgtcttccaaagaaggaacaacggacagggacgacggcaacaataatcggctggggaaagaccaaattaagtaaatttggattatttttcaaaatttttgtttaaaaagaatgctttaaaaagtttttcctgtctaaaatttttattttcttagataatatttcggcagacgcggagcagatcgacccgaagatgttacgacaggatttggtgcatttggcttctgtgtgtccacaaggatttttttgccagctgagtggcatccacaagacgtctcatgtatgctttttatgtgtttataaaatattctaaaatacatattaaaaaaaatcaaaatattaattataaccaaaaaagtagaattaaatttatttttgtttgagggcgacagcggttcaccactgctgcgcaagagtgggggcaaatggtatgcaattggaattgtacggggccacgagtcaaagaaaagtaagcgcggaaattgctttaaattgaaaattttttgacaaatttttaattaccttcaaatcacatataaattcacaaatatggacgcatatcataactgaaatattttagatttgttcactaaaatcagcccatattgtgattggctgaaagaaaaaagccgtggagag

SEQ ID NO: 83152 - DNA, 1158 bp, Heterodera glycines
  Genomic contig location: Contig_ID=SeqID_18525; Location=677..1834; Strand=-
  SCN-specific regions: Sequence locations=1-108,130-130,155-202,224 -571,616-636,659-846,868-956,989-1106
atgaaaagatggatcaaacgttcactcgccaggttcagtgtgctcagtgtggtggcattgtttggcacaaatttgggcgtcaatttggcagaacgtccggcaacggaacacccgggtaagagcaagggccataaattaattaaattttaattaagtaatgaccaaatgtgaggaatttgttaaaccattgtccaataattgctagggaccatttccaaggaaagataaactatagaaaaaatgtaaaatatggacataaatttttctaaattatgaaaatttccgaaaaacgaccaaaaatcgaaaattcattttttgtttatttttgacataatttatcattgaggaattttaaaattaaaacagattctcgagaaaaccctaaaatgttttttttaaattttcaatgtcaaaaaaccaacttagctgatgagagtgttcaaataatgtttttcgaaaaattaaatatgcaaaataaaaatacatcctaaaattattcaaaccatctaaaaataatatttcacgttaattatttaattaattgcctctttttaaaatagttttttgtgcgttaattaattatttaattaattgtctttttttaaaataatttttcgtgcgttaattaattaattgtctctttttctgatcctttccctcaatttgcacttttgtcagaatgcatttccttcggctgcctcacttccgatgcttctcgcctcatttacgccgtcaatcgttttgcggttgcgctgcccaactttttggccggcatttcctttttggctgcgcttttcgcatttcggcgccgattaaatggaattaatgggccaatcacaattgttcaaaacaccaacaacacgagaaacagcactcagcagaatggaacggtgacaaatttgaacacgaaaatggcaacggttaacaccgactcacgaaaaatggtaaacggaaggaaattttaattgaaaaaatattttttaattttctcatttttttttgaaaaaatcgcaatgttcagagtgaccgcctcattttctattgcgttctgtttgaattgctgcttgatttgttgccaaatttcatcaaccttattttgaccgctgtaaattattcatcaatttaataattggctaattaattaattaggcaattaaa

SEQ ID NO: 83153 - DNA, 2379 bp, Heterodera glycines
  Genomic contig location: Contig_ID=SeqID_18526; Location=1272..3650; Strand=+
  SCN-specific regions: Sequence locations=1-209,254-811,833-986,1008 -1087,1110-1490,1512-1649,1671-1734,1768-1905,1946-2209,2244-2379
atgagtcatgcattccgtgtgccaccgccccatcgcccacagtgagaatttctccccattcattagggaatcattttgaagattttgtttatctttttcagagcaaagaggcatatcttctgtactacaaactgaccaacaactcacaggccaagtgatataatattatcattattatttatacctgtgtactgttaccaaacattttcaaataaatattttttattattttaaaattaaaaagataaaatatcggactaaattggaaatactgactgtaaaattgcagtaacaaaagcgagggcgaaagaaacgacgctgacgacgacgacgacgatcaaactgagatagaacagtttaacagagaactcaatgaaatttgtcaaatgttgcgtgaacattaccgtaatgaagttccgaaaattggccgactttgcgcccaaatgagcgaaggaactcgccaagcgttggccatccaacaacaaatcccaaatcccgacgaagtgcaacaacaacacggggagaacaatgccagggacaacagaagcaatcgttcttccgacgaaaccatttcttcgaacaacagcagcaactgtgacaatgccaatgtcaagtgtgaatcggtgagcaacaccaaagcattgtgatcactaatttttcttagctcggattatcaatgccataagttaaaaagctcaaaacaaaatactgggcatgaaaaattaaaaattggagaattgccccattttttagggtttgcatcagaacgcgtggtggcaacaacaatttcatgaaattgagcaagcacttgataatgatgctgatgatgaaggcatttcgtctgtcgagtgcagcgaaaacggaaccaatgaaaatgataacaaaagtgacgacgatatcgaaagtgatgccgaaagtgacgacaaaccctatgaatgtgattgcgaaagtgctgaccacccaatggagtgtccgttgctggccgctcgtcgtgcgcttcgtcgtctcaaattgccgaccattcttgacatttgtgccgcaaccgaagcagaagtgcgacaatacggcacaaaattaagtgacaccattaaacaaatcgccaaattacgcgttcaaaacggcggagcactgacaagcgaatgggaactgcggagcagacagaaacaagcacaaaatctgctgcaacaaattggtaatttaatgccacaattggtcgttgaagagatcgaagtggcgaaaattctcaaattcgtcgaacaaagcgccgatcgcttttccattggatttcgggacagaaagcagcaaaagcaattcaaaaaagcaattcgacagccaaaaaaggtgtgcagcaatttgaaattagcgagaagtttcttccttttatctctagtcgaatatttttggtattttgttatttaaaaagttacaaaaaaaaaattgctgagaaatttccaatgagtgaatggttggtttgcttaagctgcaaatttatatcccttcgttcaaacaaataattattcggctaccaccaccaacaggctttcgaggttctgttaaagcacaatttggacagtttggtggagccattttatgaggagtgttacgaaaaactgtttcgtattagcgatgaaacacgggaacaatcagaattgttcgtgaagcttttggccaaaattgcttttgtgcacgtcgtgggattaaggatacaactggaaatggtcagtagagaaggcatggtttaacaaaataataataataatgcattttggcagtgattttcggatattttttatgggatgttagactagatcagttgacagaaattatacattacatcatagaaactaaaaatatttgaaaactcattaaacaactttcttattacttataatttgtgcacttttcaattatttataaaatttaaagatatatttaatgaatttaagtcataaaaatttgacaaaacatgctttcgtaggttttctggtccctttttcaacttgggtccgttaattattcttttatgccaaaatccaacagataattaattcctcctgtattgttcaggtggaaactgaatggacgcatattgtgcacgcgatgttgcagatgcgtaaattaataaatgcagctcagtatttggtgaaagaggcacaaccgaaacccttggcgtgcgaccgaaaattttcggatgtaataaaaagattgcaatatttataaatattattatttatttatttttacttcaatttattcaaaatttagcaaaagcaaccgagcttgtgttcattggacagattgtatgcgaaactctatggaaaaccgtctcaaataaaacgtgtaagagattttagggatttggtcatttcgctttaatta

SEQ ID NO: 83154 - DNA, 1438 bp, Heterodera glycines
  Genomic contig location: Contig_ID=SeqID_18528; Location=281..1718; Strand=-
  SCN-specific regions: Sequence locations=1-435,457-512,556-1438
atgaccatacggttgagcgatttacacagtttgacggaagaggcgaagagagaaacgccgagggaaatggaaaatgagggacgaatcgcaacggcgacaatgcgacggcgcgaactcagcggacaatccgcggcacttaaaggtaaagtgcaaataagaatattaagaaagtttcaaggatttaatgcataattgcatcatttgttcctttagccgcttttctcgaaaaacggcctgaaagcagatggaggacaagagcatcgcccgggaatgaagaggacatccgagaaatgttattgacaaagcgaaggcattcgactgaaaatcggaccgatcatcaccagcaaaagggtgccgcgacatcgacggcatcattccttttggaagaaatgaacaacaacgaagaaggaacggaggacagaaataggaggggacaaagaaaggagcaaatggacagaaatgggaagggaacggagggattaacaggcggagacagcgcaaaacaattgtttgaagaagcagaaaatggggaggaagaagaagaggaggaggaaggcaccgacggattgatgagtggggagagggaactgtacgagaatgtcatctcggagtttgacggacttcggcagactgtcaacaattacattacggtttggtggaggtcaaatgaagttattttttgttatttcagaagatgaagcagttcgcctccgagttggagcagcagtcggccccgtcgtcttcttcgtcttccgctgtccctttgctccctcactcgagccaacaacagtccccgccggtggtggcacccgaaagcaccaaagaaaagaggcgcaatttcttttacggcaaacaaaagcaaattgcgcaacgtcccgccacaacgactggcgctttctccgcctcacatttcagctattccacttcagtcactgctgcttcttctgccaactcgaaaactccaacaaattgttcaactatttctgacccgaagactcaaagaccacaaagttcgcctgccggcacaatggccgaggggtggcagaacaggctggagaaccttgaggttccgtcaaaaaaaaccgaaataaaaaacagtcatgttaagtttatcgatgacgacattatttccggcgaggagtgtccattgattaggccgaattcgtctgggaaagtgccgacggcaaatgttccgtccaattttttgtcgaacacgacaatgcctcacaaactgcagacaacttcaaccagaaaagactcaaattgttccgtcacttctctgcttcccaatgctgaaaaagaattcgacaaatctttcgctggcgttgctttgtcgtgcggtggtggcaaaaaagcacaccaattgaatgacattaaggcagttgtggaaaaggcaagtgccatgccattgttgccttcattagttgtaatgctttag

SEQ ID NO: 83155 - DNA, 390 bp, Heterodera glycines
  Genomic contig location: Contig_ID=SeqID_18529; Location=446..835; Strand=-
  SCN-specific regions: Sequence locations=1-177,215-390
atgatctttggtcttcgaaaaatgtctgccaaaattcgttgcgacattcaaatgaatggaccatctcgtattgacctgatcaagcagatcaatgtgcttgtggcctcatccatcagcattttgttgtacggacatgcgctggaagatgtggtttttagaacttgttgctccaagactattaattaattgattaatcaattaatattaattaattttttaggaggaaatggacggatttttggatatcaaagaaaaaatgcgatttctctttgcgatgttcccatggcatgatagaagatagtttttggtgaaaaaatttcgtttttttttctaggaaaacaacccaaattgttgcttcatcacctctttggtaagcgataaaaaaataaa

SEQ ID NO: 83156 - DNA, 91 bp, Heterodera glycines; identical to SEQ ID NO: 53030
  Genomic contig location: Contig_ID=SeqID_18529; Location=1916..2006; Strand=-
  SCN-specific regions: Sequence locations=1-91

SEQ ID NO: 83157 - DNA, 683 bp, Heterodera glycines
  Genomic contig location: Contig_ID=SeqID_18529; Location=868..1550; Strand=-
  SCN-specific regions: Sequence locations=1-510,547-683
atgttcattggcttacttctgctcaatgtgttcgccattctgttctggaattttgtgtggaaacgccgaaaattgccgcccgggccaagcccactcccattaatgggcaacttacaccaattagccaatttcccggaccatggcggtgccggtgcgtacacccattttgccaaggagtatggcccagtatacacgttgtggatgggcgaagtaaccatcttaaatccttaattagggtgtcttttcttaaattattctctaattaacccctttaatctataatttccaatttaaatctttcgataaagtaattaaaagggttattagagtaattgattagttaatctcaaattaaccctttaaataattgtaaactaatttttgttaggatccttatgtgatcgtgaccgactatgagctgattcgttcaacatttctactcaattacaatgaacaaacgtcgggccgacacttttttggcatctccgaaattgtttcgggtttatgccgataattaattaattaatgaatttaattgtttttttaggaactcatggacttcatggtgtttcgagaactcatggtgagggttggctgtttttgagaaggtttacgctcgaaacattgcgagacctgggcatgggcagaagccgaatgagccaagaagtaaaaatttaaataaa

SEQ ID NO: 83158 - DNA, 297 bp, Heterodera glycines
  Genomic contig location: Contig_ID=SeqID_18532; Location=2..298; Strand=-
  SCN-specific regions: Sequence locations=1-72,199-268,296-297
atgatcagcgaacagcgaagaatgaagcgaaacattccgttgagtcaaagagaacagcaacaaaatgaaagtgagggagaagaggaggaggaagaagaggaggaaagaggaggaggaagaggaggaaggggagggcaaaagcggaagataaagcaccgggaagaggaggaagaggagacggaggaggacgaggaggagcacaacttcggcacgggcaggggacgccgaatgggcgcgaaacgacagcgaatggcacgacagaacaggcaaagggaagaaagggagggggagggatga

SEQ ID NO: 83159 - DNA, 1112 bp, Heterodera glycines
  Genomic contig location: Contig_ID=SeqID_18533; Location=541..1652; Strand=+
  SCN-specific regions: Sequence locations=1-234,257-380,402-569,597 -998,1020-1112
atgcgagctcatgccaaaagtcaggtgggtcaaaaagacacttttccattggatttttcggaatttgtccttccctccctttgaaggtgttcaaatatgccgactccaaccagctgttcttcacctgtcagatcagaatgtgccaaagacagatggacatgtgccgcggagtgacggtgaatttgcgggcggacgaaccaatcgaaattcattttccgcaaacattcagccgccaaaatgcgaaggaggggaaaagcgaaagggcgccaatgagaagaaaatggcacacagtgaggacgaaaagcgggcgcaagagatcacgggggaggagagagtggcggcgaatggcacaaaagcgacgagggaaacggcggcggtaaaagtgggggaggaggggagagaatctcgggatttgagggcgagttaattggccgaacttcgagaatcatttgcacaatttattaaatcggatgaccaacatttttcattttaaagtccaatggaacgacgacggcactttcaaccgaagcacagcgtaagaaaaagcagcagagaccggccgaagtggcggaggaggaggacggagaagaggagggacaatgggtgctgaagagaatgccgttggcggaggggcgacacggaaggaaaagccgcgcattggtggagggtgattagtcactgattgaccatcactaattactgcaaatgccaatttagccgaaatgccattggagagaggggacaagcgaccgttggaagtggacgtggcatccccgcagatgttggtgctggaccaggaggaccgtgcccggatgactaccgcgcggtggcattcctcgtcgacaacagccgcgccttcgccgccacattctgagggacaaaatgccggaggggttatttccgcattggatgcctttcggggagtgccatcgcttcatccgccgctttgtctctcccgcgacattttcgtctttttcgtccccttcgccgttgcactgctcgtcggcctcggctctgtgctgactttatgcattttgcacgctttttcacgagttgcgcggccaaaagtgccaatgcgttggacaccgatgcttttttaagcattttggaaa

SEQ ID NO: 83160 - DNA, 1122 bp, Heterodera glycines
  Genomic contig location: Contig_ID=SeqID_3092; Location=886..2007; Strand=+
  SCN-specific regions: Sequence locations=1-85,107-412,438-588,632 -923,953-1122
  Gene Ontology: Mol. function=pre-mRNA splicing factor activity; Cellular component=nucleus; Biological process=mRNA splice site selection
atgtcatctcgacgtggcggtggtaataatgttgagggaaaggtttacgttggcggtctgccagaggacgcaacttccgaagaggtttcaaataattttttagttaaattagaatttacacagttcatatgtcacaatttcagctcgacgacgtcttccacaagttcggcagaattcgtaaaatttgggtcgctcgtcgtcctccaggttttgcctttgtcgaatttgaggacacgcgcgacgcggaagacgcagtgcgatcattggacggaacgtaaaatagttgtttttttctgggaatattcaaatggtttaagacgaatttgcggtgttaaagctcgcgttgagttatcaacgggccgttctcgccgcgatcgcgatgaccggggcggtggtggtggcggataccgaagcggcggcggtggtggcggcggcggttaccgtggcggtggagggaaccgcgactattcaaggtttttgttcgaaaagtggccgaatttggaggatcataagaacgcgaaattgcagagtagcaaagtcattcgcctttttcagcaaatcctccactcaatcgtttcttcaaagcgtcctccaccctttttcctccactgttcctcctcttcctcctctcgtctttttcttcccatccttctgaccaatgtgttactataatgtgttgctttgtccaaaatggcaaggcattagaagtgaatgattggacctacgcgttttgcccctaagttcggcttaatacgattgtttcttcgatacaaaacgccaatttgggcccattgttcgccttctcaatataacttcactccgttacttccctccctccaaactcttcactctctccgcttcactcctccataatcgttccactctccaatcagatctcgttcgcgttctcgttcgccgtaccagcgtcgcggaggaggaggaggccgttctcgctcgcgttcccgttgaaagatgggaggtgaaacttaccgaatttaccaaaaaagtgcgaacccaattttagggatctacaatttccgaagaagttgtgacgaactgatgcgatttcaaccattggcgattttaaatttgtttcacgtttttggtataattttgggttaa

SEQ ID NO: 83161 - DNA, 200 bp, Heterodera glycines
  Genomic contig location: Contig_ID=SeqID_3093; Location=250..449; Strand=-
  SCN-specific regions: Sequence locations=1-200
atggtgccatttgaattggtgaacgaatggacaaaggaaaagctgacattggccaaagcaaatgaattggacaaccgatggataatgaaacgatgcaaaattattggggagaccgcggcggtttattgggaagacggaaattgggacaacaattgtaacaatgtgttcatttggcttgttgctggcactaattgcattgg

SEQ ID NO: 83162 - DNA, 941 bp, Heterodera glycines
  Genomic contig location: Contig_ID=SeqID_3094; Location=239..1179; Strand=+
  SCN-specific regions: Sequence locations=1-45,67-158,182-888,939-941
atgccaacgttttggtcaaagacagggaatgagaagggaattaattgcacaatatgtatgtatgtgagtttggaaatgtcagtattttacccaatcgatcggttgatcgatcaatggcaaacgccagttgatcaatcaataatttcgctacagcttctggaaaatttcctttattttttaaatcgactcaaaaaccgtgaatattctaagaagtataaaaatttacaaaatatattgctcaaaaagttaattatatttatttatcgaaaagggttggttggtctctagaaactagagaccggcgcgggattttgcgggatcccagtccgcaatcccgcattttttgaaaaatttccgatttcttgcatcgcaaaaaagtggttttgaaaagaaaaaaaagtcaaatttatgaaccgttaataatttgatttccgatcaactttttaccgtcggatccaatcgaaaaatcttagtcgacccatcagccccttttaatgcatcccgccagcccctaaaaatttattttcagcattttttgatttttggaaattttttgaatttaattgaaattttttcgattttccaaaatcccgcacgggatcccgcaaattttaaatgcgggatttccgggattaatcccgcgggattccgtccctcaaaaaattttgagttccaatcacgcagcgggatccgcaaatttgaaatttccggtctctactagaaactgcgtcaattgataaaatttgatatttaaccgaaattatgtgatgaaaaaaattttggaattaaaaaaaaattttgaaaaaacttcggcttcgaaaacttcgggttttgtgggcttcgagcttcggacttcggcttcgagtgctaagccgagcttcgcccagcataatataaaattacattaaattattttgaaaagcattaaaaaaaattttcaa

SEQ ID NO: 83163 - DNA, 1922 bp, Heterodera glycines
  misc_feature (107)..(107): n is a, c, g, or t
  Genomic contig location: Contig_ID=SeqID_18534; Location=13..1934; Strand=+
  SCN-specific regions: Sequence locations=1-27,49-389,412-474,497 -541,566-1198,1228-1249,1274-1456,1480-1734,1760-1922
atgcaacttctgctggccaagcgttgtccaaatgggtgcacacgccgacacccaaatggccaccgaaagcgattgttttgcgaaaatagcataagaacaaacttccnaatggatcaccagtttcaaagaggtgttgttgttgttgttgtgctcagattctcatcatatttgggtgtctcgggaccgatttttcatacaaaggtttttctccggcggcaactaactttttttgcggcgctttttccaacaaaaaaaacggtacttgtaggttttgtcacccccttgaaatttttctaggctgaattaatgtgctgatcacgaaaatggttttcgggttctgctcaataatatgccaagaaattattttaaaaaaaacaaattttgatcaaaaaaggcagatttttggcattttgaacccattgacgaccaccatttttacgttttcacatcccttttttgtggcacgcttttttctaaaaaaaaatttaaaaaaaatcggtatactaatgggaccggcggtgccgttaggcgccgtcgggaaattttttaaaaatagtttttaatgcgatttgtcaaccgatttcgtctaaaaatggctaaatttccgattttgagctatttttaaagggagtagatcgttcccccccccccccccccgaaaaattttgacgtgggggggaggggaaatgaagtgcacccattttaaaataaatacctacatatttagtttgcttttcaattttttttattttcatttgtttagaaatttatttgtgcccgcacttcttctgtcagttacaaaattcgttttggagttttctcgcctccatcatcaattgaggagccatttgaattggtgaacgaatggaccaaagaaaagttgacactaataaaggagaacgcttattattggctgttgaaacggtgcccaattagtgaaaaggcggcgattaaatggggaaacgacggaaattcggacaacaacaacaccaaatggaactttatccattttaatttagtttgctgcaaaaatagcattgggtgagcaaatccgtcctaaattgtgtataaaatttaaaaactgcgcatttaaaattattaccaaataggattttagttttcatttttactaaacatacgattttgtttttcgtacttctcttttttttcaccccccccccccctccccctgaaattctttttaaaataatttttagaattttttatgcgcggaacacgaatctaatcattttttgatgtttcaaaaaattgtgactaatttttgtttttagtcaattttagggcaatagtgaaaattttaaaaatttgaattttcaactttttattctaattcgggttctgaattaatataaatggatgtcagattcgtggtcagcgacctcgaaaaacccccaaggaaggcttttttcgggatcagcgcataaaatttccatagaaaaattattttttttaaaatttcaggggggtgacaaaaggataagtacctattttccaattccataaaatttttttacgaagagggacttgttcgtacttggatatgttttcgcgaaaataattcaattgttttgaattttttaggcctttgtctccaccataatcaccaacaaaaacgggtcaaagcagtgaaaagggcgtctgattatgtgggaatgactttttggaacttgacaaatggtcgatcatttcgaattattgcatgaaaattgttgctttgatatatatattttttgtctttggatgttcatttttaatgagataaaagtttatttccgagtttgggttagggattggtcaaaatttgtcagattcgtaatcaatcactaatcagagcgactcgaaatctctatgaactttttaccgttttgtaaataggtacctaaaatggataacaaaaaata

SEQ ID NO: 83164 - DNA, 556 bp, Heterodera glycines
  Genomic contig location: Contig_ID=SeqID_18534; Location=2152..2707; Strand=+
  SCN-specific regions: Sequence locations=1-159,181-331,353-556
cccccattttccattttcttcctattgagtggtgggaacacccaaacacacattcctcaccttttcttcatcatttgctcgtcgtttttgcattcacttttcacaaaaccttattcgcccaattcattatatgaatgtacgttgccttgatttttgcaattttttgctcaaaaatctgttacaattacaacaaaatcagcgcaaaaagcattccagcgttatttttcaaccaaatttttctaaaatttctgcataaactcagaaaggacatacctattagctattagccaatgataagcctagggctaaattaaatccgaaaaattcgcattttttaacaaaaatcttaaaaattcaattataaccttgacagattggaaaatgacaatttctgtcgagatttttgacgccaagtcgccctcacgaccgggtttcaccatcgctgaggtgctttttggctattaaaatttcctatttttttttgtaaaaaattttaaaggttgagcctgattataagaagtgcgtcaattaaaacgcaaaattcgcaaaaaagttg

SEQ ID NO: 83165 - DNA, 987 bp, Heterodera glycines
  Genomic contig location: Contig_ID=SeqID_18535; Location=954..1940; Strand=-
  SCN-specific regions: Sequence locations=1-92,114-124,150-177,215 -246,268-498,528-987
atgatcgttatcaacgtactttatgcatttgttcttgtatcatttattagtgaccaacacagaattgcagtgactggcgattcaaaccatggtaaaaatttggctttttaaaatttagatcaccaaatataattataaattatttatttccattgaaactttattatttaccaacacaataattaattaaaataattttttttttcaaatttaacaagttttaccttaccatttttacttttatgaattaacaaaatttaattaattaatgatcatttattattcctttgtcagtgccttctccgcctcgcaatgtgaatgttgtgcaaattaacagttcgtccataaaagtcacttgggaaccgccggcggacggcgacgcgcaacttttgtacggatacaatgtgtacaaattccaaattgtcaacaatcagtttgtgaacaatttgcacagatcggtggccatcgtggacaaaaatgtgagtttttttcattttcattttttaaatttaattaaaaattattttgaatctttagaaattatacgcctatctgaacgatctcgagccgaacacagaatatgccattcgaattgcggcttttaatatgaagggggacggggaactgtccgcgttgacaaaacaaagccgaattttgacgggaggcaaacgtcggatttttaaaatcatttttaaatccaagattttcaattttagccccctctcccccgaggccccaatcgatttcgctgatcaacgaatttagacctgtcagagcaaaagtcgaatggcttccaccgaggttaaatgataagcttcattaaaaatctaataatcttattttattttcaaatttccaggcactcgtacaatttgccgttgaaaaagtacgttttgtggtggaggccaactgcgctggacaattaccaaagggccgaagtcggcccgatggagcaaagctttgtgttggacaatctctgtaattaaa

SEQ ID NO: 83166 - DNA, 460 bp, Heterodera glycines
  Genomic contig location: Contig_ID=SeqID_18536; Location=787..1246; Strand=+
  SCN-specific regions: Sequence locations=1-48,71-223,245-373,406-460
atgggctcgtccacggtgcgctctattatgttcaactcgcgcatcgtcgactccgccatccccggcctccacttgcattggctgcacgccaacgcagcgctgttgctcggcaagtacagcttgctgggccatctcccgtccgcgctgctcttcagcctcgtcattgtcagtgtgttgttctggtggcatgccgccaagttggccgtgtacttggccatgctttacggggatttggccggctgggccctccttctcattgcggctgcccttttcattggctttggtattttcttaatttgatcatcttctgattttcggaagtagcggcagtagaaaaccttttaaagcagcctcagttttataatgatcgatcattaattattttatattttaatttctaaattaggtaaactcttcaaacatttgcatttattttgtatagggatgttgtgaaagaaaa

SEQ ID NO: 83167 - DNA, 907 bp, Heterodera glycines
  Genomic contig location: Contig_ID=SeqID_18540; Location=292..1198; Strand=-
  SCN-specific regions: Sequence locations=1-25,47-79,102-376,420-907
atggtattgattgacctaagcttacttctaattctaagccaagtttttgcagcaattgctgctgaatatgaggttaaagatatttaaaaatattatttttaccactgatttccttattttttaaattttaagcaaatcacaaaactgcgtgcatttctatgcaaagatttggcaaaagcatccacttatcgtaacagagaagcatggcgaaaacttggcacttttacggaaaaagtgccaaagaatttattggactccttagcggaatggcaatttcaatacttgtctattgaacggcttttcattttttgtatcgcattagagaatggaaagcatagaaatatcggtagggattttctgaaaaaaagacggtgacttaataattaattttttatcgatgttttttaaatttatttttagatgagcgtttgttggggaaaatttcgctcaaaccaaaatttatcgatgaaaaaagtggtaaagagttaacaattgaggaagcgatgcgacaaattgtgacggcacataaaataatttttggtggcaaatccaaaaagattattcaaaaatgcatcgaatattgtaaaatcaaaaagcaattgccacaaatgcgctttgagaacaaagtgaattgttttgaggttggtaacgactatttatttgcaaaaaataagtaaaattactgtaaaaaccaatcgaaattgtttaggtgatcggttgggcatttgttctcgagaccactaatgagtgtcaaatgaaagaaagtgcattaatcgaattggaatcggttaagcaatatttgttgttactatccgatggcaaatatccacagttacaaatcacaaagccaccaaaaaagccaatgcgaaaaggaaatggtaaaagaagagctagtcacagatactaa

SEQ ID NO: 83168 - DNA, 1220 bp, Heterodera glycines
  misc_feature (1213)..(1213): n is a, c, g, or t
  Genomic contig location: Contig_ID=SeqID_18541; Location=524..1743; Strand=+
  SCN-specific regions: Sequence locations=1-73,96-207,244-363,435 -602,639-842,932-1055,1094-1220
  Gene Ontology: Mol. function=protein binding; Cellular component =nucleoplasm; Biological process=skeletal development
atgccgtggcttgaggaagagcacaaaaagcgaattattatgcacaatgaacagcaaattagtggtggtgacgattttgatgatgatgagagagtcgaagccattcacaaaagtttggaaagtgcggaagagccggacgaagaacggtgccaaaaattggtgcatttgctcggcacggcgaacattaaccaagtcaattagcaaaacaaaatatttaattaaaaaaaatatgaaatttatatagcgacagaatttgaaacaaaaatatgcggcgaaatttgggggactgaatttgaaggatgagttgatgaagcgattgcctgcgagtgaactgatcaccaaagaattgttgcaagtcaattctataaaattattaatttttgaatgaattaataattttttttagaatttcatagcattaaaaattaatttttgggaaaaagaattattcagactttaacggacacaccagcggaacacgacgccaagtacttgcagaaagccatgcaggcaaattagttgctaaaaagcattttttaattctattttatatgctttctagggacttggcactaatgaggacatgctaattgaagtaatacataattaatttaaatgtttaagaattaaaaatatatcgatttttgaagattcttgtgacccgaagcaacaaacaattattggccattaaaagtgcttataaagcaatgtttaatcgtgaattggaaaaggaagtcagagcagagacaagcggcactttcaaagcacttttgctcgatttgcttgaggcaaaccgtgacgaaagtcatacggcggacgaaggaaaagccaaaaaagtagccaaaaaaataaataaataacgaaaataatttttaatttcaaaaattcattacgaataaaactattaactttctaaaaattatttatttttcatgacgcggaggctttgtacaaagcgggagaagctcgtttgggaacggatgagaaagtgttcatcaaaatgttggccaaccaaaaccttcgccaattgcgtcttgtctttgatgaggcaatgcaattaaaattaaataattaaaaataattgattaattaacaatttgcagtatgaaattgtcgccaaacatccgattgagaaaggcatccaagcggaattcagcggcgattcattgcgcgcatttttggcactcgtcgaatttgtacgcaatggccccgntgtacag

SEQ ID NO: 83169 - DNA, 63 bp, Heterodera glycines
  Genomic contig location: Contig_ID=SeqID_18542; Location=293..355; Strand=-
  SCN-specific regions: Sequence locations=1-63
atggcgggggttgagcattgcatgtcgagtttgacggagaatgaattggagggcagcaaaaag

SEQ ID NO: 83170 - DNA, 517 bp, Heterodera glycines
  Genomic contig location: Contig_ID=SeqID_18542; Location=1554..2070; Strand=-
  SCN-specific regions: Sequence locations=1-517
gtaaacaagcagttctttttaatctcatcgacctttcatctgactgttgcagctcacgtcgctctggcattttgatgggcgatgacgacgacgttttggtgttgaacgacggcggagcgggcggcgatgtcgaagttgtcggcgaacgacggcgacgcttagctcggccaagtgtacatgaaaggggagaacgcgttgaacacgggcatggacgggaacagcacaatacacaggacagacattcgaggttttatgttgacccgaccctgcaaatatccgctatatcctgttggctgtttgttataatgtgcaccgataaattacgggattggttttgggaggtgcgaattaccccccccccccttctcagagactaaactacccaattttttagctattttattttatgcgtgttttagcatgttacaacgtctctacacttatttctacacgcccatctttcctgtgtcgcgggatgagcagcaaaggaatcagttggacttgccttcttgggtaa

SEQ ID NO: 83171 - DNA, 143 bp, Heterodera glycines
  Genomic contig location: Contig_ID=SeqID_18543; Location=109..251; Strand=-
  SCN-specific regions: Sequence locations=1-143
accggtgatgtgccatctcggtgacccagcccatcagcccgaaactgcttattacactgacatcaatgccttaatttcatattgtgccgaatttgtgtgctatgcgctgatttggctgatcatttggagaagaacagcacaaa

SEQ ID NO: 83172 - DNA, 46 bp, Heterodera glycines
  Genomic contig location: Contig_ID=SeqID_18544; Location=719..764; Strand=+
  SCN-specific regions: Sequence locations=1-46
ggagtacgaggaaggggttgcccaactcgagcaggaacatgtcaag

SEQ ID NO: 83173 - DNA, 455 bp, Heterodera glycines
  Genomic contig location: Contig_ID=SeqID_18545; Location=337..791; Strand=+
  SCN-specific regions: Sequence locations=1-4,26-455
atggaactgacagatgcagcaggcacagcgaagaggcgttctcagacgaagaaaagcggctcccctttcggattccttggcttcggcagaaccgaaggcgctgtcggtggttttgctggtgccatcggtggagggccgaccatcggaggaacgtccacttcttcgctgatgctcccttatcttttgtcggaatcggccatttcggaggacgtccattcgttgggcagcgactcggccaaccattgccatttggcggaacgttcgtcagcaggatgcggcggactgagtcaagacggagcgattggggatggagtggcactgtcgggcattgcatgccattccaccgcaggcgaaatggccgaggaagaggggggcgagaaagcagcgggcgccagcggaagacaccaccggcgagtgcttttggagcagaacaaactcattttggatgggaaaac

SEQ ID NO: 83174 - DNA, 266 bp, Heterodera glycines
  Genomic contig location: Contig_ID=SeqID_18545; Location=1281..1546; Strand=+
  SCN-specific regions: Sequence locations=1-126,151-266
cgatgggcagtaaacgccgtttcttacttcattttagtcaggctcaccagacttttagacgtgcggagttcgatgccatttgtcagattaagggaatttctgtggtgcccaactctccttcggatggggttttatttatttcttttttgggtcaatatgttcgttctgtccgcagatacacattcaatcgtttgagtttcaaaacgacgaatttgacgtctttcggctgttggaaagggctgtgttagtgaaagcggcgtacgaac

SEQ ID NO: 83175 - DNA, 1075 bp, Heterodera glycines
  Genomic contig location: Contig_ID=SeqID_18547; Location=33..1107; Strand=+
  SCN-specific regions: Sequence locations=22-355,378-1075
atgccttccccgtcctggctgggactgacccggttaggtggtcgattggcacatgagttacagcaaagacaaatcgatatttcgggttttcgtaaacgttccgctttgattttctaaaaaaatgagtgtagtgaagtaagactattctaaattacccatccccgatgcatatgtaagaggggaggagggaataccgtagtaaaatgcggtcgggtcacttcggcgtggactgctcagcgtcgccaagtttgaaatgcctaactttttcgttgttcgttaagttattaaatcttgcaaatttgaagctctttttgtgtccacaacaccgaaaaagtccgaattgaggttatgacgaaattttttaaaattttgtagattaatatagaaaccaaaagaactaatcgaatgttaccaaaaatatggttgataatgagaacagttgttagcaacgacaaaacgatcgggacggaccacgagtcgggatcccgactgaatccagatcaatcccgaacattttggaaaaacgatcgggacggaccacgagtcgggatcccgactgaatccagatcaatcccgaacattttggaaaaacgatcgggacggaccacgagtcgggatcccgactgaatcccgatcaatcccgaacattttggaaaaacgatcgggacggaccacgagtcgggatcccgactgaatccagatcaatcccgaacattttggaaaaacgatcgggacggatcccgagtcgggattccgaccgaatcccgattccgaaaaaaggatgggaaacagggttgcacgaaaactctaaaaaaaactttcgtatacgaaaacgaaacgaaaaaattttggcggacgaaaacgaaacccgaaaaaataaccgttttcgtacgaaacgaacgaaaaaaccgaaaatttttttaacttatttcattcagaattaagaaacgtaaatctttaaaattatatcctcaaactgagtgtatgcagatcatagtaggtggataagcggatatggctctagtacaggggtgtgtgattgaaaatttttcgaaaaaataacaccaaggaaaaa

SEQ ID NO: 83176 - DNA, 995 bp, Heterodera glycines
  Genomic contig location: Contig_ID=SeqID_3095; Location=465..1459; Strand=+
  SCN-specific regions: Sequence locations=1-4,27-277,303-443,465 -725,770-842,864-995
atgttgaaaattatttttgagattattttcttcttattcattatcgtactaattgatggaattgatgaagatttatttgatgatttgttgaaaaatctaaagccatcaaattcaaaaaacatcaaaaaaccgatatttggagaaattaatacgataaaggaagaaatagttgttaaaaatgaaaatgatgaacaaggaaatgccaatcaaattgaaatggaagacataaatccaaaattattacaaaagattaaaaaggaaaaaacattggaagaacaaaataataatttaaaaataaaaatgccaaaaattgaaatggaacaattggaagaagaatcatatgaaaatgagtttgatgagcaagctgatcagaatgtttcgtctactgatcacaacgattctgttgatcaagcgtattataatattatggtaattcaacaatcctgtaaaaaattatttaaaaattcattggttctaagttttgcattaaaatttgcacaaggtagtggcaacgaggtccggtcaggtatggtcgggctcggtcgatgggtcgggggcaattggtcgaacacacaattcacacaacaaaataatgctttattgttccctctcaaacttgggtacagtgccaaagagcgaaaccggggaatgccaatgagggaccgggatgggtaatgtatcacaattggacagagaaagggactaggaaaagaaatggttaaggcatgggtaaagggaaagagaaaggaagagagagagtgtgagagcgggcaaagggataggcattgattgcccgtaaaagcgaagtgaatgtgaattgggagtgatttgggggccatttaaatatggaatagggaaagagataaaaaattggggcaaaaagtgaatattgttaatttacaattaatatgggctgatcactacaaattgggggagcaacgtactttggagggaaaatttggcgaacaaacgtgttcggtctttgaaccgactca

SEQ ID NO: 83177 - DNA, 645 bp, Heterodera glycines
  Genomic contig location: Contig_ID=SeqID_3095; Location=2091..2735; Strand=+
  SCN-specific regions: Sequence locations=1-25,47-123,146-296,333 -489,516-561,583-645
atgcaactgatcagaaaatttgatcaaatgagaaaagaaaaaatttgtggacttaaatatgacgagaagaaaagatcagtaattgaacgtgaaattgctaatgaattgggaattaatagaaagaaaatttataaatggaagaaggaattggaattaggtaagagaccaatggtctaatcgaattttgacaaattaaaaaaatcaatttgaaacaaaattggaaaattgataaaaaaaatagcgtaaaaattggggttgtgtggaaaacaatttatagatggaagataaaatcgatcaaaatttataaattgaatataaaattaagaaaatttccaaagaaaaaagaggaaaatgaagaaataaaaacggaactggtcagaaaatttgatcagaccagaaaagaaatgatcaattttaggaaaaagcatcggtcacaaataattttatcctatgacaacttcactattcagagaaaagcctagtgtactatctctttgtttcttttttctttgtaatgcctttttggctaggattaaaaaaagctctaggctaaatattttgttgaaaaccaaaacaaaagtactgatgaaattctttttttttcggtaagacaatgcacgaccaaaaaattgagagttcaattca

SEQ ID NO: 83178 - DNA, 1100 bp, Heterodera glycines
  Genomic contig location: Contig_ID=SeqID_3096; Location=158..1257; Strand=+
  SCN-specific regions: Sequence locations=1-40,62-99,139-628,650-1100
atggccggctctgaaggagtcggccaacaaaaacggcaaaatcatcatcttcagcatcatcggctaactccagtgaaaaggcacgtgtttcatttgctttttctttctggtcattaaaaatttgttcccttttttgaagttgggcgtcggcgggttcagttttttatttaaagacgaggattaacccgtatttttgtttaaatgtagaggatttaaaaatttcattgtttttttaaaggatgttgacggattttgtgcgccgttgcggcagtcagtcgatcatcgaggacaaacagatcagcaagacaattttggaggtttgccaaagaggaaaccaaaatgaccttttgaaaaattttaaatgaacaccagagcagctgatatccgaacagcgcaaattcctcctgcatatcagtgcccccccagaatttttttttgaatttttaaaagctaaatttttcaagaaaaaaactgttctcggcggtgtctcttccgttggtggggcatccattaacattttaattttgccggtgaattgtcctatttggaatttcatattgttatattgaaaatttattccgaaaattgcagtttttacaaaagaagggagcagggaaaaatctgaaaatttttttttttttttttttttgcgtcggttatgtccaggcgacgttttggaatgtatccacaaaagaaattcccaaaaatctcttggaaaattctgtgcattaattttttgaactgctttctctgccaaattatttaatttttcacttcagctttgccttccacaacctctgccggtggtggcgctgcttcgtcttccgcctccgtgttgcgttctagcatcaaagacagcagcggcggtgcggccaacaaaaaggacccgtccgactcgacgcaggcgctgtttctgctggctgaggtcagtagttagccggccggctaatcaaattaacggctacttaaatctgatacctaatactcttccagaatctggctgaacttatcgactcggtctgcaaaagtgaggacaaagaaaaactgttgcccgcactgcaagcagtttggaacaacacattgccctattcggtcgaagg

SEQ ID NO: 83179 - DNA, 214 bp, Heterodera glycines
  Genomic contig location: Contig_ID=SeqID_3097; Location=743..956; Strand=+
  SCN-specific regions: Sequence locations=1-25,48-108,130-214
atggcggcgcaaaatgttgacaatgtaaaaaataatagtaaaattaagcttagtgtcagaatgcccgattcaggcacgacccctccacagcaatccaaacctttttcctaaatttgttaaacttaaaaattgaaaatatgcgcaaaatgcaaaaaaaaaacatttgtagtctcaacctctgaagattccaacacttgaggactccgatatctga

SEQ ID NO: 83180 - DNA, 131 bp, Heterodera glycines
  Genomic contig location: Contig_ID=SeqID_3097; Location=45..175; Strand=+
  SCN-specific regions: Sequence locations=1-131
gagttgcacccgttcttccatgcgttgaccatgcaaaatggcactggacaaaagcagcgacacatttgcaatggacaaaggcagtaattctcggagatggacaaattaatgagaaacaaattgattggtga

SEQ ID NO: 83181 - DNA, 1126 bp, Heterodera glycines
  Genomic contig location: Contig_ID=SeqID_18548; Location=51..1176; Strand=+
  SCN-specific regions: Sequence locations=1-893,917-1126
atgatgaccggactgaacaacagcgacgttggcaaggagttcagggtaagaatcataacgaaagcaacatattaattttaaattccaacgccaaattacaaagaaacattttctctgtcttcaatttcttcatttcctttcgccaggggcggagcaaaagcagtcaaaatagctaaatttcaaaatccattgtgtaaacgaaggaaaaaatgctaatttatcgtttcaaatacacccctattttcccagcgtcgctggtatgagcaaaaaaaaaggtcgttcgggcgaaagtttttcaaaaatacacccctaagaatcgggcgaagaattttcaaaaatacacccctaagaattgacttttcggatcggtacccccccccccccaagcccaaatcctggatacgtccctgtcccgaaccatgcggggccgaactgaggtaaaccgccctcccgcccggtaccccagcccccaccctgggaccaccgttcctgcccaaaacccataagtgccgccgcgaaccctcccttttgttttacatttgcattttcccattgttcagacatttcttcgtgccaccacttcttctgctgctgcccgctacacaattcaatttgacgtgaacaaatcgttgccaattgtgccatttgagttggtgaacgaacggacccaagaacggctgacactgtggaaaggacgcgattatgaacacgttcgtcagtgggtgatgaagcgatgtccaattggggagacggcgatcattcagtgggaagcgcccccaaactcatcggcaaccaatttgaacaatgtcaacatttatttgtgttgtgtcagctgcactggttgagcaccagctcatatgtactttgtcaaaatttgatgattttttttttctagaaaatacactattttattctgtaaacgtgaaaagatcatgctcattttcggtagttcaaattaggttctcgacgatttgccgtccgggccgagtgtggtgatcagaaacagcagaagaaatgaattgattggttgatttatgcgattatttgatctaaatgttgagcgttgttatttaggtaggtaaatgttgatcgttgttgtagttgatttttgctcattcacaaatca

SEQ ID NO: 83182 - DNA, 1385 bp, Heterodera glycines
  Genomic contig location: Contig_ID=SeqID_18552; Location=996..2380; Strand=+
  SCN-specific regions: Sequence locations=1-243,279-399,423-457,480 -1385
atggaagaagcaaaggggctggaaattgttggcttcggactgttccacaaatgcacgcccaatcaggtggggatgaccaaatggacaaatgctgatgatcagaaaaagctgatcagttgcgccgatggcaaaatgccaatttaataccgccgtttttcagttttactgctctttgttgtccgtatcgaagcacattgaaccgttgttcgtcaacgtggaaagagtggccgaactgaaaaagtcagaaacggaaaaggaggaaaatgccaacaaagggacgggacggcacattttgttgagggtgagacgaaaatggcacatttgggcgataattatgcttattggccttcatcaaccgcactttaagctcaccgatgtgcaccaatcgttgcccaatctctcctccctcccccaatatttttcggcatttgctgaacccattggccgtccgttgctccaatgtttgttaagcattttctaatttccccgagggcattttgtcatttttaaaatttccttaggcattttggacgaatttgtgagggttcacgttggcattcacgaggttgacgagttatttttcaatttttggcattttcatgcgttttattcttcatcagatggaaacgcgacgtaatttcacggtggatctttacgacgccgactcggggtaatttggccagtttttcataaatcggctcctttcacagaatcgacgaacaccccgacacccaatggcgcgactttgctggttttgttgtcgccgaccgtttccgctactgcgaaattgagttggacaggtgggcaaatgcggtcgaatcagatctgctgatgattcgagagtcggtctcgagtttctttaattaattcgttaatcctccctaattaattcgttaatttctcccccccccctttcagtggcgcctttctgtcctcatttgacgacaattccctctcggtcaatgctcctgttgttctccattccctttcgccttcaaatagggcacttttccatgactacgatcagtccgtttcggtgatgggccgtgaagaatatttggactttttgttgaatttggcgggggtaaaaaggaaagaattgaaagtaaaagcaaaacactcccaattaacagatggaaggagtaattgcaattgacgagcagaagaaacagccgatcggatacattttggcatatggggggagagtgttgcaatgctacgcggacgaggagaaagtggccgggtgagaagcacaaatttggggggaaggagggaccaattagcgttgggtaattggggcgcggaacagaagaaattggcgtaattgggcgagggtcaaaatgagggacaaaatcattctatttacctcccctccaccacacata

SEQ ID NO: 83183 - DNA, 108 bp, Heterodera glycines
  Genomic contig location: Contig_ID=SeqID_18555; Location=1..108; Strand=-
  SCN-specific regions: Sequence locations=1-108
aaaaaaatcgattttttcaagtgtccgtttggggtactcaaacaattatggggaagaaaaatcccaacgcagaattaaaagtaccaggctataagggaaggtattccc

SEQ ID NO: 83184 - DNA, 1088 bp, Heterodera glycines
  Genomic contig location: Contig_ID=SeqID_18556; Location=19..1106; Strand=-
  SCN-specific regions: Sequence locations=1-122,149-225,332-496,517 -790,850-1088
atgacagacataattgaatttaatgttggtggacaaatttttgcaagcacttatcaaacaattagtttcgacaaagaatcacttctttacactgtaagtgtaatttttacggtaatttactgtaattaaattttttttttttttttttgcaattttcagtggtattttgagcgcaaaggttcggcacatacaatgcttgacaaaaaaggtatagcttggctttagaattaataaaaaaataaataatttaaataaaaatttgccaatcaaaaatttatttttgtccgaaaattaatttttaaaaatatttttagaaaatttttaatttttactgccaatttcaggccgttttttcatcgacagggacccgacaagtttcggcataattttgaactatttacgtcttcataatgccaaacagttgtgggaagtctgcttgcccaaggaaccggacaggtacgtttttaaatgaaaaactacttattttaataattctttaaattaaattaaattaaaaaattttggatatttaaaaatttcactttaaagataataaatatccggaaaattaaaaaattcgaatttaaaattggctttcatttaatttgtaatgttttatttcgcttcgcatttttttttgttgaaattttggtaaattttccaaattttgtaaatttatgcccatattttgaaaatttttctaggtattttatatcattaattgtccatattcatccatatttggagaacttttctttgatattattttttatggcctataaatccaatcaataaatgtaattttttttaaaaagaaaatcgaaattttatttttaattaaatttaaaaggcatttaattgcattttgctatctctttagactggctttgttgactcaggaggccgaatttttccgcctcccatccctacgggaccaagcggtggcactgttgcgcaaatgcaccgcggaagagccgtcaccagcagaaattcggggacgaatgatgagtttgaagacgaatggtgggatgaaaaatggacggagatggcgaacggatgaagatgatcatgataatgaggatgattaa

SEQ ID NO: 83185 - DNA, 1402 bp, Heterodera glycines
  Genomic contig location: Contig_ID=SeqID_18558; Location=39..1440; Strand=-
  SCN-specific regions: Sequence locations=1-260,282-900,923-1223,1245 -1402
atggaggcaataaagcccatcgaatttagccactgggccgctccaattttggtagtcaaaaagaggaatggcaaaacacgagtgtgtatcgatttttccacgggattaaacgacgcacttgagctacaccgccatccgctgccacgtccagaggacatttacaatgcaatcgcaggctctaaatatttctcacgcctcgatttgcgcgacgcttatctgcaattggaattgtctgatgagtctaaaaagctgtgtacaatcaacacacaccgcggactcttccaatgccagcgtttaccgttcggcgtaaaatcagcgcccgcaatttttcaaagtttgatggacaaaatcattacacccatcaatggcgcattcgtctatctcgatgatgtgattatcgccaacacgactctcgaccaacacgtcaaaacgattaccaaagttttcgacaaaatcaaacaattcggtctccgaattcaactggaaaagtgcagttttcttcaaaaagaaaccgttttccttggccacataatttctgaaaatggcatccgcccggacccatcaagagccgaggctattcgaaaaatgccagcgccgcacgacaagtcaactctacggtctttccttggagcgctcacatactacggcaaattcatcaaacaaatgcgcgaaataagaagcccattagatgaattgcttaaaaaggatgtaccgtggaattgggaagatgaacaacaaaaatccttcgagaaagccaaagaaattatgctttcggatttattgttaacgcatttcgaccccaaattgccaatcattgtggccgctgatgcttcaaaaggaggaattggtgcaacaatcagccatcaatttcccgacaaaagtgaacgtgtcattgaacacgcatcatgcactttcacggctgcgcaacaaaattacagccaaatcgaaaaagaggctttaggattggtttttgcggtacaaaaatttcaccgcatgctctacggcagaaaattcactctgttgaccgatcacaagcccctactggccatcttcggatcaaaaaaaggcattccaatatattcagccagccgacttcagcgctgggcgttaattttgtcaaattacgaatttgatattaaatacgtcaacacaaaggcattcggaaatgccgacgtactttcgaggctcatcgcaaattatccgaggccatcggaagacattctcatcgcaaacatctgcaatgacactgattgctgtgttaattttgtttttgaggccaaaattgagcaacttccgatcaccgcaaaaataatagcggaggaatcagcaaaagacgaaattctacaacaaatcagtgccttcaccaaacaaggatggccgcaaaaattggacgacattaaaa

SEQ ID NO: 83186 - DNA, 752 bp, Heterodera glycines
  Genomic contig location: Contig_ID=SeqID_18559; Location=66..817; Strand=+
  SCN-specific regions: Sequence locations=1-232,311-334,364-449,472-752
atgttccgagtgcgcgaaagaccacgtggatttgtcggaggaggcgttcaattggttggagccgggcggcggatcggtgggagtggcgaaaagtgaaaaagcaaaaacaaaattggcattaattttcatcttaatcattttagatgctacaataacctatgtgaagtgttaaccatggggatatgattggtctatggatgctcttaagtgatattcttctattttatttcacattttttgttaaaataattattaaatattattattcaacaattcttttgtttttattataattgcttaatttaattatgaatggttggttagttttgctgactatttaattattttaatacattttaaaaagttttgttttttcattgatcaaaaaagttatgtggccaaaaatatccaaaaaaacaaggggttttttgtgttccttagtcataaccttttttaaacaacaaaattttttgaaattttgcaaactgatagagaacactttgggctatcagatgatatcaacaattaaaaattggttgattttgagcaaaattataaataatttttcatcaaaaattttcatattgatggttttttaattaacgccctttatttatgatgttttttgttatattattttttaaccaatttaatgtatatggtgaaggaaaaaaatcttgagttaataatttcgagacggagagcatataattacaaattagcatatgatataatatggattaaatttatta

SEQ ID NO: 83187 - DNA, 563 bp, Heterodera glycines
  Genomic contig location: Contig_ID=SeqID_18559; Location=1236..1798; Strand=+
  SCN-specific regions: Sequence locations=1-61,84-563
atggtcctgctttttctccaattggcactgattttgctctgttcggtgtttgcttttattgtgtaagttttaaaatttgaataaaattttcatcactttttggctttgctatgttattaaagcattttccaattcctaattctttatttaattggggccaatagcagttcgtacaataacaatttataaaacaaagcctaagatcaggcttaggcctaagtccaagcaagtagaagcttagggcgctaaggctaggctcaagcctaagcttaatccgaaggcttatgctgattctaagcctttataaaaatgcctattgtacgaacggtctttgtacgactgccatgaccccatttaattgtatcaaattggccatagaatgatgcgcaaacatcgcaagtactggtccaaccgtggcattccgtccccaaccccgcagctgatcagtggcaatttcggctcgctgtacggcgattatccgagcatgttccagctgcgggattggaccagacagtacggcaagcagtacggtatccaatacggttggcgcaacgcgttggtga

SEQ ID NO: 83188 - DNA, 864 bp, Heterodera glycines
  Genomic contig location: Contig_ID=SeqID_3098; Location=194..1057; Strand=-
  SCN-specific regions: Sequence locations=1-138,160-189,212-597,641-864
atggcttcaacaaatttttcgataaacgatttaaatgacagcgaccgttttgacattgtgtcgagtaagtttcaatgctttcggaagatactctcttgtaattatttggaaaaaaatagatgggtcccaatcccccgaaatggaaaataaaaatttccaagggaacaatctggcacattataagtttacagaattttttcttaaaaattttcgggtacttttcacttgtttctgctaaacaacgtgcctatctcgacagaacatattttttttaacaaaacataagtatttttttattcaaaattggagtttgaaaatgctcttattttgtggcttaaccattttatgactattttcaccataaaaaagtaattaaagccgcatttgtcgctacaaatagccataatatgcgcaaggtaccaattaaagaacagttaaatgctttgaatcttgctattaataaggaataatgattatttaaactacaaaaaatctgttgaggaaaacaaaaacaaaatttttttattgaaggaattttccgacagttatttaaagatctggaaaattgttaaagaactttgttttggtaagcaattgaaatttaatttataaaaaattagtttattttattaaataaaatgccaccaacaaaatttgttcatagatttgtcacgaatttgtgcttttgcacgggaatataagaaaaaatatgttgacggattgccaattttgaagagtttatggtttatgaaaaaggaagcaaagactcaattggatttgcaaatagccaaaacaaatggaaaaggaaactgccatgtttgggaggagaaacttggcaaaatgtattgggatcacattttattg

SEQ ID NO: 83189 - DNA, 429 bp, Heterodera glycines
  Genomic contig location: Contig_ID=SeqID_3098; Location=1417..1845; Strand=-
  SCN-specific regions: Sequence locations=1-225,247-429
atgaatggaattgtcaatgttgcgaatggaatggactacaaatatgaaaagttaaaagaaccgttactttcaaacgaagacactgatcagcagtcccaatttgaagtgatcgaagatgacacaacggaggaggaagacatggaaaaagcaattaaaatcctcaaaagattcttttggcgagttataatggcaatgaattgcaaaaataataccattaaaaagccagaagaaattggattcaaaaaatcttaccaagaattggttgaaatttgcgaatattggaaaatgttatcaatagcagctgaagcatatgtgaaaagttggaagaggtgcaaaaaaggaccaaaacaggagaacgaagctgaagttggcacaagttcaacaagggcacaagacacacttaagacggaagaaaatggcactaaataa

SEQ ID NO: 83190 - DNA, 1381 bp, Heterodera glycines
  Genomic contig location: Contig_ID=SeqID_3099; Location=50..1430; Strand=+
  SCN-specific regions: Sequence locations=1-12,71-391,421-539,562 -687,720-1008,1050-1104,1189-1250,1272-1381
atgttgaggtggcggtggaggctgcggatgttgtggttgttgcggttgtggcggtggcggtggcaacaacaacgacgccgcactgttagcagcaatcaccgcagcaaccgcttctaccacgggtcgacgtcgtcgacgacagcccggcacattttgggacagtatcatgcaacgtttggcacgtgcaacagcgataacaacggcaccaagccaggtacacgtagaataagctgataatgacaatcttatagttcgttttgatcagtggaaaatcaaaatgatcatatttgcgaaatgaaaaccacaaatagaaaaattatacctatcaaattctcgacattttttagaattctcaagtttttgaataaaaaagtatttataaatttgatcaaattaactaaatttttatttcttcctttcattaggtagccctaattattattctctattaatctgctagttttcaaaaatttttttgtttcaaaaaaagttatgactagaaaaattttagtgttttaaaaacgatgatattaaaatagtttaacaaggtttttataatatcggaaaattcttgtgcataaatgaaaaaattggaaaacaaaaggtacaaaattcatctgccctcggcggaggagtccaatgcaattgttgttgtgagaatggacaatgtgtgaaatgtgcccagggacagtgttgtgtgaatggaaaatgtggccaatgccaacagggaacacaacaaaaacagaagcaacaacaagttcaagcagtacagcaacaagcgcagcagcagcagcagaaacatcgattttggcacagaatgttgagaaagaagcgcggagcggacgacgaaataaacatttgaaaataaaattaaaaaagtggcaaattgcctgtttttcgtgtataaatttgctttcgtaatgagttttatatgtatgtatgttatcaatttgctctattgattaaaccaataaattcggttcggaaaataggcactaaaaactttcgtaaaaaataattaataataaaaataataattaacaatattaccaataaagatttcctcccttcctcaattcttatcatttctgaacatataaaagcaaaaaaaaaaaaatagaatttacaaattattaaaaagacaaattataattaatttttaataaaaaatttttaaattaaaaaattgacattttcttcatttatttctctttctgaagtgaagcaatgcgccaaatgttcgcagaaaatttcccatttatatacatattcagggaaccagtattttttctatggacaaatttggtgaaaaatgatcacacgatcactattgtatggccaatggtgtcaatggtcaatgaccggaaatttttatgagaca

SEQ ID NO: 83191 - DNA, 581 bp, Heterodera glycines
  Genomic contig location: Contig_ID=SeqID_3100; Location=340..920; Strand=+
  SCN-specific regions: Sequence locations=1-188,231-400,422-433,455 -471,493-581
atgtcttccggcggtgttccgggaattcgtgtcgtgcaaatgccgggccgacgccgtcgtcgacgacaaattgcctccgttcagacactgattgcccgtgcaacacgttcaactccaagcaaaccagtggtaccaagcatggtaaaagtttgacttgtgtaattttgcataaacaaaataaaaaatgctaattttaaatatgaaaaaacttttaataataacaattaattggtgaattttattaggtatatgcatataaactcatgaaattttaaaaaggtgattttcttattcagttaatggttgtcagaatgacttaaaatcatgcagaaaaaaaccttggcaaattaggactgccagtagcaaaatttccaaattaattcagtcattctgataaataattaaataactgaaaaagaaaatcattttttcaaaatttctaagttttatttacatataatttccagcctagaataataatctgtttaaataccccaaaaagcacaaccgaacacatgcccaaattcttgtttaagatgttgagaaaggcgcgaaggatggacgttggaaaaaaacattaa

SEQ ID NO: 83192 - DNA, 396 bp, Heterodera glycines
  Genomic contig location: Contig_ID=SeqID_3101; Location=2643..3038; Strand=+
  SCN-specific regions: Sequence locations=1-396
atgacaaatcattctgacaaagtgccgaaagactctggcaaaatgacaaatcattctgacaaagtgccgaaagactctggcaaaatgacaaatcattctgacaaagtgccgaaagactctggcaaaatgacaaatcattctgacaaagtgccgaaagactctggcaaaatgcctgccgaaatcggcggcgagagagaatatttgttgctcgaaaaatatggacaaaagattctaggcaaaacaatcaaacacagtgaacaattgagaaaggtcattgaatggatttacaaaaaacagtgtctattggagccagttttcgataaaatttcaaaggtcaatttcaaaaatttcgtattttgggacaggcggtgccgaaagaagccggggaatttatga

SEQ ID NO: 83193 - DNA, 640 bp, Heterodera glycines
  Genomic contig location: Contig_ID=SeqID_3102; Location=422..1061; Strand=+
  SCN-specific regions: Sequence locations=1-39,61-393,415-640
atgaatttttctgaggtaaaagctttgaatttatttaacaactatttattttggtgtaaaaccagtgttcccaactctgcttatttgtaagcattttgctgatttctaggggtcaaagatgatttttttttgttagattctgatttgctgctttttgagaaaatttgctgatttttggaaaaaaatcagcaaaaatatctgtttttatgtaaaattgctaccaaattaccaaattttcaaatttagggcgatatgttgatttttttgtgtgtgactttttattccctagaaattttatggcttcattgttattaactaattagtttctcgattttaagtacatttatgactgtaatgcgcaaaattttcaaaatttgctgatttatgctgatttttggaacaaatctcaaaatggctatttttaggctatcggtccaccggtccctaaaattccactgaaattttcaaaatttgactaataaattcccaattttcagtgaaaatctgtttaaaaaggttcaacatttccaattttttccacggcggcgcctatcggcaccgccggaaccacgccccatgtttccaaaaggtttttttggataaatcgcgccgcaaaaacctttttattaagttttatgga

SEQ ID NO: 83194 - DNA, 55 bp, Heterodera glycines
  Genomic contig location: Contig_ID=SeqID_3103; Location=253..307; Strand=-
  SCN-specific regions: Sequence locations=1-55
atgcccattccggcgactgatgaggcaggcacctgctgcagtctgcggatgcaca

SEQ ID NO: 83195 - DNA, 307 bp, Heterodera glycines
  Genomic contig location: Contig_ID=SeqID_3103; Location=713..1019; Strand=-
  SCN-specific regions: Sequence locations=1-254,277-307
tcggagtaggacaaaacgtcgtcagccgaaacgtcgtcgaacgaatttttcgaccataacttttttctttctcaaccaaattaaacattcttggtattattcgaaagcattcgaaaaatgctattagcctgcaaattttcaaaaatttttatttatgcacaaaaaaatctgagcaaaaaaagttcgaattactgggtttttgagttccttctggccataacttttttaaagcttaacgaaaaattttgaaattttacaaattaataataaacacatagagctatcgaaaaacacccacaatgcttaa

SEQ ID NO: 83196 - DNA, 429 bp, Heterodera glycines
  Genomic contig location: Contig_ID=SeqID_18560; Location=64..492; Strand=-
  SCN-specific regions: Sequence locations=1-279,318-429
atggccagttttttaattccaaatccccaacatcaacaggtgtctggtgcgcaacagttggtcagtttggtggtcggtggcactgtgtgcgagtcgcatcgccttcgtgttgggcgctgctcccgtgttgtggtcgatttcagcgacaacagcagtggcggctcattttgtgccgccaacgcgggcggccgtgccaaaatgaagaaaatgtttgtcaccggcggcgacggcacggagcagcagcaggacgacaccatcaccgatgaactgcagcagcaggaagacgaggatgacgacgatgatgatgatgaagacgaattccgcatactatccgcacaccgtaagcaaagaaaggaaaaacagaattctcatttatacaatgttgatactacttactgtatccagttagttcagggaggtggtgtactg

SEQ ID NO: 83197 - DNA, 317 bp, Heterodera glycines
  Genomic contig location: Contig_ID=SeqID_18562; Location=1899..2215; Strand=+
  SCN-specific regions: Sequence locations=1-14,36-98,139-317
atggcacaccgaaattgttgttgggccctgctcattctgctcacggtgttgtgttgcttgaccgttttggtgccgtcaattttggcctgctgttgcgactgttgctgctgttgcggcggtggtggcggtggcggcaatagtgccaataatattgcaactgccacagcgcttgccactgctctcaacggctcgttgctggtgttgccgggttcaagttctggtaatgtttattgtctcgattttatgacaaaaaaggcctaattttgatagggaatgaatttgcttttccaatttttgctttttaacgctaaaattga

SEQ ID NO: 83198 - DNA, 448 bp, Heterodera glycines
  Genomic contig location: Contig_ID=SeqID_18567; Location=395..842; Strand=+
  SCN-specific regions: Sequence locations=1-120,160-319,341-448
atgccgcgcaattttctgctttgggtcaatgtcattgaatatttcgtctgtttggctttacaattgcctgctttgcttctgcttatggccattaccatttcagtgcaatttcgaaaaaagttttttatttttattttctttatttttttataaatttttctccgtcagaaatcactcccaaaatgagaaaccgctgtgtcccactctgatctattatttgctctttctgctgatcagtctcatctccgcagttgcttatcactgttatatggtttccaatttcgtgcaaaatggtgccgaaaaagccgacccctattggatgttctggttggcactgtgctacgaatgtgccaacgttgcagttccagtggctatcctcggcctcacaattgaccggtatggcatcggcaacagagttgccgccgagtcactcaaccggaagcattag

SEQ ID NO: 83199 - DNA, 2104 bp, Heterodera glycines; identical to SEQ ID NO: 18569
  misc_feature (56)..(56): n is a, c, g, or t
  misc_feature (94)..(94): n is a, c, g, or t
  Genomic contig location: Contig_ID=SeqID_18569; Location=1..2104; Strand=+
  SCN-specific regions: Sequence locations=1-174,196-908,952-1344,1366 -1813,1835-2104
  Gene Ontology: Mol. function=sulfate transporter activity; Cellular component=integral to membrane; Biological process=reproduction

SEQ ID NO: 83200 - DNA, 538 bp, Heterodera glycines
  Genomic contig location: Contig_ID=SeqID_18570; Location=261..798; Strand=+
  SCN-specific regions: Sequence locations=1-157,225-229,252-359,381-538
atgaagaaaaatacactttcattctctaatgttcaattgtacgaataggctttttgagttcaaagcacaaaagacagaactcaaaaattattaaaagaaagtcggtgtaaagcaaaggatgctaaaactgcaaaagaataaaaatgcaaaaaattacggggtagtctgggaattgaacccaggacctctcgcaccctaagcgagaatcataccactagaccaactaccctataaaatgccactatttataatttcttataagcaccttcctttcgttgattcatcgcaatttcattcctcattaattaattgcttccagcgcaacttattttcttaaccccttgcaacttcatatcattaattaattaaaatgaaaaaatgtggtgttttaaaaaaaattgacttttctcgttttttcgagagaatttacataaaaaacgcaaaataagttaagaaaaacagttaagacaattagtcgtccatttcctgtccataaactgtttaaggaaaaatggtaaattctgcactagaaataaga

SEQ ID NO: 83201 - DNA, 1368 bp, Heterodera glycines
  Genomic contig location: Contig_ID=SeqID_18571; Location=567..1934; Strand=-
  SCN-specific regions: Sequence locations=1-52,74-79,101-407,429 -548,570-809,831-1346
atgactccgattggagccgagcagaaaaacagcgaattacttgaggttattgaaaaatcaaaattgaattaatctaccgaattttcccaacagaaattccaatcggttcgcgaaattggagaggcaaaagtgcgagtggccgaatacctgcaattgattttagagaagtaccaggaaagggtggcgaaggacttggccgaattcaaagccgacttggaggcggagaaccccggggagacggagttgatagaaaagagtgagttgttaataaacgagggcagggttttagaatttttgtggcattttttaacggtaatattaattgtgagcaatataatataaagtacccagattttatgcaaacaatgttggcaatgtcttcttcatctgctggacaattcgccgatttgttggacaatttgaatattggaagtgacaacctcgagcagcaaatcatccacccgttaaggccttttgtttcggtgtcggcggaaaacttaaacggtgacgaagaaaggtaattaattggcaaaataaagagaaaaggaaccagcgattcagcagaacatcaacagaaatggacttgactccgaagggccatcgaacacaacaatttgacgaattccgaattcccgccactcttttgaatgttggcgtggcaaatgggctaacaaagaaacagatgtttagtttcaattttggtcatttttagcggcgtccatcacttgccgatggtccaacgaccagcagcagcagtgccacattgatgccttatgatgaggatattttcgatgccgaagtggcaccccctttgaaggtggtgattttgtccgtgcaaattaaggcatttctgaacagaagcagaagcctatcgcaactcaacatttttttccacatattggagcagttcaacaacaggaaataattgcagtcgaacaacaaagtaaaaacaatgggaacggtgtaaaatttatcatttctttaggagaggtaatgaaatgatggactgtttggttcagacagatgggtaacagaccgaataaaattggttaaattaggttaaattctttttaacggtagtgatttggaatggtatttcggttaattttcaattaaaaatggtcgtattttcagggttcggcgtcatctgtttcgacaatatcgacttcatacccaagcacttcgttcgcaaaaattgatttcgatggcaccgaattgggctcaattggtggcccccttttgagtcctttccacgcacgacaaccatcacttgcccgaatgccgttgttggccggcgtacatgcaagcagacatggaaggccaagaaagtggcattcgataaatacgcatggcgaaaaggcaaataaa

SEQ ID NO: 83202 - DNA, 1428 bp, Heterodera glycines
  Genomic contig location: Contig_ID=SeqID_18572; Location=1164..2591; Strand=+
  SCN-specific regions: Sequence locations=1-312,334-337,359-568,590 -986,1012-1428
atggaaacttggtgagcaaccatgacgaggcagcacgctttgaattctttgacaacaaccacagtgcggacaggtgaatttttggtttgggaggtgtaaatttgcgctttttgtgggtctgtcaatgctttaccctctaaaattttgttttttcagtgcccgtgacattctgcagaaggctttgcgcaaatttcccaccgcccctcgcctttggctcacttattttgagattgaaattcgcttcgttgaattgtgagtttattacgggaaaaatatcgatgaatttaaccattttttgctgtaccattaaaaaattttcaagttttaccctcttattccaatttaaaacccccaaaaattgttaaatttccatgaattttgttaaaaattgtttcattttcagtcttcaccagcgtcgaatgttccttttgcaacaacacaaaagcaatgagatgaaaaacaaatggcaaaagaaaaacaacagcagcaaaaggaaaagcaatggacaacaaaaaaatgaagagacggcacaaataactgatgaagaagccgagaagttcaagcagttcaacagcagcagtaacaacaatgatgacgaagacgaagtgcttggacttaaattggccaccattgtgtacgaaatggccatgaaaagtgtggaggagcacccggcggagaagacgagtgagtgaaagtgaaaaatatgccataaaacggaattctaaaaattcttacgaattttcccataaaatttacgataatcacacggatccaatgtctaaaattttgttgttttaatagttagtcttaatttaagaattgcttcgtgattttctccgtgttgcgcgtgattgtgcccattttgcggacgttttggtgcagaaactgacggaccatttgcatgcgttgggtgaacacgctgaagaggaggaagagaatgccgttgagggacaggtgaggagctaagttcaagaaatttgattttgaagaaatccaaacttgaaaaaatttgccaaaacctggcatgactgctattgtcagagatgccattcttacacccgagacttgcgtttttatgtgccatttcagttgatccctgacgagcaactgtttgctgttgacacggagggcgatgatgatcagcaacagaagcacaatgccgaggacgatgacatggaggagaacgaggcggaggaagggacgaaacagggcatcagtggtggcaacaaaacggacaacaatggcattggcatcgccacaaaaagcactggcgatggtggtggtggcggcaacaacagtgtgctggacggattcaacccggacgatcccgagcttaaactggttggtcttctgttctcacaatactagcagaactattctcttggagggagtctaatcgttcatgaccatgcctgtgaattagaaaaa

SEQ ID NO: 83203 - DNA, 1885 bp, Heterodera glycines
  Genomic contig location: Contig_ID=SeqID_3104; Location=1..1885; Strand=+
  SCN-specific regions: Sequence locations=1-75,99-238,263-684,706 -758,780-1425,1447-1885
  Gene Ontology: Mol. function=flavin-containing electron transporter; Cellular component=cytoplasm; Biological process=energy pathways
tcaattggggttcgattttgaaaaccattattttaagtctcaaagaatgtgcattttgaatataattataccatttttctatattttactattttttacagggagtggacgaagtgttcgaaaaatggttgcccgaactggtcgaaattgtcaaaaaacagccggtaattcaacaatttgcaattttacgcccatttttctcatcagattaggcctcgaatcgggatgaaaatgttcgaattttggaaatgcaaaaatttttggtggaatttgcgccctcaaatttggccaactcaagccaataccatccaatttcggtggttgccaatgaccgactcactgaccaagcgcatttccaagacacgcgtctcatcactttggcaacacgtccatttgagtccgagctaaggttcatttttcacatttttgagtagggaggggttcggtatattgtttttaagaaatactgtttttttttgaaaatttcaagcgaactgaaaaatcctttttaataaaaaaatgggtggtttttttgaagacagtgtcgattttgataacaaattcgttaaaatgtgcaaatttttctcctcggcgctttttgccaacgcctaatgccaaaagccgttaattttcaaaatttggctcaaaatacaaaaaaaaacggtctttttttggcaaaaattgcttaaaaatgccattttcaatgtatttcctcttacaatttcggctattctcccggcgatgttctgatggtgctgccagaaaaccttccccaatccgtccgaattgccaccgatgcgttggaccaatgccggcaccgtttggatgagccctttcacatttgtcgtacgagcccaaatgtgccattgcgtccccaattttcacgctttttctgtaagtttttttttgagggtttctgcctcaaaaattttctcatagacttttttttttcaaaacccactcgtgtgcagataattgcgccccggacattattttttttaacaaataatctctgggggcacttggagtatattttgaatttttctaaatctttttcctttttcgctttgtttaagggtaccaatcccaacccaaaattgttcaaacccgttgaatttgcttaaaaattcccattttttagcttcggatgttccgctgactctccgcgactgtctctgcttttattttgacctccaatcggtgccaaaacgttcctttttgcgcgcgttggccaaatgttcgccctcagaaatggagagggaccgtctcatggagctgtgctcggcggagggaattgtaagggacagaaaaaacgggagcagctcgtccccccgtataatttctcccgaaatcgttttaaatttctaacaatattagaattttaaaaaaaattcggatcggccaacgcagttcattgtcagctagaaaaataaataaaaattttttccctaacaaattgctattattgtaaaaccgtatgaataatttggactaagctttgggtcatcacaaaaaaattcactttttacgcttcaattcaacgcgaatcaaatcgtattgttggctaaagaatccgtgaaatttctattttttgaaattcgtagctaaagaacccataaaaattgctacaacttttctcaaaattttttgtttcaaaaagattgtttcggtccatttttaggacgatttccttgactattgccagcatccgcggcggacattggccgaacttttgcgcgactttccgaacactgcttctcgcctgggcccgtccgaactgttcgactttttccccgtcattcggccccgtgcctttagcattgcctcgtcgccgacggcacatccgggccaaattcaaattttggtcgcacgagttgaatatgct

SEQ ID NO: 83204 - DNA, 880 bp, Heterodera glycines
  Genomic contig location: Contig_ID=SeqID_3105; Location=1761..2640; Strand=-
  SCN-specific regions: Sequence locations=1-41,63-336,360-579,601 -732,754-880
atgcaaaatatggacaaaaaatacgaaaatatggaccaaaattttctgaaaattggttggaatttttttgaaaaaattcataaacccataaatttttttgtcaagaaagaaaaaaatcattttaacatgaattatagaatttgataattgaggcattctatttattctatactaaaaaaattgaatttacttagaaaaaaagcaaaaattagtaaatttcaaaaatgcatttttacacgaattttgctgatgaaaatttttttacataatttttgatatttttccaattcgattttagaagcgtattttccaaaaattttccatctagggttgtatttttggaatttttagtgaaaatgccaaaatatggaagtaaatatggaaatatggacaaaaacctgaaaatggaaaaatatggaaataaaaatgcattctagaagcatcaaaccaagctaaaaatactatttacgtggtttttattccgaaataagtgtgctaaaaaaatatggaaatccctacaaatccgtccctactaattagtgtctttcttaatgtttttgaagaaaaacacaaataagcaaattttaaatttttttattaccttgtctatgaaaaatccagaaagttttttcagttttactaaggctaatttaaatcttcaaaaactgtccttaataatttactctcaacaaaatgtcagacaaccgaaaagaagccgaggaaaagatggcaaaagcaatgtttatttatttattttttttcgataaagaaaaaattgccatcagaagggcgggaaccacttactctgatgactgatcacagtaaaatagtcacagagtaagtgaaaaaatatcaagtgagatcacaggttaaaaataaa

SEQ ID NO: 83205 - DNA, 1117 bp, Heterodera glycines
  Genomic contig location: Contig_ID=SeqID_3105; Location=2994..4110; Strand=+
  SCN-specific regions: Sequence locations=1-51,74-289,311-649,694 -980,1004-1117
  Gene Ontology: Mol. function=flavin-containing electron transporter; Cellular component=cytoplasm; Biological process=cell organization and biogenesis
atgattattttgtacggctctgaatcgggcactgcccaagattttgccgaacaaacttggcaaaccttccacaggaatggcacaaaaattgtggccaaatgcatgccatttgacgattttcaaattgcggtgggtttaatttatacaaattcctaatttaatgccattttacagcaattatccgatgaaaaaatgaccatttttatcgtttctacgagtggacaaggcgaagtgccgacgaatatgcgcaaaaattggcgctatttgctgtcacgcaaattaagcgctcaatggctttcaaatgtaattgatgtcacctttttgataattggattaaggggattttcacatatatttgtgaataagaagggccgaaacgaagggcgggattggggttactttttgggttcgaaatccggggttttttaatgaaaattccggcaaaatactgaaaagtttggtgtaaatccgctatgaaatcgggtgcaaatttcgaagttttcccggcgtccgcctatagttcacctccgcaaaaactcaccactatagaaatttgaagatgtgttgaatttcgtccgatttcttatacatgaaattattaaaaacaaaaaattcgttatttataacattttatgctcttcccctcctgaaacaaaacaaaaaatatttttgatttaatttgccataaaattaaaatgccgttttttagttgcattttgccgtgctcgcgctgggcgacagttcctatcagaagtacaattttgctggcaaaaaattgtacaggcgtttgttacaacttggcgcaaaaccggtcatggagttggtattggcagatgaacagcacacacttgttagttttgccttgattttgagaaattgttcgaaaatttattttttcgggatttttcaattgggttcgattttgaaaaccattattttaagtctcaaagaatgtgcattttgaatataattataccatttttctatattttactattttttacagggagtggacgaagtgttcgaaaaatggttgcccgaactggtcgaaattgtcaaaaaacagccggtaattcaacaatttgcaattttacgcccatttttctcatcagattag

SEQ ID NO: 83206 - DNA, 775 bp, Heterodera glycines
  Genomic contig location: Contig_ID=SeqID_3105; Location=4303..5077; Strand=-
  SCN-specific regions: Sequence locations=1-401,423-475,497-696,726-775
atggggtgggggcaaatggacgacaaccgaaaaatggtcgccaaccgacaaatggccgacaacggacaaatggtcgacaaaatcggggccaaaaggttaaggccatttgacaaagcgaaaaaggaaaaagatttagaaaaattcaaaatatactccaagtgcccccagagattatttgttaaaaaaaataatgtccggggcgcaattatctgcacacgagtgggttttgaaaaaaaaaagtctatgagaaaatttttgaggcagaaaccctcaaaaaaaaacttacagaaaaagcgtgaaaattggggacgcaatggcacatttgggctcgtacgacaaatgtgaaagggctcatccaaacggtgccggcattggtccaacgcatcggtggcaattcggacggattggggaaggttttctggcagcaccatcagaacatcgccgggagaatagccgaaattgtaagaggaaatacattgaaaatggcatttttaagcaatttttgccaaaaaaagaccgtttttttttgcattttgagccaaattttgaaaattaacggcttttggcattaggcgttggcaaaaagcgccgaggagaaaaatttgcacattttaacgaatttgttatcaaaatcgacactgtcttcaaaaaaaccacccatttttttattaaaaaggatttttcagttcgcttgaaattttcaaaaaacccagtatttcttaaaaacaatataccgagcccctccctactcaaaaatgtgaaaaatgaaccttag

SEQ ID NO: 83207 - DNA, 444 bp, Heterodera glycines
  Genomic contig location: Contig_ID=SeqID_18573; Location=1..444; Strand=+
  SCN-specific regions: Sequence locations=1-301,323-404,426-444
cattcgctcattcatccacggaaacttgaagaaaggtgctttggttgtcaaaccctattagagcaaaaatagattttttcattacatagtaaaggaatatgcaaaatcaaatcattcgttatggttgggctaattgtaaggatatcaaataatcggcatcctcccattacatattttaaatacaatagaaaatgcatttaatccgttttgttctttcagctcctatttggcttcgtttcatttgcaaagatgggactgagtcggacacttactatttccgaggcggtggttatgaatcgcttgtgaattgtttgcaaaggtataatcgtaaaacattacgttcaatgtttttatccttcattattttgtagatacgtttttcttactcgttcggccaagtcagacaatctcattttgatttcggacagtcgcaccgatgccttg

SEQ ID NO: 83208 - DNA, 993 bp, Heterodera glycines
  Genomic contig location: Contig_ID=SeqID_18573; Location=618..1610; Strand=+
  SCN-specific regions: Sequence locations=1-525,547-773,795-993
  Gene Ontology: Mol. function=Rab GTPase activator activity; Biological process=signal transduction
atgactttggcctccaaagtcacctcttcccttgcaccactacttgatcctgaggcggttatcagtgaaaatcagctccgagttctaagccaacagcaacctgctgcagacgaagacgaaagttccaaattgaggtgaaggctctgtttttttgaagcagttcgcgctcccctctcaattataatgaatattggtccgaggggtgggggaaacgtagtacattcctgttttttaatttactaatcttagacaattttgtgactctgggtttgaacacatcttccaattggatttgccacatcgtccacaaattttacaccgtgatccgcctgttgataagactattttcgacaaattccgatcactttctgggaatgatggacgaattttggactcgcatggattgaaaagtctgatttttcgcggtgggatttctccagaaatgcgaccgattttgtggaagtatatgctgggtttctttaaatgggatcgttccgacgccgaaaatgaacacgtattaatttcatattttttaaatattccaattcactgtttagcatcgaaaaaaattagaggaggactattacagaatgaagttgcaatggatgagcatcggcgaagaccaggaaagtcgatttggcgcatttcgagacagaaaagcccttgtcggtgagatgcattcgcttttgtcaattactttttgacttcactcatgccatcgcatttcagaaaaggatgttgcccgcaccgatcgatctcatccgttttttagcagaacaaaccctgaaaatttgcatttgctccgagacttgctcatgacttattgcatgtacgactttgaccttggtcagtttggttatccttcgttaccgtatttaattgttgtttttaggatacgttcaaggaatgagcgactttctcagtgttttgtgcgttgttttggagagggaagtcgacattttctggtgttttgtcggtctcatggaatttgtg

SEQ ID NO: 83209 - DNA, 213 bp, Heterodera glycines
  Genomic contig location: Contig_ID=SeqID_18575; Location=1109..1321; Strand=+
  SCN-specific regions: Sequence locations=1-11,33-97,119-213
ttgaacggcagcaactctgccaccagcggcagtgacggcgaagtgccgtcctcgtccgcgtccaaagttatgcctccgaacactcacagtcaaccgcctcagcagcaccaccacgtcactccgtcacagcccatgccggtgccgatctcttacgcggcgagtgccgcagacttttccacgatggtcggtacgcccgagttcatccaggtttga

SEQ ID NO: 83210 - DNA, 918 bp, Heterodera glycines
  Genomic contig location: Contig_ID=SeqID_18579; Location=836..1753; Strand=-
  SCN-specific regions: Sequence locations=1-458,480-667,689-918
atgtttttgaacaacaacgacaatgaaacgaagtaaattcttgaaaccatgaaccaaacgacgaaaacaacgaccgcgacgacgattttgaagaatacgataatcagaagagaggcatttgtctttggtccgaaggtagggaatttttaatcgccaatggaaattttttttaattgcaaggatttcgttttcgcactaacaaatgagctgtgatttaaattttctttttttagactggacattttgagcaaaaatagtggaacttggcatttggacggcaagttcaaggcatcgccagccatgaggatgttcattcgcagcacacaaactttctatgtatgtttaaacaattacatctgtaattttttcagttatttgtgttttaagcgttttgtcggagacaaaaacgatgccgaaatttattgccctcttcgtcatcatatcgaaggacacccacgaaaaataaaggaccatgaaaaattagcttcaaccgtgcatgtcctttaaaatttgtacatttctgttttttgttatcctttcaattaattggaaatattctttgtctttaccacgttttattgttttttttaatatgattttgataaattttctaatgtatttcgtatttttgaaccttaaaattatgtaattttcgattttttctccaattttaattggtagggctgctaattttaggtaaatacctaaaatttttgcacacttaatacacgtagataggcgcgaaaaacgagtttttagcttggtttggagcttctacacccacttttataatacttatttttacctatttcgggatttttctacctattacctaggtacctatttttatacctatttcggcatttttgttacctattttaaggattttcaaaaaattcttaacaaaaatgcaataaa

SEQ ID NO: 83211 - DNA, 285 bp, Heterodera glycines
  Genomic contig location: Contig_ID=SeqID_18580; Location=97..381; Strand=-
  SCN-specific regions: Sequence locations=1-118,140-285
atgccaaatcaaccaaagccgttttgggcttctagtgcagaagcaagacgaaagcggaaggaatggcgccaggagcacggttgcagggttggttcaacaccaaaaagtgagaaaattgattaaattaattttattaaaacactgcatttttcagtgccaaagcagaccgaagccgcgccaacagcagatggagaggggacatcgacccaagccgccgaaagtaagccgtcaacgtcagctcaggaccttcgtaagtcaacaaatggatgtcatattcgtgattag

SEQ ID NO: 83212 - DNA, 1285 bp, Heterodera glycines
  Genomic contig location: Contig_ID=SeqID_18581; Location=681..1965; Strand=+
  SCN-specific regions: Sequence locations=1-534,556-861,883-982,1004 -1285
tggtatttggggtcgctgatcatgaatccagcatctatttcgatcaattcggaattccggacccgaactcgaacaaaaagtcgaaaattcaaacgttcgaattttatatttttggttcaaattttgtttgaatacacggaaacgaagtggaaagtcatcattagggctgggatttttatgttttaacatattttttttttgcagcttagttatggcgagagaagcccaaaaatagcattttctccgaacaatttttgatttagagcgagttataaaaacataaaaacacatattttggcgttttggcacataaaaacatatggcacatatttcggggttttggcacatattttggcatttttgagaaaaatcgtaaaaaaaatacaagaaaatctgaaaatgcaccctaaaaattgactactttacgtttcttaagcatttagaaaatttctttatatatttaaatgcctaaagcagccaaatcaaacgctgtgttaaatcgtcactggatttcaaagttcccggaaggaacttattcaactgatggaaaaattaatccgggactttacaaattgattgatatcgccaaaattttgattggaggtcgggcgaaaattgataaagactgatattaaatatgattttttttttgcgtaaatacacttggtttttccaatttttagcacatatttttgcattttttaacacatatttaggcctttttttggtttttagcacatattttgggtttttttagcacatattttattacatatttcaggatttttagcacataaaaatcccagccctagtcatcattgattcaataaaagatcaaactattttcagaacaaaaatatgaaatttgaaaaatttaaatttcgacttttttttgattttgggtccgggtttcggaattgatcgaaatggatgtcatattcgtgattagcaaccccgaatatccttggaaacacgtttttcctttaaaaatataaaaaaatttctatggggtgtaaactgtacaagtgcccaaagtcatagacaaaatcatatattttgcaaaatctaagctcagattcgtaatcagcgcattttttagcctagaaaatctggggttatgaatattcttgattttgccactagccttccaatatatattaatgaatacattttagggtgctcgggtactcaaagtttgagaaggtcaatccggagatgaaagactatatcgacgaagtcagtgctgaggatgaaagtgaagaggaggagagagatgatgctgaga

SEQ ID NO: 83213 - DNA, 733 bp, Heterodera glycines
  Genomic contig location: Contig_ID=SeqID_18582; Location=561..1293; Strand=-
  SCN-specific regions: Sequence locations=1-236,258-333,355-625,650 -662,723-733
atgagaacaaataagggaacagaaaagagaatggcctcaaagcgaaggaaacggaaggaatcgtcgccaacagcggaaaaaggggccatttcaggttcaccatttaccactcatttaatatttatttgaccaattctgacattttaatcaattcatcaaaacaaaaccatccgattccgagccttaaaatcatgtgaaatatgagaaaaataaacaaaaaaatcagagttcccaagtttttgtctttcaaaataaggacaaacgaggctaaaactaagattttgaccccaaaaataagatttttttctacaactaatagtagcgcgaaggaaacgcaataaaatacatgaaaaccgacataaaacaacattttttagcgtgaaacaattgaatttttttttccgcagaccatttttctcattttgccgcatatgcacttttttgcgtcgcttttttccaaaattgttaacagattttgcccaaaaattatacaaattttgtgacttagcaaaaaaatttcagataattgtaaaattgtgactgttctttaaggcattttgggcaattacattatttgttaacagattttcaccaaaaattaccaattcttatgattttgagccaattttttaaaaagaagtttttggggctcggcggtgctcgataggcgccgcccgcgggaaaaaattttgaaaattgggagttttggtagcatttatatcagcgaaataaa

SEQ ID NO: 83214 - DNA, 1114 bp, Heterodera glycines
  Genomic contig location: Contig_ID=SeqID_18583; Location=75..1188; Strand=+
  SCN-specific regions: Sequence locations=1-452,474-852,874-1114
ttggatttgtagcgacgtgtggatggatattctcccatcttttgaccatgctcaacttggactcaaaatggcattgctttccgaccgtttcgatgttttggtggacaaacattttgatggaaaagcaacggaattgacattttggagaattatcagaattggaaaggaaaatggaccaaatgcaaacgataatggaccaaaaccgaaactgtctgtactgatcgatgacaaatgggtggcatttccattgccggaccattcgctggctttatatagagtaatttgaactttggatatattaaagcattttaataatttgtgatgatggaccaaatgcaactgctgaccaagtgttgtcaaaatggttgcacacaccgggaaaagatggccaaccgaagcgattgtttcgcaataattattttggtccactgaatctcgaatgggtcaacgacttcaaagaggtggtccgttccgccatattttgttttatcaattttttgtttagacatttctccgttccatcacttctgtcagttacacaattcgatttcatttattttcgaacacaatgccaattgagccatttgaattggtgaacaaacggactaatgagaagctgacattgatgaaggatgaaaatgacgatggaaaattcaaggattggctgttgaagcggtgcccaattattggggagacgatggcggttcagcatgaccaaaatttggaccattcaaacagattcttcagtctttgtggtgccattgggtaagcagaaaggaggccttatttttgtataaagcacagacggacaaggacagtatcccctgtacagtactttctcagaatcttcatggcaggccggcaggggttccaattaaaacgggacttaagtccttgtcttgtccctcccgttctggtccatctcggaaaccctggtcctctctggttcgagtttttttcttcaaatttcgagctctactttcacaaaaagtgttctcatccaattcaaattttggcttaatttaggccgatgtctctaccaccaacagatcaaagcgatgaaaaagtgttctcgactcccgggccaagtgatcagcagaagaaggaaaagtga

SEQ ID NO: 83215 - DNA, 1173 bp, Heterodera glycines
  Genomic contig location: Contig_ID=SeqID_18584; Location=2..1174; Strand=-
  SCN-specific regions: Sequence locations=1-729,753-1173
atgatcaatcattaccagcagtttgtgaagaatatgcgatttcttcgacaaccgttggatgaactgctgaaacaggatgtttcgtgggtctggtcaacggactgtcaaaatgccttcaacaaaatgatcgaagtgctgaagtcggaccaactcttgacccattacgacccggaaaaggacatcattgtatctgccgatgcctctaattatggaatcggagcagtgatctcccatcgttttccggatggcagcttgaaagcaattgcacatgcttcttgctctttgtcgcctgccgaaatgaactactcccaaatcgaaaaagagggattagctcttgtctttgcagttcagaagttccacaaatatcttttcggaagacacttcgtcctgcaaaccgaccataagccattgttgaccatttttggtaacaaaaagggcattaaagcgtgtacagcaaatcgcttacagcgctgggcactcatacttttggcgtatgattttgagatcgaataccaaaacactgccgattttggtcaagccgatgctctttcgcgcttaattgcaaaagcgccagtgcccgaagatgaatttattgtggcaacaataacggaaagccctaatttggcaactgtgaatgcctttacggcacaatttccaattgtccacgaggacattgtcaatgccactaaagccgataatttgcttcaggaagtgaagggattcatcatgaaccaatggccaaacaaaatggatatgtcagatgacattttacaattccatcgaaggcgagaagcgctgtcattcgaaaacggatgcatcatgtacgccgaccggattgtcgtccctgcatcgctgcagacggaagtgcttaaaatgctacatcgtggacacccgggcatgaagcgcatgaaaagcctcgcccgccagcatgtttactggccaggaattgaccaacaaatcgaagaagtgttgagaaaatgtgagccgtgtgtcaccgaagcgaaggcgccaaagaaaacggagctacattcttggccaaaagccgaagggccatggaaacgtgtcctcatggactacgccggtcccttctttggaaagatgtatctgatcatcgtcgacgcacactccaaatggccggaagtgttcgaaatgcgttgttgttgttgttattag

SEQ ID NO: 83216 - DNA, 1605 bp, Heterodera glycines
  Genomic contig location: Contig_ID=SeqID_18585; Location=266..1870; Strand=-
  SCN-specific regions: Sequence locations=1-376,398-646,669-697,744 -837,860-920,942-1009,1056-1090,1131-1605
atggccacgcgaaaacggccctcacgcgaaaacggccacgcgaaaacgaccccgaccgtggaatgggtcgaagcgggtcagttccgtcttcaaaagtcatgaaaacatgttttagggtgattttcggttttcgggccctagaagccctacaaagcgctttgaaatcaattaaaaattgcaatgatcagtgatcactgactgatcaggtttttttgaattatcgccccaaaatatcgctatttggcattatgagtcattgtctaacactgacactgggtttgacgttttactcagttataccaacctaaccttttaaaaagtacgaattagaaaatgaaataggaaaatttatcatacctaatactaacaccaaaatttcttattaatttttaaaaattctcaatagtgtcgaatttactcactgtcgaaatggtccagtgtcgaaaatgcaggaaaacagtgaaagtttttgaaatagttcagtgtcgaaatttctctatgtcgaaaacgtagtgtcgaaattacttagtgtcgaaaatactcagtgtcgaatttacccagtgtcgaaattaccagccaccgttgaaaattcctcacttagttgtaattgataatatttattaacgcggactaaatttttttatcgttatttatttaatgaaaattatgtaaatagcacatatttgttttgaattggttaaattttttagaattttagattgttatttatataaaatatatttgtatcttttaactaacttgataatttaaggattagtgtaaaattagcaaaacgaaggcaagtgattgcacatgttcatgcataatatgagtttcattatgtattttgtatttatttcggctattttcttaattagtttctaatttataaacattttttaaagttataagggatttagttatttatatttcatatgtttgtacaattaattttttagattattttgttcagttcgacagggaaaatcttttttgtataaaagaattgtttttaatttcaataatattttacaaacatttttaaaaataaaaatcagcacaagtttttcaatttttttactgtttcttgaaatttaactttttaaatctttttttttaaattttttatagtttctcttaaccagctgtaatttaaaccaatttttattatatattagattctttagtgtatttagagaaattacttataaaataggtttcttagttatctttaaaatgcaattcttttattgcagagctttttataattttttttaaacataaacgattaaaaaaattgtgcgtaagattaaattgattgatattattccttcgaaattaattcagagcttgacattctattagtccgatatcaaaatttcgtttttattttaagaaaatatcaatttcatgtttttcgatttaattttcttattgaattttagaaatacttcttcacttttaacacctctttttgcagtattgatggcttataatttgtttccgtgtaaccacagtcacaactgtttgattgttgtgggcacggatgatttctaatattggcctatttaagagaattataaaaattaacattcaaacaataaa

SEQ ID NO: 83217 - DNA, 1148 bp, Heterodera glycines
  Genomic contig location: Contig_ID=SeqID_3106; Location=935..2082; Strand=+
  SCN-specific regions: Sequence locations=1-230,376-449,481-1004,1026 -1148
atgggctcccggacaatccgtccagtggacaatccgtcagtggtcaatccgtcagtaatggacaatccgtcagtggataatccgtcagtggtcaatccgttggacaatccgtcagtggataatccgtcagtggataattccataagcaaatttatttttaaaacacccggattaattaaaatcgtgtgaaaaataatttattttgctaaaaatatgaattaatagttctgttattttataaaattataaaataatcatttttaaaagaattaaatgataatttctcgaaaaagtaaattaattaaagtataaaacaactagaaatgttaggaatttcataaaaaattatatttattaaatttaacaataatttttgcaaatttttgatctttgctcaaaaaaaatttgctgatgaattgcccaactgacggattgtccattactgacggaaaaaatttaattaaatttcaaaaatattatggacaaaaaacttaaaaaaaaatcggttttccgaatgcgcccaactgttggcgcccaatcgacccccaccgcggaattggccgaaatggatgccggattcatgatcaacgaccccaaaacccctgtaaacttgtttttatgacaaaaaaaaattagtattcagtgacccagcaaaccttaaaatactcatttttcaagttttgataagatttaaattttcgatatttcgtggttttttactcttatggacttttcgtggcttggacattttgttggtaatttattcctcattattatttcttataaataacaatagttgatccgagttgtaattttagccttagacaaagggccacagtggcaaaaaaccttgacccaaaatgattgggctaaaacggtaaggtttaaacaataattaaagttgccattggcccattaatggcggtccgttagtgtcttttgaattttgcttatgcatttgaagttccattgcaatgcaattcaattttttaatttctcagttgttttaaaatggtcttttattctatttataaattcagattattttgcctgcagcaaaatggggtattgcgctccatgccgtcgtgtttctggcgttgatggttcaccagcgacctttcgctgttgaagtgctcagtacattgcac

SEQ ID NO: 83218 - DNA, 753 bp, Heterodera glycines
  Genomic contig location: Contig_ID=SeqID_3108; Location=866..1618; Strand=-
  SCN-specific regions: Sequence locations=1-538,576-578,600-698,721-753
atgtctttgaataccttcattttcgccgaatgcgtcaattggccccgtattctcaacgagtgtccatctctccgttttttcaatattattagcgacattttccccgaatttccgcctgatgacaatgccaatgcgacggatggtcaagcggtggttaaaaacagtggaaccaaatttacatttccattggaaataacggaaccgacgatatttttgattcctaatcattcaaatttgaacaaatttcgatttatttttcttttccaatcttatagaagtaaaaacatatgctccgttgcaaaattataaggcacctcaatttttcgttagtttgacgattttcagtaaactgatcgagcttaaattttaactacgcatacctttccaataatttttcgtaaccataaaaagcaagtagaatatgtaaaaaaaatgtttgttttttttactattttcgaaaatggcaacaaattggcgttgcaaaattgtaaggcactatctacaacttttatgtgaaaccacctaatttttttttctgtaattaataatatttaaggggaatgatattggtaaaatttcagctcaattattttatgaaacgtactcaaactcacgaaaaattgaggtgccttatacataattttacaacggagtatatgtatatgaaaatgacttatccataagaaaaattctaatggattttttgattccgttttaagggaattcaagggcagtgattttctcaaaaataaa

SEQ ID NO: 83219 - DNA, 688 bp, Heterodera glycines
  Genomic contig location: Contig_ID=SeqID_3108; Location=1742..2429; Strand=+
  SCN-specific regions: Sequence locations=1-164,186-295,329-365,388 -501,530-688
atggctgagaaaagtgatgacattgcggtcgaagtaactaaaataggaaaaagtgatcaaaaaaaaatttcaatgtgtctccattcttacgtgatcaaaatttctttgaatccgatgactttgttgggcacacggattttgtgggattggcaaacgcttccaattgacattgacaatttccatttcattggtgccattccatcgttgcgattccaaggccaagctgagaaggcggaagtaaggcgaacacttcgagccaacaataggcggagatgaagctgaaaaggaatttccgattttattaattttattatttatttattttttacatttcttttttgtttaggcgtcgtcgttttttgacgtggtcccaaaagaaccaaagaatggtgccacagccgaccaacagaagagacacaacgtaccaactgaaaatgaatttggggaaatgaatgaataataaaaaggcaaagaaaaggccaaagtcaggaaagtccaaatgagaaaattttttaaatttcattttgaggttttagtggggctgacctatggggtaatttttctcaaatgattttttgaacttttttaaaagattttatagagtagtgatacgatgtaaaaaggaaaacgtacggaattctcgaagacattacggcaacaaaatgaacggagggaaaattataagcga

SEQ ID NO: 83220 - DNA, 146 bp, Heterodera glycines; identical to SEQ ID NO: 56264
  Genomic contig location: Contig_ID=SeqID_18586; Location=121..266; Strand=-
  SCN-specific regions: Sequence locations=1-79,113-146

SEQ ID NO: 83221 - DNA, 146 bp, Heterodera glycines; identical to SEQ ID NO: 56264
  Genomic contig location: Contig_ID=SeqID_18586; Location=373..518; Strand=-
  SCN-specific regions: Sequence locations=1-79,113-146

SEQ ID NO: 83222 - DNA, 146 bp, Heterodera glycines; identical to SEQ ID NO: 56264
  Genomic contig location: Contig_ID=SeqID_18586; Location=625..770; Strand=-
  SCN-specific regions: Sequence locations=1-79,113-146

SEQ ID NO: 83223 - DNA, 146 bp, Heterodera glycines; identical to SEQ ID NO: 56264
  Genomic contig location: Contig_ID=SeqID_18586; Location=877..1022; Strand=-
  SCN-specific regions: Sequence locations=1-79,113-146

SEQ ID NO: 83224 - DNA, 561 bp, Heterodera glycines
  Genomic contig location: Contig_ID=SeqID_18589; Location=554..1114; Strand=+
  SCN-specific regions: Sequence locations=1-200,230-376,398-561
  Gene Ontology: Mol. function=structural constituent of cuticle; Cellular component=extracellular; Biological process=reproduction
ggccaattgtggactgatttggtgagagcgaagcgccaacttgttccttcggcggcaggaagcattgtcaattacggcataaatgggcaaagaaagcggcgtcaggcggagccgcgctgcgattgcattagcaccggtaattgggcgtatttttttacgtgatcacttgttttacaaccaacacgccaatttagcactttgccccgcgggaccgcccggccccccgggcattccgggcgcggatggcgagcctgggagagcgggcgaagcaggcaccgtcggactgcccggaccattaccgcaaattcaaaaaactgttgacgcggagtcttgccgagtgtgcccgccagggcctcccgggcagcctggatatacgggaccacctgggccaccgggagcagttgtaaggacaagctatgattggttattggagaaattatctttttagggcccatctggagagaggggcgttttcggaatgccaggaaatcccggagccatgggacagcccggcgattcgggcaatccgggagaagccgggcaagaggtacaagcgacaac

SEQ ID NO: 83225 - DNA, 793 bp, Heterodera glycines
  Genomic contig location: Contig_ID=SeqID_18591; Location=36..828; Strand=+
  SCN-specific regions: Sequence locations=1-793
atgttagtaagctttctctcctcagttttgtacattggtttttctttcagttcactgttcgtgccgagtatcatttttatttcgtggatgagcagggcattgccaaattcagcaacgtgaacactggtgatttcaaagtgaagccatccaaaggctcacactcttggggactgcgcaacattccgcgcacaaaggtgaagagttgcattcgtcccgacttgtcgctgcacatcgtctgccaaatcgaactggtccccgacttcagcaaagtgcaatctcagtgctttcgcaaccgccgttacgatcagtcgcaggtttttaaaatttcattaaattaattcatactttcctttatgtacagttgaccaaggaatatttggaccgcatccaccaaatgtttctgtcgggagagggctcggattgtgtcatcgaatgcggaaatgagcagttccatgtgcacaaatttgtgttgatgacacattccgaagtgtttcgcgctatgttcagtcataaggagacgatggaaagtgtcgagtcgcgcgttcggatcaccgattgtacgcctattgccgtgcatcagatgcttacttacatgtgagtgattggtgatcaatgacgaacttgcagatcagcttattcaatgacgtttattgaaggtattctggtggattgcccgacaaatttgacaacgatcacgcccaggggctcattgaaatctcagagaaatacggacttgagccactcaagattatttgtcaggacaaacttatttctcggtaagtattaaaaacaa

SEQ ID NO: 83226 - DNA, 589 bp, Heterodera glycines
  Genomic contig location: Contig_ID=SeqID_18593; Location=127..715; Strand=+
  SCN-specific regions: Sequence locations=1-589
atggtgatgtgccttctctcctacggtgccggcctcgacggcaggcggacacataaaatgacggcactacattttgcggtgtccaagcgaaacttgcagttcacacgcttgctgctctgcatgggcgccgacccgaacttggccaatgcgcacggggacacgccacggcatttggccgccaaattgaacgagtaaatttttttgggtggtggttaaatttacattattcttcgcccaaaaataggaccccaaattccaactctcgtttttatccgcttaaatatgtcaaaattttcagggttgatttgctgaaaagtctgatcaaatgcggtgctcggcgttgtccactcaccaaggtacaaacacaaaaatgttgcactattagtaaaaaaaaaaatttctgccttccaaaattcttttcatgatttaaaattggataaacacatccatatctaacgttttacgaatccacaaatacgcttttttgtattacaaaaatccgtttttccccccgtattttaggttggctgtgtatccggttgtgtcaacgagaaatagacaatactcaaagaatgagaagaagaagaaa

SEQ ID NO: 83227 - DNA, 879 bp, Heterodera glycines
  Genomic contig location: Contig_ID=SeqID_18594; Location=96..974; Strand=+
  SCN-specific regions: Sequence locations=1-84,107-263,440-650,846-879
  Gene Ontology: Biological process=protein biosynthesis
atggctaatgctgattcgccgatactaatttctgatgaggaactaagcgacgacgaaatacatttgagaaaattactattgtcggaacaacagcaacaacaactacgtgagcaacaattcaatcccgatcggccctactcgtcgacagtgcattccctgcccatcaaccaggtccaaattgtgaccccagcacaaggacaacagctaaagcgtgaccaacagctagccctgattaatcagaaaataaaagagatggaagccgcaaaaagacaaattgaagaagaagaaactgccgaagaagaagcacgaattttaagagaaaaggcatggaaagcggaagaacagaagaaaaggacaaagagggaattggatgaaaaggtgaagaaaagggaagaagaaaagaaagcggaagaaaaggcaaaaaaagacaaggaggaggtcaaagcggcatttaagaaaattggaatgagtaccgaagtggggggaaaagaagatgaaaacaaaccaaaaaagaaaaaatcgaagaacaacaaaggaaaggacacggaaaatggaaatttgaaggccgaaaaactcaatgatggacatagggaagctaagaaagatgcagaagaaaaggcgacgagagaagcagaagcgaagaaagatgcagaagaaaaggcaagagagaagcagaagcgaagaaagatgcagaagaaaaggcgagagaagcagaagcgaagaaggatgcagaagaaaaggcgagagaagcagaagcgaagaaggatgcagaagaaaaggcgaggagagaagcagaagcaaagaaagatgcagaagaaaaggcgagagaagcagaagcgaagaaagatgcagaagaaaaggcgagagaagcagaagtga

SEQ ID NO: 83228 - DNA, 525 bp, Heterodera glycines
  Genomic contig location: Contig_ID=SeqID_18594; Location=1184..1708; Strand=+
  SCN-specific regions: Sequence locations=1-128,151-525
atggagacaattagcgaaaaatggacacccaaaattgtgggaagcatttttgacccgcgaggtgaagaattgggggacgattggacgatcaaaaagtgccaagaaaaccgggaaaaagaggaccgactgagagagggaaaaagcgaagagcgaatgaaggcgtggaaggaatggacgcagccaaaaaatcaatgggaaagtggtggcacggcacaaggagggaaaagattttttgagaacacgctgaaatccgcagtgatctcggcgaatgagacacgagccatcccaccggaaggaatgggctggaaacggcatgtaccatgcttccaagcagcgccgcctggccccggcttcaagcgccgacaccacgacgtgagcccaatcagaagaatggacagcacgggacaagggacatcggcggcgagcggaacggaagaaaggatcgtgaaaattcgaaaactgttgctgcaggccgccgacttattgggagaaatggcggacgaattgttcccgtataagaaatag

SEQ ID NO: 83229 - DNA, 574 bp, Heterodera glycines
  misc_feature (85)..(85): n is a, c, g, or t
  Genomic contig location: Contig_ID=SeqID_18595; Location=90..663; Strand=-
  SCN-specific regions: Sequence locations=1-352,374-574
atgtctacagttacgagtgaagatcaaccagcaccagtccagaaacaacagagtcggccggtgccaagcaatcgacagcagcccncaaattcggttgaatatgaccaaccactactagtgaataaacaacagggccgcccggtcccgagcaatcgacagcctcaaaatgggacggcagaagaccacccatcaccagtgaagctgggcaatcgacagaatcaaaatgggacggcagaagatcaaccagaccaaccatcacccgtgaagaaacaacagggtcggtcggtgccaagcaatcgacccccccaaaatgggacggcaaaagacaaaccagaccattcaccaccaatgaagaagcaacagggccggccggtgccgagcattcgacaagcccattatgaggcgactgaagaccaaacacgaccaatgacgaagcaacagagtcgaccgatgccgagcaatcgacaagcccaaaatggcgttgaagaggaccaactactaccagtgaagaagcaacaaggccggtcttttcgcatggcagaagatcaaccagcattcgtcaagaagcaacagg

SEQ ID NO: 83230 - DNA, 94 bp, Heterodera glycines
  Genomic contig location: Contig_ID=SeqID_18596; Location=614..707; Strand=+
  SCN-specific regions: Sequence locations=1-61,84-94
atgagcttccaacgagcacaactacaaaaggttgctgtgcattgtgaagggacaattagaagttgtagcaacagcagcagcagttcatctgatg

SEQ ID NO: 83231 - DNA, 1158 bp, Heterodera glycines
  misc_feature (29)..(29): n is a, c, g, or t
  Genomic contig location: Contig_ID=SeqID_18598; Location=179..1336; Strand=-
  SCN-specific regions: Sequence locations=1-132,184-359,383-411,473 -525,548-632,696-725,747-941,967-1158
  Gene Ontology: Mol. function=cysteine-type peptidase activity; Cellular component=intracellular; Biological process=proteolysis and peptidolysis
agaaaccaccttgccaattggcccgcccncatggattccttatcaataaggcaatgatttgccggtcacgtgaattgacgaattcctttgtatcgatgatggcatatgcatggctctatttaatgaaaaagcaaaattatttttcattttaataatttttgtaattaacttttaatttttattgccactattttggtatttataggaatttgctgacaatagaaaaacgcacactttttcaatttatctttttattttatcgttttccccatagattttactaatttttcttcgttttttgtcattattctttttttcttttaaaatgttatgtatgtaaaaagaaaagtttgcaaatgtaaaaaaattttaaaaaatatttcaccccttttccattttggaaaaagttcctgaatttatcataaaaatttagtaaattttaaaaacagtatgatgttatccccattttacaacacataaatatgcgaaagtttccaggaacaacttattttatttttaatcactacatatatacatctttttttgacattttgcaaaaaaaaaatattttgtcagtaaaagcaaatattgcccttcttgagggcaaaaaaaaacaaaaaaaatgtgtctggaaatataaataaaacaaaataaattatataataagttattttttaagattaaaataataaaaagggagaaaaagcttgaaattcaatgatatatttaccaaagatttagaaatggatttttgagctacaaaatattagaagatttttttataatgggcaaagaaattttgtctatttttgttcctgattttcaggcattttccattttcatttctggcactatggaaggtggacggaagtgataatcgatgaccggcttccgtgccgaactgatggccgcttactttatagtcgtccaccggatgagtgattaaattaaattaaattaatttaattatttaatttattttttagtgacgtattttggtctgtgttattagaaaaggcgtatgccaaagtctacggagggtatcaagaacttgtgggtggcaaaatccgggagtgcttgtccgacttgacgggcggaataacggaagaatgggacctaaaagccatgagcataaaccaaaaaagaactctggaattg

SEQ ID NO: 83232 - DNA, 78 bp, Heterodera glycines
  Genomic contig location: Contig_ID=SeqID_18598; Location=2347..2424; Strand=+
  SCN-specific regions: Sequence locations=1-78
atgaatggggatgcaataatgtatgatggaaaatggacaaaagacacagccaggagggggtccacaaaaccccagcat

SEQ ID NO: 83233 - DNA, 798 bp, Heterodera glycines
  Genomic contig location: Contig_ID=SeqID_340; Location=173..970; Strand=-
  SCN-specific regions: Sequence locations=1-4,26-73,110-148,247 -390,444-461,483-488,517-590,703-753,787-798
atgtcatatattatttattcccaatgttatagacaagacctcaacgacagagaagagccattttctgggtgggtatataaaaaataaaattgtgtataaatttatatttcaactttatagcggatttgccctagagtcttggttagtcagtataagtatataattataaaatataaatatatataatataatattataatatatcttctatatatatgtcatataataattaattctaatattataggacaatcgacgacaaatttgacggtggctggtaagtcacatgtttaaaaaaaattatttaaagcactcctaatatttaaggcccaaagaaacttttggcgatttttggaagtgagtttagaatttttttcttaagaaattgagaaattttaaataatttttagtttttatgaagagtttttttatttttaaattttcaaaaaagtttttcgtgttattttggcaaacattttaatgtggtcaaatttttttaaattttaatttttaaaacagattaaatgttaacaaaagatcaaatgtttttgatttgatttgttaaaaaaattaaggcgtgcacatgttcaaaagaaaggaaatgaggaagagaaaaaggaagaaggagaagaggaagagaaaaaggaagaaatagaagaggaagagaataaggaagaaagagaagaggaagagaaaaaggaaagtggttgattaattagagacaaagggtgaggattattttttcaaaaagacaattttaataattttgcataagaaacataatgcttattaaataaa

SEQ ID NO: 83234 - DNA, 795 bp, Heterodera glycines
  Genomic contig location: Contig_ID=SeqID_340; Location=1056..1850; Strand=+
  SCN-specific regions: Sequence locations=1-51,88-117,168-261,284 -392,446-463,485-490,519-592,705-755,789-795
atgtatattactgacaggcaagggtttgtgccaaatccgctataaagtttgaatataatttatatacattttaattttttttatatacccacccattatcaaattgctcgggttcgctttaaatataaatcattaattattgcttaaatttatttaaagtaaatttactcaattcttgggtttttcacggtgggtgtttcagcgtctgaaaaagagcaagctcttttttttgaagcaatgtttgcctaaaatttgccaaaggtcacttttacaaaataaaatgacagaaaattgaccatttattatttaaagcactcctaatatttaaggcccaaagaaacttttggcgatttttggaagtgagtttagaatttttttcttaagaaattgagaaattttaaataatttttagtttttatgaagagtttttttatttttaaattttcaaaaaagtttttcgtgttattttggcaaacattttaatgtggtcaaatttttttaaattttaatttttaaaacagattaaatgttaacaaaagatcaaatgtttttgatttgatttgttaaaaaaattaaggcgtgcacatgttcaaaagaaaggaaatgaggaagagaaaaaggaagaaggagaagaggaagagaaaaaggaagaaatagaagaggaagagaataaggaagaaagagaagaggaagagaaaaaggaaagtggttgattaattagtgacaaagggtgaggattattttttcaaaaagacaattttaataattttgcataagaaacataatgcttattaa

SEQ ID NO: 83235 - DNA, 1387 bp, Heterodera glycines
  Genomic contig location: Contig_ID=SeqID_340; Location=2289..3675; Strand=+
  SCN-specific regions: Sequence locations=1-499,521-609,633-1195,1218 -1227,1249-1259,1282-1387
atggaagcacttcaccgtatcctacgtgaacatcacaagcttgctgtcgtttacgagtctgccgctgaaacataccgccaactgccgattgaagaacgtgttcatttgcgcatgcttttggtggatacgaataaaataggtgttgagcgaacagttgaagatgacgcagcgcaagcacctgctaatttgcatgctgacgaccgtgcgaatgtcaaacagatacatcctgggcgacttggcacggagactgtggctggtagccgtcttgtggcacaagtacttacattgcgtatacaactattttctgttttaatagtggtgttgtcgatattgacgttcaaataatttcagttttaccttgacgatggctccaatgttataccgccaagcgagtacgacgtcattttcatgggccgggacgcgaccaaagtgaagcacatgaaatggtggaacaggaatatcgatcccgcactctacccgcttctgtttccctacggccaatatggatatggtgaaataatctaagtaaacacctgtattcgtgtttgtatagaatacggaatccaactgaaactggaaaaagacgaacgcttcgacacgacatacaggcagatcagagacaaagacaacaaccttctgagcacagccgatgaccttggcgaagaggaagaatttcttggcgcagaacaagagcagcagttccaccgccgcgatcatgtctcgagatcccaatggtatcgatacatggcgcacatcagggggctcaactacaattggcgcgatggacactggctttgggattggcggactcttgctcaacattacacaattagcttcaacaatagaatggaagctcaaaaatttcagttcatgaagcagcatcaaggacgcagacgcctcattttgccgagcgccatcatcaattggcttaaggcgctccgtgataataaaggcaaaaatgacttcgtcgcaaatgaaatgttttattatttaggatataagggtgatattggccgtgtgtacatgaccgatgagcattttcggggctcgcggcaatagagtatgccaattgcatgacaatatgcagagaagttagcaagccggaccttctggtgacattcacaatggaccctgagagccctgagctcgatctttttagcatcctttaatttttcgccttttagcatctcttcaaaaaattctttatttctcctccttttcggtgccaaataattctggaaaaatggtcaattttctgtcattttattttgtaaaagtgacctttggcaaattttaggcaaacattgcttcaaaaaaaagagcttgctctttttcagacgctgaaacacccaccgtgaaaaacccaagaaagaggaatttactttaa

SEQ ID NO: 83236 - DNA, 1473 bp, Heterodera glycines
  Genomic contig location: Contig_ID=SeqID_341; Location=60..1532; Strand=+
  SCN-specific regions: Sequence locations=1-339,361-448,472-1161,1183 -1259,1281-1473
atgacgcagcgcaagcacctgctaatttgcatgctgacgaccgtgcgaatgtcaaacagatacatcctgggcgacttggcacggagactgtggctggtagccgtcttgtggcacaagtacttacattgcgtatacaactattttctgttttaatagtggtgttgtcgatattgacgttcaaataatttcagttttaccttgacgatggctccaatgttataccgccaagcgagtacgacgtcattttcatgggccgggacgcgaccaaagtgaagcacatgaaatggtggaacaggaatatcgatcccgcactctacccgcttctgtttccctacggccaatatggatatggtgaaataatctaagtaaacacctgtattcgtgtttttaagaatacggaatccaactgaaactggaaaaagacgaacgcttcgacacgacatacaggcagatcagagacaaagacaacaaccttctgagcacagccgatgaccttggcgaagaggaagaatttcttggcgcagaacaagagcagcagttccaccgccgcgatcatgtctcgagatcccaatggtatcgatacatggcgcacatcagggggctcaactacaattggcgcgatggacactggctttgggattggcggactcttgctcaacattacacaattagcttcaacaatagaatggaagctcaaaaagttcagttcatgaagcagcatcaaggacgcagacgcctcattttgccgagcgccatcatcaattggcttaaggcgctccgtgataataaaggcaaaaatgacttcgtcgcaaatgaaatgttttattatttaggatataagggtgatattggccgtgtgtacatgaccgatgagcattttcggggctcgcggcaatattaccagaaagagtatgccaattgcatgacaatatgcagagaagttggcaagccggaccttctggtgacattcacaatggaccctgagagccctgagctcgatgaatgctgccagtggtgtcaaaggacaaaaggcaacagtggtttgatcggccagatgtggtttgcagacttttcctcgacaaactacgtgaattgcacaacgacctcacgtataaagaagtcatgggacctgttcgtgggtggttctactcattagaacaccaaaaaaggtgtaaacattttctataaatatttgcttaaagtgttaattcaagaggcctcccccatgttcattttgcgctcatcctcgactgggacaggatccgttgcagtggtgtaattacaacgcctgaggattacattgaccaatatatctccgctgaaatacctgagaacccctctgggcggtcgccagaagtggttttaagacgaaaattgtacaacattataacaacaaagaacatccatacctgttccgttcgtcgctgtttagtcgacgggaagtgttcaaagcatttcccagtaagcaattga

SEQ ID NO: 83237 - DNA, 736 bp, Heterodera glycines
  Genomic contig location: Contig_ID=SeqID_341; Location=2145..2880; Strand=+
  SCN-specific regions: Sequence locations=1-736
atgggactgaaagatgatgaagaagatttgaatgcaatttgtgaagcggcccaagccgaagaagagcgaagagcaagaggcgaagagcgagttacgcagcttacagcgtatttcaccttcaacaaggacaatgctccactcggtctgacttatgccaaatgctacaaaaagttgtggtacgatattgcaaagaagcagtggaagccgtatgtgaacagagttgttccaaaattttgccgactcaagaccgtttcgccaaacaaccgcgaacttctggtgaatattatttaaccaattaacacattatggattataataggctattcggatgctcctattggttgtttgtgacccaactggatgggaagccctgaggacgcacaacaacattgtccacggctctttcattgaggctgctcaggcccggggtctgctcagtgacaataacctgtggatgaacaccgttatggaggcctttcaaacaaaaaagtccatccgccagagaatcagatggctcgctgtgttcttcgcgactacaaacctctcaagtccgacaacaatcttggacagcattttgaaggacgccgacaattggcttgtgaacaccagtgttgcaaaggcttcggctgaagatcagaagcaatatgtcctgcgtgctttggagtggttccttctggcaaatggaatcacgcctgactctgagcccagggaagatggcactttcgagtctgcctga

SEQ ID NO: 83238 - DNA, 1145 bp, Heterodera glycines
  Genomic contig location: Contig_ID=SeqID_341; Location=3336..4480; Strand=+
  SCN-specific regions: Sequence locations=1-187,210-641,663-722,764 -772,795-849,875-1099,1122-1145
atgcactttcttgccatggcttctacgggcattgctgccgaactgttgtacgagggacaaacagtgcacaaacgcatctgcaggatgaagcacgtcgactcttccacgtcacccaacgttgactacgaaagcaacttcgcgcacatgctccgcaacattcatggcatgcttatcgatgagataagcatgcaaaacaaggatgttctggagtttgtggaccgtcttctccgctctgttgcccctgatgaactcaaggaaattccatttgccggaaaggtagtacagtatacagttgcatttattttttgtacctaaaatttaaaggtcgtagtcattggaggcgagtggaaacagttgacgcctgttattcccgggggcgccgaaacttgaggcttctgtcaagaattcgccattgttcgtccactttacaactgtgcgactccgtgcaaaccatagattgttataaaattggagaatccccagcagttgctcggttttcatcgaatttgtcgcgcacatcgctcttttgtgagacaatccgaaaggttgccgaacaaaggcagcccaaaattggagtcataacccaattaattaactaaggcaggcattcgagactgaaggcaaaaggaatatgcaattcgaaaattccctcaaatttcattaacattccattttttctacaatcgacactcgagttacgaaattttttttgtatgattttttaaaatattgatgaaaatgtaaatatgaagcttaaaaataccaggaatatgttagttatgaaagcagagtttgctagttttgcttatttaaaagatttgtgcttatttcagcattatgtgcctattgtgaattgaatatttaaaaaatggccacttttcagtgaaaatctctaaaaattgttaaaattcccaatttttcctacggcggcacttatcggcaccgatgggccacgaaacttattttttcataaaaaattagctcaaaatctcaaaaaatggtcatttttggtgaaaatctgttaacaaattgcattcaatttttcaaaatttttccggcggcgcctatctgtgcaccgctggaccccccccccccccccttccaaaaattttttggaaaaagcgcgccgcaaaaaatggttttga

SEQ ID NO: 83239 - DNA, 1264 bp, Heterodera glycines
  Genomic contig location: Contig_ID=SeqID_342; Location=724..1987; Strand=-
  SCN-specific regions: Sequence locations=1-20,45-172,194-566,588 -704,740-832,868-950,972-1170,1192-1264
atgggccgaaaatttgggcacgaaatgaaaaacgggggacaaaatgaacagatgaacaaaatgggcggaaaacgggaaatttgggggttcatcgttctttggagtcgattcgccaaattggggacggcggcgaaaagttgcggtttgacaaattggtcattaatttgtgcgcggagtgggggaggaacacacaaaaacaattgacaatttgaaggaaaagggggggcagggggatggaacggcgaaaacatgtcgcgcggcgggcgggggattggtgaagggcctcctccctcttaattcgccgatcattgattggcgatcggaattgaaattccgacacttatcattttatattctctgtagaatatattttgtattcgttgtaaatttatagctgcatacatttacctgcaaaatataaaaaagcatgaatgcttgatttttgtcgaataaaaaatgaatatatacttaacattttatattctctgtagaatatattttgtattcgttgtaaatttatagctgcatacatttacatgcaaaatataaaaaagcatgaatgcttgatttttgtcgaataaaaaattactatatacttatcattttatattctctgtagaatatattttgtattcgttgtaaatttatagctgcatacatttacctgcaaaatataaaaaagcatgaatgcttgatttttgtcgaataaaaaattaatatatacttaacattttatattctctgtagaatatattttgtattcgttgtaaatttatagctgcataaatttacctgcaaaatataaaaaaacatgaatgcttgatttttgtcgaataaaaaattaatatatacttatcattttatattctctgtagaatatattttgtattcgttgtaaatttatagctgcatacatttacatgcaaaatataaaaaagcatgaatgcttgatttttgtcgaataaaaaattactatatacttatcattttatattatctgtagaatatattttgtattcgttgtaaatttatagctgcatacattttaccggccagtaccggtaccggtaccgctcaactctacttcttgcgatcggattatccatttttgacgagatggccaccacttgggaggagtcatcagtgaattacttgcattctggcgtttgaccaaatgcacaggtaaaaaagaattatttgatattttaattcattttggtcatttattttatttatgggttttaaacaatagggtaaaattaaa

SEQ ID NO: 83240 - DNA, 1791 bp, Heterodera glycines
  Genomic contig location: Contig_ID=SeqID_343; Location=980..2770; Strand=+
  SCN-specific regions: Sequence locations=1-448,471-1083,1106 -1514,1537-1768,1790-1791
atgtctggaccaatacaaaaagggatcatcaatgcactcaaaactctggacaatgccaaaagcgccacctcactccttctacaccccgacccggacctgtcaaactgggaaaatgccatcaacttggaggctcaatttgatcgcgtcgtcaaggaaatccgtacaacggaaatgcagatggacagtctacgagacttatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagagaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcctgaactctacgaatccttcaaatcggcaatcggcagtcaatcaatcagtaaagcgcagaagctgaacttactccgcaatctactgggcggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgaaggtcctcaagtgttcctcatgctggaaaagaagctgacgccagcattcctgcgaaacatcctcaacaagaaaggagaagatccgacaaattggacgacaaccaaatttcgggacgtgctaaacgaagccgtccgaaaagaagtccaaatccaagaagtgttgggcgagtacggacaccaccatcaatcactcgatcggccagcaaggccagcgactcaagcacaatcatcgcgaacacgcaatttcgcagcaaatttccggaaccgcaacgcaactcccgccaatcgggaacgcacttttatgtcctcaacaattgaggaggttcataagcgagtgaaccacaacaagccgcaacagcggaagtcccaaccgaagggactaaggccaactcaagcgccttcaactgtgccaatccggaatggcaccgcaaatcaagccgggtcgaggaagccaccctcaccgtgccttttctgtaatggaaatcactggaacgaagattgccagcgatacaacaccgtacagcaacggtcagcctttgttcgagacaaaggcttgtgcttcaagtgcttgaagtcaaaccatcgggccagcgagtgcccaaggccaatcaaatgctacaaatgcaaacagctgcacccggccgtactctgccaagaaggcaccaatgccgcaacgcaaacacaacaagcagcagccgtaatggaacggcacccaaagcaggatgaacagaaatacacaagtcaaacggcacaattaatgagcaatgccgttaaaagcagtgacacccgagctctgctgatgacaacaatggccacaattttcaacccgtcgaggccatgtcatagcatgatgcaaccatcttcattgacccgggaagccaccggtcattcatttcaaacacggcagccaagtaacttgaactga

SEQ ID NO: 83241 - DNA, 288 bp, Heterodera glycines
  Genomic contig location: Contig_ID=SeqID_344; Location=213..500; Strand=+
  SCN-specific regions: Sequence locations=1-288
atggccacaattttcaacccgtcgaggccatgccatagcatgatggcaaccatcttcattgatccgggaagccaccggtcattcaattcaaacacggcagccaaacaacttgaactgaccgtgctcagaacggaagaatgcttccttacgagctttggagaacgcgaaccaaagcgttacgtcagcgaccgagtcgcaatcggcttttcatgtcccaacggggaccgactcattttcaacttgaacgcactcaagtttctgctcaacaatttgcctgtcctacaatga

SEQ ID NO: 83242 - DNA, 906 bp, Heterodera glycines
  Genomic contig location: Contig_ID=SeqID_344; Location=815..1720; Strand=+
  SCN-specific regions: Sequence locations=1-399,421-880,902-906
atggacgactcttcaacgctaatcgaccgtgatgaagtgatgaaaaatttcaaggaaaacttgtcgttcgtcaacaacaaatatcaaatcgcattaccatggaacgacagagtggcacaattgccaacgaattaccatcaagcaaaggcaaggctcataagcctcatcagaaagcttcggacaataaacttggtcgacgaataccaagcaattctggatgaacaacagcagaattccatcatcgaactggtcaattctgatcattcttgtggtccagtccactacctgccacacagggcagtcatccgaaccgataaatccacaaccaaaatccgcatcgtgatggatgcctctgcaaaacccaaatccactccgtcagcaccatcactcaacgaatgcctgcacacaggcccgctacttttgaaggacctgaccggcattctccttcggttcagacgcatggaaaaagtcatccttgccgacattgaaaaggcatttctgcaattgggcgtcagagaacaagatcgcgatgccactcgattcctttggcttgctaacccaaaggaagcaaatctcgaacagctgagacaagaagacttccgcatcttccgattttgccgagtcagtttcggattaaccgtgtcgccatttctgctcaatgccacgatcagggaacacctggcacttcacgacacggatgttgcacaacgcatcagtgacaatctttatgtggacaacatcatgatggaagtcaaaccaagtgaaagcatcaatcaactggtcacggaagcaaaaatcatttttaaatccgccggaatgcggatccgcgaatttttcggaagtcaaatcgacgaactcaaagagcttgactcatccgaattggccaaagacctcgaaaacacaagg

SEQ ID NO: 83243 - DNA, 1912 bp, Heterodera glycines
  Genomic contig location: Contig_ID=SeqID_3110; Location=540..2451; Strand=-
  SCN-specific regions: Sequence locations=1-253,275-375,407-570,592 -721,744-824,846-1128,1150-1269,1292-1295,1324-1912
  Gene Ontology: Mol. function=RNA polymerase II transcription factor activity; Cellular component=transcription factor TFIID complex; Biological process=estrogen receptor signaling pathway
atgcattcatcagggaccaatgggttggcacttacaattgagcaaccgttcgatgtacacgagagtaatgatggcacactccgcggtcagttgggcggcgtggaaaagtgtgcggatgaagcggtaaatttgtcggtgttcagctaagttgaagataatcagcagaacaatgatgcgcttgattatgttaaaataacttacgatcccgtgtgaaattttcagccgccacgggttcattctgaaaaatgccctccttattaaaatgtttattacccacaatgattatgagaaacggaagcaaatataacttttaggatcaaattcaacaactttcgactcaatttctatcagttaatgatagaaacccaaagagtcaaaattttaattttattaaaagaaaaattttctgagatgtaattttaagataatcacttctcattgtcagttaattttgttgcaaatgcccaccgttatcggatgcaaccgttcctcaaaaatttccatgagccgttctttcccgcgattctttctgttgattatgtgataaaacactgccaacgacacacaaatgattgtgttcttcagatggggctgtgaaatggtcgaatcgtccaaataaatggtcgaacaactgttcgatttcttcaacgtcaccggcgcatgcaaattgttaaggtccaaaacgtaaaatgaacggcgattgtcgcgcactgaatgaaacaaattaaaatcaaataacaaaatttttagaccaaaaacccattatttttagaaatgcttctaaatttcttagcaaaatgaaatgcatttcaaaaaaagtgacaaccaaagctcactcaacagaatcgaaagaaagtataaaacgcacatttcaattcgcttctgcttcgctcaacaaaagtcggacgcaccgacggatgggtggacggatcctgctcagtgtctgaagaaaacaaatatatgaaaagagagaaaaggccaaccgtcggggatttcgcgttcactaatgtgcggcaaaaaattgacggaagaatcgcggccattgaaaaagtgattggactaaaccggaaaaaggaagttttcctgaataagggctttaaatcatcaaaattaacgatacaataatcgaatttgaattgatttgatttttggagtgtttgttcacttgccgtgtgattttcctgcgatttctttttggaaatgctcggcgtatgccttacacagcaattgttgttgcccattcgcctcacatacaaattaaatgaattaatttatgtacatcaacagaaacagacaaaaataaatatatgaaataaaatttttctttgctaaaattaaaatcatttgcagaaaaataaaccgaaaatgaaaattttttcaaatccgtccaactcaaacgatggaaacgaatgggaaaatcatttcattatgcgatttccacccgaaattgctacaaaagtacgccaatttgtggagagagacggccatcagaccagcaatgaccgactcggcataaactttgacaacaatttgaggacgggaacgattcagtttgagcacgacacaatgcgttttacactgtacgatttgccctgcgtaattgaggtggacaaaatcataaaaatttgttcatttctaattaatcttgttttttattattttcagataatgaagacattggacaacaaaactgtctacaaaattgccgatctctgtcaaatgattgttgccaatgcgccaaaatatgagtcgaaaaaggaaggcgtcgaagaaggcgcagaatcaaagtccgatcgcttccaatggccggatgggatttgtccgccgttgaaaaatgtgcggaggaaaaggtttcggaagatcaagaagaaaaagtacatggatgttgcggacgtggagcgggagttgaagc

SEQ ID NO: 83244 - DNA, 2719 bp, Heterodera glycines
  Genomic contig location: Contig_ID=SeqID_3110; Location=1211..3929; Strand=+
  SCN-specific regions: Sequence locations=1-92,114-396,418-498,521 -650,672-835,867-967,989-1325,1367-1400,1422-1963,1988-2418,2440 -2628,2650-2719
atgggcaacaacaattgctgtgtaaggcatacgccgagcatttccaaaaagaaatcgcaggaaaatcacacggcaagtgaacaaacactccaaaaatcaaatcaattcaaattcgattattgtatcgttaattttgatgatttaaagcccttattcaggaaaacttcctttttccggtttagtccaatcactttttcaatggccgcgattcttccgtcaattttttgccgcacattagtgaacgcgaaatccccgacggttggccttttctctcttttcatatatttgttttcttcagacactgagcaggatccgtccacccatccgtcggtgcgtccgacttttgttgagcgaagcagaagcgaattgaaatgtgcgttttatactttctttcgattctgttgagtgagctttggttgtcactttttttgaaatgcatttcattttgctaagaaatttagaagcatttctaaaaataatgggtttttggtctaaaaattttgttatttgattttaatttgtttcattcagtgcgcgacaatcgccgttcattttacgttttggaccttaacaatttgcatgcgccggtgacgttgaagaaatcgaacagttgttcgaccatttatttggacgattcgaccatttcacagccccatctgaagaacacaatcatttgtgtgtcgttggcagtgttttatcacataatcaacagaaagaatcgcgggaaagaacggctcatggaaatttttgaggaacggttgcatccgataacggtgggcatttgcaacaaaattaactgacaatgagaagtgattatcttaaaattacatctcagaaaatttttcttttaataaaattaaaattttgactctttgggtttctatcattaactgatagaaattgagtcgaaagttgttgaatttgatcctaaaagttatatttgcttccgtttctcataatcattgtgggtaataaacattttaataaggagggcatttttcagaatgaacccgtggcggctgaaaatttcacacgggatcgtaagttattttaacataatcaagcgcatcattgttctgctgattatcttcaacttagctgaacaccgacaaatttaccgcttcatccgcacacttttccacgccgcccaactgaccgcggagtgtgccatcattactctcgtgtacatcgaacggttgctcaattgtaagtgccaacccattggtccctgatgaatgcatttctgaattggagatgccgaaattgacttgtgcccgtccaattggcgtcgcattgtgctcggtgccattatgttagcctcgaaagtgtgggacgaccaggcggtgtggaacgtggactactgccaaattctgcaagacacaaatgtggacgacatgtgattcttcttgcagtttcattgtaatttttcccaccattacttttcaggaacgaactcgaacggcagtttttggagtcgttggagttcaacataaacgtgccaagttccatctacgccaaatattactacgaccttcggaccctcgccatcgccaatgacattcagttgcctttacagcctttgtacaaagaaagagccgcgcggttggaggcactaagccgaaactacgaggacaaagtggcggtgaactcgcagaaaatgaccaaaagtgtttctgcggaacgattgagagaacatcggtcaccggcgataatcccatgaaaaggggacaaagcttttgtaaatgaatgaatggaacgacttaagaaaggggaagcgaacctcacttcggaagtgctctctctctctgctgatcttgcgacaattcccaaaatgtcttatttgtattaatttgccacttaatttgcaattccttttaattaccatagtaatagcgaagtcatcaaacgctttttccaagagattttcataccaatttggacagtcatttcgccttaaatttctaaaataacatttgatttgatttctttgttattattgcacctcctttcttttatattgctttcataaccattaaattttgctttactttgaatcactcttcagtcctatccgatgttttttctcggtttttcttttttagttcggttttcattttctttgctttaacagccattcttttcgcgcaaaatgtgttcgcatgggcacggcggagcagggggagggccctgttcagcagcggtcgaatcatttgagcagcaccaggagggcatgcagtacaccatggagagggtgagcacaaaatgagggcatggaagggaaaacccaagcaaaatcggcattttgagtttatcaacaaagaacgcattgttgtgctgaacgaatcgatcgacggatcgggcaaaaaagtgttcaaaagatgggacgagcgaatggaaaagtgcgtttggccaacagacaaaaataataattcattttccagagaaaattttgtcgagtcggacgttgacgaggaactgctcttttctgtgccattcacaggtgggaaggtgcgttttcacggtcccacaattccctcccctttaggcaatgtcaaattgagcggcctttgcttcagcggtcgaatggatggtccgtcatccctacgattttttccgttttatttcccaccccaggaagttttccggcccgagtacgaattttcaaggatcgcgttaacgtatcattttcaaaccccccctcgctcgcagagggccagcg

SEQ ID NO: 83245 - DNA, 4514 bp, Heterodera glycines
  Genomic contig location: Contig_ID=SeqID_3111; Location=221..4734; Strand=-
  SCN-specific regions: Sequence locations=1-149,189-466,488-509,531 -753,775-999,1021-1471,1493-1692,1714-1897,1923-2024,2048-2241,2263 -2315,2456-2508,2530-3694,3718-3794,3816-4153,4175-4350,4380-4514
taaaaaactaattttagttctttcaaagaaaatgcagacaaatttatgtttactaaaactggaagatatgtgcgtttaggacttcttgctgcaactgtttgtggtgaacgcattacaatttaatctcaaaatattgccattccaatttgaaaaaatttcaattttaaaattaattagttttttaatttctctgtctttcatcggtctcttactttttcagcttatcccgtcattaaagtgtgcagctcgggcccgttgctcagcacgtcgttcaaatggcgggttaaaattgacacggagtgaatttttttccaatttttgcgttggattattcttaacaaattgtcgacgttatgaatgtctttagattgcctgaacatttggagaaaacgataaacgaagtgagtgaattttcaaataaacgccaaaaaatttaatttttcgtttttcagcaaacgttcctttggctggaaaaagttggaaagattcagagcgacactcactgcacattctcttgtctaaaagatgcttcgggtgattattttttactttgttcatttttccgttatttccgtgaaacttttttggaaatagcggaaaacggaaggattttaattaaataatgaacgtttctttctccgttctttatttctatcccttcgcctcccctttttttacattttatccctcagaaaactaaaaaccgtgttttttttatttggaacaacacaatacttttcatggtccctttaatttatatctattttaaaatgttctcaatttcgttttcccctcccttccctaagcttcgcttgactccataagccttggcacttcgagcttttcgaccggcgcacaaatcgctcttccattttacgtaaaattcagaacggcagacgaagcaaaggcttacgcaaaggaacactttgaggtatcgccgccacactcaaaaattggcaaaaagtgtccactcccccaaaagaatacaaaagccgaagctgtcttcaatttgtttttaaataatattgagtcccttttaaccgtccgttgcattaatggcttgcaattagcccatttagcccttcaaagtgttgggcaaagtcgcatgcgtcgtttgggagtcgcgtgtcggtcgtcagcttttgtccacctttgtgctgtctgacgaagtgtgtggttggcattccaaatgcttttattccttttcatttttggcattttttcctttaggccctcgcctttttggtggcccgcgaccttttcagtgtcaaagagacttatatgctgacccgggacgcgctcacttggttttgctatgtgattccttccttccctttcaagggcgtagccacaagacccttggctttgggggggggctgaagtcaaaaattcgattttttaggagtgtatttttcctttttcattcgatttttaggagtgtgttttttttgtttgggaaatcccgaattaggagggtgtattttacaaaaaatttagccgtttttcattactattttttgccgtttggtctccatttttcagaaatatgggtccggggtgccgttagacgttgccggaaaatttattgagaatttaatgcaatttgttaagaaaattcttgaaatttttaattttttgaattttcaagggagggaagggctttagccccctcagccccccctggctacgccctttttccctttgcttttccttcgcttattttcctccctcagactctctgttacatgagttgcttttacgttctgcacgccaccgtcttcaaaggctctttcctctcatttgtgctcgtttatccgctcctcgccgcgctttccgtgctcaccgccaaacaatggaatgaccttgcgacgtttgtccgtcccccaataaacgcatccattttttgttatattttcagttatgccaatgaaagacaagcggatatggaggcggcgaaaatgtcgcaattgcacacgcgagggggacgcgagttttacagcaaatttctgctgaggaataggtcaaacaatgttttatttcttcaatgtttgttgcttttctccgtaggttactgcgtgaattggtcgacggaggtgacaaattgttcactgaggtgggcgactaccgaaaagcaattgcggaatatgtgctacggtacgacgacattggtacggtgcggagtgaaaatgaacaattgtcgattagcatggagggggacgacattcccgagggactctgaccaatgttttagtttttgtatttctttcaatgtcttattcaaactcttttcttttttgttttgctaaacatagtggttttttatttgtttttctttgttcactgattgcttttttgcattggtatacttttttttattagttttccatttatttattttgccttttttgtaattttttttccattttatcactttttcgttccctcttccatttttaaacatccttctcttttgcttatgtgatgggtgttgccctcggtctttcttcgtgtgtcgtttcgtccttttgttttggctcaatgtacgtggtacgttttgtctgtttatcatcgacggcactttcattttcacggcttttaggctgtacgcaaaagcggcgatccacgggatggaatgttcgtccaatgggtggtcagtttcaatttaaaatgtaaaattcgaaacacggggcgccacttgatttggcattccgttttgttttcccttttctgttaggtttgttccgccatctttttggttggacttcgtacgtttccgttttgtctttttcattttgcttcttttccttcagtgactttccttttcaccggatgtccgccttttcagcactttgcgatgtttggcggtgcgctttgggcactcggtgatttttgtcgtttttctttaatttgtttattgggatcaagtcttatttttacctcattgtaaggcaatttgactgccgtccccattataaatgccattggactcggaatgggcattctgatttggggggtgtgcggctgtgtggtcgggtgggccattggtcgcttcggactattcggggtcactgtttcaagtcacttaccatgcacaacaaatgtacggtccatctttccaacaggtgaatccgaatgtgccgaattcgccgattcttaactatgccggactggttttcgtcattatcgggtgcgtcgacacgacaaattacttaaaaaattgtttgtattttcaacatttaaggggcattctttttgcgctcgttcgcccaaaagacaacaaaaataatgccaaaaatgacgacgaaatgcccaacgaattaatggggcagcaaacgacgacggagagcggggcaatgaccgaagaacggattgggttggtggagacggacaaagacggggacggaacacagagaatggcggcggatgggacggacgaaggcaatggacaacgaaaatcggcagaaaaagttgcaacggaaaatggggcaaaatgtatggacagcaatcttcaaaagcgaattttgtgcgtttgaattaggccccaattggccatgggagattaattgtcagtaataaatgcaaaattttgtaatttttttgattgccatttaacttttgctatttttcagtgctatttgctctgctgtctttgccggcatttgttatggagcaatgtgatttttttgtaacggtaaattgtaaattttattctttttacaatttaaggttcactcccgtcatttacatgcaggacaagtgaatattcgcataaaacatttttggataattattttgtttccaaatgcgacaatttctcgtttcaagttcagaactgtttgataacccaccaaaggatgccattctctacgtgttctcccatttctccggcgtttacctcacttccaccaccgtcttgctcatttacatttgtttcacaaagaacagaccgtacatggacaatagacttattttcccggcacttttggccggtgttttctgggccattgccatgttggcttggtgagtcggaggacaagtgcaaatggtcaagggaacgcagaagttttactgtttttaggttcgttgcgaatgaccaactctctcaagccattgtgagtttttggcttaactgggactgatttgtctaccctttttgagacttttcccatcaattcgatggcgcccggagtgatcgcgtccgtttggagtgttctttacttcaaggaagtggacaagagggacttgaaactgctggcatcagctatgctcatcactgtattcggtaaaacatttactgaacacgaatgaaaacagtaaatattgaaaattcctttaagtcgaaattcaaacataaatttttttttattttttaaatttttctcttctgggaacataatggttttcaatacttgaatgtgtaaacatgctagtttccaatagtttttcattgaatttttatttgattgggcgcataaaacttaattataggggcagttttggttgggctttcgaag

SEQ ID NO: 83246 - DNA, 417 bp, Heterodera glycines
  Genomic contig location: Contig_ID=SeqID_3111; Location=4891..5307; Strand=-
  SCN-specific regions: Sequence locations=1-232,254-417
atgcctttctggcgcaaagtaagtttaattatttttgctatttttgagtggcaacaaaaacactcccttaagagaatatctccagtccagcattgaactcggcaaattgctttatcggttaaccgacggaaaagcgccttttgatgcgaatggaaattgcaaaagacacaaaatgaaatacaccgaccgaatgaaagcgatcgaaagcattgagaaaaagatggccaaagaagggaagcctaagaaaatgcaatacaacagtaccttttgagcatctttaggtattattcgttccgttttcccaaattttattcactctttttgtttgtcattattttgtttttgagtgataattttaattttctgtgtccatttttaaaatccgtagttctccgaattatttaacataataataaa

SEQ ID NO: 83247 - DNA, 1139 bp, Heterodera glycines
  Genomic contig location: Contig_ID=SeqID_3112; Location=14..1152; Strand=-
  SCN-specific regions: Sequence locations=1-67,89-89,114-390,414 -593,615-678,735-765,788-1139
atgattcttgaatatcgtcattttttaagtttttacggtgtgtaaaaatatgtgcgaagcagacagatccaaaaggaaattaattcttccaattttatcctttttaaattataaacaaaaatcattttgggtcctgaaactgatcaattcggctgcgcaacatcgagttccgattggccaatttctcttcgaatttcgtcagttcttgggacaactgcttctcattgaacactttgtagaatgaaatgccaaaacatgagaagttgattttgaacagctcaaggcccgccccggcgatgaatccaaaagccaaagtggccgagtcgcttttttgtaccaacacggtaaaattacgaagaatcacctttagcattatcctcctaaaacaagcaaaaagaattttattttttattcacgggaggtctcgcctgttgtttaatttcggaaaaaaagtttctagggttatttatgacgctgatcacgaatatacatttgttttgcaaaatcatggagatgtgcgagaaaacttttcatttcatttcttaagcgtgtatttctgaaattttagggtcgaattcttagagtatttttcctttataaaatttttgttaaatttcaggcataacgccaaaataggcaaaaataacttttttcaaaactttttaggctttttggctctaaaataaagaaaaaaaaattaaattttaaataattttcaatatttttaaaattttcctgttaattattattgatttttttagatttacatattttcccttttattttccatcataagaaaatgaacagtaagatgcacagatctttctttcattggacatcactactcatgcaaggcggtattttgtgtgcgccaataattgtcaatttacagagaagtgggtccggcaattattaataacttttattgattatagtagccttgctaataaacactaaaaacgcaaaataatataaaaaggctaatcaaaaatgaattttttaaagataaattgaaccatgacttcaaacttcgcaaaatgatgtccgctgaccttcccaatatgcctgatgaaaatctgctcgatttggttgaagctgaaatgttagccaaatctaatgatcggctttatcccatttga

SEQ ID NO: 83248 - DNA, 212 bp, Heterodera glycines
  Genomic contig location: Contig_ID=SeqID_3112; Location=780..991; Strand=+
  SCN-specific regions: Sequence locations=1-212
atgctaaaggtgattcttcgtaattttaccgtgttggtacaaaaaagcgactcggccactttggcttttggattcatcgccggggcgggccttgagctgttcaaaatcaacttctcatgttttggcatttcattctacaaagtgttcaatgagaagcagttgtcccaagaactgacgaaattcgaagagaaattggccaatcggaactcgat

SEQ ID NO: 83249 - DNA, 237 bp, Heterodera glycines
  Genomic contig location: Contig_ID=SeqID_18599; Location=1..237; Strand=-
  SCN-specific regions: Sequence locations=1-237
ggaagagtccaccgtaaatcaccagtcgccaaagaaaaaggcgccaccaaataacgctcgggtggccaggagaccgcgcgatttgcgtggactgttccctcgggcacaccgaccaatttcctcggcaagcgaacagccgaccacccaactgaagtcgaaccgattgttcgcgcgcattgacgagtcctttcggagccgttggcttaaactacgctcaaaatcgacttcgatggtcaa

SEQ ID NO: 83250 - DNA, 1948 bp, Heterodera glycines
  Genomic contig location: Contig_ID=SeqID_18600; Location=191..2138; Strand=+
  SCN-specific regions: Sequence locations=1-4,31-90,113-210,235 -346,368-424,447-464,486-525,548-586,636-819,841-1634,1656-1948
  Gene Ontology: Mol. function=UDP-galactose transporter activity; Cellular component=microsome; Biological process=transport
atgtatgttgatgatgatgatgatgatgatacaattacacatggtaataatccaacggcaaatgacgcagcaatggcacaacggatgcaaaaacagctgcaggagcaacaggaagaagcggatgccgaattagctaggcgtttggctgatcaactttagggtaataatttgggctggcaatttttaattactaacaataacaagttattcaaattaataattaattaataaatagtgaagaattaaaaaaaagccaaaatacgaatttaaattctgtgccttcaacaaatcatattaattgtgagtcgatgtgtaaaaagtaaaaagatggggagagagtctggcaaagcaagacaaagcaaaaggatggaatattggtggatggatattattttttttggattgggggggggggggacgagacgaaggaagggagggctgtgcagttgccattggctaatgttgaagagagaaggaaaggaaggcttaaatggaataaattaagcgatggctaatcaaagccaagcacaacattgacaaaacgccgtcatttaaattattggatgctgaaagtggccatcccaacaaaaatttaaattttacaatttttagcatattttttattttctaaaaaacatcgtccccatatggccggtggaacaactttgcaactctcttcacaacaagcctggtcacagcgcgcactgaatttgttgttttgtgccagtggaataataatttgttatggcgcatttagtgtttttcaggaaaaaatgtgggacctttcaaaaacgtaaaataataaagacttttcattcattcagcacccaaaggctttttggtgaaaagaaggagcgttttgtgtacatgcaagccttagtgttcttccaatgtgccaccaatttggttggcttttgtttaacaattacttgctgattcgcttctccttgtttagcttgttgcttggtatgttttgagaagaaataaacagaaatcgctggacaatgtgccgattcacttgtactcaatgtgctcaaccagctacttcctggccatgctcttcagcagttacgccttggaatgggtcaattacccgacccaagtcagtcactcccctcccattgaactgttccattttcgaatctctgcaggtccttggcaagtcgtgcaaacccatccccatcatgctgttcggtgtcctttttgctcacaaacggtacggacttcgcaaatacttttacgtgcttctcatcgtcaccggaatggccatctttttgtacaaaccccagaagggcagtgtcggctttcagtttggcagtggcgaattgtttctgtgtctgtcgttggcaatggacggattcactggcgccgtccaaggtgccctcctttccttccccacaaatgcatttctcacccccctttttcagacagaattcgccattaccacaccaccgacaaatggaccatgatgttctcgatgaacgccttctcttccgccttcctcgccttaattcttctcgccagcggcgaactctttcagtttttccgattcgtcgccgcttaccctttcattcttcagcaaatgcttctcttctcgctgtccggtgcggttggccaggtcctctcgtcccatcccttttttccattctcctttaattaatttgctcgttttcagtgttttatcttcaaaacggtcaccgatttcggccctctcacctgttccatcatcacaactcttcgaaaactcttcagtctcgttttttcgatcatcatcttttcccacccttacacaaatcgacacgtgctcggcattatttttgtgtttgccgcgttgattttggatgccattgacagtcggaaaagccatggaaaagcaaaaggggacgaaaagccaccagcaaaggacgggcttctccaagaagcgactgcgcaggagaaagaaaactga

SEQ ID NO: 83251 - DNA, 189 bp, Heterodera glycines
  Genomic contig location: Contig_ID=SeqID_18601; Location=712..900; Strand=+
  SCN-specific regions: Sequence locations=1-48,72-92,114-126,162-189
tatattatgctggtcagttcatatttttgaagaacgttttaaagaaggataaaaataattattttattttaccgtcactagatatgcatatgtattttaaattttttattgttatgtaaacttctaatatatatatatatatatatatatttatatacataatcatatgagttggcggttttaagaaac

SEQ ID NO: 83252 - DNA, 258 bp, Heterodera glycines
  Genomic contig location: Contig_ID=SeqID_18603; Location=42..299; Strand=-
  SCN-specific regions: Sequence locations=1-16,38-230,252-258
atgaacacgtcccttattcttctgctgttcacggtttgcttcgtttttttggcccattttccccaaaatgcgcaggcagcagacacaaagagagtttattttgtatatggtaatccggttgaagttgaagctagatgtcccgggttaagcattgaacttggagcaaccacgaaaggtgctgaatcgaaacaatatttggacattgcaactagtaaatggccaagttgggtgggcgacaatgaagagattactttccat

SEQ ID NO: 83253 - DNA, 706 bp, Heterodera glycines
  Genomic contig location: Contig_ID=SeqID_18604; Location=264..969; Strand=+
  SCN-specific regions: Sequence locations=1-124,217-392,414-584,618-706
attttggtcgatccatggcaattggttcaactgctccaacttggccaagccgaatttgaacgggtcgtggtcggattgtacgtagtcattagggtgcgttttgaaaacacagtcatttgggagcattaattagtttaaaaatttttttttaaaagttttcaattttctaagatttttttcttggaaatttctaaatttaaatattttttaaaatttcggcggcgagattttatcccatcacctttatgctttatctttgactgctgtcccaccctatattttccttcaagaagccatggtcactcgaacgaattgaaggcgtcgcatggaatgccgtgccgacgtacaaaatttgtggccaagggcccctgaacgttttgctgtgcttcaacggtttcagctacaaactgtgcaaagtggattattcaaggccgaactctaaccacgaaatattgaagaatgagacgatggtcagtcagccatcgtctaccattttgtttttaggaaaaattaatttgttattcaatgcaaaaatggggagcaggacaaaacgtctccgccgaaatgtcgccggacataatgtcaaacgcaaaacaaaaaacatttagtaaaatatttctataaattttcttgaaaaagattgtgtttcttttgtgcttccgtttttgagttctgagttgtttggagcggatttttattatttcaa

SEQ ID NO: 83254 - DNA, 472 bp, Heterodera glycines
  Genomic contig location: Contig_ID=SeqID_18604; Location=1297..1768; Strand=-
  SCN-specific regions: Sequence locations=1-149,183-282,304-472
atggcgggacgaggacaccaaaagattgaatccgctcgtgggactcgcgaaacaactgaaacaagagcttagattttatcataatttgatcttgatccgaaattggaacttttggagttcctctgccacaattactttgggtgaaaagcaaaaaaaaataataatttaatttttatttttaacatgtttttttttcaggtgtcaccccgaccaaaatcaattctgtccgggccgaacagggtttcagtcataaaataaatccagcatttgcgaatgcacaaattttccatgtccacatgctgctgtgagttatgcgacaaatttgacaagagtataaatcaattaaaattggtaattaactaattgtaaaaaatgatttgaaaaatgcgggaactttttgcgcacacgtcgtttaaatttaatattcccaatttttaccattgcatttaaatactgcgtgaaagtcaataaa

SEQ ID NO: 83255 - DNA, 375 bp, Heterodera glycines
  Genomic contig location: Contig_ID=SeqID_18604; Location=2067..2441; Strand=-
  SCN-specific regions: Sequence locations=1-130,160-254,276-375
atgccggacgcagaccaaattttgcagcaactggagcaccattttgtcaacaattggctcctcgactctggcaaaattgatgaactgaagcaggtatgtatgtttggagggggtaattgcgttaatcttgttttatttaaaaatttatatataataattcagagacaaagtgatcagagggaagagcatgatgagttcgatcaaacggaagaagaaactgacgaaatttcgcttatcaatgtcattgattggtgatttagcaagaagaaattggtggtcgacgggagacggacgaagaaaacaatggagaaaacaattcgattttgaatagacacagttcgataaaggtttttattcgtttttacaggaaataaa

SEQ ID NO: 83256 - DNA, 1268 bp, Heterodera glycines
  Genomic contig location: Contig_ID=SeqID_18605; Location=694..1961; Strand=+
  SCN-specific regions: Sequence locations=1-183,217-485,507-547,569 -637,659-726,764-773,796-1268
acgataattgtgcgcttgccgtgcggaacaaaggcgcggcatctaaagacatcaagtggcttattgctacttataagatcaaagccacagaagaagacgacataatcgatgttgttgattgtcctggcaatgtcttcatggggtaccagacattctcttgtttggatggttgtttcatttttcaatttaaatatttattaatttgatatattttttcaattcatgccaacttcagaacaaaataatgatatatttgtcttgaatggatgcgccgaaacaaatagttgttcatctaaattggagaaaatctggaaaaatatgatggatttgcgtcatgtgttagttgcaaagaaccattgccagtgtgcaacaaagaaaaaattgagttaaaggagccctttcctcccttcaatgatggccatccccatcgatggtttgtgtagtaaaaaagttttataaaattaaaacacatcaaaaaacaatttattctaaataggtgtttttagcttcttttcgatggtcggcatgctctacacctttttgttctattttggaatgtaaggcgttgaaagtgatggagcacgcgtaacacgaagcttcttttcgatggtcggcatgctctacacctttttgttctattttggaatgtaaggcgttgaaagtgatggagcacgcgtaacacgacctgacactgtcgcatggcaactttggcttgaaaaagagaagaataataaatatttaaaatgattttcatttaatttttgttcatcggtttattttgaaatttgtcatcctcaacccaattacacgttgagaccacgaaaatataccccctaatcggcaccgcatcgaaaatttcaaattttcgccgatttttcatattctttaaaaaggcatattttttcagaacgtttcccattttaggtttaaaaaatttttcattgggaggaaggaaaaaattttcctccctccaataatgcgcgcaatcaccgatggtttgtgaagattttttataaaaataaaacaccaaaaaacaatttattctaaatagctgttttacattgttttaaacgattttgcacaaataaaaacttttttagacgataattgtgcgcttgccgtgcggaacaaaggcgcggcatctaaagacatcaagtggcttattgctacttataagatcaaagccacagaagaagacgacataatcgatgttgttgattgtcctggcaatgtcttcatggggtaccagacattctcttgtttggatg

SEQ ID NO: 83257 - DNA, 1691 bp, Heterodera glycines
  misc_feature (1595)..(1595): n is a, c, g, or t
  misc_feature (1599)..(1599): n is a, c, g, or t
  Genomic contig location: Contig_ID=SeqID_18606; Location=232..1922; Strand=+
  SCN-specific regions: Sequence locations=1-264,286-617,640-649,677 -770,792-879,902-1437,1463-1633,1658-1691
  Gene Ontology: Mol. function=RNA helicase activity; Cellular component=nucleus; Biological process=meiosis
ttggccctctccactcgcatttcatcaattattaaggaggaatcgttgagttattagtcgcgggacggacaatggcaatgggcaacaaacactccgtgggaaaagcaaaaaggggccaaggaaatgagagacaggaaaagccaaaaacagccctaattggtgggcaactgatcactcactcactgatcatcgtgtggcaataatttcggggtttgaaatggcggtcaaatcggggcgggggggggggagcgaacccaaccgaattatctaagataaatgtcatcagtcgctaatggcgaacattgttaaaacaaattttaaattgagaattcgcattgttgaatatgtttcatttatgtaaattgttataataaaaaaattaaaggttttagaaaagttttagtaggcgaaacgtccgactttgccttagtaggcgaaatattgagtaggcgaaatgtcagtaggcgaaatgtcagtagacgaaacgtctgcacactcccctccccccccccccgcttttttttttggttttttacggcttttctggtctcggcaagtttcggtccatttcttactcgaaattccttttcacatgtaacgctaattaaatgtcaaagaattttttttatttaaaaaattgcactgttttcaaattcaaatttaaatttttatttctgaatagaaacttaaatttcaaaaacgttcgggacgtggtcccgcggaattaatcccacaaatcccccgatcgctccggttctctactgctgaacaaattaatttataaaatttatcaaggacaagtgctcaaattattctaatttataggtatatttgctatttacattatttttcaccaatagacaaatgctgagacattgcaaaaagagaggggagaaggaaagaggtggaaaaaggcccaagttggacttggaaatggtttcggcactgcaaacgccgctttcgtctcccttccgcgtgccctttctgaacggtgccattggccatcccttcgttcactgtttcatcgttccgttcttcagacagtccttccacctcgcgtactccccgcactgttctgccgctttgtcggcgttcggtcagtgtcgtgccaatgccaacagtcacagactgtgcccacgaaaatgtaatcaaaaagcttttggctcgtcccttccgcgtcccaatccccggctacacaggtccgtgtggtgggcctttcattttcgcgccctcccacttttgttcaggcggttgcagcaaccgtttgctcggccttcgcatgtccggggtgcgtctttcgctgcacgacccttacgcggagaatgcgctggtcgttttcgcaccaccggaattatctgcacacgaacagttgaaagtgtggtgttatactatttaaaaaggcatcttttgaaaagcgggacatttgctgcttctctctttttttattttaatttaaaaaattccctttgccattttcctcatttgtcagatcgacgataccaaacgtgaagtccatgtcgtcgtggacccccttttgtgcgctgtgctgcggccccaccagcgcgagggcgtcaagtttatgtacgattgtgtgngtgngaagcgtgtcgaagggcacaacgggtgcataatggcagatgaaatgggacttggcaaacattgcaatgcatcgcactgatgtggacactgct

SEQ ID NO: 83258 - DNA, 2100 bp, Heterodera glycines
  Genomic contig location: Contig_ID=SeqID_18608; Location=1..2100; Strand=+
  SCN-specific regions: Sequence locations=1-340,364-519,558-614,651 -892,915-1272,1295-1729,1753-1921,1943-2033,2057-2100
  Gene Ontology: Mol. function=signal transducer activity; Cellular component=plasma membrane; Biological process=invasive growth
actaccgtagctgcagaagcagaaactaccgtaacatcagaagctgaaactacagtaacaccagaagctgaaactacagtaacaccagaagctgaaactacagtaacaccagaagctgaaactaccgcgaaaaatgaagatgaaacaacagcaacaaaagaagcggaagagactaccgtaaccaaagaagctgaagcgactaccgaaacaagagaagcggaagagactaccgtaacaaaagaacaggaagagactaccgtaaccaaagaagctgaagcggctacagaaacaaaagaagcggaagagactaccgtaacaaaagaagcggaagagactaccgtaacaaaagaaactgaagaaagtaccgtaacaccaacagccgttcagtcgagtgaaaatgcaacatcggaagagtcaaaagcagccgaaaattccaatgccccgtcgtctggcggtgaaattggagcagtgcccgcagaggaagaacaacaaacaacggtaaaacaaagagaaagcatcaaaaaataattatttaattaagtattttttgatttttaggagggatcaacaatctctgcagttttaactgaacaaacgaatactgccgatgcaagaaatattaataaatttaatttattgtaattatttttcccaattttaaaattttgtagggtgccacaaacggacaattgacaaatggaacaacagcagaagcagaaactgcaaccactgcttcaactgctgctccaccgactgagcaaacgacacttataaatgcaccaccggaaacgaatgagcaatcgaacggcacaaacacagcaaatgcgatgaattcggcaccactgacagaccaagcaaatgctgaacagacaaaaggcgatgccaatcagacaatgacggacaaagcaccagacggcacaaatgcaacttctgctggtcaacaaatggcgggagagaaaacagaaaatgcgacaaattcaacgagtgcagcggtccaacgcaattctgatcagacaaaaggcaatgctgatcagttgactcagcccagcaaagaagacagtgccaattcaaccgctactgatcagcaagcgatgctaacgaattcgtcggatggcattgcagcgaacacgacaaatccggcgcaaaacactgatcagaaaacagcaccgggaacaatgcaaaacagcgaaaatccaacaaaccaatcagcatcacctgaagcagagaagaccaatgttaaccaaataaatccgcaaaagtcggatggaaacgcaacattcacaactgcaaaccagacaaccatgactgatcaaggcaatgctaatttttcaatttccgcacaaaatgccgaactaagcaatgttggaccaacgccggaaaaatcaggcaacaacagcaacgcaaattcaacacaaaatgctgcagatatgggaaatgccactcagaaaacaacgagtacggagaagtctaatgggaatacgaacttgacaaatgccgacccccaaaaaagcaatgctcaacaaaaacaaaatactgaccaaaaatcaaatgctgatcaaatggcaccaacagcgaaggctgagaccagcgtcgccaatgcgacaactgttgatcagaagacagcgccgacaaaggcagaaaacagcagcgccgcaacagcgaactcggcacagaataatgcgtcgaacaatggcacttccgtcagcggagcaccggcggagatgcaaaatgtggacgatgagacgaagctgaagatgatgatcatgtcgtcgcttgcttcccagacggcgcctcattctgcgccgaatccgtccaattcttccgctgccgaacagcgacagggtgcgcccaaaggcgccggcgtcacaaacaattcgacagcgccagaaagtgctgagaaaaagccgtcactgcccgcggctaaattggcaaatgaaaggccccaaaaggcgtaattaggacgtagcctaatgatgtgcaatttaacagttttcaatcaatcgatcaattgtagagtaatgagatatgacattgtgtaaaataatacattttatagcgcatttgtgtatttgtttttttttcttcttcgatgatagtgaa

SEQ ID NO: 83259 - DNA, 1834 bp, Heterodera glycines
  Genomic contig location: Contig_ID=SeqID_18609; Location=326..2159; Strand=+
  SCN-specific regions: Sequence locations=1-887,909-1095,1117 -1473,1515-1775,1797-1834
gagcctgttccggctgaggatgcttacggtggagaagatgaacaaggccttgacgtggaagagatttgggagtgtcagatcagagaacagctcaaaagagatgatgaaatgcgagattttttcgacgacttggggaccgatcgggggcccatcgacccacgtcaaacattctacggaggcagaactgggccgcttcagctgattgctgagccaaaggaggatgagaagatttcggtcttcgatatcgtcagcctctacccgtgggtcaactatgccaccgactacccgaccggaatacccacagtcatccaccccactgttgaagagatgatcgtcgactggactcggcccgaacatttgcaataccaagggatatatcgtgtgcgggttattcctccaaaagggctccgaattccggttcttccactaaaaatcgacgaacgcctcctgttctgctgctgccatcgatgtgctgcaaaatttcggaagttgaacacacgacgagtgcacaaatgcccacacacggatgagcagcgggcttttacaggaaacttcacacatattgagctagaaagagccttggaaactggctatcgagtggacagattctggagagcttggcactacgatgaatggtatgagttagttaaagaatcttattattttattgcaatttaggagtgacggaatattcaaggactatgtacgtctgttgattaaattaaaggtctgaatatttttttttaaagttaaataatgtccaaattgcaggtggaggccagcggttttcctgatggtgccaacactgtggaacaacagcagcagttcgctgatgagtacagaagaatctacagtgtaaatttggacctggaaaatgtgcggagaaatcctgggctgcgcttcatctctaagctgatgctgaacagtctttggttggtatcaaaaattttagtcaaaataaataacaaatttaggggaaaattcggcatgcgaaatgaattaggcgcgaacaaagtgctaacaaggccgcaggaatttttcagcctcatcatggatcataaaattgtaaaccaaaatgtgtaaatgaattttcaattttgtacactgtttaggaagtgtcggctgtcatccctttgtcagacaccgccgtccgtgtcatgtacaagagcaaaaagaatttcgtcagcgaacacacgtcaagcaacattgtgataagtctgtggacgaccagccgtgctcgcctcaagctactcgattttatgacacaaatcgatcgaacagagggagccaaactgctatatacggtaaaaaaagctctaatattgtcaagtaaatataccccaacctttaggacaccgacagcgttgctgtgctccataaacgtgacatcgtgcccatccagacaggagaatacttggggcaaatgagcgaggagtatcttgactacgagatcaaaacttttgtctgcggaggtaaaaaatatttaatctttttaattttttattctaaaatttcaggcgcaaaacaatacggctttcgaatgttgaacaaaaggacaggagaagttgaatacgtacaaaagattcgtggcattacattcgacgtgaacaacagtaaggcgctgcagtttgatcacttcctgcaaaaggtgaaaaattacggacggaacactggtgacgacaacgatgatgctcctgccgtgttttcctacgacaaaataatgccaacacgagacagccgaatcatcacacgtgagctacgtaaaaaatacatgccaatatgtcaaaaaggaatcatcaacgagcaatacgaagtctacccatttggaaattaa

SEQ ID NO: 83260 - DNA, 684 bp, Heterodera glycines
  Genomic contig location: Contig_ID=SeqID_18609; Location=2219..2902; Strand=-
  SCN-specific regions: Sequence locations=1-46,71-181,203-600,622-684
atgttatccgaagaagaagtacgagggaatagtgtggtaagttttctaaataaaaaaatattaatattttcattttgcattttttaaggagcgaacctctatatgtggagttgaaggacttgaagatttgccagggagactcgccgctgtgtctttcacgccattgcgaacaaccgaacagcagcagcaacagcatgaacctgatcgtggacgagttggatctgatcaactattggagcgacaacgaacgcgaaaacgagactacaacctggtgagagtgctgtgccggttcaacaactgtggcccataccgattgacgaagcaactacagaaacaacggactgagaaccttgcctatctgagccaattggacattgaaactgtccatcttagaaaaaatgttaagattatccctgatgctttgtgccccatcggtgcaaatcaggtgtttgcataccgtggattcctaggaatcacggttcagcaacacctttacactcgccatcgtgttatgttaaagtatccaacccttccgtgtgttgttcaatttggtggtggtcaccaccgcgatattttccccattgaattgttacgtgtctccaaaactgaaacccattaaaacggaagcattttcatttttcactgaaacaattgttgtattgctacattttgaagacgaataaa

SEQ ID NO: 83261 - DNA, 352 bp, Heterodera glycines
  Genomic contig location: Contig_ID=SeqID_18610; Location=1124..1475; Strand=-
  SCN-specific regions: Sequence locations=1-147,172-224,246-253,278-352
atgagacagccaaagggaatttttaaaaagctttgtttaagaattctcagttggatttaatttaaaaaaagagtggacttatttattgccaagatttgatagtaattttttttcattaaatcgttcacaatttctatcaattccgtgaagcggtggcgaagatggttatatgccccctgtttatatttttcccataaaagtgcaattccaacattttttagtcgttttaaacttttttcattgaactattttcataaataatttaaaaaattaaattcttccaaaaaaattctaaaattgttttaggatcacattcattcaaaggataaagttttaagtaaattaaaataaa

SEQ ID NO: 83262 - DNA, 105 bp, Heterodera glycines
  Genomic contig location: Contig_ID=SeqID_18610; Location=3536..3640; Strand=-
  SCN-specific regions: Sequence locations=1-105
atggctctgcttaaaatgggactgtccgcggcagagtgcgttttcatcgacgacctcgaagaaaattgcaaaggtgccgaagcggtcggaatacgaagcatttgg

SEQ ID NO: 83263 - DNA, 596 bp, Heterodera glycines
  misc_feature (529)..(529): n is a, c, g, or t
  Genomic contig location: Contig_ID=SeqID_18611; Location=54..649; Strand=-
  SCN-specific regions: Sequence locations=1-423,445-596
atgaaaatattttttattagttttatttttcccttaattttacttgattatttggaaggccataaatccggatttgaaggattcgtaaaaaatcctcaagcaatatcacttgtcaaaagctatgaaaaaaaggaaataaagacacttgatgaactacatggacaacttatgcataaaggcatacagatttctgtatgcactttgaaacgctacctgcataagataaaaattgtttttgcgcccacaaaagataatgttgattcatcacctaagcttgaagtggaaaaatgcttctccaaaaagctgactaacactatttatataattggaaatggatcaaattggagaaaatacattcagattaatgataagaaaaatgatatctacattccgtgctccagctgtttgtatttaggtgaaaaggaaaacaatactagatctattatctcaacagcagtgcttcgccaaggagttaatcgtgttatgttgcgctcggaacataattctgagtgtaagccagaaattttgnaaaaattgaatcattttggtggtttttgaatttggtgggtaattgcaagcttttctcgggtattaaa

SEQ ID NO: 83264 - DNA, 308 bp, Heterodera glycines
  Genomic contig location: Contig_ID=SeqID_3113; Location=472..779; Strand=+
  SCN-specific regions: Sequence locations=1-308
atggccaaaagaaccaatagaaaaaatcaaaagaaaaaatctattgacaagggacgaaaatcgagaaatcgccgccaaaaagtgagttttgattttattgtagaaatgaactgtttaaaaattttaaaactcagcaggaaacggagagcagtgactctgatgactccggaaacgaaagggatttttgcgacggagttgcagcggaactcttgcaaaaaatatgcagagccgtacgggtcaagggaatgaagcggcgaaatgatcgaacaccaacccctatcagagattacaggaaaaaaccggatagt

SEQ ID NO: 83265 - DNA, 910 bp, Heterodera glycines
  Genomic contig location: Contig_ID=SeqID_3114; Location=461..1370; Strand=+
  SCN-specific regions: Sequence locations=1-145,198-260,299-715,737-910
  Gene Ontology: Mol. function=caspase activator activity; Cellular component=cytoplasm; Biological process=signal transduction
ggacctgcgttattaatcaataacattcgctttggtggcaatgaataccggcacggggcaaatgtggacactactggaatgctcgaattactggaacaattgggttacaatccggttcacatgtttgaggatttgagttcccaagtaaatttaaaaaataaataaataaaattaaaaaatccaaaataaaaaattaagcaaatggttgccaaatttgagtggttctcgcgtttgacggcattgaattttgcggacaggtgtatttttataaatttttaataataataaattattaattctgacgataatttttggggtgaaaatatctttttttaaaatttaaaggtatcaatgttatggctaaccttttaggagttttttaaaagttttagaaaggtaaaattaaaactcaaatgaaaaatcgagattttacaaaaacctttttgttatttaggaaattttttttcaaatttgaaatgtgccaacaaagaatggttttatttaaataggacaaaaactttaaaagcaaatttgaattttttaaatttaaaatgtggttttggctgattgtggcttatttttgtgattttaccggtgcaacaacatgtctaaacgctcctaaatttttttagtactgtcacggtggtaatgtcccacggtcatttgcgatcagtgcaagggatcgatggcaattctgtaccaatcgctacgttgaagagcaaaatgaacgggaaaaattgtccacaaatggttgacaaaccaattgttgtaagaaaatgatttggcttattatggatataatacttgggattcagatgcttttcaattcctgtcaaggagccctgcgagattatggggttgaaagcagtgaaagcccatcattgccaactacaaaacggcacgcaaaacg

SEQ ID NO: 83266 - DNA, 720 bp, Heterodera glycines
  Genomic contig location: Contig_ID=SeqID_3114; Location=3139..3858; Strand=+
  SCN-specific regions: Sequence locations=1-262,299-339,361-471,493 -498,537-699
atgattgttggctattcgacgactcctaacttcgtgtcatttcgaaacaaagaattcggatgttggtatatacaagccatcttacgtgtctttggccagttcgcgaaaagcgaggaaatcacacagctcttcgagagagtgcacaatattgttgccaagcaagaaacgaagggacagaaacaaatgccttttttcgaaagcaaattaactaaacgtttttactttttcccaaacgagtgaaaaaatttcagtccaaacattcaatttttaaaatatttatttctttattacatttattggtattgttgaacaaaataaatgttgaatccatcttaatacttttattaaaaaaatattatagtgtttcgtattttcctatacattttggcgatgattatggaggcactttaatatttgatttattatggtttgaaaacttattgggtgagttttcaattgtttctacttttgactgcaaaataaactacagttaaatgcttttttttgaaaattttgattttaatttaaattttattggatttggcttacatgcatggaaaattttaagtaaaaaatgtccattttatgaacaatattcgaaaattaaagtgattcaaatttcgaaacatatttctattcactgtaacaatatgagcatttttgctgataattggaatctctagaggaaattaaaaatctacagaaaattcatctgagaaa

SEQ ID NO: 83267 - DNA, 695 bp, Heterodera glycines
  Genomic contig location: Contig_ID=SeqID_18612; Location=1701..2395; Strand=-
  SCN-specific regions: Sequence locations=1-68,137-173,197-212,269 -286,312-397,434-448,495-614
atgaacatcaacgggaagatcgggatggttttgtacaaattcggtgggagaatgtgatcgatggtaagaaattttatataaataaaataaatttttttaatatttaaattatatattattattattattattttttggagggggatcgtgtgccgttcaattaaacgattttatttaacacaattttttaaaaatcactaattcttttttgcataaaatattaaattattgtaaaaagttgaaaaataaataaatacaaaattttaaacatgttaaatgccgcttcatttaaaaaaaatattttattttaaggtgcaagtgccgattttgaaaagctaagtgccattggattaagcaactatgacgagccatacgattatttctcaattatgcactgtaataattttagaaaatataaaatttcttttaatttcgtaatttttattccaaaattgaattaaaaaataaaataaataaataaaattaaaaataaaccatagatgaaagtacggaaggcagcaaaaatggaaatccaacaattacagcaaatgcaccagcatatacaaatttaatgggcaaatcaacggattttactgaaggttggaaaagcattgaaaatatattttatttttattatttaattaatttaatgtctattaaattttcagcaatgtaaattttaaaatattaataaa

SEQ ID NO: 83268 - DNA, 66 bp, Heterodera glycines; identical to SEQ ID NO: 53774
  Genomic contig location: Contig_ID=SeqID_18612; Location=692..757; Strand=-
  SCN-specific regions: Sequence locations=1-66

SEQ ID NO: 83269 - DNA, 636 bp, Heterodera glycines
  Genomic contig location: Contig_ID=SeqID_18614; Location=281..916; Strand=+
  SCN-specific regions: Sequence locations=1-27,50-390,412-495,631-636
atggcagggaattaccgtaaccatactttttccattttaccatctacacttgatcatacttaccgttttatgtttaacgatattacagtaattcgcttaccataattcaaaattttttatttatccatgtccaactttttattttttgctaagttttcttcgctccggaaatgccagcgccggtgccggtgccgtcggttggcttgccgacttgcgcgagccgagcacatcgcacacgctgctccatctggccgcattacatggccacagggagctgacccgtgtgctgatgcagcgggatgtacagcttgcaaccgcgcgtgatcgcaagggatgtttgccgctgcatttggccgcatggaatgggcacgaagaagtgatcgcggtgagaaatatttatttttaaaagtttgaaaaaatcagagattgattttttagacacttttggcagctgaaccagcctcagtggtagatcaattttaattttatcaactgaatttttaaaattgtaaatgatcataataattttaattgttattttttttattaattgttaaaacatttaatataaattttaattaatttaaattattaaaagaattttttaaattttgctaaaatataaaatatgtaata

SEQ ID NO: 83270 - DNA, 1440 bp, Heterodera glycines
  Genomic contig location: Contig_ID=SeqID_18617; Location=355..1794; Strand=-
  SCN-specific regions: Sequence locations=1-89,111-222,247-502,525 -604,627-1098,1120-1350,1372-1417,1439-1440
atggcacccgaaattctgctcaccgcacttggcagaaaggacggctattcgtttgaagtcgactggtgggcattgggtccgtctgtttcctttgccattttcccaacactttcggcacattttggtcctttttaggcacttgtttctacgaaatgttgcgcggtcgaattcctcacgaatatccgtcggctttttcatcgcttcaggcacttaattccattgtttaaatgtatttttatgctttttccaggtcttggacatcgtcttcactcgtcccgtggtgatgcccgcccgttggccctccgatttgatctcttttctccgttcaatgatcaatccggacccggcccggaggatcgcctccttcgccgctttccgtgcccatccgtacatgtcgcgcattgactggaccgccgtttttgaacggtctgtcccgaacaatacgaaatagtcaatcattcggcaaagggcaaaatattggtcctttttccgatcatttttcactaatttacttattttgaatagtttacgtgcgatcattcattgaattgaatctgatcagtgactgtcccaacgattttgggtttgagaaaattaatgggactttcttgcattgaattcgttgtaaattacaaatgtttagcgccttgaatgaatgttcaaaatccccttttgatgctgccttttcaaccactattcattttagcaaaatggtgcccatttttgcgccttctcgcgaccaccaacacttccaccggggcgagcgcggcttccgtgccacggtgtcggcgccaatcagcagaacgaaaggcgttgatgcgagcagacactttttacaccacccgcaaatcaaagagcgcaattcatccgacacggggagcggaagtaatggaaaaagagggaatgattggaaacagaatgtacaaattaagcgaagggagaaagtaaatacgaagaacagatggaacggttgagcgcgaagttcaagcagttcaatcggttccgttgcgaagtccaaccggcggatgctcggcctttgctggacgaaacgcggagaaacggcggagagaaagaagtgagggaattgcaaatgataagaaccaattaaaaacaaagaaatcacagacactggaaagggggaacagcagaagcaaagtggccatgtcagcaacggcggaaacaccgcggggaggggggacaaaggaattgagggcaaagacacaggcggaccgaatgagggcgatgtaccggacaaacaatcgcgaagtgaattattcaatgtgatatattctcccaaatttcagctttgtatgtacattaatgtaagatgctcatatccgaacctttaagtacccatgtttctgtgttttctcactattattatttgccaagtctcacaatttgtgttacatttattctaaattaaattaaacaaataaa

SEQ ID NO: 83271 - DNA, 444 bp, Heterodera glycines
  Genomic contig location: Contig_ID=SeqID_18618; Location=1346..1789; Strand=-
  SCN-specific regions: Sequence locations=1-333,356-444
atgatcggcggttgggccaagaagcgaaagcaggcgatcggctcacacccagcagaaaattggcaatttgatggccaaattaggagccaagaactgatcggggtcgacacttggccattggagaagcgatcactgatcagcagctgcaaaacggcggagacccatgcaacagtcagggaactggagttgaaccaagcgaaatacgacacgttttacgcccgcggggagcgcgactctcgagtggaaattgtgatgcgatttggcactccgcgggaattgctcggatggcacagatccattttcagtgatcagcacaaatacacagccccaccatgtggtgaaagggagcaaatcctgctcaacatcatccacatggacctgtttgcattgctgcacattttccaatcggtgccggcatttatgttgctcgaattggatgatcaa

SEQ ID NO: 83272 - DNA, 358 bp, Heterodera glycines
  Genomic contig location: Contig_ID=SeqID_18619; Location=1091..1448; Strand=-
  SCN-specific regions: Sequence locations=1-358
ttcaagtgtccgtttggggtactcaaacatttatggggcagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaaca

SEQ ID NO: 83273 - DNA, 2292 bp, Heterodera glycines
  Genomic contig location: Contig_ID=SeqID_18620; Location=94..2385; Strand=+
  SCN-specific regions: Sequence locations=1-200,222-637,659-1097,1119 -1151,1173-1232,1264-2086,2109-2292
  Gene Ontology: Mol. function=motor activity; Cellular component=non -muscle myosin; Biological process=cytokinesis
atgtcagtgcccgagcgaagccaagtctccatacagctccaacagctcggactggaagacgcagatgtgccaatcattcttgaacaacttcaaaaagcttcgccgacgcctgaggcaacactaaaagctttgcagacggtgcaagagcatttggcgaccaaacattttgcggaaaaggaagccaaaatgtggacagaactgggcattgaccagcaacaacagcagtcacaggcaatgctcacgttgagttcggcattggaggaagtggccaaacttgaagcgaaagcagcacgagaagagataatggagctaattgcttcattggaggggccggaaaagcgggcggagatcagagagatgaagccgactcaggaggaagtgcagagggaggaaagactgctccgaattgagcgacaggagcacgttcttgcgttggtaaagcacgtgcttagcgaatctgcacaacgacgcgccgttacgctgagcgactcgcagttggcccaagtctcggagcagttcagacagttcggcatgacggagatgggcacgaatgttgcactggaccgtctccaacagacaagcgacattacgggcattgcgcaaacaattttggctgattggaatcggctggaagagcggttgttgaccaaaagtgccatcgaagatgaagccatggtacaagcaacaatgtaccggattgatttggttaagccggaagcgaaaataaagctgaaaagtgaactgaacgaagcggcgaaaagggatttaaaagaggccaaagaggagttgaagacgttcatcagctcactgatgggcaccgaacaatgggagacagtgctaacccttcagagggctcagcgaattggagaagcaactgccatcacggcaagggccccgatcgagctgaacaccgagacagtcgctgaactgcttcaacttgatgaacaagcattggctggcgtcattcgaccaattgaattggcaagaaaggctgaagaaattcggttacaaattgaaaaggaagaatatgcagaagagatgaccagaaaattgatgagagatgaattcagagaggtcaaactgggcgagaaggaattcgaaaaggtggccgagaagttcaagcagttcgggctgaaagagacgaccgcaacagcagtcattgaacaactccaacgaatctccaaaacggaaaaggcattgaaactgaaacaggaggaaagggcggaactgttcatcaaaaagttggagaaggaggtgaaggagttcatcagaattcggaaagggtacggaaatgtgcagaaggaaaaggaacggaagcacgatgaacaacaaaaagtcatggaaattgtggcaaaactgatcaatgaggagttcaaggaggtcaaactggacgagaaggagcttttgcaaatagccgagaagttcaagcagttaggcttcgaggaaatgaccatcaccgccgttcttgaacgtcttcaacaacttgctgcacccgctctgctcaaagttgctaccggagaacaacagaaactggaggttgagctgttcttacaaaaactgatggaagagatccgagagtttgcacgcctgcgtataagctacgctaatgcacagcgcgctaaataccaagcacagcggttgagaggtgcagtcgtgcaagtgactgtgccgttgagagaacgtactatgccaatggtggacacggcacgtccggcagctgcagaagcggaggaactgtttattgaagagcagaaatgggaacgcctcgtctattggttcgtcaatgtcacgcgtcgctatgcggaagagcggttgcgcagagacttgcatgatgcgcgtcagcgagcggaggttgcgcaatacatcgcatttgaagggcctgtgagtgcggtgcagcgcgcacttttcactcccaccaccactgcaccgatattgcacacagaaatgacgatggacaaagttgcaggcactgaggaaatagttgcggaagttccatcgctgcatgtgccacaacaaatcgttataaaacacgctgaacccgttggaatggctgaacagcaaatttcgagtccaacaacatggcatgaagagctgaagatcaaagaaagcaccgcagcggaatggcacacaaagaccgagctgtacaagcacgaaattccaagacaagacgaggagacgacgcgtgttttgacggcaccgcatgagcagaaagcggaaatgcgagtacccgaagttggcaccgaaagcgcacaagccagtgacccaagtgagcaatgtggcgcgtgtcgctga

SEQ ID NO: 83274 - DNA, 55 bp, Heterodera glycines
  Genomic contig location: Contig_ID=SeqID_18621; Location=344..398; Strand=-
  SCN-specific regions: Sequence locations=1-55
atggatgcgctttgggaaaaggacgccccagggcaaatggatgcgattcggaaag

SEQ ID NO: 83275 - DNA, 1123 bp, Heterodera glycines
  misc_feature (695)..(695): n is a, c, g, or t
  Genomic contig location: Contig_ID=SeqID_18622; Location=1050..2172; Strand=+
  SCN-specific regions: Sequence locations=1-132,154-241,265-325,396 -415,444-530,554-641,663-759,781-1061,1083-1123
atgcaagtggtttattttattagacgccatgtttttggtgtgtgacgttttttatcacatgattttggtgggcgtaatgggtgctagcgcgtttgttaaaaactgccagcgcgtttgttaaaactgccaatgggtttgaaaacaaaaaatgggtaaaataattaaattaatagcttggctcaaattcaaccaaattaatatttcgtggtatcattcaatagctttaattgttctctttcagaatataattttcctaaatttttaacttaagtataaaagaagttataaagcattgaacaggctatgttttttgcaatggtaatgcatatataataataaacatttaaaattttaaagtctttaaaatgaaatttaaccaaaattaatttatatttcgatagccctaagaattctctatttatatttaaaattttagaaaatttcattgagtttcaaaaaagttctgaacaaaaaatgctgacttaagattttttgcaattttgtgacaataactttttttatacttaagttaaaaatttaggaaaattatattctgaaagagaacaattaaagctattgaatgataccacgaaatattaatttggttgaatttgagccaagctattaatttaattattttacccattttttgttttcaaacccattggcagttttaacaaacgcgccacacgccncgaagaattctttgtgatgtttactcaattgtcaatgccaatatgtttatataacatttgcaaaaaatggaaaattttaaatttttcttaaattcaactcagggtcggagttcgaattgagctgaaagaaggcaagacccgtccgtgctcacaaatcagcacctcaaattacccttagaaataattttgaaaatttcgaggctggatttatgaaaagacgattcagtcacttgaaagaagaaggtggttgcctggcgtcaattggataatgtcgccttgggacgataaatggaaattcatttgtcagggaatggcattccgcagaatttgaatcaattaattaaccgaaaagaacggatacaattacaaatggtttcaatttcttttgcgcctttccggttttgaccttttcaatgagtgcttcttta

SEQ ID NO: 83276 - DNA, 435 bp, Heterodera glycines
  Genomic contig location: Contig_ID=SeqID_18623; Location=491..925; Strand=+
  SCN-specific regions: Sequence locations=1-76,98-216,238-292,314-435
atgtcctttgctgtcgaaaagtccttctgtcgaaaagtcctctgtcgaaaagtccgtcgcccctttaaattaccaaaatttaattaaaattcaaaaacgaatgattttcttgatatatagatagatagtatatgggagacggaatatttttgaatttataagagtcagttttctagggcaactaatttttgcatcaaaaacctgggttacatatataccctttttctgattcttaactagacgaagactataatcacaatgaaatataaattttcagggcttccataagggattaagatttgattttgatcctcacttcgtttccgaattcaccgaagaaaatgattggccaaagttggacgtaaaagccagtggaaaatttggcaaagattttctgcgtgacattgtcacctctttaaatccatattcggcacg

SEQ ID NO: 83277 - DNA, 938 bp, Heterodera glycines
  Genomic contig location: Contig_ID=SeqID_18624; Location=4..941; Strand=+
  SCN-specific regions: Sequence locations=1-24,46-224,247-542,564-839
atgacgaatccaacgattataaggattcaagaccaaagttcaaaaagagaaagagcagatacgggagaaagtgctgggtacgagcgaacgcagtgggaaccgcagtagcaagctgtcacgcagcagttcagagacacgacagcgtagcagaggcccaacggtgggcgctataaatttgtgctagccaattctgtaaaaaccaacacatgtgcaattatgtcgaaaaattttgtcagaagaaatgcttattattgtttgtgctaggtcatttcgtaaaagtgccaattttacattgtctatataaaaactcgtcaaaacttttcttaaaaacaaccgaatcaaatattcttggtaataaatgatgattcataattttgttctataagcatgaaaaatttcagaaaacttcattcagtttaaagaaagttatggaaattttttgaacatttttggtcacagcttcttgaaaactgaataacattttttgaatttttcatgctaatagaacaatcaaatagtagtatgatgccaagattattaagttgggttttgaaaagttaatgcgagtttctctcgaaatctgtaaaattggcacttttaagaaacgacctaacaaaattattgtgtacattatctttttggtggaattgaataaatttcagttgtcgaggaacgtgtccatttcatcaacaacatcgtcagcaagtggggtatgtaaattttttagcttacttttttatttaaatgtagagtgcgccgggaccgggacttgccgggacctgagaagccgggaccgggacctcgatttttttcgggaccgggaaccgggaccaaccgggaatttttaaaaattcaaaaatttttttaaaattcaaattttaattttttttcaactgaaaataatacaaaatataaatttttattttgttttttattta

SEQ ID NO: 83278 - DNA, 2988 bp, Heterodera glycines
  Genomic contig location: Contig_ID=SeqID_3116; Location=1295..4282; Strand=+
  SCN-specific regions: Sequence locations=1-715,737-802,824-1347,1369 -1623,1645-1684,1706-1825,1851-2349,2371-2865,2887-2988
atgcccacaactcacttggatcagcaaataaggtgggggtaatcatttcttctgaacttttagaccaaggcgacattattgttccaattacaccaatttcctccaatgtcgtagatgcagtttttaatcaattttgtaaagtggagcagagtaaatccaaatacgtcaacctctacggtgcgccgtttatgatcacggtcacagtacttaacactgacggacttccccgacaacgaacaatcaaaggcaaagggcaccctccttcttcatcatatgcccatatttttaaaatcaacaacaatgacaacttttgcctattttatgccattgaattaatgcgctattattcattgtataaacgtaatattatttctagagacaaatggcgttggattagtgacagacaaactacagttttgaggcaaaaagtccatcttcttctccgagaagcagggattcccacaacagaaactgaatatgacgcggaaatttacatccatcaagtgcaaggattatggaatattaaacacccgggcgaatataagatttttatcttcaacgactatcaaaaccgccctattgctaaatctgatgtcaccgactaccagtttcccatactcctctaccataataattatcattttgatggcattaaaactctttctaaattcttcaagaagcgttactattgtctctcttgtgaatgtatctacgaccgcaaaacaacacattctatgaactgtacttcactctgtcacggctgccgggaggtgggcgtcgactatccgtgtgagcctcagcaaatgtacttcaaaaaatgtgagcactgtaacaataaattttacaacatcaactgctatgaacgacatcttaaaaatgatatctgcacaaaattcccacgatgcaatgactgtggtgtaatatataacattaaatatcattcaactatgagtcatcaatgtggagaaaagttttgtcgcctatgtaaacaatttcacgtaaaagaggaagacgacgagaatccatgcagtagttgttttatccaacctcttaaacaacaaaaaatcaaaccgtaccggatcatagcttacgatttcgaggcaatacaggacaaaaaagttggaaatagtttcgaacacgaagtcaactttgcagcggctaccgtcatctgcaccaattgtattaataatgaagaatggaaaaactcactagagggaaaacaatgtgctatatgtggccccaaccgtacaattacattctcaccatttgattacaaagagacaacagtagaccaaaaaattgtcacccagcaaactctacgggaatttgtccaatggctactatttgaacaaaataaaaaatacccaactgtagcctttgcacactttgggggtcgctacgacatgacaatgatcatcaaggaagttattgcacacggtacaatttttaatattcatagattatatattttttaaggtgttcacgatccacaaattatcaaacaaggaaatcgtctttatgaactcaaaattaaggataatgagcatgccccactaacaattttccatgacagttacaatttgatgcctatcaaattatcgggtctcatcaaatcatttggactcaaaattcaagtgattcattttcataaaaattatcaattttttttttaaggataaacaacactttccacacatgtttaacaaatcatctaattatgaaaatgttcttactaatttaccgccgtgcgaaaaatactgtcccaatcaaaagaaaaaaactgatctgcaaaagttcaacgaatggtacaacaccaattatgaccaacattttgatttaaaagaaaaattacccgaatactgctgcaccgacgtcaaaattctcacccacgccctcgtcgagttgcgccgggaattcaaacaattaacacaaagagaaggaaatcatagaggaattgacattctttggcaagcaatgaccaaagccagcgcctgcgtcaaaaacgttgcccttaatcatttgagatccaactctctagctatagtcccggagaaaggctacaccccacaacaaaaccaaagtgcactggccaacaaatttcttgactggtactctcacataaacaacgttcatgtacaaacggccagttcccgctacggagaatatatgtttaaacgtgaagggcaggtttatcaagtggacggctacattaaaggcacaaatgggcagcgggacaaaataattgaagtgaatggttgtttatggcatgggtgtgaggagtgttttgatgatatggatgaagagacgaggatgccaaacgggaagacactgggggagattaggctaaggaaacagaggaaatatgaaatacttaggcggtacgtcgacttggaggtggtatgggagcacgagatcaataaacaaatgaagagagacaaagagatgagggagtatttcgaaaactggaaggattgctcacctatcaaaataagagaagcatttcacggaggacggacaggaccaatgaaactaatccacacagcaaaaccggggcagaaaatcagctacaaggacttcaccagcctctacccgtttaccaacttctctacaaaatatcccctagggcatccaaaaattatttctttcacgaccaatgagcaaacggtcaattggctttctccaactgacaacccctacaaaggattacttaaaattcttctacaaccaccagacaacaacgtcaaagttactgtaatgccaataaagtttgatgagcgcctgctattccctctctgtgaaaaatgtgccaaagttattagcaacaaatacccaaatggcctcaaagacaacgaatactcctgcccccacttcaaccccaacgaccgcgcctttgtatcaacctgcacccatcttgaaataatgcagcactggaggccggctacaccgcccgcaactttctcatgtcctacaatacgaccaatggagtga

SEQ ID NO: 83279 - DNA, 983 bp, Heterodera glycines
  Genomic contig location: Contig_ID=SeqID_3117; Location=690..1672; Strand=-
  SCN-specific regions: Sequence locations=1-20,42-57,135-316,339 -830,875-911,970-983
atgtttgatgacgaggagatagaagaagagaaggaagacgacgtgtgggctggcttggaggaagaagaaggggacgacgaaaaggaagaggaggaaaaattggatgtaaaagaagaggaggaaaaagaagaggacaaaaagatttgtatttattcttagacataatcaaattttttccaaagggattttcaaatcggaaaattttgacgaaaaagggcaaaatatgcaaaaaacctgaaaatattggtaaaatatgcatgaaatattcagaaaaaaaacatgcataaacccaaaaataggcaaataaaagtcccgatttttatgcgcaaataccaaaaagatatttttcctattaaataccctacggagaaccctggagaaaaaatgcatttgcatattttgacagctttgatgattatattattttgaattttgcaaaaaaaaaaattaaacacaatcaaagtacaaagtttcaggccttagcggcggcctttgcagggggctccgatagttttgcttaaaaaagtgctttttattgaagggcctattaaatatatttcatttgtacatacattgaaggcaattattggggcactaatgattggtcgggctctttgcatggcgggcattgtttgactgtgttggcgtcggtggattctcttctgaatataatagtagcttttaaccataataaacttttaataagtaaaaattaaccataagtaaagatacggcaccaatgatggtgaaagtgcaaatcttgcaaaaatttttttatttgttacagttataaatattaacattaccatcagaataattgtgataaaaattgataataataataataatgatgatgatgatgatgatgatgatggttgaaatggtggtggttgggtgctgaaaatattagctataattattaaaatgatttgttattattatgattaaatgattaatgaattaaaaaaacgcaaaataataaa

SEQ ID NO: 83280 - DNA, 108 bp, Heterodera glycines
  Genomic contig location: Contig_ID=SeqID_3118; Location=36..143; Strand=-
  SCN-specific regions: Sequence locations=1-6,99-108
atgcttgatgacgaggagatagaagaagaagagaaggaggacgacgtgtgggctggcttggaggaagaagaaggggacgatgaaaaggaagaggaggaaaaattggat

SEQ ID NO: 83281 - DNA, 1506 bp, Heterodera glycines
  misc_feature (1313)..(1313): n is a, c, g, or t
  misc_feature (1431)..(1431): n is a, c, g, or t
  Genomic contig location: Contig_ID=SeqID_3118; Location=384..1889; Strand=-
  SCN-specific regions: Sequence locations=1-301,324-375,399-542,583 -900,934-1220,1312-1393,1415-1444,1466-1506
atgataattattatggtagaggagtatgggaaactggtagtcggtgacatcagatttagaacaaagtgaatattgtatgttcacttttgttttggaaaaataattgattaaaaaacaagatcgtaagaaacgtctgactgatattactccatcttttgtctcttcaatacattcccagaaattatgtacttatccatttcttttctgataaatccaattttctgcttttcatcacttacttttctcgatgaattcttttgcagtttctcttcattagaaaggcagcaataattgctatttgtttggccaaataccaaaccaaaaaatactaagaacattattttattcacttttatttgaatatttttcaagttcttttatattttatttatttatttgatttctcgacacctttactaattcggcatcataaaatattcctttaatgttatccccatttaaatcttcaattcggtaagcattccgggttaattttttcgcttcatttaaaattttttgaatcccagcaaaacttgccgaagattttaaattataataaatttttgatagaatattatatttgttcattttgtttttcattatcgataatttttgttttatattttgatttctagatattactatattttcatctttttttgcaatattcgatgaaaatcgctattttctgtgtatttgctttttttggacatgtcttgttggcatgaatatctacaaatacataaaaacacacgcatttggcccaatctgcacctgcgcatgtaaacaaacacaccccctgcatctacacctgacacaaacccacatacacctgcctgcacccaaaacacacgtgcacacctctgcatttcacctaacttgtatctgcacctctggccggtaccaaaacaaacacacacacataacacgcatttacacttaacctgtatctgcacctgcacacgcagacattcacgcatcgcataaacacctacaggaggccgaggatgcaggcgctgatgatcaaggtgcgtttatgcgtcaattaaaaagcaatttaattagatttcgttgcagtttttattgtaagaaaaaattttttccgttttttaatttataaaccatttagtgaaaaaaataacaatttttgagaatatttaaatgtttttttgaagaagaaatgtcgttttataaaaattaaatatgtaagccaaaaggtctaatttattttcaatattcaaattattattatgtttatagttaaaattttaaaaattaaactttttaaaaactttttttttaagaatatttgntcataagcgaccaaatggcgctcgatgtttgatgcggaggcttcaagaagtagacgaggaagacatgtcggaagggatgagaagggaagagaaagatgatgcttttagcaccgacganccaggggagtttattgggtttttaaaaaggtgttaatttaaaaaacccgatttagttacagttttgggcattaaa

SEQ ID NO: 83282 - DNA, 56 bp, Heterodera glycines; identical to SEQ ID NO: 52733
  Genomic contig location: Contig_ID=SeqID_18625; Location=859..914; Strand=+
  SCN-specific regions: Sequence locations=1-56

SEQ ID NO: 83283 - DNA, 1434 bp, Heterodera glycines
  Genomic contig location: Contig_ID=SeqID_18626; Location=1050..2483; Strand=-
  SCN-specific regions: Sequence locations=1-690,712-872,897-1006,1028 -1114,1153-1229,1252-1334,1356-1434
cacccatcatcgctatcccactttttgctcagcacccatcatcgctatcccactttttgctcagcacccatcatcgctatcccactttttgctcagcattcatcatcgctatcccactttttgctaagcattcatcgtcgctatcccactttttgctcagcattcatcgtcgctatcccactttttgctcagcattcatcgtcgctatcccactttttgctaagcattcatcgtcgctatcccactttttgctcagcacccatcatcgctatcccactttttgctcagcacccatcatcgctatcccactttttgctcagcacccatcatcgctatcccactttttgctcagcacccatcatcgctatcccactttttgctcagcacccatcatcgctatcccactttttgctcagcacccatcatcgctatcccactttttgctcagcacccatcatcgctatcccactttttgctcagcattcatcatcgctatcccacgttttgctcagcattcatcatcgctatcccacgttttgctcagcattcatcatcgctatcccactttttgctcagcagtaatcatcgttaacccagtaaatattcaacaaagaacatcgttaacacacttcgactttacccaacttccacgcataacagttttgatacagctttcatcgcaaagcaatagcttagaaaaagcttttaaatagattaagctttcgaacgactccaccaatgtcggatttggtttacaaagaaaaaagttatagccaaaaacatgctggcgccgaaacgggagcgccgaaacggcacagggacccctagttacaaagcgtagtattttgaaaattttttcacttttttttgacataatttttttttaaatttatttacacattatgatgaatattaagcattaacaagacaattatggcgactaaaaagtatattcacgattttttatctcaaaaaaattttgcaaaacaaaagggtcccccctattgtttttgataaaattaaaaatctgtcactttataactagcgccaaatttgcttaataggcccaaataattgtcatatccatgatcagcgacctctaaaacccccgggtacttggtttcaggactttttaaattaaaaacaaattatgtaaaaaaaaagtgaaaacattttcaaaatactacgctttgtaactagcgccgacttttcaattgtgagctttgattctcttcctcctctttcagacagttggaagcccgtccaattcgactttctgctccattccgtgctgttgcgctgctctctgctcgagttggtcgagcagcaacagttgtccctggagaatgtgctgcgcatcgaatgcattcgccagtcacccgccccgcggccgaccgccgaactgaacgaagcgcaatgggtggccgatcttag

SEQ ID NO: 83284 - DNA, 1572 bp, Heterodera glycines
  Genomic contig location: Contig_ID=SeqID_18627; Location=340..1911; Strand=-
  SCN-specific regions: Sequence locations=1-6,28-193,217-728,780 -898,961-1355,1384-1572
atgttgtcctcatcatcatcgtcagcgcctgaggaaggggaattggacgaagatgttgccgaagaaaatcagccaattattcagcaacagcgatttgacctgcttaaatcgagtagccaaagggatattctaagtgcaaacggatatgagtaccattttgaagcttacagtagaactgaacagggtaaaagcccaaaatttttgcctaattgatttaaattttgcctaggaattgagtattggaaatgtgttaaacgccgtccctattgtcctggaagagttcatgtcgctggagcaattaatagggatgatgatggcgggcaatacaaagtcggggttatatgcaattcccgggataatcaccctcctgtacatgtgtctgtacgaaggggacaaatggagttgcgccgatttgcagaagcgcaaaatcctcctccgaccagacaagccattgacgatgtccgaaccaacatcccaccggatattcgggcaacgcaagctcaatcttcctcagcaatgggaagatcatttcggaattacgtagcacaggcacgggctgaagtgggagatgatttgcttgattctcctggagtgattattcctgatcggcttcgtcaaataacaatttttgacggtcatgaggaaggccgacgactaattgtttttatgtctgagtttggccgaaatttgatcgcaaactacggatctcatatagcaatggatggcacttttaaagtaataaaaaaattaattatcataatatttaaaagtaattaaaaggttgcgccgagcccattcactcagctatataatattagtgtccttatcgatttcgttgcggttcctgccgtttatgctttactacagtcaaagagcactgcgcaatacgcacgagtacataaatataaatttaaaaaataatttacactcaaatattaataaaaaatttttattttttaaggttttaacatcagttcgccagcttttacaaaattggcatcctgaaacagtgatgacggattttgaaagatcagcaattaatgcggtcaatcaaattttccctcttgccgtgcatagtggctgtcttttccattatgcgcaatcaatctaccgaagggttatcagagttttttttttgctaaatttcataaaaatataggttcaaaatttgccgggactcaacgagcggtttttaaacccgcatgatccggatgatacaaaaaccctgattaaatcactgatcagtctcgctttcactcccccaggcgaaccactatataattatctgtgtgttcttattagacagttccctcaagaagaggaagtcgaaggtacggtaaaaaaagtttcctaagattaatatttaaaaaaataattaataaagaaatcgtcaaatattttgtgagaagttgggttggttgttcgcgtgttatgcaaattgctgctgtacctattgaagaggaagattacggtggagccgatgcatggatcaggcattggattgaaaatgctggattgcaaaatactgatgcaatttttccacaagaaatgtggaacatgtgtgatcggtaa

SEQ ID NO: 83285 - DNA, 303 bp, Heterodera glycines
  Genomic contig location: Contig_ID=SeqID_18630; Location=920..1222; Strand=-
  SCN-specific regions: Sequence locations=1-303
atgtacaatacaatcaaaaataaattggccaattttcggacggagaatttctggcttctcctaatcgttctcggttagtataattaatatcatttttgttaatgaccgtttttcactcattaatatttctctttgctttacacatgttcatctttcagtaccaccaattgggctcgcccggcgtcaaatgagttggatggaggtggcacagcctacaattaaattttttacatgggcgcttcgtaaaactgcgaaatttacagaatttttgagaaaaattagtcataacttttcttaaataaa

SEQ ID NO: 83286 - DNA, 1824 bp, Heterodera glycines
  Genomic contig location: Contig_ID=SeqID_18632; Location=38..1861; Strand=+
  SCN-specific regions: Sequence locations=1-76,99-239,261-270,296 -436,461-961,984-1091,1113-1273,1296-1332,1370-1622,1649-1700,1740 -1824
aatatcagtgaatgtgaaacggatggtgatgatggtgatcattcatattgtgacacagaattagtgatcagtgctgatcaaattgatcagctccaaaaattgccagacagaaacattcacaaaaacactgttatccaaattaatgaaaccggtcagagttttcatgggcgaaaattgttgcagcaacagccgccaggtaaaaatgtaaaaatttattaaaaaaacggatttattttttatctttgaacataaatctataatatgtatgagattaaataaaattttaattttttttcaatgattttggcaactttagcaggtttaggtgccgaatttttaaaatatagtttctatcaaaagtcttgaaaacatatttccgacagggccaattggacggaaaacttttttgaccatgcatattttttcaaatcaattcaaatttttgataaatatggtcaaaacagatgcgtctaaaactcataaattttcttaaaaaatggcttaaatagcaaaaattggtcattttgggtgaaatatagtacaattcacaacctaattccaaaaaattttctcggcgctttcgccgcagtcataaaattcactttatatgctgaattgactcagataccggaaagcattaaggattgacaaaatttgaattaaaaaaataggtgggaaacgtttttcaaaaatttcggcttcgaaaatttcgtttttttgtgcttcgaacttcaaagttcgaataaaatttgggctttgccctcggctgcggcttcgagagctaagccgagcttcgttcaccctctgctgctcccgattaaatttgattttctcaacaaattttacagtatgtccgtcgggatatgtgctatttaattacatgaacgcatgcaattatccattgtctgtgaccgcagcgagcagagaatatcccccagcaacaacatccgttgctgctaacaaacaagtgtctgtatgtgcacaagctgtgatgtcatcgggacgagtatgggccagcaccgactgtactgtacaggtagaacacatacagtatacggatgcgggaagatggatgccaaacatttgtacattttaaataaatagattaagaagcgttaaattctgtaaacaaaaaaatcggtataaaaaaaattccaaatttccttccggcgacgctgtcggcgttggcatcacacagaacaaacctaaatatttttttagattagggcttcttttggttagaatatcttaaaacctgacgatgttttttttgaaattttgcagaatactactcatagagaacattaggactattaaatgattcgtaagcaattttttaaaattttggcaaaaataaaattaagacattcatttttgtactgtatttaaggattcatgtgtagcggcacagccacctgtgtcgctgtttgagatgacttttaacgccgatggcagtcagtttatggatgttagctatgtggacggaattagtgatccgatcggtgtccgtgttaaaaactgtcagcagggacaggatcagacggtcacatttgacccacaggcggtggccaatttgcgggcaatgtttccacaaatggctgaaacggacaccgaaactggcgtatgtctcaaaaaatatatataataatggccagaaatggcacagataatagtggaaacccttttttaatagctcaaagaatttaaaatatttttttttaaaaattaaaaataataatggcatttttgaatactaaatgtttttgtttacatttttacaggaattttgtgcaaaattagtcattttttatttgtctgtttgga

SEQ ID NO: 83287 - DNA, 667 bp, Heterodera glycines
  Genomic contig location: Contig_ID=SeqID_18633; Location=10..676; Strand=-
  SCN-specific regions: Sequence locations=1-65,89-483
atgcccccgggggtggtgccgtccctcgcttcgcttaccctttttctaccgtctccgcctgcgttggctcccctcggccctcccccgctccctttggccgtctcctccctttccgtgccgttctcttcgcctcgcggcgtcgtccctccgtttgctccgttcgtcgtctttttttgtccgttctttttgcctatttcctcattcatttcatttgtgtcatttaaaaattgctgcgaaagttgtaaaagtttgtcaattgtcgccggtgtccgtagattttgttgtttttgtccgccatttatgcccaaggaaaacgccgtcacttcgtccattgtcatcgccgctgaattctttttgaaattctgcgtttgcgcaatgctttcagccgaaggcaaaaagccactgattccgaaattcgcgtcaacgaatgatccatttgcgatccgttcaaaaaggccaaataaatttgctgttgagagaggtgaagagaaagggggagaggaggaggaagaaaggggcgttgttgtcagaggagggacaataggaggaggaggaggaagacgagaagcatttgttgaagaggaagagacgcaaggcggaggaggaagagttggtgctggaagaggagggaaacaagaaatgggaaaggaaaggagggggggggggg

SEQ ID NO: 83288 - DNA, 2857 bp, Heterodera glycines
  Genomic contig location: Contig_ID=SeqID_3119; Location=232..3088; Strand=+
  SCN-specific regions: Sequence locations=1-282,304-642,665-918,940 -961,983-1096,1131-1496,1528-1763,1797-2155,2190-2207,2238-2258,2349 -2511,2546-2734,2764-2857
  Gene Ontology: Mol. function=calmodulin-dependent protein kinase I activity; Cellular component=membrane; Biological process=induction of apoptosis by extracellular signals
ctgcaacccaaacgtgcaagaccaagccggggacacaccgctgcacatcgcggccgaacgtggactgggcccggctgcacaatcgttgtgccaacttggcattccggtcgatgtgcaaaatgcggtcggtgtataaaaaagaaacaagcagcgttattgctcgagactcaagaatctcgaccaaatgattgccactaatagaccatgggatagtgacttttgctgtttcagaaaggcctttccgccctccatttggccgctcgccatggccacattgacattgtgcgctgtctttgcttgtccggcgcaagtgtccatttgaaatcgaatgtaaatgatgttggtcttttccgaatttgtgattttatgccgcctttaaggatggcatgaccgctgagattatggcactagcccaagagcagaagcaaattgccacacttttggccaaagtgaggccggagaaagcgcgcacaaaattcgtcaagcaactgtccacagtggaaggcccgctgaagaggatcaagctgaaggtgttcggacatccaggtagccgagctaaccaatgaaattgatcaattactgattggtgtttgccgatcgcattatatatactgattaatcggcttggtaataaaagccctgaaaatttcccctttttcccaacattgagtcaaatggattacttatttatccctcatccgtcccccaggggctggcaaaactcggctggtcaatgccctgcagcgctcctccgcctcctcgttgaactcgctgatggagtcggtcacgcgtcgcttctccgacaatcttttcccggctaacagcagcagtgtggtcgtctcttcttccacctcttcaggtatgtccaaatatttaaatttcgtagcattttaacattttttgcccccgctttcctccgacctttttaatttcaaattaggaccgaaaagaaaagcccggcttggccatgtcatgcaaagtttatccgatttttcttattctgcagaccaaatttcgccgactttgtgtacaatcaatggcagttcctcctcaatgattatggcatcgccttcaaaaagcggtatgttttttgtagggaaaaatgccttccccagggataaagggcagagtttttaaaaaatctaacaagaatattcatttgttaatctcatcatgggcaggtgaagcggaatcgtcggccgatgagggcatccattcgggagtgccgtcctcctcctcgaccacctcctcttcgtcaaccaacggcgtcgtcggcattggccatcggcacaaaacgtggccatgtgcggagcgcaactcatcagggcgggcgccgacgcagggcattgacattcaaaacgtggcatttccaggcaagaaagaaaagcatttggagtttccaacgtgcatccacctaacaaccggttgtgtgatgctcgagagttgactttcggtctcgcatctaaattcaaagtctcgcgcggaccttgggcaaacaatagaattattttcattaaagttgtttttgatctcgacagattgcggcgagttttccgtgtgggacttctccgggcacgagcccttccacatttgctacgaccattttgtgggcaacacggactgtgtgcatttggttgtcacccgatggtatgtcggcggcacaaaaaggaatcttttcgctaaaccgttgttttcaatatattcttaaaagaaacggattgccattttctgtatctttcggtatttttgttaatctcttttagtatataaaatccaaaacaaattttttgaaattaatgagttgggttcaacaaattagtctcgtccaatacttcgttttaatggggcagacatttttaattaaactccattaattcagttcggacgatcccatggatgagtataaggtgaggaacgggcaattagccaaacattgatacgattattcaccttcccccttgcccatttaaggagttgctgtactggctgaacttcctcaaaggccgcgtcacgcccagcgagccgatcggacattgtggacaaatttcgcgtcgatcggtggtggccatcgcaggcacatttatgggcggcgaatgtccgatcaccaagaacgaggcagaggcgatgatgaggacgttgaagatgaggtgatcaaagagaaggagagaagagaagagagagagaagagatcatcagaaatagttaaggaagaaagtgataaaaagaaagagagagtgccttgagacatgcaaaactgtagagggagattgaaatagggagaaaatgggaagagattgatcaaaaagatagttgagaaggaaatagatagagcgagagagagagagaaaacgttatcaaaataatggtaaagagaagagagtaaccacggaaaacggaaaagtgagtaatgagagattaaaagaatggctaaatggaagagaccagtgagagaaggggaagaatgagagggaaaaagaggacagagaaaagattaatatgttgaaggacaaattcaaaaactaacttttaaaatagttttaaacattctcaaactcccccccccccgcactttgcaggttcgaaacccatttcgacatccatggccaactgtttctggtcgacctttccgcgcagtccgattgtgtcggctctcgcgaattgcgtgcctttttagcgcgtcaacgggacagcattttgatggtattagcatttaaatgtgtgctaattaaactcattaccattttgttttgattttcagaggcttcaacaccccctccgaatgttggactctgcgctggcctttttggagcaactccgtgaacaatacgctcaattcccatgcatcacgtggccttag

SEQ ID NO: 83289 - DNA, 2115 bp, Heterodera glycines
  Genomic contig location: Contig_ID=SeqID_3121; Location=505..2619; Strand=+
  SCN-specific regions: Sequence locations=1-84,106-354,418-418,453 -636,658-1180,1202-1332,1369-1407,1445-1464,1489-1622,1644-1937,1959 -2115
  Gene Ontology: Mol. function=calmodulin-dependent protein kinase I activity; Biological process=induction of apoptosis by extracellular signals
atggaggaagagagtgagacgcaagggaagagagagaaatgggtcgcggtcgttttcgtacgagcacaaatttttgtctataacttttttctttgccaaccaaatccgataatcctggtatcattcgatagccctaagtgtcctctattagcctgcaaaatctcgaacaattttcttaaggttttatggccagaagaattcaaaaaatggttatttgaacattttttgccataactttttgaaccttaacaaaattgttcgaaatttcgggttaatagagaacaacaaatttttttaaaaggctgaaattattattttctaaattttttggaggcttttttgtagtgaaagacgaaaaaaaaattttagtttattcaagtttgatttaatttttctttaaataaaaataaatttaaagaaatcaaatcaacaaattttatttacttaaaaaacctctaagaattagaaaactattaatttcagttttttattttatttttttcaacttccatttttgttaggtttgtttcggctccaaagaagctgccggtctgctcacgctcggcgtcgacatttccgtctcccaattgcaattgtccgcccgctcggaactcgccgctttgctggacgcaccgaacactttgggcatggactggagcatcctggcggtgaagctgaacttgactgaacaaataccggaggtgggttaattagctatgataattgattggttattattagggctgccaaaaatatgtacaaaaagtggtccaaatatgtacataaatatgtaagaaaaatcccaaaatatgtacaaaaaaccccaaatatgtaaataaaatttttttaatggtattttttgggaaagaaaatccccgtaaaatatgaaatagccacaaaatgacataaaaattactttttttggtatttttaggcaacattttcaaacttattttttctttataaatcttcaaaatatgtaaaaaaaatgaaaatatgtacaaaaatatttgccgaaattttggatttttttttgaggattttcaaaaatttccgtaaaaaatactcaaaatatggtaaaaaaatgaaaatatatatgaaaaaaatccaaaatatgtacaaatatgtaagaaaatcccgaaatatgtaaataaaagtcccggtttttgttcgcaaacacaaaaaagaaagtgtttttcctgctatttagagcaaggagaagccaggaaaaaaatatgtatttacataaaattggcagccctgattattatcccatccattagggagtggcacaaatgccatttgctctttttcaatggcatttatcacttcataaattttaaaattataaattttaaacattaataagttgcagctgattttaatattctaattacttgcaaagtattaaaaaacttttgggttttttgattatttttatggcaattgaattgcatgccaatctattaaatttattttgattttattaatccaatcgaaatgctcttttgttatgtcaggtcgactcgtcaggccaatcgttgtcccgcactgatcagctgctcaccgaatgggcacttcactcgcccgacagcgcttcggtgggcaaattggcctccattctgcaggagatgggccgcaacgacgtcaaagaggtggcagagcaataatttcattgacttaaatgaaataggttggggggatttcgcattggttggaagaaaaatgtgaagcgattagtgaagctcgagagtctcggtctcaattcttgacttgagaaaagtctcgtttttgggtctcgggttttcggtctcggagtcactctcggtctcgaatctcgggaaattttctgtctcgagcatcattagaacgaggcggggaaaggtcagagatgaaagggataagagagaaaagcgatcgtaaaggcgaaaaggacaagattttcaaaatgaaaatattgagtagatgatttttggtctcattcctttaaaaatttcatcaatttcatccaacaaaatgggacttttcaaattttttctcggcgatgcccacaaaaatcctaatcattaaaaaataggcgcaaaatcgcaaatttggttttttggtgaaaatcta

SEQ ID NO: 83290 - DNA, 685 bp, Heterodera glycines
  Genomic contig location: Contig_ID=SeqID_3122; Location=3..687; Strand=+
  SCN-specific regions: Sequence locations=1-68,90-685
tgactttctgaaaaaatatttatgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaac

SEQ ID NO: 83291 - DNA, 1080 bp, Heterodera glycines
  Genomic contig location: Contig_ID=SeqID_18636; Location=818..1897; Strand=+
  SCN-specific regions: Sequence locations=1-385,407-771,793-932,954 -1080
atgttatgccaactgttcgcgctcatcggatgccctctttttctgcttctgatcgccgacattgacaaagcaatcgccaatttgtttcaatttttattgcaaggattcaccgagttgacaaggaaaatatgccggaagagaaccgcgaaaaagagtcccattaccaatggggaaaatggggtaaaatgtgttgaggacggaccacaacagcaaaaagggtgcgccggtgccgaaaatgggtgccatttgggcacaacggcgacggatgagagagtgtcggcattggcagcagtgccatttctgttcgccttctgcgcattgactgcctttgcctacgcacatttggagggttggcattggttggactgcttctacttttccttcatctccttttttgccattggttcgtctcttccccttcgatttgttctttatgtaacgggtgccaaaatcattcctcccccccccaccttcttgggactgtttttaaccattttcctactgtaggttacggtgattttgcgccgtccaattgcgcttctgttctgttcacaatttgctctgttgtcatcggaatgtccatgtgagtttttgagcagtcctttccaaattcgcttctctttctttttcagtgccactcttttgctcgattttattggcatcgaatacatccgaaacattcatcgaattgagagaacggcgaggggaaaatgttgtgggagagaacggaaaaagggcagcagagggaaacggaaaaggacgagcagaagccggaagaaatgaagaacagggggaaccattgagcaactgctgatcagtcacccggccatcaatcgataagtgatcacttattttgcccaccactaccctgacctatgaccattttttagcctaccattaaccgccgatcactctttgatcagtcggtgggtcagtttatttaaccattcactgtgatcacttaccatccctacgccttattatgccaattaaatttggtgttagtgatcacttattttcaaccaccgtccctttgccagaccaatttttgatcagtgatcactgtttgctgataaatca

SEQ ID NO: 83292 - DNA, 986 bp, Heterodera glycines
  Genomic contig location: Contig_ID=SeqID_18637; Location=939..1924; Strand=+
  SCN-specific regions: Sequence locations=1-157,179-200,222-420,445 -527,549-631,658-986
atgagcaaaatcagtcgaaggaattgggcgatcagagattttgtacgtttaggtcaaatcaccggcaaaatcggagtcaaaaacgaatggaaaagcgaaaaatatgaagaaaaagttacgcatcaaaaaaagggagaagaaaaaggaggacttggaggagttgaagaaggaaatgaaaatggtgaggcgaacaaaaacagaaaatgattattgtttttgggcggctttttcaggacgaacatcgcgtgccattggacgaactttgcgaattgtatggcacaagtttggagaaggtgccgattcgcgtttcaattgagcattgttttgttgaaccttttgccccagggcatgccctcttctcaagccgactgcgttttggcccgcgacggccccaattcgctgtcgcccccgcggaccacgcccgagtgggtgaagttctgcaagaacttgttcggcggcttcgcccttctgctgtgggtcggtgccattctctgttacgtcgcttattccgtcgatgcgctgactttggagcggccctcaaaagacaacgtaaggcaaagggaacgaattgacaattaatcagtgattgattttgatcactttcagctctatttgggcattgtgcttatgagtgtggtgatcatcaccggctgcttccaatatttccaagagcgcaaaagttcaaagattatggaatcgttcaaaaatttggtgcccacttatgcactggtgatcagagacggcgaaaaacggcaggcatggcggagtgacagaatgccaaaacgcgggaaatcaattttcagattccaagcagccaattggtggtgggcgatattgttgaagtgaaagggggcgacagagtgccggccgacattcgcattacccaggcccatgggtttaaggtgggtcaaacgcggacacaaactcatttaaagcaattagggcactgtaaccgttgcgttatacagcaaactcatcatcattca

SEQ ID NO: 83293 - DNA, 1118 bp, Heterodera glycines
  Genomic contig location: Contig_ID=SeqID_18638; Location=250..1367; Strand=+
  SCN-specific regions: Sequence locations=1-375,399-419,441-483,512 -583,605-989,1011-1118
  Gene Ontology: Mol. function=sodium/potassium-exchanging ATPase activity; Cellular component=sodium/potassium-exchanging ATPase complex; Biological process=transport
atgggcacggcaatggacaccgacactgggcaggtgctactccgcgtggccgccttgtgcaaccgagccgagttcaagccggggcaggtgataagagcaaaagcacacaaattggcaaaaaatacggaattttaatttattcttacggtaaaattattccaaaatgcataatcattagcatgcaattagcgacattagcagcattttcattactcgatgctcactttttgttagcacgacgtgcccgttctgaagcgtgaatgcaccggcgacgcctcagaaattgccctgcttaaatttgcgcagctttcgcttcccggggaagacggagtcaaagaatttcgccgccaaaaccaaaaagttgtcgaaattccgttcaattccaccaacaaataccaagtcaagcgtttgcatcttaacttaattttaggaaatacaaagttcaggtttcggttcattacaccgcggcgaacgaaggcaatttgctggtgatgaaaggtgccccggagcgagtgctgtgccgttgcgatcggatgctaatcgaaggcgaagagcgacccattgacgaagatttacgcgcggcttttgagaaggcttatttggagctgggcggaatgggcgaacgcgtgctgggattttgcgactgcgcacttgacaaggaccgatacaccaaggtgaaaaataaagaaaaatgaatttaaatgaatggggggaggaaaagccttaggggagggaaacaatcgacacaattaacaaaacggaaaggctagaattggcatcgtttccagcaattccccttcaacgcggatgagcccaacttcccgttggaaggcttccgtttcctgggactcatttcgatgattgacccgccccgcgcggctgtccccgacgccgtggccaaatgtcgaagtgccggcattaaagtgaactcacaaaacttactaatacgtacgcccacggcattaatgtgtgaacaggtggtcatggtgacaggagaccatccaatcaccgcaaaagcaatcgcaaaatcagttgggataatttcggaaggaagcgaaacgatggaagacatcgctttgagaaaaggcattacggtggccgaagttgacccgaagtga

SEQ ID NO: 83294 - DNA, 362 bp, Heterodera glycines
  misc_feature (79)..(79): n is a, c, g, or t
  Genomic contig location: Contig_ID=SeqID_18640; Location=3118..3479; Strand=-
  SCN-specific regions: Sequence locations=1-312,335-362
gtgcaacggaagcgcaggcgcattgcgctgaaaaacaaccggccgtgttaagcgacgcgaggaagccgctctttaccanccaaacacttgctaaatacgcaaaggtaaagccggggcaaaagcggatggcgagatggaaccaaccgatacatttctttcacgggggctaactttttgtaatttaggaaaagcaggcggaaaaggtcgctcgtcgccactcttccgcttcgcactctcaaggctgaggaggagaaagaaagtgcgaattgacttccgatatgcgctcttttcgtctatgtttggctgttattgttttgttgttttgcaatgataattctttgcgataaattggcgaattgttt

SEQ ID NO: 83295 - DNA, 494 bp, Heterodera glycines
  Genomic contig location: Contig_ID=SeqID_18641; Location=416..909; Strand=+
  SCN-specific regions: Sequence locations=1-494
atgtcaatttttaccaaggaaatgtcaagcgctttggcgcaaaaagttcgcgacaattacgaagaattgtttccgcaaagcaaaaaggcagcgttttcgcgccgttcgcaaattgcttgggccaacattacttcagaaattaatgccgaatttggcagcagcatttctgaaaaacagtgcaaggaaaaatggcacaacttaaagaaaatagcaaaaagagaaaacgcaaacgaacaaaagtgaagcacacaataattattttttaagttacattttacaggcatccccgtggcacgggcggaggaccaaaacgacttgaatctaaggacccggctctgcaaattattacggacactatgggcgagagcgcctcattcaaaggcattcccggtgggcggagttcggtgaaagccgacgaagcatacagtgatgttagtactccaacatcagtagagaaagaagtgggttactattgtgttatattagtactgtaa

SEQ ID NO: 83296 - DNA, 920 bp, Heterodera glycines
  Genomic contig location: Contig_ID=SeqID_18643; Location=419..1338; Strand=-
  SCN-specific regions: Sequence locations=1-93,124-177,231-305,355 -707,770-821,843-920
atgttaattcatgtatctattatctttttttatttaaaacaaagaaaatgtaacaacaatattattttatgttaaggtaagtgtggatataacaatataagtatatattttaataaaaatatagcaacaaattctttttttacataatctttaattatagaaaaatgttatttgcacaaataaaaaacaaaataattcaaaaattattatttttttaaatatataatatactcttataagaattcgggaaaaaaagaattagatatttgagagaaccaaaaaaccaatagcgcaccatggaaatgtttaaaaattgaaagaaaaaatgaataaattttattataagttaataaagcaatgaaaatttaattaacatcatttccattatcatacataatttataaattgagaaaaacatagtgagttaaatgaagacaaatgaatttaatgaaatgaaaatgaaaatattaagtatttgaaacctcttattaataagttttaaatttgaattagaataaaaataggaaagaataaaaatttttgatttcagaaattaatcgcgatattactgaatatatcttatagaggattaatatccaatattttttcaatctaattgctgttattaatccaaaacaataatttttactttttgatacatttttttactttgtttatttgtaattttaatgaatccgtctttttccatattttaaatttatatatgttttttctttattaattgtaaaattcatttaattatatatttcatgaactaaatttgttatttctgacttaatatatttgttttgttgtaattctaatcaaattttttattaatagtctgttattcttggcaagcggttcatctttcaaagttaacttcaaacattgagtattgtaaaaaaaaaattaataaa

SEQ ID NO: 83297 - DNA, 567 bp, Heterodera glycines
  Genomic contig location: Contig_ID=SeqID_18644; Location=977..1543; Strand=-
  SCN-specific regions: Sequence locations=1-30,55-79,101-234,271 -288,319-567
atgactgtcattaaaatgttgatggcctcctattttctttttattttctttaatttggcaaccgctcaaaatgaacagctgaattcatccacagaggagccaaaagcctataataatgtgttgacaaattcctcatcaacaagttcgaccgataaaagcacttttttggcctggatttcatagcttaattggaaaatttattttcaactgccaattaatttaacaattacgtactattaaaaatatgtactaaatttaaaaaattacggaaggataatcaattcgtacttattatttaatatttatttattttattttcctttttttcagcttctcctccgtttctgtttggctgtccgccgggcgaagagttgcgcctttgcagtttctgcgatggcacgtgccgtttcccggtgccgttttgtggctttttctgctcgttggtcccgcgctgtttttgtcagttggacagattgagaaacgcacgcggacaatgcatcccgcgcgaccaatgcttctcgaggcaaacgccggcggagagctgtataagaattttcatttaataaa

SEQ ID NO: 83298 - DNA, 853 bp, Heterodera glycines
  Genomic contig location: Contig_ID=SeqID_18645; Location=1680..2532; Strand=+
  SCN-specific regions: Sequence locations=1-20,42-293,315-510,533-853
  Gene Ontology: Mol. function=copper, zinc superoxide dismutase activity; Cellular component=cytoplasm; Biological process =neurogenesis
aaagtcatgcaaaagcgttcggctgtctgtgtgcttgttggtgatgaggacccgaatgtgaaggggaagattaacttcatccaggtcataaatctaacagaaaatttcttagcatttttgtagcttctagaatctcggaatttaaggttcaatttttgcaattgcgaaaaaatttaccattactaatgctattccttccataatcttttaaagttattctaatttatgaattaaggagaaggatgactctccggtgaccatccagggtgagatcactggcctttcgcccggaaaacacggcttccacgtccacggtcatcgaccaacccatttatccattttaaaataggatttgttttagctttcggtgacctgtccagcgggtgtatgtctgctgggccccacttcaatccgacgaacaaaacccatggtggaccggaggtggttaagggagagggcggaattaaaggatgatatttgataaaatcgcgcttccttttttgattagggatatatttttatataaaattaaggatgagacgcgccatgtgggcgatctcggcaacgtgttggccgggcaggacggagtggcaaaactcgatttcacggacaaagtgatttcactggtcggtccgcacaacatcatcggccgcgcgcttgtcgtgcacaagctcgaggacgacttgggttcgagaattcattaaataatctaataaaattaaatcttactctcaatttgctaacaaattgactttttttaggccgtggtgaaggactcaagaagccggagagcatggagactggcaatgcgggtccccgtttggcgtgcggagtgatcggaattgctcagtga

SEQ ID NO: 83299 - DNA, 84 bp, Heterodera glycines
  Genomic contig location: Contig_ID=SeqID_18645; Location=3434..3517; Strand=+
  SCN-specific regions: Sequence locations=1-84
ctttattctcttgcattttccgtggaccttcaacacttaacccacaaaaacaaatgaaccgaattcgaaaagcattgacagtac

SEQ ID NO: 83300 - DNA, 729 bp, Heterodera glycines
  Genomic contig location: Contig_ID=SeqID_18646; Location=822..1550; Strand=-
  SCN-specific regions: Sequence locations=1-476,516-545,569-729
atgggcacaatgggagagggaagtgatcggacggaagcggtggaacacggagaacggtgtgatcagagtagcgatcggcaccaaagactacgggtgagaggagtacacggcacacaccggcagcagtttggcaccctcccttcatggctttaactggcccaattagctgaaacattcggtttatttagttcaatatgcgaccgatcactgcgaagtcggacgccgaaaaacaaatgattggtggcgatttaagagcaattgatcatcatttttaagttctttaaaatcattattttctttctttttggattttttattttatatttccaaaatttaaataaagcaaaagaaagttttttttaatttatccgtcacagttaagcggatattctgtggacattctgccaatggtgcagattatttgtctgagaaacggatcggatcagagccttttggcccaaaagcgaccagaaaatttgggaagacgcccaatttaaggcagaaaagagaagccagtttcaaaatccatctttatttttcactacatattataaaaaatataaattttgctaaacaattccaaccaaatttattcatcgattctgacgctgaaataatccaacataatttgcgtcagaaattcatcaattgacgtggcaccacaacgagctgtttgcccaattcattttaataattcaacgaaagacagtttttattattttcaataaa

SEQ ID NO: 83301 - DNA, 789 bp, Heterodera glycines
  Genomic contig location: Contig_ID=SeqID_3123; Location=37..825; Strand=-
  SCN-specific regions: Sequence locations=1-627,661-742,772-789
atgccaatgtttaagttttggtattttaatggaaattttcggaaaattgcaaaggtgagttagggaggaagagcagctcgtttgcgcctaaatttgctgggaaaatttcaaacttatagaaaaaaatttgtaatcagtacaaagtattgttttctccctcactagacctactaccttcagtattcggtcaccgatacgcaaccgtcgcgtgaggtcggccggcgagttggacgcaatgcgcgagatgaacacgcccgggttggcgggcgtgccgaacgggtgcgagcagtggtcaatgccgccaacgatggacagtcccagcgagttgtgagcgtcgcgcacaagcggaacttcctggaaaaaatataaaataaaacaaaaaatgaatttctcaaagcactcaactctgaataaaaaaatgtgcttgatggaataatcttacgaaaaaaaaatcaaaataaatcatcatgcttcaagcggactcgaacccatgacaaattggtcattaaaatgtaagagggaaatcgcattatttatttattcaataaagaaaaggtccacaaaagggaaaatccgctgactttgtggacaacataagtataaattaattgtcaaaaagtaatacggataaaattaaaaaaatgaataaaatatttaaaagagagatcacaagttacacaattaaaagtaaatataagtcaaagcggctaaaatttatcaaaattatcgaacgcttatgaactatttattaaaaaaaaatattttatttttcagtcatttggcttttaa

SEQ ID NO: 83302 - DNA, 354 bp, Heterodera glycines
  Genomic contig location: Contig_ID=SeqID_3123; Location=1025..1378; Strand=-
  SCN-specific regions: Sequence locations=1-292,324-354
atggcacctccgacttgcgggttcattgaggtgctgccgattccaccgcaaatgcttaggccgagcgggtgcgtgtcccggcgcggcacaacaaccacacggagaccgtccggttgacgctcatggcgtacggtgatggtcagcgcgcggccagtggccttcaacgcctccaccgcgtcggtgtgccgggcgccggaaatgtcgcgcgagcagaccttaattaattttcggtaaaaattaggcaaatagaaaaaggtggagagctcagcagcaggtggttgaacaccgctagaaaattaaattttaaaatttgttttttttttgaaaacatgtcctaatttcagaacaatttag

SEQ ID NO: 83303 - DNA, 1491 bp, Heterodera glycines
  Genomic contig location: Contig_ID=SeqID_3124; Location=152..1642; Strand=+
  SCN-specific regions: Sequence locations=1-227,249-443,495-840,863 -998,1022-1084,1107-1417,1440-1452,1474-1491
atgtaccagaacattgctgttggcactgttggaggcgatcaaaatgccgttgaagcatcatcctcatcaacgatgatggcaccgaagaatgaatcaatcggaaaaacggtggtggagcgacagatgtcagcctcagtctcattgttggacgttggcaaacagtcggtggaagaacagaaaaaggtgtgtgtgatgtgtgtgtgtaacaagggttgcgttttccgaggcccaaaaattttttggaatttgaaattccggggtgtaaaaattttttgtatgtgatatgtgtatttttgtttgcacacaggttcgagcccgctctgtgcgatgcgagaattattttattcttttctaatgacagagaaaatgaactgtggtagaaaaaaatgcatttaaactccctaaattaaaaaattatgcaaaattaaatactctacaattcgtttttaaattaaattatattaaaattagttttaaactttaaatttatatttcttttgtagcaatttgaagtgacgaccttctccagcgtgtcgtcatcgcacaaccagcacaatcaattgccaaacggcaccatcggcaacaaccacaacaacaacggtgccaatggcaggaaagatgacgacgattttggcacagagcataaaaaagtggcatcgtttggcggttctcctccgcctgttgcgccaaagccgaaaacgaacgtgggtgcctatacttttctctttggatttttactacgggtgtttgttttttgtaaatgtttttttcattttttcaaaaattttgcgcatttcctgccggtttcagtttacatcgtttgccgtcaacgccgctccccataatcataaacaaaatggcaatagtggcggttgtactgacacgacgacaacaacggcaatgatgaatggcggcgtcgccaccatcgccgacggcactgcgccggaaacaacaattggcgacttttcgagccgtcttcgcctcttccaacaacaaacgcagcaacatcagcagcagcaaccgataatgccgaaccggacaacgagttcaacaagtctccagcagatggcgggggcggcacagccaacagcagcagcggcggcagtactgcccaagctgaaacggccattgctcagcagcgacgacttggccaagctggccgaggacgaccaaatgaggaccaaagcggcggaagctgccgctggtgatggacgccgtagggcagcggcatcgctgggggcggcggcgggcagttcgggcgacgcgtcctccggcggagagcaaccgttcccgtcgccgccaccgccaattgctgctgctgccggaggcggcgcgaagacgacgacgttgatgctttcgcccatgtcaccggttgtcgacggcggcacatttgagcatcttctcaatgactggtaggccagcaggaggcgtggtcaaagtgccaaatttctatggtatttgccatatttttgtgccttcataattaaaaaa

SEQ ID NO: 83304 - DNA, 1106 bp, Heterodera glycines
  Genomic contig location: Contig_ID=SeqID_3125; Location=301..1406; Strand=+
  SCN-specific regions: Sequence locations=1-74,96-279,317-326,351 -361,383-498,520-523,550-744,766-977,1000-1106
atgtgcacgaaacagcaacaatgggcagcggtgccggtggcggggcagtacaacagcgccactcgcctgcaggtgtgtgacaaatcagatgaggagttggagacgaacgggtgctgtgcggttgtacccgccggatatgaccgcagcggcgtcggtctcctgaattgaggactttttaccccctccccctccccgatttataaattccaaatttaagaatcgaaaaagtgataaaaaattttctacgttttcttaatttctgaattttttccagcgagcaaaattaaaataacaaatatttaaataaaaaaaataacaacaacaataatttgtggttttttcagaaaatttcaacgtcaaatgatgaaaagaaagatggaaagtgtgatcacatatttttggctgttgctgcccagtttgcatttgcgccgaaggcccgcccccctttttttatttttcgataaatgtgcaaaaaattgtcccaatgaatggctgatcaaaaccaaaaagaaatgtcctttatttccctcttctgtctctttctctttctattcaatcacttattttttctgtagccaaaaaattctcaaccaaaaataacgcgccttttccatttgctttttttttctcattattcactcatatattcatgtatttatagggcctatcacagaaaattttaaaaaaaatgtatttttagggagggccttgagccaaaaattgaaaaaaaaatggaaaattttctgtgacaggccctgtttttcattcaattttttgtccaccattaatgtgcaaagaaaggttcaaattttgattgatttgtatatgtacacaaaatgtttgttgtttctcatcacacaatttaatgtgcccattttttgttttttccatcattttttgcgccaaaaattctcacaattacatatttaacctaattattgtccgcaaaaccaaaaaggaaagcattcctcccatccaattatcatcatcattatcatttacctataattaagtgtttgtttctttcttttagcctctttttttgataatttttgtttttgcctggtgctccatttcacgttacacatacatttgattgggaccaa

SEQ ID NO: 83305 - DNA, 1911 bp, Heterodera glycines
  Genomic contig location: Contig_ID=SeqID_3126; Location=252..2162; Strand=-
  SCN-specific regions: Sequence locations=1-575,597-656,678-940,967 -1911
atggcactgctgatcatgctcatcagcattgtcggaacgttcggctgccaaccatccattcgagcatcgggaatggacccgaaccttccatttcgagagggcccaagagtcccatgcaccacggagtgtgcagaacgaggagtcacaaatgtgagtgggcgggaatttaacaaaatcgagattcgttgcgatgacggatgctgggcaacaatgccaaagtcgaaggatgtgaactacggactgccagcgaaaaagctgatgcatggctatccttgccatgacaaatgctggtgggggagcaatgcccctttcaacacaacgaggcgcaatgccaatcggaaaacgggttcgaaaacccgttgctacaactcatggacacacgcttcggagcttcaactgtcaaggggcgccgcgggcaatgtcgccaattttttcattggcgacgagaaggcgggtcaatccccgcctattacacaaatgaacgggacgggactcaatcgaagcaaaaagaatgagggatgttcttggagaagatcggggcgagtcccgattcatcaattcattcaaaattgatcattcctaatttttgccccttttccatccaatttctcatatgcatttctccatttcgtaccattcacattttgcccgttcctttgtcccatttttgccccatcgcatcccttcacaattcaaatcttttctcatcggttggctcatcttcggccaactttgtgctcagatttcctttcacaatttctcactttttacatctgccaattcacattcaatttttgtgcgcccatttcctttgttcgcaattcgcttctagaattttctgtccattttttgtctctctcacaatttgtctaagtgcatggccttttgcccttcccccttcgaaaattgtctatttaagcgcccccggccaaggggtcgctctcttctcttctcttctcttctcttgcttccactccccttcgcttcatattcggtctgcctgtgaccaattcctccaattcccccgtcccatcgcccaattcgatcaattcgtcgcttttattcattattcgttttgctttaataaattcgtgctgaaacggcttggaggactcggaaaggagggaaaagcaccctccacactccatcacattcggcaaattctcgtgcggggccaaacggaggcgcccattcacgtcttgaccccttcctttcctggcagccctcgtcgttctcccccaatcctcccgatcccagttcctttccctttggcattggagaatccgggagttggcccggagcgtcagcgaatttcaagcagttcagactcccgcagccggagtctcgcggatcggtgtcagtctcccgccagccggagcagccgtagggacggggcgaattcccgtcgtcgacgaaaccaagtagggcagagaaggaaggaagagccgagcggtgccaaaccgtccaccgaagggcaggcccgttcgtcgccgctaatcccaccagccggagaagcgcgcatcgccggagtcagtctcccgccagccggagcatccacaggaggagacgggagtcgaaacccgtgctcatcaagtcgagagcgaacgtcacgaagttcgagcagttcagattcccgcagccggagtctcgcggttcggtctcagtctcccgccagccggagcatccgccgcaggaaacgggagtcaaaacccgtttcatcgagtcaagagcgaagagcaactccgcccgttcggagcagctcaaagggtcggacaagcccccttcacaaccaatcttgtcgagcaactcccgcccgttcggagctgctcaaaggggtccgacaagcccttcaccaaaatcttgtcggtggtgccgttaagcaagcagcaaatcgctgtataacatccaaca

SEQ ID NO: 83306 - DNA, 695 bp, Heterodera glycines
  Genomic contig location: Contig_ID=SeqID_18650; Location=15..709; Strand=-
  SCN-specific regions: Sequence locations=1-40,62-94,118-151,177 -282,306-351,373-401,424-533,561-695
atgttgctggaggatggcgccggacaagcgcaacgcgtccaacaacagcaacaacaccaagtaccaagcaccagtggaggagttgtgccaactgttcaacaacaacagcagcaacagtcggctggcaacaaggccaccaaaaacatggcgacagccagtagcagcagcagcaagagtgccgccgccgccgccgccctcaacggcggggggcaacgggcgcaaaaaggtgcagcaccatgttagtagtgcactcactcgtttccggggccctatgtttcctttccccccccccgcccccccgccccacccactgtgtcgtttgcccgccatatcattcccatcccgcgaaacaaaaaattttattttccaaaattagaatttttttcaaaaaaaaaatcatagaaatctttcaaaaaattttagtttttccttttttaatggattttatcaaaaaaaaaagttttaatttattgctatgtaacattcttaaggtcgatcagccagcgacgacagctcgaaaaggaagtgttcatcaacagcaacaacaacaacaacaacaaaatgcagacaaatcaacaaagacaatttcaaccaccggcacaagtgccacaagcaataacagtggcgggggcaacaaaatgccatccatggcctataatgagcaacaagcaaagctcaaaatggtgttgaaatga

SEQ ID NO: 83307 - DNA, 1008 bp, Heterodera glycines
  Genomic contig location: Contig_ID=SeqID_18651; Location=1413..2420; Strand=-
  SCN-specific regions: Sequence locations=1-174,198-206,228-238,262 -636,660-793,815-1008
atgccttggcgccgttttttctatcgaccgtcgttgtgagttccgtacgataatttatgacattcttagactccctccaaaatcatatgtcattgatttcgaagggtactaatccaaagcagaggacagcgaagtgataaggtgagtaggaatagctcacttccttttttggtgtaaaatttttaaaaatatgaaaaatgaatcgaattccattgtttacatattttcacaactgaagatttatataatattttattaaatcctttcagtgtttggctgaatagcctttgtgatgatcattgcgatgactccgccaacccaaaagcgctctccctcaaaggctttgattattccgctatttcgttggatttaatcgaaactttgcacgaagtttctcttttcttatcgatataagcataaatttctgtgttttcccctccccccccccccctctccgtcccccttaatttgcctgatgaccgtacgtcccctcgagggtttccaatgtttggcttatttttggccttccctcatcacttaagcgatgttttcgcgcagaaacccacatttttcgcccgccgtttgcccaatgtttggcggaacggaatgttatgagaagagagaagacgcgccgccgggggggggggggggggggggggagcacaaaaacagcggcggatggcgcattgtcacttcccttcgccgcttcgcttcgatgcgatgggcgcgcacattctcccgcacattttttgtcccacgtcattcgccaacgggcaaaaaaacggtctaaaaatagctcacttattgcatcccaacgcaccaaaattagccaaaatctcagcaaagcccccgccccatcacagcacaaacagaggggcaattcagcagcaattcattcattttcccattttcgtcctttagtgcattttattatgcttttgtttgtacgccgaaactgtcagaagcgaaccgccgcgtgacagcgttagaaaatgacaaaaaaataaa

SEQ ID NO: 83308 - DNA, 199 bp, Heterodera glycines
  Genomic contig location: Contig_ID=SeqID_18651; Location=93..291; Strand=-
  SCN-specific regions: Sequence locations=1-36,58-101,123-199
atgcgactgatcgaagcaatggccaacagcagagagaaaataatgggaacaaaaattgaggaaaactcatcaaaaagtgtgtcggaggacgacacatcggcggaggaagaggacgaggaaaacattgagaatttcagaccgaatggaaccacaaataggaaaagagcacaccgaaatcccacctcggactcggcccaat

SEQ ID NO: 83309 - DNA, 2945 bp, Heterodera glycines
  Genomic contig location: Contig_ID=SeqID_18653; Location=20..2964; Strand=+
  SCN-specific regions: Sequence locations=1-79,102-493,516-543,565 -881,903-941,963-1043,1066-1359,1381-1419,1442-1471,1519-1917,1954 -2138,2164-2316,2338-2777,2807-2945
atggaaacatttgttgaaatagtcattcaccaacactcaacaccagaaatagttgtaactgatcaggggcgacaattcacttcagaattatttaatgatatggcaaaaatttatggatttgaacattgcacatccacggcttaccatcagcaatcaaatggccaaattgaggggtcaatgagaattatggcaaacataatttcacaaatgattaatgaaaaggggaataattgggacgaagtgttatcccatgctttattcatttacaattcctcaattcatacagtcactaaacattcaccatttttccttttacatttgcgccacccaaaaatgcccactgatcgcttacttaaactccctaatcaggaagaaatgaattcagacatttcaatttacaccagaaatcatgtttcaaaagctgtgactgcttggaatgcagtcaaagaagcagtcacaaaggctcagattatacaaaaggacgaaaatgataaaatcagaagggcagaggaaaaagtgattgaaattggtgatttgctcctactaaaaaaggaagttttaaagcataagtttgatcaacgatgggtaggtccattccgttgtgtaggagtcgataagaccaagaaaaatgttatcatacaacagatagatggaaaaggaaaattaaaaaaggtacaccaagaaaagattaaaaaattcaacgggccggcggtccttccgctaagagaggcggatgaacccttaaattgggaaaaatacgcaaatgatccaaatttggaacaagaggaagctgaagaaagctcagagagcgacaaggactcagaaattttagaatgtgaagagagcaaaaaagacggtgaaaataaaaaagagatcaaaaattctttttccaaatttgggtttgaaagtagcgatgatgaaaatgaaatggatcaaaaagaaagaattgtgtttgtgagaggtacggatgaaagagaaatggaggaaagacctgaaattttggacccgcaaatttgggacattgagcagcctatgccttgtacaattactgaaatatttgtagaaggggagtttaaatgggcttatacgagttggccagaggaaaatttgattcctttaacatcgttaattccaagcaattttgttaaagattactgggaaatttacgaaaatgcctcaggcaacagattcttaacagcatggttgctcgggaatagctttgagttatatttaaatgatgaaacggacaaaatagtcttgggaatacaagttcaatttgcattaaatgacatatggcactcaagaactgaaagggaaattgagtcctattgggaaccattaggcgaaatggacggtcaaacattagaaatacaaagatttcccgacttaacaattacccataaagaaaatttggaggaaaacgaacaaagaaataacatattggaccaaacgaacattaatgcaatttgctacaaaaataataataatgataataaaattaaaaataattatcaaaatggtcgtatggaacaaagtataaatgtgattaaagaaggggatttgtttatgagcatatttgatttaaatgaagaaataaatcaagaaatatatgaagaaaaatcagaaaaatatgaacaagaaacaaaaaatgatggtgacaaaaaagccgaaataaatcgtgaaaatacggatttcctaacaaaaaaacttaacagggaatcaatgacctcgccaaaagcgcctgcaatggaagcattcaatgaggagcatttaatcgccgaggaaaagaagttaaaaagtgaaattgaggagttaaagcggcgactggacgaaacaaataatcgaaaagcggaagcggaaaagagaagaacagagaggaatgagagaagacagatcgatgagatagtattggatgtggaggaagaagaagaggaggaagaggaagaagaagaattggccagacaggcaaaaagggggcgcctggacccattggaaacaaaaaaattggtggaaaaaacgatcaatgaaaaatgggaaggccaagagctggtcacaattgacccacgggcggcaggctttaaagagcccccagagggaactgacagccggggatgggaagacgcaatcaggctgcaaatgagaggagaaagagaaaaaggatggagagaatttttgtcgacgaaaacgtcgctggatcaaatgaaagaagacagattgaatgtgatgggaagagcgggattgacccagagtggtcgaagaatggcagaaaatagtgtaaagagtgcagagaaaagcataatggaaactgaatgcattctgccagaggggaaaggaaaacaaacaaaaccgtggaacgaattggaaatgcaacgggaaagcacagaagacatggaaagaagaagaaaattcgcagttcggaccccgccaaactcggaaccttttgcgaattccgggtggggagaaatgtcaaataacgaaggaaccgaaaaaatactggataagatcggggaaatgcaaaagaagttgaacgaagtcaataacgaattaaattggttggcaaaagatgtgcaagaactgagccaaaataaaggaaatgagataaaaaaaggggaaaatggccagcaggacaattgggaaaaaggcaacacaaacatccctttctggagacaacatgacgacaatcgtttccgtggtcgtggcacgggcggaaatcgcgggcgcgggagacaacgcccatttcaatatgggtggcgaggatcagatggatggaaaaaaaatgatcagcaccagcagcagcaacacaatgacgaagcatgcaccagcagcagtgtcactacaactcgctacaccggagaggaattcacaagaatggcaggataccgtgattgaagaaaaccaatttttccaataacgcttatatagtagggaagacggttaaaaaaaaa

SEQ ID NO: 83310 - DNA, 80 bp, Heterodera glycines
  Genomic contig location: Contig_ID=SeqID_18654; Location=94..173; Strand=-
  SCN-specific regions: Sequence locations=1-80
atggaggagaaaaagcgttccaagcaattttttgcccaaaaaaaaaaaatcgaacctcctcaatacacatcgaaggcaga

SEQ ID NO: 83311 - DNA, 265 bp, Heterodera glycines
  Genomic contig location: Contig_ID=SeqID_18654; Location=676..940; Strand=-
  SCN-specific regions: Sequence locations=1-171,208-265
atgccgtgctcgcctccatgtacagctcgcccgtgcgggcgtcaacgcggaacatgcccttccgtgcagtcggctcgtccaacctatgaaagcagcaagcacatcagtgagtataattgggcatcaataatgccaatgtggcggagcatgacaaaatgtcgccgcaaaaacaataaaaaaattttagaaaaaaatcaaaaattattagttacccttttgttttttttcaggaaattcagaaattttagttttcagtaacacctag

SEQ ID NO: 83312 - DNA, 1314 bp, Heterodera glycines
  Genomic contig location: Contig_ID=SeqID_18654; Location=949..2262; Strand=+
  SCN-specific regions: Sequence locations=1-42,73-107,201-262,284 -478,500-603,630-654,759-762,804-855,877-1046,1068-1154,1176-1314
atgccaacggaggagacggagcacgagctgggcgtggaagtggttgttgacacacagcagcaacaccaacaagtggttgcacgacggacattcacggtacgcttggtacaacgtacaacaactgcaacggcgacgatggaaacggcgacgcggacaagatcaagcagtacaccaacaacaaccgcaacaccaacaacagctgaacaagagagcgatgtacggagggctaataggggaaatgtagcccggaaaacgggctttttgccaagttattatgctaaatcccagtttggcatgacgacatttcgcccactggacatttcgcctactcaggcaaaattggacaaatgtcttattttgacttaggcgaaacgcccggttttggcttacaaattagtaggcaaaatgtcagtgggcgagctgtcaagtagacaaaatgtcggcgtaagccaggtttagattggaaccttagaccaatcccaagggtgggggaatggcaccaaatttcggtagaccgacaaacggcactgtttagcccagattaagcctaagcctggtctggaaatcgaatatcccggactggcttgtcgagaattgcgatgcttaattttatttgaattttttaggataccactgctactgcaacggaaatgccaacaaccatgacaacagtagtaacagaaacggcaccaacaacaacaccgagcagtagcggtagaacaaccacattggttgaagaacaacagcaacagaagcaatctgttgatggtggtggtgataatgatgaagaggaaaggtgtggatgaaaatattttcaagttcgacaatttgacaaaaaagcctgaacctgcattccattttggatttgatgggcctggattttctgcgtaaaaatccaggtccaggaaaatacaggcatggatatatgcccagatcggactcaaaataattatccattttttaaatgaattaaatttgattccccaaggggaatgcaaccattagaaaagcaaaagtgccaagattggcaattcatttcgaccctttagggagtgccacaaaaaatttggtgacccttccccatagagaatatgccgaaaattggcaatcgatggcccaattatccatctaacaaagtaataagtggccatgaattcaaaatttagcacaattttcccggacgagttggacgacgaaccatttggcacaacgacggatattttgccggcactttcagcagtgccaccaaattcttcagaggccagacgggcgccaactgcggcaccgttggtgccattaagctcctcatcagtg

SEQ ID NO: 83313 - DNA, 429 bp, Heterodera glycines
  Genomic contig location: Contig_ID=SeqID_18655; Location=450..878; Strand=+
  SCN-specific regions: Sequence locations=1-291,313-344,370-429
atggaacggcacgccagcgcatacaaagtcaatcggatttatgaatggcttttctcaacgtctacaaaccaacagggagttgaaccactcgatgatgacgacctgctcatcgcatttgtgacgagggacagtgccaattttggccaatattgcatggaaatggaggaacacaatttgttgatgcaagtcgggttactgttgaggcgtaagggcaagggcaaatacgatattgacgagacggtacggtatttggaacaacagtatgaagcatatttgggcgcaatgtatttgttgagaaagaaatggaattgtgacggaattaaagatgattttctcacatgggcagaatgtgacagatttagaagctatttgatttcattgtatcaattcatctttcgttaaatatctggagggtaattaattaactaa

SEQ ID NO: 83314 - DNA, 325 bp, Heterodera glycines
  Genomic contig location: Contig_ID=SeqID_18656; Location=320..644; Strand=-
  SCN-specific regions: Sequence locations=1-325
atgcacgccgtcagcgccgacgttcatcaagaggacttaatgactcgtaagtgtcacgaaacgaatgtttttggaagaatgtaaagtctccgcccaggataggtagcttcaattacaatcaataatatggattgcattttactagagctcgaccttttgaaaaaggacctggatttcctggacataaatacaggcctaggaaaaatgcaggttgccgaaaatggcatgggcctgattcctggataaatctaggcttggatccccaaggtcgatcattgcattttacctttcattctaattgattcgaatcatgattcgaattaaa

SEQ ID NO: 83315 - DNA, 343 bp, Heterodera glycines
  Genomic contig location: Contig_ID=SeqID_18656; Location=1021..1363; Strand=-
  SCN-specific regions: Sequence locations=1-77,132-343
atgaaagcgatcactgcactgcgagaagagaagctgaaaatgcgagaggaacagcttgagcaaaagattttggtaggaaaatttaaaaaaaaatggaaatgaaatgaaatttaaatttttttttaatttttcagaaagacaaagaggagagacagaacgcatttgcggccgcggcagaggagcggcggttgcaagccgaacaagagctggaggatcagagaaaagaatggaagaaattgtcgatggaaaaggacagcaataataatgatgggaaaattgatgataaatgattgaaagaagagccccttttttgtttttcaatgagaaatttttacgtaataaa

SEQ ID NO: 83316 - DNA, 1523 bp, Heterodera glycines
  Genomic contig location: Contig_ID=SeqID_18657; Location=969..2491; Strand=-
  SCN-specific regions: Sequence locations=1-94,116-1222,1245-1523
gtggtacggacgaagcaatggaaaccgaacagcagacaggaaaggcaaacattgaggaggacacaatttctgtgctgggagaagatgaagccgaaacgccaaaagtgatttcctggagcacatgttgcactggtgatcagcacaaagactgcgcggaccttttaatggctgatctggatgctgttttggaccgttctggaatggggcttctcaaaatcgacaatccgctgaaggccctgctcgccaatttcctgctcaagtcagaagcggtgaaatcaggatcggccggaaagaagctgattttgcaaattttggaggccgaagtcagttgggagttagccacttactgcagtttgagagaagacgacgtaaaaagtggcgcatttccgtcagaatcagacgtggaaaagacattggaagtgtgggccgagcagtgccaaatcgtgaatgaggaattgaaaatgaccggcatgggtccaatttcaatggaagtgcccgaaggcctgtcccttttgccggaaaacgaaagagaagggctgaaaaaggcgatggaaagtgccgggtttcagctggagaaaatccgggcggcctcaattcacagaaaacggctcattacggaagagcgtgtaattttgggcgattcaggcgcattccaactaatgaagatttggcccaagtcggaatttgttggagcagaagcaggctcagtggcggaagtgatcagaaactttgatgaagtgattctgtcatcaaaagtcaagtggttggtcgtgatggtcggcaaagactcaattttggcgggcgaagcgattgacagtgtgatggaaagagtgaagagactccgccaattgtgctcaaaatttggccacgtgaaaaccttttggctgttgccgccgttcattttttccaaaaagaacgaatccgaagagttctgtggaagaatgcggtcaattttccgaaaaaaggacgaaattgagctgattgctgtgaatgaagaagggcgaagcctattggaggtgttccgattcggcaaaagcttcaataatgaaactgtgaaccatcatggatggatgacggagaagggattgaaggtgatgaaagcatggctcacggcggtggttccaggatttccgggtgaccgagaactcggaatccacacaattaagtcgcaaataattgtgccggaaagaggtgccaaagtgaggggtggaggtccagcagaccctccccaaattggccacaattggtccgagaaaaacgggaaaagaggaggcccaggtgacctttccccttctctatccgattcagcttctgagcatgcccaaaattcagttcggtctgtgaatgtgcgaagttatggagagaaaagtcattttggacgggttggtgcaggtcaccgccctggtccttcatttcgtggtcagtcgtcgtctcaattccatccgtatcagcgcatgcgcggagggcccttccaccattcgactccgatccaacgccgttccgaatttgtgccgagacgctga

SEQ ID NO: 83317 - DNA, 260 bp, Heterodera glycines
  Genomic contig location: Contig_ID=SeqID_18658; Location=1..260; Strand=+
  SCN-specific regions: Sequence locations=1-59,120-260
atgattatggtattgagaaaagggataaacaatagaaaatataaaatttgtgaatacggtattaaaatataaatttcgtattgaaattaaaattaaaataaatataataaaataaaaatgctaatattttcagaaatgaattatgatgaattgagtattgtgaaggaaggagctgttattatgataaacgatgaatcattgactgatcagcaacagttgaaggtggaaaaaataaaaacaaataaaatgaaataattata

SEQ ID NO: 83318 - DNA, 970 bp, Heterodera glycines
  Genomic contig location: Contig_ID=SeqID_18658; Location=279..1248; Strand=-
  SCN-specific regions: Sequence locations=1-90,158-166,189-264,299 -361,456-593,615-667,711-763,801-970
  Gene Ontology: Mol. function=actin lateral binding; Cellular component=contractile ring (sensu Saccharomyces); Biological process= N-linked glycosylation
atgaattatgatgaattgagtattgtgaaggaaggagctgttattatgatagatgaatcattgactgatcagcaacagttgaaggtggaaaaaataaaaacaaataaaatgaaataattataataaaatataattttatatttatttttacattttagaaaatgagtgaaaattttgaaaaattggaattggtattgaaaaacaccaaacttgagctcaaaaatgtgagttttacaaagagtttgaaaatttaatgtgatttgcaattaatttttgtaaaaaaaattaattaaatttagaagggactccaagaaaagttgaagcagcagaaaacgaatgcactgctcgcaaagatcgaagcggagaatgggaaaatgaaaaatgaaattgagaaaatgcaggcaaaaatgaaaatggacgagaaggaggagcaattggagaagaagaaggagcagtacatgaacaagttggagcaactgcataaaaatgtaattctcaaaaaaaaatttctcaaaacttaggcattgaacccaaaatttcggactcattgaactaagacagatttgaatatcttccattttgatgttttctgattgtttaaaaagtatattaaatcatcctaagacagaaagtggaaacaaatttcgggctctcaaccgaaagcacctaaaaataaagaaattaaaaagaaaaatctaaataaaatttaagtttcctttaaggtgacatcgatagttttaatgggaatattttaactgttcactttatttaaattttttgtttaaattttaatttttaaaggccgaggctgagaatcgaaagctgaaaaatgaaattgagaaaatgcaggaaaaatttgacaaaaaggaggagcaattggagaagaatttggaggaattgcagaaaaagttggtcgaaatggaacatcaacagaacgaacaacagaaaagcattgaaatgtaaaaataaa

SEQ ID NO: 83319 - DNA, 190 bp, Heterodera glycines
  Genomic contig location: Contig_ID=SeqID_18658; Location=2219..2408; Strand=+
  SCN-specific regions: Sequence locations=1-45,93-190
atgcggcgatgcaaaaataatctgacggacgaagaatatgaacggtaaattttatcttttacaaaaaaaataaatgtttaaaaatttattttgccttttaaatgattgcaggcttttccctaaaagtgccgacaaatatgtcttcccaacgaatacaaatggcatttgtgtaggacttggcaatcaaatg

SEQ ID NO: 83320 - DNA, 2274 bp, Heterodera glycines
  misc_feature (2274)..(2274): n is a, c, g, or t
  Genomic contig location: Contig_ID=SeqID_3127; Location=31..2304; Strand=-
  SCN-specific regions: Sequence locations=1-1734,1756-1807,1829-2274
  Gene Ontology: Mol. function=pre-mRNA splicing factor activity; Cellular component=spliceosome complex; Biological process=mRNA splicing
atgaccgagggcattctcttgcgcgaattgctgcacaattgtcggctcaacgcctactccgccgtcattgtggacgaagtacacgagcgttccgtaaggcattcattcattgaatttaccatacaaatggcacctattttattttatgtcaaattaccccatttttgacctctctcctttttgtcagctcaacaccgatgtgcttttgttcattttgcggcaagcgcaactcgaccgcgtcaaacgtggcgatgcgcccctgcgcatcattttaatgtccgccactttggacgcgcgtcccttttccggatattttggcggcgcgcccatttattatataaaggggcgcatgcacaccgttaaggtgatgaacattgaattggaggatttttttgattgaaaaaagagtttaaatggggtttccttcaggtttttaactcacccgacctgaatttggacgacaacgactatttgttcaacgccatttcaactgttttggacctaaacgactcggagccggtggagagcggatttttagtatttttaacgggccaagaggaaatcgacacggcaatgaacatactgaggaagctaaaacaaagcaaatcggaccatgccgcggattgcattcacgcggtggcattgtacgcggcggtgcccactgcggtcactcaacgggcatttgagccaccgccaaaagttggcattcactcggaacattagcaaaaaaatgaatgtgcgaattcagggtcatcgaaaggtgattttcgccacgaacattgcagaaacatctgtgaccatccctggcattgacgtggtcatcgactcgggcaaagtgaaaagacggtcagtgagagggaaacactttaaattccaaagggatgcgaaattgggtttcgctctccttggattttttgacgaattagattttcagttctttcgccgcttccaatcgcatggatttgctgcgggtggagaacatttccaaggcccaggccatccaacgcgccggccgtgcggggcgcgagggccccggcaaatgctaccgattgtactcattggaggactacggcactcttgctgacgaacaagtgcccgagttgcaacgctgccgacttaccaccgtgagaaaagcaattgcaaatcaattcccagctacaattttacaaaaaaccatgctcaggttgtgctcgaactgctccaacttggggtccaaaaggtgacttccttcgcgcaccttctctctccgcccgacattggccaagtgcacgccgcggtggaagaactgctcgcactccgagccatcacattgagtccaaagggacagctcgaaatcactgatgagggcactaaactcacggcattccctgtcgaacctgcgcatgcaaagtgccatcattttggaataaaattactattttcatttttttgcttttctcaggattttgctgtccgcctccgagttgggctgtcttgaggaggcgtgcaccgtcgtctcctttctttctgctgatcccgtgttccaattttcgggccacgaccttttctgtctgaatgagaagcaaaagtacggccaggagagcaccggcctttcttcgagttggcaaatttcaatttttgtacgcgaaaaagttttaccttcagattattccgacatgaaattccgcaccaacgaaggtgaccacgtgcgaatggtgcaaatttaccgcgcttacgcatcggtgaaacgaatccaggaaaaaataaaggcaattataatggaatgggaagaaaatttcgagacggtgtcgggaggggggggggggtaattttgaaaaatggataaaaacgacatttattccaaaaaattgactttcaataatttaaaatggatcgaaaattttgaaaccgatttttggcataaatgccaaatgtaacgtaatcgtagataaaaactcactctttgtcttctataggaattttgcgattccaacaatttgaatctgcgccgcatggaacaggtgtgcaacatcaggaaacagttgcacgccgaatgtgtcaagcagaaattgcacttcagcacctccatgaacaacttggagatgttgaggtgcaaatttcaattttttgggttatctaatgccattgtatactttagaagggcaatttgccggggactgttcatgaacctgtgccatttcgacacctctgcccagtgttacgttttggaccgggaccgcaaagtgcatgtgcgcatccatccctcctcttgtctccacaaccaacggcccgccn

SEQ ID NO: 83321 - DNA, 674 bp, Heterodera glycines
  Genomic contig location: Contig_ID=SeqID_3128; Location=138..811; Strand=+
  SCN-specific regions: Sequence locations=1-108,133-674
atggttggaaagcaaaaagttgcaaattcgccaaagcaaaacgacggcaaagagaaggaaaagcaattgagagacaaaaacgcaccaaagtaatttcctaatttctactaaaatataatatatatttttttagaattccaataaatgcctaccaacgttacgtcacgcatcgcctgaaggtgtccccgtcaaagaaattcggcacttcgcgagaagcgatggcaaattttgcagctgaatggggggccatggagcctcaaaacaaaaaggtgaaaggacataaaaatggagaagaaacaatcgtttttgcttttagcctttttttgacgaatatatcgcggagagaagcgaatacagcaaaaagatggaggattataaagtcagttcgggggaacaattcaaattagataattacttttaatgttattaatttgcagaaaacagaggactacaaatcatttcaaagttaacaatttcgctcaaaatttattgaatttgtaacatttaagtgcagaagtcggcaaaaaggcggaaattgacgaaggttttgcatttttcgtttttaagcattttttctttggcatagggtcactcgacgatcgctgggcaccatcgtccgttgcatttgccaccgaatgtcaagcaaatttttagtcgcgaatttttggagtaca

SEQ ID NO: 83322 - DNA, 335 bp, Heterodera glycines
  Genomic contig location: Contig_ID=SeqID_3129; Location=626..960; Strand=-
  SCN-specific regions: Sequence locations=1-335
atggtagcaactgttgacatcaaatataatatctcctttttaaacaatgaccttaattggctgactgatacaaagggtgattaaataagtgtcaaattaaattaaagtgccgccaattagtttattaattaggcatttgtccccactgtaattagtctctctttaccccccccccccccccaatttaatcactcgtcgactctgttttttctgaattgcacccgttccactttgacttcgtcgttcagcagccgataaatgtacgaaacaattaaatcctgttgcacatccatcacaatgaaggaagggatgacatcgcttaaaaaacaaataaa

SEQ ID NO: 83323 - DNA, 757 bp, Heterodera glycines
  Genomic contig location: Contig_ID=SeqID_3129; Location=1..757; Strand=+
  SCN-specific regions: Sequence locations=1-757
  Gene Ontology: Mol. function=hydrolase activity; Cellular component =cytoplasmic vesicle; Biological process=Golgi to vacuole transport
tttgaatagcaaaaaaaagggcgtcgccggagaaaaatttgaccttcgtatgaaaaatcgggcccgagacacccccctgtcccaatcgtccgtcgtatggcccttgtgctgagacaccccttgtgcatgtgtgatgggccgtatggccattttccttccctacgatgtaaaaggggtaaacaaatggcagctaaaattgcattatctgccaaatgcccttcccccgttcatttctccatcgttttccctttgcgttcagttcactgcgttcggggcgactttgacgacgacacggcatttccggacgtgaaggtcatcccggtcggccactttcgcatcggaattacacatggccaccaattcattccctggggcagtctcaaggcaaacacacaaaaagggggggggggtaattagcgagagagcattttaaaattcgtgccttaggccatggaactcgcggctcggcaaatgaacgtggacgtgctcatctcgggccacacgcacgagtgtaaggtgtacgagaaggagggcgtgttctacgccaacccgggctcggccaccggcgctttttccatcgtcaaagagtgggcggggccaattaattaattaccgtccaaaattttttatttgttttttaagcgatgtcatcccttccttcattgtgatggatgtgcaacaggatttaattgtttcgtacatttatcggctgctgaacgacgaagtcaaagtggaacgggtgcaattcagaaaaaac

SEQ ID NO: 83324 - DNA, 445 bp, Heterodera glycines
  Genomic contig location: Contig_ID=SeqID_3129; Location=1063..1507; Strand=-
  SCN-specific regions: Sequence locations=1-445
atgcgctccattcgcgcatttgctgccccaccggctgtggctacaacgtgtgcgtgtccaacgtgcaacagcccatgctcagacgaattggccaaatgggtgagcaccaaaaaatgcccccataatattccttcccacatttaaagaagcccgaacccggctgatgtccccggactgtccgagtcccttccaaattcgcatcaaatgcgtcgtgccccgtcccgcctcgtggtgccattcggcccgcgagtgccccacctattccaaggcgtacccgcgccggtgctgtttgaccccgtgcggatacaacgtaaaaaacagaaaaaatatatgacatttaaataaattttttaggtttgcatgacaaagtttggagacgggggatggattatcgcataagaaaatcctcaatcacttttttttgaacttacgcaatttaaataaa

SEQ ID NO: 83325 - DNA, 2081 bp, Heterodera glycines
  Genomic contig location: Contig_ID=SeqID_3130; Location=873..2953; Strand=-
  SCN-specific regions: Sequence locations=1-533,557-1630,1654 -1866,1906-2081
atgcattccgcgcggaaacgtcccgcggacaaagagcagtacgagcagcagctaattcattacgcaatgcgaaaactcttcaacattttccccctcttggagatggacgacattggaaagttagtattacattgtggtttgagctcaaaagaaagccctggatttgggtatggttttcgattgtgagttttaaatcttcatgggcctggaggttcgcaaattttggaaattttcttaacaaatccattaaaaattctaaaaaaaatttttgcccggcggcacctatcggcaccgctggcccccctgttcccgaaaattttttggaaaaagcgcgccgcaatgcattcaaaatcgaactgtcttttaataccaaaatgtgccaatgcaaatcataggctcaaatgtctctctctctctccccctttttaggtcccattggcacgaattggctttcagcgtgttggccaatccgacggtgactctgcgcgaacattttctgcaggaattggtcgtctcgctgatgtaccaccactatcccaaggaggaacaaacagaagttgttgttgctgaatgttgctctctctctgttcccccaatttgcgcctctttcagcaagccctccgatgcttttgcgatgcgatcaataacattgtgacgcgcaatttgcagacggatcaatcgaacatcgatcgatctccgtcctactcatccaattcttcgcgcgattccctccatctgaacccaatggccaaggtgattaatgtgttcgttcgttctttcatgggtaaacgagtgctaattccagttggacgacccaattcgaatccgttgtatgtccattttcaccgcaatgctccgttcgggccgttttatgcgcagtagtgtcgaattggacggtctctacgaggcattggtcggtcgtataatgtaaaaaaatacgggtttttcaattcatcactttcagatcacaaaagagtctctcgccgccacttcggctgaggagcgtgctatggcctaccaagtggggcaaattaattgttttttctaagggaatgcttttcccattgtcagtgtctcacctggcgctgtttgttctccgagaccgaagcggtcacgttcatgccaatcatttggcacgcgctgcagctgcaccagggccgtggactgctctcctacctggacatgatcggcgacttggtccgcttctacggctacgccaaaatggccaattggtacgtcaaatcgctggacgaagtgcgcgaggtggatgacactttcatggtggaggaggaacaggaacgggcggtggccgaaggtcgcagcgtaacgcaaatgacgcggagcaacacgtcggaggaggacaccgatgcggacatggaggagggcgacggactcgcagcggatgaacgcaaaatggaaatgttggacaaatacattcactgcgcacgccaagcccaaatggttgtggccaattggatggactgctcgaacttgttgaccctccctttttctcttttgcaggaacctcaagtggccttccgtgccaccgagcacatttgcggttggctgttgtgcggtggtctgcgcattggaagtgcggaaagtgtgaaggcgttggcccatcttttgctggtgatgtttaacacggagagccgtgacagagcgccggaggcgcacgtgtgcctttcccgctttttgccctgcttcgtggcggtcaatcgccgacaccagcagttgctgttccgggccttcatgtccgcattttcactgcttcaggtggcaatccgatcatttaattgttacgttttcacatggaattgttcgagagtcgagacattgaaccaaaacccgggaaattcccaatagaaataaattaaacaattttttttttttgttttaattaatgtaactttttctagacaatgagtttggcactgcaagaagaggcacgtcaaatcgacactgtgaaaatggcgatcagtgtgcagcaattcactgcactttcgatgttggccgaacgtgccgttgaccgacacttgggcaccgttcactcggaatttgcacagaaagtgctggagatg

SEQ ID NO: 83326 - DNA, 168 bp, Heterodera glycines
  Genomic contig location: Contig_ID=SeqID_3130; Location=6427..6594; Strand=+
  SCN-specific regions: Sequence locations=1-168
atgactaaaacaagagaacaaggacgcaaaaggaagcaaccaaaaagcgaagacgcagatggagacgagaaaaaagtcaaaaatgatgagcagcaaaataacgaacagcaggaggagggacgggaaaaggaagaagccatcgttgatccagagcgaatgaaaattttg

SEQ ID NO: 83327 - DNA, 1863 bp, Heterodera glycines
  Genomic contig location: Contig_ID=SeqID_18661; Location=479..2341; Strand=-
  SCN-specific regions: Sequence locations=1-457,492-764,786-973,999 -1366,1388-1424,1451-1540,1562-1643,1665-1863
  Gene Ontology: Mol. function=DNA dependent ATPase activity; Cellular component=nucleus; Biological process=DNA repair
atgtcgaagatcggtcggatatggaattcggcttttaccagcgcagtggcaaaatggttgttctccgtgagcttttgcgtttgtggcgcgaacaaaatccagatgctttcgatcatcgaaagctttgttatcactgaagggttggcaaatttaacgctaaaaaacatttaatttatttatattaccgtattattacagttattccttccttcgcatggacggcacaacgccaattggcagtcgacaaactctcatcgaacagttcaacaaagttgttgctgcctttcttacatttctcattttaattctaacaataaggatccagatatttttgtgtttttattgacgacaaaagtcggtggacttggcataaatttgaccggagcgaatcgcgttttgatttttgaccccgattggaacccatccacagatgcacaggtcgatttgctcaatttcaataaattaattttcccattttgggttttaggcccgtgagaggtcctggcgaattggacagattagggcggtcacaatttacagattgtgcgttgcaaaattattgcccaattaaacagttaattaaaaaagcttcaaaacagattaagctttcgaatgatactaagcttattggatttggatgacagaaaaaagttatagagagttatagtggaaaaacatgctggggccgaaccgtgggggccgaactgacgtagaccgatgggtacgccacactgtgcagcgaaaagcctagtactatctcgtcgtttcttttttgctttgttatttctcattgacgtactatctcttcgattttaatggtgtaaaaaacaacattacttcgtgacctttaacttttttttttctacacgttaaatctacaccaaattttgtataccgatagagaaaaaaataaagaatttttcaatcgatttttaacagaaaacaatcgcttatttcattagttatagaacaaaacataaaaatacatttatttttctctcattttggtgtactaatttcatctctctaacacatgaaaaaaatcaaattcactattgcctataatggtacaaatcaatttattattagataccaaatttattcagtttagttgggaatgaagcaagttttggctgatcaaaataaaaaatacaaaaaaggcattttccagtgtaaatttaaaattagcgcgcaaaaatttacgccaatttcattcctatcagtatctccggactcccaagttccataaagtttttgaaaagttcgccataacaaatttgaacgccgacctctctccaaccctcggtcgaccggttagaggctaaattcaggatactaaattaattaaatttggctctttcgtagtcagtttttaatgtttttgtgacttaattcccatcccaatgtgaataatccttgcgctaatatcatttatttattttttatcagcttttaataataaaaaaactaaagaaatgccaccaaaaaacaactccgcgagtaaaaaaacacaggtattaatgaaaattgattgtaatgtttaattaatatagaattttttaggaaagtccattacaaaggcgttggaggaaaagtagctggaaaaatgtggtttgcttactatttttgttaatcatttcaattttattgttaaaaacatttttgtgctagggtttttctaaagtactctttatctaaccattgctttttctaagctcaacactttgatcacgcccgaccacacaaagaaggcctacgttcgcttagccgcagattatgatgctttggacgtggccaacaaaattggcattatctaaacacattctttttttattccgcgctttgttgattttcgggaataaa

SEQ ID NO: 83328 - DNA, 853 bp, Heterodera glycines
  Genomic contig location: Contig_ID=SeqID_18662; Location=73..925; Strand=-
  SCN-specific regions: Sequence locations=1-207,230-240,264-329,356 -385,407-695,718-853
atgggactgggaatcagggaaccggaattcaatccgattcggtcagattctcgatcccggcccggaaagcagttagtatgtgcattttgaccttttaatgaaagaaatgtataaaaaaaatcaaaagaaagcggagcgaaaagataaggtcaaattggacgacgaaatattggggaaagaataaaaaaaagaactgaaattaagttttaaagagaaattttatacctttctatcaactccatttttgaaaaattaaaaatttgttatttactcattttaagtcattgtaaagtcggagttttatccaaaaacgatacaacaaaactagcttaattatttttttaaaatatattttcatgcatattaagggcatgcatagtttcattattaattttggcttaaattcataatattggatttttatgcaaatctattaagaaattataacaaaattagaaaatttttcgtctcgcctcgggaccgtaggccaattcttataattaaaaaaaacaaaaatgtcaacaaagtctgtttgtggccagtattattcttattctggaatattttcgatggcatcttaaaagcttaacggtataaggaagtgtttcacagccgaccaaagtcaaagttgacgagaactcaatcattctatctccctatacaatctgatacagcaacactccagcaaatggcactccaaataaaaccgattacaatgagaacggatcaaggatgtaggaatgccgacttccgattggcggtttccgacattttgggctcggaattcccgtttccgatggctggatttttctgagcatcgtaattccgactgccgaaattttataatattaaa

SEQ ID NO: 83329 - DNA, 1817 bp, Heterodera glycines
  Genomic contig location: Contig_ID=SeqID_18662; Location=1..1817; Strand=+
  SCN-specific regions: Sequence locations=1-53,92-208,231-519,541 -570,597-662,686-696,719-998,1020-1161,1186-1259,1281-1335,1358 -1509,1531-1817
  Gene Ontology: Mol. function=transposase activity; Biological process= DNA transposition
tccactttttatggattttccgacctgctttttttaaagaggactttctatgaaaaataagtttaaatggattttaatattataaaatttcggcagtcggaattacgatgctcagaaaaatccagccatcggaaacgggaattccgagcccaaaatgtcggaaaccgccaatcggaagtcggcattcctacatccttgatccgttctcattgtaatcggttttatttggagtgccatttgctggagtgttgctgtatcagattgtatagggagatagaatgattgagttctcgtcaactttgactttggtcggctgtgaaacacttccttataccgttaagcttttaagatgccatcgaaaatattccagaataagaataatactggccacaaacagactttgttgacatttttgttttttttaattataagaattggcctacggtcccgaggcgagacgaaaaattttctaattttgttataatttcttaatagatttgcataaaaatccaatattatgaatttaagccaaaattaataatgaaactatgcatgcccttaatatgcatgaaaatatattttaaaaaaataattaagctagttttgttgtatcgtttttggataaaactccgactttacaatgacttaaaatgagtaaataacaaatttttaatttttcaaaaatggagttgatagaaaggtataaaatttctctttaaaacttaatttcagttcttttttttattctttccccaatatttcgtcgtccaatttgaccttatcttttcgctccgctttcttttgattttttttatacatttctttcattaaaaggtcaaaatgcacatactaactgctttccgggccgggatcgagaatctgaccgaatcggattgaattccggttccctgattcccagtcccataagtttagggattggtgagacaaatacgaaatcctactgacaaaatgccaaattttgagataattcatcaaatatttaagtaaaataattttatgaaaatactgaggaaaagaaaaaggaaaaaaatcaataaagctgatcaaaagtgatattttcttccttcaatgagtgaccaaatcaaatctgaagttggggccaaagttggcctcaattttatcaccagcgccattcaaactcaaagtgacgaaagggaaaaagaaacaatcagcacaggaggatgtagccatcaactcagaattatctaaataaaaaagcacgggaaatttgaaggaaatgaaaattattttgggttttttgggaaagaagggatagacggtgccgacaagccaggctccaagtttttcttcctattgggttgatgaaaaagttctgaccctctgaaaaaacaattatgcaaaaaatgatatttaattctaaagagattgaaaaagggaggcaggcaattgggatgaatcagcggacggttggccatcttttggccatttgcatttgttgtatagccattacttttgcaaaatcgaacgattttcaaaaaatggacaaaattcgcctaaatgttgcgttctcaacgcaacaaaaaattgagcaacttcgatgggcggttcttcctcatccaccatacagcccaggcatcagcccgtgtgactactatctgtttcgatctatggagcacttcttgagagggaaagaatttgctgatcaaaacgaggtcgaaaatgcattggatgacttttttgtatcgaaaaatgatcagttttataaaaaggggattgaaatgttgcccgaacgatgggggaggatcattgatcaaaatggtgagtacatcattaat

SEQ ID NO: 83330 - DNA, 721 bp, Heterodera glycines
  Genomic contig location: Contig_ID=SeqID_18663; Location=310..1030; Strand=-
  SCN-specific regions: Sequence locations=1-19,49-100,223-225,253 -260,336-407,475-610,646-721
cagataccgccctagttctgaccgtaaacgatgccaactagcgatccgccggcggatttattcgccctggtggggagcttcccggaaacgaaagtcttccggttccgggggaagtatggttgcaaagctgaaacttaaaggaattgacggaagggcaccaccaggagtggagcctgcggcttaatttgactcaacacggggaaactcacccggcccggacaccgtaaggattgacagattgatagctttttcatgattcggtggatggtggtgcatggccgttcttagttcgtggagcgatttgtctggtttattccgataacgagcgagactctagcctactaaatagttggctcattgcttctgtgggcacaacttcttagagggattttcggtgttcagccgcacgaaattgagcaataacaggtctgtgatgcccttagatgtccggggctgcacgcgcgctacactggcaaaatcagcgtgcttgtccttccccgaaaggggttggtaaaccggtgaaaatttgccgtgattgggatcggacattgcaattattgtccgtgaacgaggaattccttgtaggggcgagtcatcaactcgctctgaatacgtccctgccctttgtacacaccgcccgtcgctgcccgggactgagccatttcgagaaattcggggacggttagtgttccggcttcggtcggtatgcagactggaaccg

SEQ ID NO: 83331 - DNA, 1562 bp, Heterodera glycines
  Genomic contig location: Contig_ID=SeqID_18668; Location=568..2129; Strand=+
  SCN-specific regions: Sequence locations=1-1562
atgccgaatgaggcggtgttcaaaacacccacgccatccacaagggcacagcacccaaagacaacgccaattgagttgaataacacagtgtccaaacaacatctggacaagttgacggtggtgaaaggcgacatcaccaaacaacaaatttggatgatcgtcaatgccgccaactcggatttggtcaaaggcggtggagtagacgacgcaatccatcgcgcgtgttctcctcgtcaaaaagagctcgaacaactgctcaacatcaagattttgtcaaatggtggaccaattgcggacggcggggtcgtggacacgcccgcgtttggagacttggccaacaacgtccaatgtatgccagtgctaatcgtgtgttagtcttagtcccacatttgtagacattttgcatgctgtcggtccaaaagtcagtgcagcgctcaatgagcaccaccgcaggtccctggcaaagtgctacaccaatgcattggaccatcttgtgagcatgcacatggatatagcaaacccccagtcgagatcaattgttagtgcaattggaatttattcgttgacttatctttccataattataggcattcccaagcatttccaccggggctttcaatttcccccgtgtggatgccgcgcacattgccattagagcaattctgaattggcttgcggaccaaccagcggatgcaccggcaatcgatgaagtccgcttggtcgcatttagtgacgaggactttaaattgtacaaggagattcgcgaacgagtaataaataagcaatcatgttcgtttctatttttttcgtaggtcaaacgccaaatgaacgctggcaaacgtccaacgcccaaaacatcgttgcagacgcctttacgcattccaatggtgtgtatatgataacaggctcatttgtatgtttgttataatagctttccccgacaacatcgcggctgtcggaatcggttgagcgaatcgacctagccatgactcctacaacgagtcgcgccccggtcccccactttccaattcaacagcagcgtcgcgtccgaattgttgatgtacgaggcgatggagcttgcttcttccggtgaatatattaatgcactaccaaattacaagttaccattatgtagggccattgtgttcgccattgttggccgtgacgatgtcaacatcgcattcaacttgcgtcagcaaatgtttactcttttgcgacaatttcttgacgacccaaactgtttcccgcgaggcttctatgccaatcgcgcgcgtttcatgcaatttattgaagcactccttttgggcgatgaaaacaccaactttgacgcttacatcgcaagtcgggtgggcgcaactgcttgggcagacgcatctgatgctctgctcgcggccgtcttactcgggcagacaattgttgtcgtgtcacctgtagatcctgacaatgtccgccgtgctacgagcttttttgacgacacagttcgccatacaattggagtgtttttcccagacggaaatcatatggtgacaaataatttcaaggcctacctcatattggtttaa

SEQ ID NO: 83332 - DNA, 798 bp, Heterodera glycines
  Genomic contig location: Contig_ID=SeqID_18669; Location=505..1302; Strand=-
  SCN-specific regions: Sequence locations=1-18,43-126,155-191,216 -330,361-437,475-487,530-710,734-798
ttatttttgggcccagccgcaaataaaatagaaaagtcaaatggtcaatttgatggtttggttacaaatggtgtgctaattctttcacccaatgataatgatgatgaggtaaaagagaaacagaagaaaatttatttaaaattttttttattttcagggggcctccgtttatttatcagcttcctcttcaaacaatgatgatgatgaaaatgaatcagacagcgaaatttctccaaattgttggaaagaaggtaattgtcatcattttgaaaaaaataattcaaaaatttgagaaatttctcattttttcagaattgcttaaataatgccaaatttaaaattaaaattaatgtaaaaaaagttaagtcaattaatttagtgtccgttaacggcaacatttactcgaaaagagaagtgcgctctcctggcaaaatgggagaattgcttcctggaaaaacaaacaaaattgaagtaaactcatcatttcatattttaaataattgtaaaaaaaattatttctaaaaaattactcaagaagaaccattttgaaataacatttttgggaaattttgatttcaataccacgcaaaatttcatgacaaggctttcaaaaactcttgtaaaaaagccctaaaaaatcatttttctgcattaaaacatttttgaaggcaaacattgttttttagggtattagtgctttaatctgaatcataaaaaaataatatatatttatggaatcaatgttttatttttttgttttttaacttttgaattattatggttgtggattaaaataaa

SEQ ID NO: 83333 - DNA, 111 bp, Heterodera glycines
  Genomic contig location: Contig_ID=SeqID_18670; Location=1436..1546; Strand=+
  SCN-specific regions: Sequence locations=1-111
atgccaattttactccgatgggtcagaatcggaattggaaccgaaattttggtaaccgaacgaattttgaaaattcacgatttcaacggggaaactttaacaataatcgag

SEQ ID NO: 83334 - DNA, 2495 bp, Heterodera glycines
  Genomic contig location: Contig_ID=SeqID_3131; Location=2865..5359; Strand=+
  SCN-specific regions: Sequence locations=1-560,584-1403,1425 -2011,2034-2495
  Gene Ontology: Mol. function=lipoprotein binding; Cellular component =integral to plasma membrane; Biological process=cell proliferation
atgccctaccttaaattgacttttcttttgctgtcgcttccgttcggttgcccattaagctttgtcaatcatcgtcttgaccaaccgcagtcagcagtcacttcgggtagtccccctgttgtcccaattgcctcacttctcttgtgccgctttaagctgatcgcacatgtcccttaaatatgttcctttgtcgtgcaacgcagcgttgcatccctcgttcgtgggtgtgcgaccaggagaacgattgttcggatgggcaggacgagaagaactgcggtgcattttatacctaatggtttcgttggacttttctttttatttgtgcagagactcctcaaaaacgatgctctgaaagtgaatacgaatgcaaaaacacacaatcaatgcaacagaatgcaaatgacaactcttggctcaaccacttggcccgcaccggtttcacacacacgtgcattccaaagaaatgggtttgcgacggggaggccgactgtgtggagaaggatgacgagttgaactgcgaaggaagtgagtaactgacgaaaattcgtcgatcacaattcttttttggttattcttttctctgatcggcctttctgcacatgactttttcaaatttgtcaggtttctgtttttgatatttcagagcttaaatgtgacgagaaacactttgagtgcaaaggctttgacttgcattctgcgacttcgtgcattccaatcgaatgggtatgcgatgggcaggtaattctcgactaatattagaggaatagggtcaattgttctgctttcatttaggctgattgtttggacatgaaggacgaagcaaactgtacagctaaagaaacgaagcctgaatgtgaaaaggactctgagtttcggtgaatcactcattaatcaattcttttactccaattgattctcaaggtgcgattctggtcaatgcatttacaaaagttggcgctgtgatggggacagtgactgtatggatggaagtgacgaaaacaactgcaaggtggacacgtgcggttctgttgacaagttcaaggtcatcacgcgaagagtccacctgaaaatgcaaactgacagttttagtgcaaatcatcgactttctgcattcccaacaaatggaaatgcgatggcgaaccggtaatttaatgttggaatttagaaatttgtttatcaaacctaatttcaattcttatatgtgttttgatagctaagtaatgcaaaaaattctttgacaggtaaaagtcgaaataaaatcaggcgatcggtgaatgacataaggacaaaaaatgtttttggttttgttaaggactgtcctgaccactcggatgaaacggactgcgaaggggttactgctcaacaggaagtgcactgcaaggaccatgtttgtttcaacgtctttgcccttttcccaattcaattgtctttttctgcactttgtccaggagtttgcgtgtgcctctcgttcccaatgcatcagcagtttttggcaatgcgacggcgacgaggactgtttcgatgggagtgacgagcacaactgcacacgcattcagtgcaaaccgaaagagaaggcgtgcgctgacggaaagagttgcattgacgaggaattgtggtgcgaccgatcggaggactgcgcggatgggtcggacgaggcaaattgtcccaacaatgacaaggggacggaggaaaagtgcaaattggacgagttcacctgccccggagagaagtcacgctgcataaaataccttgatctgtgcaatggccattcgtccaacgaatgtgccaagaagggtctttgcaaccaggaaataagtcagtcaaaggcattaactttgctgactttatatgattttttggaacctatccatttaatattattttgtagactctgccctaaaatggtttctttaatctcgaatattgcggattaggtttctcaatgaaattttaaaattgtagggtccggcggaaaaatgagaagaaaattaggatgttttcaaaaattcccatttttaattttaaaaatatttggttacgcgaggtaagatatagcctcctcattgtcagtcctctggctatgcacacccttccgtccactctatcaaacgcttttggtgaatttttcccttaatctgtgcagaatcatgcaagttgactggggatcagaatgacccgtgcatttcccggaagatggccacacatggaatgctgtactactgcgccaagggttacaatgccagcgtaatcgcggacaatcagcccggcttttgtgaaggtgcacaattgaaaaaataatgcttgtgtctgacggcatgcatctacttatcagacatcaacgagtgcgaacagcctggggcgtgtgaccaaatttgcacaaaccttcctggcagttaccattgcagttgctacccaggctaccaattggtcaactctgactctgacaaacccgtaatgcataaatgtcgtgcgattggaccggacccgttgctgct

SEQ ID NO: 83335 - DNA, 2100 bp, Heterodera glycines
  Genomic contig location: Contig_ID=SeqID_3132; Location=2513..4612; Strand=-
  SCN-specific regions: Sequence locations=1-234,306-378,426-1433,1457 -1885,1915-1921,1943-2100
atggctaacccaattgcaaccaaaaaacaaaaagtaaaattgtcttacgaacgccacctttacaccttcgctaaaatgagttctgatgggatgacaaaattttggagatgcgagttcaaaaaatcaatttcacattattttggagtttctccggggaatttctcgcaactatcgaatgaacccgtgattttttgttttattgtccaaattacctcatgaacccgtgaatttctgttaatttttacattttttattgttaaaattattgttgaatttatttttaaaatgtttattttacattttatgctgaaatttaaaaagttgtttttactgtgtgttttttcatttttctgtacttggggcccaaacgaccctggagcccaaaaacgagggcccaaaaacgggggcccaaacgcccccgactcaccgaatggacgcaacggaattccgttaattgaatctaaaataacataatgccaaatttttgctttatttatttttttctttcaaaaattcacatcggttaaaatttgttttgaatttgaagttttgttgttgtttttagtcaaaaccttcaaaatgagttcaaggattaacgtcgtcagtgtgcagttgttggagaacccggccactccgagtgaccacatcaaactcgaaattgttttcgaaatattcgaaaacattaaggaaggttgtgttgtttcttcagcaattcctccccgtgttcaaaattcataaattaagacgtcgaatgggaattggttttcgtgggcactgatggccgagaagaacacgaccaagtgctcgactcagttctcatcggaccgattcaggagggacgacacaaatttttgtttgaggttttgtgcctttgaaatatttttattccaataaataaaaaaagcagtcaaaaaatttggaaagaaataaatcggtagtccatgccattaaaatacctttatcataacttcaagaaacagaaagaaggcccattccccaataactttctgataaataaaaaccaaaaattcttttcaggcgccacctccacaaattcacaaccttcgacccgaagattttatggatgtcactcttttgctgctcaagtgcaaatatcgtgaacagcttttcatgaaaatcggtttaaataaacttttgtttggttatgatgccatttatgttttaggttggttcgtcacgcacacttacactgacccggaactcgtcgaaaaccctccttctcagcccgtcatcgaaaaggtcaccagcttattgacttcttttacaatttatttttcatttactcgtcggcatttaagctcaagcgaacgattgtcggcgaggatgtgcgcgtgacgagttacccgatcaaatgggacgaggaggcggaacagccgatgggtttgtcgcagagagagggacgggccgaaagcccctttttctcctttttctgtcggaaccaatgaacccctgcataaaacattttgctgagcattatgcagggaacaaaagcctacaacaaccatttcctttgattgtcagatgacgatgaagagccaaacgccgggaatgaggtttcctacggagtggcggccattgaattaacatcgaacggcaacagtcaacaaatgaatatgtcacaacaggaacagacgccgatggcggctgttaactaagcggatgaaagttgcgagcgttaaaaaggacagaacggactcgatgttttatgggtacaaaaaacggatttgatcttcaaattgcatttatcactttaacccaatgttttgttcgacaagctcatcataaatgtatgcggcaaagccgcccaacttgataaaaaccaagctatccgaattgatgacagaaggataggaaatttcatttacaattagacatttttaattacttaaaaaattggggtcacaatacagttttgaaaatcggagtttatggggaaaccaatcttggtgcattcgagaacaaagccaacttgaccagcgaaaacttggcgtcgtatgtcatacccgtgtccgggggagaagttgctcccacacctttcaaaatagtttttaatggacactaatctagtagtcaaataaa

SEQ ID NO: 83336 - DNA, 187 bp, Heterodera glycines
  Genomic contig location: Contig_ID=SeqID_3132; Location=2550..2736; Strand=+
  SCN-specific regions: Sequence locations=1-121,143-149,179-187
ttttgaaaggtgtgggagcaacttctcccccggacacgggtatgacatacgacgccaagttttcgctggtcaagttggctttgttctcgaatgcaccaagattggtttccccataaactccgattttcaaaactgtattgtgaccccaattttttaagtaattaaaaatgtctaattgtaaatgaaa

SEQ ID NO: 83337 - DNA, 1875 bp, Heterodera glycines
  Genomic contig location: Contig_ID=SeqID_3132; Location=1..1875; Strand=+
  SCN-specific regions: Sequence locations=1-242,264-385,407-779,801 -1425,1454-1482,1504-1737,1759-1875
  Gene Ontology: Mol. function=calcium ion binding; Cellular component =integral to membrane
tgatcaacaagttggagtcggcagtggcacttgactatcggcacaaccagagcactttggtgtggtcggatgttagcaaggaacaggtcggcactaatttcaagatgcaatgtatccgtttaatttctaattagcttaatggcaaagcttgaccgttcatttcccagataatgatttgtgcgggtatcaacagtacccctgggaaccacgcgatgctggaaagcatcaacagcatttgtggcgagaagagccccaatctgaccgtcataaaggacaatgtcactacgccggatggacttgccgtagattgggtgcatgggctgctgttttggacggacaccggactggacactgtcataaaccagaaacatttcatttgatgacagtctttttcagataaatgtctatgatttgcgcagaaacaaacggaaagtgcttttcgacaagggtttggacgagccgagggcaattgccgtggacccatccgctggtctgatcttttggaccgattggggttcggacgcgcgaattgagcgcgctggaatgaatggcgatgacagacaggtgacctttttatacacttattaatagtggccttgattgcttttttgtcacagattattgtacaaggcaacgcgataaaatggccaaacggtttggcattggacattttggacaaacgcgtgtattgggcggacgcgaaaacgaaacaaatcaacacttgcgattattggggcgagtcttttccaaaacaattaaagattaaaatttacgttgcccttttacgtgttttgtttctcgcttctgcaggtgaacatgttcgcgtcatcctccattcccatcagcacgttcgccatcccttttctttggccgtatttgaggaacgcctttattggaccgactgggaccacgagggtgtgttgtccgtcaacaagttccacgggaaggacttccgacaggtggtcatttacttctcgatcattcttttgctctttgttgtcgccactttcattttttatggttgaggtgttgcgcggcgtgagcggtccaatgactgtccgagtgtaccacaaacaagcgcagcccgttctgcaaaataaatgcgaggggcgcgactgcgaccacctttgcttgcctagggcattatatcgtttgtttttcccgatctaaatgatatttttaacttactattgtaattgacttatcgaacggcatttttaagagaaacctaccaaaaatgccgaaatccgactcaagggactgccttactcttgcgcctgtgacattggtttccgtgtcgatttgaacaacagttcaatgtgcgtgtcaacaactgcggtcctttccgagtcgactgtcttctgtcagtaaatgtctcattgtctggtgcacaaagtttctcccccgtttaccccgccgtttttcaaataatttttttaaaaagtattttttagtttttcggggtaaacgcgcggggtgaggtccccttcattatcagcttttgtctgtttctcatccaattttgtgcccaatttagtccaacaaagtaaacactatggccaaagctccttctcctacatgttcgccttcatttttctgggtgtcttatttgtgctggtaacaaatttgctcaatttgcgccttattttcttccccattaaaggcctacactttctaccgtcgccaaccgcgtcagttttctgcgcttcattttgagaatccaatttaccgccgaacggtggaggctgacatggacgcggaactcgaaaataccggcgacaattccctgggcccaatctccattttgcccgtaggtggcactcacaatcagagtggtcacctttcgagcggactgttgcatcagccgggcgagct

SEQ ID NO: 83338 - DNA, 199 bp, Heterodera glycines
  Genomic contig location: Contig_ID=SeqID_3132; Location=4366..4564; Strand=+
  SCN-specific regions: Sequence locations=1-199
atgtaaaaattaacagaaattcacgggttcatgaggtaatttggacaataaaacaaaaaatcacgggttcattcgatagttgcgagaaattccccggagaaactccaaaataatgtgaaattgattttttgaactcgcatctccaaaattttgtcatcccatcagaactcattttagcgaaggtgtaaaggtggcgttc

SEQ ID NO: 83339 - DNA, 321 bp, Heterodera glycines
  Genomic contig location: Contig_ID=SeqID_18675; Location=724..1044; Strand=-
  SCN-specific regions: Sequence locations=1-321
atgaccggcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcagcccaacgtacagcaacaaacgg

SEQ ID NO: 83340 - DNA, 510 bp, Heterodera glycines
  Genomic contig location: Contig_ID=SeqID_18676; Location=79..588; Strand=+
  SCN-specific regions: Sequence locations=1-336,358-386,447-510
atgcatccgttggcacttattcgttcggctaaccctccgctggaggacgaccagcagcagcagctgatggccaacaacatcgtgcacagacggcgcagcacaccgaaccgatgcgaagcgttgcgcttccgttcgtcccgcgttcggccggcaattgacgaggaggaggaagggaatttcgagccaatcgaacaagatgaggccgacttggacgacgaattcggatcggacatgcacagcgacgacacggaaaacggtcaatcgtcgatggcaacggatgcggatgaattggacagtgaggtgggcacggagcaacgcatggagaccgacgggggcgaggacagcgacgacgaaatggccgaatttatggcagacaatggccaaatggaggccgaagaggaggaggaggaagaggacgagtggggcgaggacagcacggaggaggacctgttcatgttggccaaactccgtcagcaccccgaaattccgtttaaggtgggcagcgaatga

SEQ ID NO: 83341 - DNA, 640 bp, Heterodera glycines
  Genomic contig location: Contig_ID=SeqID_18677; Location=313..952; Strand=+
  SCN-specific regions: Sequence locations=1-609,635-640
atgcatttgtctcttttgaagtgccatcgcctcgtcgtcgtcagtgcactgtactggtcggtgaccgcgtgtttctgttcggtggcacaatgttcgtcccgtttcgctcgctttttctaccccatttccctttgccctcaggccaaacggcgagcggaaaagcggactgtccgaccttggcgatttgttcgttttggacttcgcgccgtcgttggccacgctgtgctgccaaactgtgctcaaatttgggctccaccggcatgccgccaatattttgcccacaattatcatgtgaatatttgtttctgaactgtttccccccccccccctccgactgttctttgatgggttaattctgacaaatgggcgtgaatttggggacgtacagtcccaggggacgaaaatgcaaaagggcaatcaaactactgtatgatataattctgtacaaacatttcaggaaggagttgcattatctgagcactcccaatcggatctccaaattgcacgtgccatcgtcggacaatatgacccacggctaatccccactcattcgtctctttgctttcgctcttacgcggctttcgacacattggaacggcatttgatcagtccgtccttctctccctctcttctcatctga

SEQ ID NO: 83342 - DNA, 1082 bp, Heterodera glycines
  Genomic contig location: Contig_ID=SeqID_18678; Location=410..1491; Strand=+
  SCN-specific regions: Sequence locations=1-162,184-370,392-729,752 -868,891-1082
atgttttcgttttgcatactttcacactcgattgttttacccagaatactcaattctcatactgtcgggaatcaacagcaaaaaaggcagggttacaaatccaagaatttgacgggggaaatccaaatttaactgcggcaaatgattcttttattcaaattttgggaaaggcacagggaaaaattcgcatttacgacaattcaactggaaaatttggagaatgaaaagtgtgtcttgatgagatttggacaaacattatatcagtaattgaagttgaaatgactaaatcaactaaagtaataatgggaaaaaccgagataatcgaaccatgaacggaaaacattattagcacatgtaaaggagcattttccaaaagaacaaaatttcttggtaaaaggatttagtcatcaatacccaagcataattattggtagaacattagtgatccctgggaacagtaataatgttacaatccaaattttgaatgctgggaatacaaatgtaaaaatttatgaaggatcacatattgctgacttggaacaaatttacataaatgcactgcctggagatgaaattcatccaaaagattacatgcctccggagacaaaatggcacgaaaatttgcctaaattaccaacacaaatcgtgaacccgccaccttcagaaaaaattaacctggaagggactagactaagtaaaaagggtcagaatgacttaaaaaagctcgcagataaatattccgaagcatttgtgggagaagatggtaaaatcggacgctacaaaggccaaattgtacatcgaatcgatttaatacccggatcattaccatttcatttccgaccgtaccgttatccgccggaaactcaaaaagaaattgaaaggcaaataaaactaatgcttgaccaaaacatcataagagagtcggaatccgagttctctagtccgatcgttatggtgccaaaggcagacaaaatatcgtggcgttttgcagttgattacagggctttaaataaaatgactaaaaaaagggtgttccatttaccaaatattcaagaattgttggatttaatgggtgcaaaaaa

SEQ ID NO: 83343 - DNA, 202 bp, Heterodera glycines
  Genomic contig location: Contig_ID=SeqID_18679; Location=781..982; Strand=+
  SCN-specific regions: Sequence locations=1-202
gttagggtgggtattcatgggcccgtcccgtattcatcctaattggggagaggctgagttcacttgcgacggtgtcgcatgcaggactccccgctccctggttacggtgtaaaattttagcatataggaatttggagtgggtgctcggaacggatattttcggactggaaatggccgtggacgttaccggcacatcagcatc

SEQ ID NO: 83344 - DNA, 245 bp, Heterodera glycines
  Genomic contig location: Contig_ID=SeqID_18680; Location=119..363; Strand=-
  SCN-specific regions: Sequence locations=1-101,125-169,206-245
atgctgtcctctcgccagctcggaatgagccgaaacgatgccaacggttgtccgcaactgtccgcaaaatgcacgacgcgacccgcgccaaatgccgcattttttggcatttcaaactttttggcattccgtaaaattgacgacaatctttgcctgttaaactttatggctgatgttattgttgttgttgctgatgatgataatgaaaatgaagatgcttcttcatcactgctgctgctatcaga

SEQ ID NO: 83345 - DNA, 557 bp, Heterodera glycines
  misc_feature (65)..(65): n is a, c, g, or t
  Genomic contig location: Contig_ID=SeqID_18680; Location=1..557; Strand=+
  SCN-specific regions: Sequence locations=1-85,107-158,195-239,263 -456,478-557
taaggatggcaaagatttgtccaagatggcacaaaatcggcaaataaaatgtaaaaaaattcatntaaaatttattcaaattagcgaaattattattttttaagttatcaattccgactctgatagcagcagcagtgatgaagaagcatcttcattttcattatcatcatcagcaacaacaacaataacatcagccataaagtttaacaggcaaagattgtcgtcaattttacggaatgccaaaaagtttgaaatgccaaaaaatgcggcatttggcgcgggtcgcgtcgtgcattttgcggacagttgcggacaaccgttggcatcgtttcggctcattccgagctggcgagaggacagcatttcagtggaacaatgaaaaatatggacaaattggaggaaaatgagaaaaaaaaaaccaaaaatttttgagatcgaatttatttaatcctattgttttctttgtatgatttaatccaattttcgaatttatttaatccaatttttctttctttgtattatttaatccaattttctttgtcaattaaaatattttt

SEQ ID NO: 83346 - DNA, 1202 bp, Heterodera glycines
  Genomic contig location: Contig_ID=SeqID_18680; Location=489..1690; Strand=-
  SCN-specific regions: Sequence locations=1-84,106-505,527-551,581 -687,710-820,842-844,872-882,914-968,1023-1128,1150-1165,1189-1202
atgagcttggctgagcaaattgcgccggaattgaacgacaatgaactttttgacgaaattacggcactgaatgagacgcttgaaaaaatttctgatgagaaatttagagaaatgaacgctgaacagaagtggatgaagctttttgaggcgaaattgcccaatcttcttttgcttgtcagcaaaattctttcaattcccgtgtccaatgcatgtgtggagcgcgttttctctctttgttcagcgcaatggactgatgtacgcaattcattgaaaatcgaaaccgtgaaaagtctggcacaaatcaaattgaattacgatctcacttgccccgaaatgtatgatttgctcatttcctcaccaaaattgttaaaaatgatcatgggaggtgaaaaatataatatttgatacattattgatcgaataaattgtaaaaataactgatttgaagcaattttgcaaaatgtccttattttttaccctaaaatcttattttttggccttgatgttcttatcttgaaaaattttcgatacgcgccctgataaagagtgacaaaattaattaaaacatttatttaattatcgtcattttatacaatgagaggcgggtgcatggacagtaaaatcaaactccttctgaattttgtagatggataaaggcatcagccgaaatgccaaaaaacaaaaattaaatttttaatgaagaaataaaggaaaccattatttatccactttcaagatttggccaatttttttgacattttttaccaagggaccttcaagaacaaataatgcaaatcctatcataaaaacataaagttcctaattataaattatatttaatcattccaattattcaaaaaatctttctaatctcatggatatattaattaaaaattcagtcttttattttggactttacgctcttaaaataagggcgtccctattttggtgtttatcctttttggcacttaaatttttcaataaaacataaaaataataagaaaataatattttcaaaaatacaccaccataaaatgcgagtcttctcaaaaaaagaatatttcattgacgaataccgaaatttagctctttttaattgcagttaaatccgatccccattaataactctgtgaaaaaatattttaattgacaaagaaaattggattaaataatacaaagaaagaaaaattggattaaataaa

SEQ ID NO: 83347 - DNA, 354 bp, Heterodera glycines
  Genomic contig location: Contig_ID=SeqID_18680; Location=1732..2085; Strand=+
  SCN-specific regions: Sequence locations=1-166,189-261,283-354
atgccaaatccgttggaaagcgctcaacccggaaccatttatcgacatatgaaaaagtttggtggttttatggtttgatgagtcaatagaaattgaaaagggaagtccggtcatttcctgcaatgcaatggatactgaatgcggagcgactattcctaaatccttatcaatttatatttaaatttataggaaaaacaaccagtagtaattgctgcacatttcttctcttttgatccgtaatttgccgcaatttttgaatcaggaaaaatttttgacaacaaatctgagacacaatcggccgatttaaagctttgcgcatggcgcgcggtgtgatatgcccaagcgcctaaacaa

SEQ ID NO: 83348 - DNA, 551 bp, Heterodera glycines
  Genomic contig location: Contig_ID=SeqID_18680; Location=2092..2642; Strand=-
  SCN-specific regions: Sequence locations=1-120,142-150,220-551
atgtccttatttgtaagatttgtccttatttagggctattgttcttattttgttcttatttgtcgcttgtccgaaaaatctgtcaattttctttataaattctgattggcgtactgtttaagaaaaatatttttaaattttgcattataatttcctttttgctgttaattttgtctaattatttttgtatttgttgtttttctcttttgtttttaatttagcagctgcactaatactaacaaatggcaccgcctaagcgcaaaaatgtttttaaaagtgaatatgccaatgaatttcagggtatcacaaaaagcaaaacaggagatgaattcgcgcattgtatcccatgcaattttgacatttcattgttgtctattggcaaagcggccattcctcaccatctaaagacggaaaaacacaaaaaagcagcgaaagctgcaaattccgctttggcaatcacggcattcatgccaagcaaatcggcacgaacgaatttggaccgtcaaacagcagcagtggaaggttgaattacaaattaaatcagaaataaa

SEQ ID NO: 83349 - DNA, 718 bp, Heterodera glycines
  Genomic contig location: Contig_ID=SeqID_18682; Location=205..922; Strand=-
  SCN-specific regions: Sequence locations=1-582,604-718
atgtgtggtttcatgtcgacaaagtgccttttctctgttcatttttatttcttcattttaattcaacttttttttcagttgtcctctgcccatgtttatttaaggtgagttttgtgcaatttgctggcctggttcgtcgtttattatttctaccaaatctgtgaaacttatttccccttcattttaaggttgtccccaggccaaggcgtcgaagaaattccagaaaattaagttttttttttcaaatcgaaaatctcaaaataatcgaatgtgtgtgtggtcttatttcaggcttctccaggactgttgccaactcgtcaaagctaattcgattgaagtgtgatttttttaacaaattaattttcatatgaaaattttgtgttttttgaaaaaaattttacgaattaaaaaattttgagggctgcaaattggctttcaccgatgttgtgtacacaatgtggggcaacttgaaaaagacgggcgatatggtgacgggacaagtcggctttcacagcgacaaagctgtcaaaaaagtgatgcgttttattgttaggcgctactttaaaaatggcccattttgaattttattaaaaaacccaaagggtggactcaaatttttatgattataactcgtaaaaacttgttctcggttgattttttggtccctgaccacaaatctgtgacacctatttacaccattttctcaaactcgaataaa

SEQ ID NO: 83350 - DNA, 241 bp, Heterodera glycines
  Genomic contig location: Contig_ID=SeqID_18684; Location=459..699; Strand=-
  SCN-specific regions: Sequence locations=1-17,58-81,103-104,151 -192,215-241
atgccgacattcgccaacaaatgccttccgctcgaacttctgtacgaaattgtgcctttcatccctgccgaaaatgccgccccgaatgcgctctcgtcctgttcgctgctgcacaaacttttgctgccacgtgtcatcaaatggaaagaggtatgccgtgccattggaattgggcttgaaaagcaatttcggtggtcatccactctgagaacacagtacggaactattgttcaatgggctc

SEQ ID NO: 83351 - DNA, 1019 bp, Heterodera glycines
  Genomic contig location: Contig_ID=SeqID_18686; Location=93..1111; Strand=+
  SCN-specific regions: Sequence locations=1-489,511-532,554-594,642 -1019
atgtgcgcgtttcaggtgaagcaagcgataaatcgccgaattcaatcaatgggatttatgcaattgtacagctcaaaagaaccaaatggacttgagtttcagcgccttgttcgcaaaattggggctctacaattctgtcctcccaactatttagcccgttcgcttcaactcatgcgccacctcatcactagggcgtgtaattatatggatataaaatctcgaaatatggccataaaatatggaccaaaaatcgcaaaatatggacataaaatggcaaaaatcgcgaaatatggacataaatggcaaaaatgtcaaaatatggacataaatttttcaaaattgaatgtaaaatttcttcaaatttattggttgaaattgcatatgagatacatttccaaattttttgactcggtaaggcgctttgacaaagacggctttcgttttgcaattagtcggtcaacattcggaaattagtctcgaattttttcggcaattacgtgcaatcattttaaaagaaaaaaaacataaaagctaaaatttattaatttttttagcgcaaaatcaacaacaaaagcgaaattttcgcttttttgcttatttttgatataatttattaatttttaagaaaatttaaatttattcaatattctcgagaaattttggcgaaaaaatgattttttgaaaaatttttcgggttttgggctcaaaaaggctaatttagctctgctgggggccgttctaatagaggttttttttgaaaaatgacaaaatatggacataaaatatggacaaaatgccaaaatatggaaaatatggatatagaaatccttcctagaagcttcaaaccaagctaaaaacatgtttttcgtgcgtttcaggcctccaataatccaggaaaaaaatatggatttccatataattacacgccctactcatcacacactccccattgaaaatttttcaccaagaatcacatttattgtcccaaacttattcaaatgaacggaatataatagaaa

SEQ ID NO: 83352 - DNA, 154 bp, Heterodera glycines
  Genomic contig location: Contig_ID=SeqID_18686; Location=445..598; Strand=-
  SCN-specific regions: Sequence locations=1-154
tgattgcacgtaattgccgaaaaaattcgagactaatttccgaatgttgaccgactaattgcaaaacgaaagccgtctttgtcaaagcgccttaccgagtcaaaaaatttggaaatgtatctcatatgcaatttcaaccaataaatttgaagaa

SEQ ID NO: 83353 - DNA, 1332 bp, Heterodera glycines
  Genomic contig location: Contig_ID=SeqID_3133; Location=843..2174; Strand=-
  SCN-specific regions: Sequence locations=1-313,337-352,393-618,640 -979,1001-1028,1050-1191,1213-1332
atgacgagccccgagttgcgtcagttcgagccgcttgagatgtccaactcggagccggacgacgatgagcggtcggaggacggcgcatcgctgggtgccgccaccgcacgcgggacgcgtagccgaagcggaagcgcagcacgacggcgacgcggctcatcgcggcacgacgggcacagtttggcacgcagcaaatcgaccaggcatgagaacggaatggacaaatttgttaattcaagactcttgagcactcggaaaagtgcgttgttcggaggcctaggctatttaccatcctaaaaactttcgagaaaatgggagaaaaattctgtttttattggcgttttagttatgcaaaaaaatatattaaattatttgaaaagttatatttttatctgcaacaatcaaatacataattataaatttttgtgccgtgctccgccgagaaatttttaaaaatggccaaaaaaataaaacaaaaacagaaatcctcaaattcaaaatctgttttgatctgaaaggggaactaaggtaaatgaccccccttttcagagcatcgttacggcatgccaatgcgacgggtgccaacagtgccattcaaagagtgccgacgggtggcggcagggacaacgccaattcacttgcggtgtccggcggtgcgcaaatgttggcacgcaacgcgtcttcgatgagtgcgggcactgcagtgggtggcggcagtcggaagcgggaaacgatttatctcaactgatcggactcaatcatcaataataaacataatgactgatcagttttgattgcttagcattttcttgctggtcagtgcttgatcgatcgaattttattattaattttcgatcacttttctttgagctttcgaaaagctgatcagacgattagccacatattttggccctttttctgctcccatttatctaactaatcgtgaaacgctgttgtttagaagcacattcaaattttctcagctgatcagtgcaatccttaagcttaaacatcaaaattgatcgattagctttgatcaatgcatatcagtccgagcagatacctttccgtatcaaattatcattcattgatctaatccataatgatctttgttttctcgatgttcccatgtgtttatcatccactctttttgaatctctcccacaatttgatcccactcttttgaaaaggccttttgttgcaaagtgccaatttttttctcatcattctgatcaatcaatatctatctccatgtatcaaccattgatcacttctttccaccaaaaaccgttacaaattgcttaacaaatgctaaattttatttataataaa

SEQ ID NO: 83354 - DNA, 155 bp, Heterodera glycines; identical to SEQ ID NO: 51421
  Genomic contig location: Contig_ID=SeqID_3133; Location=3071..3225; Strand=+
  SCN-specific regions: Sequence locations=1-155

SEQ ID NO: 83355 - DNA, 2732 bp, Heterodera glycines
  Genomic contig location: Contig_ID=SeqID_3133; Location=3657..6388; Strand=-
  SCN-specific regions: Sequence locations=1-259,289-509,568-874,896 -1119,1141-1148,1198-1638,1673-2026,2063-2186,2208-2732
atggttaaaaaacatccgcttattattgattcggaaaaggaggaacatctccttatcaatgacgaagatcgtggtgtgctgccaccaggaaatgatgctctttgtataggttataaaaagtttgattcatgaaaataattaacatttaagaggcaccgggatgcgttatctatggaaatgttggtcttagaaatcgtttaagcatcactaaaactggtgaaaacagctggcgaccacaattgtctatcaaacgtatcggaaatattttatataaatattgatatttttgagtttattttccctcgctttacgggctcaaatttattgtaactagcaatttgctcattagcagttgttttttctttttgtggtttaggcttgccaatttaatactaattgaagttttggcacaaagtattttgtataaaatcaaaaaaaaagttaccaataaaattttcaagcgcctgctgtgtaaagagttgatggctaacacaaaacatgcttttttcattatatttaaaaataatttttttaaatgtacattacaaacaaaataattatttaattgcttattttttattctagcaaacaatgcgcaacagcaacatgtccgctattacgctgagattgacggcaggaaatacccaactcaagggctcagttatgatattgatgtctgtgggacgggtcttttagttgatggaaagttttataaaaatgcggtccccacgggtcatatcaatgaaatcaatcgaattgaggaacgaattcccgttctcggctcaccgagcaaaggttagtgttacgttagttttaaatctctcttatttcctgatgaatattgccaatcaattctctgactcactatccgtctaaaattcttatcatttatgaaatttgcttgcaagcagcttatcccgttttatctttttagacattccactaattgctgcgggagatgttcagagaaatactgcacgtttacatacgaatgttgttggtcagcaaattttagggagtgtttcctttccaaaaattccgattgggggaaacactgattatataaacgctgggcataacaagcatgatggaaaaagcacttttggagacaccaaacgggaagaaaaacagaagaataaacagaaacagcaaaagagaggaaagccaatgggtggaaatattatacatataaataatcaaaacaatgaaaacattggtggtactcaagacatcggacgcatacaaattggaggaatgccaccaggaggagctcttcattttaatactggtggaaatcgcaacgttggtggtactcaaaagattggaggcatacaaataggaaggatgccaacaggagggacatttggtttaaatattggaggcaatcgcaacgttggtggtactcagaacattggaggtataaaaataggagggatgccagcagaaggatcttttcattttcatactggaggcaatcgcaatgttggtgatactcagaatgttggaggcatacaaatagaagatatgccagcaggcactactactgaagataatcataaccttgatagtgctcatgagattggaggtatgcaaaatgggaggggatgtctatctttttgataccaactaaaagctaagacttgaaaagattttcaatttttattttagatttagttgcttctctgcgaaatcaactcaggaaaaataagatttcgataaatggacaaaattacgcggttgacggacctaatgttaatgttggtgttgaagggcatgatttgagtgtgaatgggagagtttatcaaaacagggccacagagcagtatctggaaattatacaagacaaaaacataagaaatgtaattgtcagtgtgccattagcgttattttctcgcgaaaacataaccgttgggcaaataaacgctgaatgcgatggtaatttatacattggtcaatcgacagggggctgtcttcgcatattatgcgttgacatcaaaaagcgtgcgtatacaaatggaccaaaaaccagaggaaatttacaaattaaaaatacaacaatcgaatgtgtttccattggtggtggagatgaaaatgttattgaaagtgatggagttttacaaattaccgagtcgccaatgggcaatgttgcgatgaaaagcggtggaaatctaaaaatcaaaaactcgggaatggaaagagttcattttgaaagtggtggacagttacaaattgaagagtcaccaatgcacaatgtttgggtgaagagcggtggaaatttaaatatcaaaaactcgggaatgaaaagagtgattattgaaagtcgtggagctcttcaaattgacaacattgacaagttaccaatgggaagtgtttggttaaaaagtggtggagctataagcattgacaattcgaaaatagaaagctatgcgaaaatgaattctggcgggtctttcactataacgaattcggaaatagtaaacgatgcagaaatgcattctggtggacatttcactataacgaattcggaaatagaaaacaatgccgtaatgacaacatctggcggctctttcactataatgcgttcggaaataaaaaatggtaaatttgagtgcaatggatcaatgacaattaaggagtcgaaaatggagagtggtagcattgtgtatagtggaagctttactgattggaattctcaaatagcaagcaaagttcgtaaagagaaaaagcattga

SEQ ID NO: 83356 - DNA, 200 bp, Heterodera glycines
  Genomic contig location: Contig_ID=SeqID_3134; Location=403..602; Strand=-
  SCN-specific regions: Sequence locations=1-76,98-172,194-200
cgtgcatctatggcatttccaaggccattcatttatccatggcccacattttggctaatccctccgttccctcaaatccgatccccggttttctctccctcccttcagctatatctcagctggacatcagcagcttcactactctcagcaaatggaatttatcactttttgaagaaatcccaaagcttgggttttcctgg

SEQ ID NO: 83357 - DNA, 369 bp, Heterodera glycines
  Genomic contig location: Contig_ID=SeqID_18687; Location=1668..2036; Strand=+
  SCN-specific regions: Sequence locations=1-17,40-50,72-151,173 -187,209-369
ttacatttttattcataaattttgagcaaaacacaaaaaaggtcaaaataggttttgttaaacttcttagggttcaaagaaaataaaaacgataaaataagtgctaataactcgaagagttgcttaacaatcaccaaaaaacatattttccatgctttagggccactggaagttcaggaaaaataagtaaaatctaaaaaacttatttctatgtagtaatattatttagcaatacacattaatatgttaattaaaaagaaatttagtaaaactgacaaacaataacttgtttttatgattactgtcgaaaagtccattatttttaatttttctgtcgaaaaatccttcactgtcgaaatgtcctttgct

SEQ ID NO: 83358 - DNA, 780 bp, Heterodera glycines
  misc_feature (723)..(723): n is a, c, g, or t
  misc_feature (736)..(736): n is a, c, g, or t
  Genomic contig location: Contig_ID=SeqID_18688; Location=61..840; Strand=-
  SCN-specific regions: Sequence locations=1-233,255-333,355-694,718-780
atggaggcggacatcaatgccgaaaacaatgatggctatagtccgtttatgttggccgtcatgaaccaggacactcaaattgttcgttattttgtctcgaaaggggcgcgagttgatcggaccaacaaagatggtgaggagtacaaagtagtgatttcgggacgaaaacgatgatatctttaggggtatttttcgacattttaacgaaatatcaaccgagtaaaatgtttcggttttttattttttaatatttaccgatcgattcaatcacttgtaagatctctagtgtttaagcagtttatcatgctttattttaaacgctccaatttattttctgctcacaatcagcagctggaatttttgaaaaattttattacgttggaaaatttaattttgaaatcccaagcatttttttaaattttcattcaatttgggaagtcaaagccattgcaggcatttcgcgcttcacttctgtgccggcagtgacgacagatttgagttgtgcaaattgttggtggagaacggggccaatgccaaccaaaccgatggcattggtcgtggcgttacgcctttgcatattgcctgcggccacggcgctttacaaaatggttagaaaatgaaaattgccttccgcatcctatggattggcatatttaatattccataattagtcgttgctggcatttgccagatgtttttttattattattattttttgcgtgnggtgggggattanaatgatcaaagtctgggaccgggaattgccgggacttgaataaa

SEQ ID NO: 83359 - DNA, 568 bp, Heterodera glycines
  Genomic contig location: Contig_ID=SeqID_18690; Location=39..606; Strand=-
  SCN-specific regions: Sequence locations=1-403,429-517,539-540,562-568
atgaaaatttttactccttttctgcttgcttttatcggaactcattttgctgtgtttgcaacgctccattctttggatgaatggaaagaaacatgccgaacaattattaatgaaattgaagacactgaaactaatttagcggctggttggttttattaaaccataattgaaaagatttgtaatcatttgagatcccgaagtatcgaagatctaggaaatagagaccggaatacaatcaccaaatttaaatgcaaattcgaagctgatcagacaaattgatcagtattacgggcagtatcctatcgaatggaataacaaatttatccttttctttcaacttaaaattaaggattaactcatttaaaattaaagatttctaattgaatttcaactaaaataactgtaaaaaattatttaaaaaattttatgtcggatttccgcttgggtcgggttttccgactcccagttttatccctgtggccggtcggtaccaaatgaaatggcacacaaatgccgaatttaggaataattacattaaaataattcataaaacaaatgcttaaataaa

SEQ ID NO: 83360 - DNA, 2025 bp, Heterodera glycines
  Genomic contig location: Contig_ID=SeqID_18692; Location=602..2626; Strand=+
  SCN-specific regions: Sequence locations=1-40,62-1148,1170-1812,1834 -2025
atggcaaacaagttcctctcggatggcaataacatggcaatcagtgatgaaattcaaagtgaccttcaatgccccagtcgtgctaatgccaaacgcctcaactgcacactcagatggggctcatgtccaatgtgcctgcctgaccacgattcagcaaaaatcaactgccaatgccgagatgtcaaactcgaaccagcactcgccgatcctgagaagcgcctaccaattcagctcaaaaacttgcttctccggaacgaaaggcgggacatttttgccgaaatcacctacgcgccgattcagttgtccattcaattcgaggggcttcgaatcgctacggaagaagacctcacaaaatgccatgccatgtccaagggtcttttcgggtgctattcatgccacactggagctcatctccatttgcaatgccacaccgacttcggttcagcacttggctacgttcgttgttcggatggcaccgagttcacagctctctgccacaaaacaccagaaattttaaatgtcagcctatcattcaaccgtgccgaggtcgacatcaactgtaccattgaatgcagtggaggacggaacccattcgtgattaatggtcatctccgctatgtgccaaaacacttccaagcacctaatgaaggaagctcatttgcctcgaaggccaaacccagcaactcatgcctaatttggtgcccagattggaacttcgacttttccgatgtcttttggtatttctttggcctccaaaatgctctacgaactgttggcatcatcactctggcccttttcatcatctatgtccttttgcgttgcaaccctgcccttcgatcttggagagccataagccgagtcgtccttttgttccttgctctttggcctacgactgattcttctgcagcgggagagctgagccatctactcagcattcaaaattcagcaccaaagctgcagtttgaaggccattcttcggtgtcaagacgtgtgactgagactctcgacatttttgatgcacaaatcgggaccattcatctcgccaaaaaccaaaaatcgccaatggacttcgctataaaagccgtctctgtgccagtccattcaccattcctacaaattcccgaatcggccttccacattcaaacccaagcccaattccctccttttccaatggccacactgatctctttcctcgccaacacaatgaacatcgaggtggaacgctttggtcttgccgtgaccacatcgctgagccgttggaacgaggcccgaacaatcgttgagggactgcatgaacgcggctacgaactcaagacgaggcatctgcacccacgtgagcgaaatgtgcgacttcacggatctgagctgagccgaagtggtgcgaatcgtctcggtgcctacaatggaagtgcctgtggcccaactgtctccgagctgtaccgctctcgacatggcatcactcttcggcacccctctgccccatgcctgatggagcccggcgggaatggacaccatgattttttccccatcgaaatgatccgagtcgtggcccctgaccaagtttctacaccacggggcttgtccacacgctctcttccccgcccccgcccgtctcacttcgagctctgggacagaactgaccatccgccccggtcccgagaattggtgatcagcgttatgccccatggtgattcgacgactcgaggtgccgcggaggaataccgcatcggtgttggccgcgaactcacgatctctggccccctcgttctacgaatctatgctggtgcccttcttcttgccctattctctgttgcccttgtcgatggccaatcatctattgctggtccctgccctgctctttcatttgctctttgttctccacggccgctcaaaatttcttgcccttgttcgtcgctttttggtccttcaccttccgattttgtgcaaatcgtgaacaatttgctccgctggcttgttcaccgcttcccggcagcgaacactttgctgaaagccatgccaaattag

SEQ ID NO: 83361 - DNA, 1904 bp, Heterodera glycines
  Genomic contig location: Contig_ID=SeqID_18693; Location=57..1960; Strand=-
  SCN-specific regions: Sequence locations=1-878,916-1142,1165 -1287,1328-1423,1459-1504,1548-1771,1799-1840,1896-1904
atgccggccattgactgcgttttctacggcgccgctggcggcgccattgcgaacaatggcaccgaaagacactttttggaggaactttttctgtccgtgcgcgaaaagcagtaagaaatgttgcattttaaaatcattttttctaatttcaatttttagacccgctctgaacagcctgcaaaaagcaatgaatgaattgagtggtgggaaagtgccattgctcgacttttgtgtgttggtcgccaatcagcatttggccacaaatatcaactgggcccggcaggatgtgtacttcaaccaattggacgtaatcaacatttttggcattcattgcctttcaatgaatgatgccaatttgatcattttatcattttagcgttattatcgcccgcgttattttatcgctgcgtgggctattctccatctgatcgactttgcctacggcgttaagtctgatcaacttccggtccaagtgaatgtcggccaggacaaagagttgggtttttcttttttggcaaaatttgtgctaatttttagacaggtcgaaatgtgcagcattgcgctgttggggtgtgaccaattccgagtcgaatggaacgaacttttgctggtgggcaaatgcaaattttggaaaatgaaaatttatccgatggcatttcgccaatcggtgatttgattaaactcgggttgggatctccctcgaatcaaaattctcgagtcccaattttcgattaatcaaacaatgaatgaatgattggccaattgtgattgctgattgcctttagcaacttcgccaatatcacttcgatgagtacgattacgtcgccttcaaatacctcactctgctcgactacagtgttttccaccgtaagaaaaagttattattttctttttgtatttatatatttttaattaggccccccttatgacgaggcgaaattcgcgcagtttcgcgcccaattgtaccaaatccacagcaaagtgctgcacagttggtccgaactgcgcaattacaacggactgatgctttcctccgttttgttggacattttgcagaaatttgggtaatttttttcatttggccaaaaatttaaataaatttttcttttttcagccaattagcctcaaaatgcgtggagagtttgcggaagaaagcccaggcggagcagctgaagctgccccaactgatggaggaaatgctgggaaaaggcgccgcgggggacgaagcggcggaagcggtcaatggcgaagaaagcggcgccggaggggcgctgaacttttacgtgcactaattaattaattaatgagacaaatgggaagcagaaaaggggggcagaagaacgggcgacagaaagcagcagggcatttgcaaaacaaacattgtacgacagggacaatcacttcacttaattgaatgcagttgttttttatttcattttttgtaaatttattatttttcaatggcattgcaaaatctcttgcccaattttgtgtaaaaaaggccaaccaatcaattaattaaatcattcattcattaattattaattgtcgtttttccactgattttctctttgctgtctgattatttgatgcggatgtacagttgaatatttaattctgttcttttttcccactttttaattctctttttgcgcttcattcgttgccttacgctgttttttcttattttttatttatttatgcattttcattattaaattcacatcaaaatgtgttattttattattttttcttttcttgccaaaaagcatcctcttctttctttcttcctattcatttaccacaagcggcaatttgtcaaagcgatattattaaatgcattttaatttaatgtaattattttattttatttttttttgactaaaattaatatactgaataaa

SEQ ID NO: 83362 - DNA, 1467 bp, Heterodera glycines
  Genomic contig location: Contig_ID=SeqID_18694; Location=660..2126; Strand=+
  SCN-specific regions: Sequence locations=1-201,349-472,494-669,692 -761,791-847,871-1364,1386-1467
atgcccgtccccgactctgatggacaatgggcggtgagcagcgggtgtttgagcagcaatgaatcggcggcgaggacgagcctaaaagtgtcttggccaatctttgaattgttgttttaatcccacccaaagattggctaccgaaacattttgggcgtggagcaatggctttgcgggaaggacttttgcaattcgaatatcggaggaggagagggagagggagcaaatgattggggcggaagggagaaagggcggggacagacggacaaagatacaccgaaacagaacggaaaggacggaggaggggagggacagaaagagggcgaaaagagcggacgcggagaggaaagcagcgctaggcggaggacacgcggatggcattggccgatgcacttttgttgggccattttggcactttatttccttttcacttttgtacacatccattaataaaaactcgattataaacattcaattttaaacgttttcctttggaaatgacctttggacttggcttttttctgatcagtcgcattttggtccaaaaattggtcaaaggagcgactctcctttcccatattcccttcccacctaattatgtttaacatcccattaattatgcactttaacgtttccatgccgacttcattcgcaaatggtcttttcggtgaactgtcctccgtatgctttcatttaattaataatttcgtttcactttgcttttgctttctattaactcacttaaatgaattgttcgaaataaaaattgccaaaattttaaaatatttccgtcgaatttcggcacaatgaaaacctacgggaagcaccaagtgccaatgtttgatggggaggagaaggaagagaagaaagttggaacagaacaaacggaaggcaaaggaactcgcttgtcgcaacagaaggacgaatatttggagcaaaaaaggtgaaggaaaagcaaacccacgccatttgagtccctttccctcccctccgttaagtgcgtcggctctgatcaaagtcggcccatcggactttccgatcgcccaaagggtctcttcgcttaggtctaacggcgtcaaattaaaaacacatccgaccatcgctcttctcaacggcacaaacaatgaacagaacattcgcaaaagcgcttcgaccccttcgcttcagacaaagcctctccaaggaaaggaagatcggctgcagctgagaagcgaattcgaccggactgtgcccaatgccgcacaaatgcttttagcggcacgggaacgagaaaagcaaatggcaattgcatcgccgagaaatgttggaatgcgactgccaccgcttcagctgccaaacgggccgaagagaattgaaatggaagagtgtaagaaaggagaggatggagggcagggaatgatcgcaacggtggcgacacggcctttgccgcaactgcagccgctgaggcagtaccaagtcggagaataa

SEQ ID NO: 83363 - DNA, 780 bp, Heterodera glycines
  Genomic contig location: Contig_ID=SeqID_18696; Location=608..1387; Strand=-
  SCN-specific regions: Sequence locations=1-88,226-357,400-573,644-780
atgtgtagacgtacattgatacagcgattagtgcaaacaattagacaacgcaacaacaataactttaatgctacagaaaagacattggttttaataaaaaaaaattgctaattaatttaaattaatgattatttttgatcctcaaaaaataaaatttgaaaatgaatcattataatctattttaatatttttaaaattaaaaatttcattttcattaatttatttcttacaggaaaaagctagcgtaaccattgaacatttttatatatttttgagcaaaataaaaatggattttattgctcaaaatgccaatggatttgaccagaaaaacgaatatttggaaatagtatgttttgctaattttaatatagtaatttaaatagttatttatgttattaagcttcttcttgacggattaaaacgaaaagcaatgaaggaatttgtttcaactgttattgaagtggaaagtagcaattcgggttgaatttgattcatttttgaaatatatctaaaagatgattaaaatattaattttcgccttttaaataattcgtttatattttttttacgaagattttatatatttttgaaatttataacgacaatttattattttttttaatatttataaaagtaattatttcggcgcttttacttttatcatatttattttgtcagcaaaaatttgattttatacaggagttttaactgagtcaatttacatcccgaatattcaactaaacattagctgctatttgaatatgaattaacgcaaataaa

SEQ ID NO: 83364 - DNA, 1030 bp, Heterodera glycines
  Genomic contig location: Contig_ID=SeqID_18696; Location=1505..2534; Strand=-
  SCN-specific regions: Sequence locations=1-109,131-134,171-382,421 -622,675-740,770-807,830-889,927-992,1024-1030
atggcaaattatttactcatatttattctatttaccataatcagtttagtaaaaagccaaactccaataaataaaaatggtaaatatttttgttctccgacattttaggagcacttttttgaattaaaactgtctaaaaaacaaaaaataaatattttttttcaaaaaatggtgacccaaattaattttacgagttaagcatttaaggcaaatgaaaatctaaaaaactgatataaacatttcccaaagatttcgtttttaagtcaatttgaggtgctaaaaatttgagtcacttcttattatcattaaggagtgatctgaataacttgtgcaaaaaattggtcggaaaatatcgaactacgatttttttaacatgtcctagaaatatttttaatgaattatttttcatatttttaaaaacactttttaaggttcatccactgaaacgatacacaaaatgaaggttcaacatgaacagggtttagaatttttgaagctgttgacagaaattgttgatgaacaattcagcagcaacaagttcaatagggttagaaattttgtcggcaatttttattgattcaaaagccggacttttttgtcctgtttttgcgaaatttttcacaataatttttttttattatataaatttttcatttaaattaataaattttaaagttagaatttttttcagatgaattatgatgaacaaatctcttcagttttaaagtatataaaaatcaaattggaagaaaaaataaaggaaattggtgtacaattaagtgaaattggtcatttctttttgaatttttgctgtgagcagtttggcttcattaacactaccgatgaacccaacaaatccaacgcattatcagtgaatgaaaaaatacacaaaatttatcataatttaaaaatttttttttattttagagtaatttaagttcgaaaggatcaaaaatttgtatttttggcacatttatagcattagcagaatgtatcaaagaaaaattgatgaaaaatatgtaataataaa

SEQ ID NO: 83365 - DNA, 146 bp, Heterodera glycines
  Genomic contig location: Contig_ID=SeqID_18697; Location=204..349; Strand=+
  SCN-specific regions: Sequence locations=1-116,138-146
aaaaaagtttggcacgtcataactcggcactcgtactcatttcgcagaaaataaaaccacttttcttaagaacccatgggtgctctatgcacccaccaaatttcattccgaaactccacggacacctccagaccttcctttgttag

SEQ ID NO: 83366 - DNA, 1087 bp, Heterodera glycines
  Genomic contig location: Contig_ID=SeqID_3135; Location=77..1163; Strand=-
  SCN-specific regions: Sequence locations=1-321,351-363,385-856,887 -1087
  Gene Ontology: Mol. function=structural constituent of ribosome; Cellular component=mitochondrion; Biological process=protein biosynthesis
gtcaagcaattgacccgtatattcctcccgaaacttcgctgttttcacgaggggccaaagacattttccccgatttgaaggcatttgctacccgcaaataccaagggatattctacgggttgaggaggattcggaagaaggacggatttcagaacttcaatttgaaggttcgatcgagtacattcccatttccatggttccttttttggcaccaggatttcacaaaacttgccgagcaaatctacgcaaatgcgtacaatgcgttggcactgcgagacaaaacgaagctgcacgaactgatcactgaggccgcgttctctgtatgctttttcttttcccttttccaagttgagtgttcattatcagaaattatttaaaatttgaagaaaatgtggcccgatgttgagaaaggcacactccattggaaattggtgcagttcagcgaaccgtccaaagtgctaacggtgcgctgcttggacaacccgaccaaatcgggcaacgacattgcgcagattattgtacgaatgcacagcacacaggtgacaaccaacactatcaccaccacttttaatcatatccggtcaaattttaacaatttcagattttggcactttacgacaaggacggccatttgttattgggctctgaggaggagccaaggcaatgtttggaatacgtcgtctttgagaatcacgtggccagcgtcgatggaatgtggcgtttacacgtaaaaatatttaaatttgtattcttagcattctgaattattattttttcaacgacttacattctattcaatgccaataagtgaataattcctaataaagttcaaattttatctggaaatggatttggctggtttattatttattttttcaaaaatttcagatttaaatcactagaaatatcgaaccttttccatttttagtgccgcatttaccctaattggctgaagcccaaacaatcgccgcaccggcaaggactgatcgacgaagaggaaatggagaaactgcccaaagaaccgctcaaaatctcatccgggaaccaagttaagcagtccaaaaagagaagcagcaccgcaggatga

SEQ ID NO: 83367 - DNA, 631 bp, Heterodera glycines
  Genomic contig location: Contig_ID=SeqID_3136; Location=897..1527; Strand=+
  SCN-specific regions: Sequence locations=1-112,146-631
  Gene Ontology: Mol. function=chaperone activity; Cellular component =cytoplasm; Biological process=nucleosome assembly
atgacttcaacaaaaaataatagcaaactgaacgaattgttacaagctggtggttatgatgcttctgatggaattgacagtctcatccccagtcatcttaaacaagtaattcttcttaaaaatgaaaagttaaatttaaattttttcagctttctcgcccggtcattcgtcgtgttcgaatgctgaagaaaattcaggcacaatctttggaaattgaaagccagttttacaaggagttgcacgagcttgagatggtaagattgggagtttcatgtccgcaacattttctaatcgtagagctgacgacgctagggagagaatgtgatgcttgcctttattggaccccgaaataggctaatgcgaaatttcacaaaatcaccttttaggggttagtaaaggcgagtattagcttatcaccctttcattttttcaatttacagaagtaccaaccgttgtacgatgctgtgaatgccaaggtaactcattaaaaaggaagagacttgttcaattttctcttttcaatatatattttattcagaggactgccattgttcgtggcgagatggaacttacggacgcggacggtgaacttccgccgcttgttagtgaactcgagccacagactttggag

SEQ ID NO: 83368 - DNA, 236 bp, Heterodera glycines
  Genomic contig location: Contig_ID=SeqID_3136; Location=173..408; Strand=+
  SCN-specific regions: Sequence locations=1-236
ctcacccttctcatgtatcgttcgttgatgtgggtgtttcggttcgcttttgcggggttcgagcgtcgccagcccatgaaacgctcaaacccaccgggttcctccaattccttgtgatggtgcacaaaacgaagttgcatgatgccggtggaaaaaagtgatggtggaagacggcacaacgaacgcatggcattcaaagtcaaaaatggcataattaaaaatcttttttttctgaa

SEQ ID NO: 83369 - DNA, 1313 bp, Heterodera glycines
  Genomic contig location: Contig_ID=SeqID_3137; Location=594..1906; Strand=-
  SCN-specific regions: Sequence locations=1-359,386-456,480-505,537 -588,618-1313
atggtcacagcagggcaaaatccaacagattctggtggtgacaaatcggcatttttcccgaaggcattggccgttctttcttccggcgttttggcattttctgatcaggtaatcagccaatctctgacacgaagagtataactgtgccggttactaaaaactgaaagacgctcacctaatgatcaatctgatcagtaattagccaaatacgcaggcaatcgcggctattcgacaaattgagcattcgcctcgaattcaattcgacgcggttgccaaggtgtaccgggtgaacagcacggaaacgggtgaactgctcgagtttgacgagtggggaaggcatttgagcacattagccacggacagaagcggaggaggaacagagagaaggattttgttgaggagaagcatcagttacggagaagaagcggaaaatgggcagacaatgctaagcattttggaggagaaagaagggcaaaaaagcacggaagtgaaagtgatcaaagggcaaggcggaggaagaggaggagcagaggggacggacaaacaacgattgtggacaatcgaaacggaagggggacaaacggttgtggaggaagaggagggggaggaggaaaagggtggagcaacgactgaagcggaagttggggcaggacgagcgggggacaacattgttcggcagaatgtgagcgcagatctttaatgtttttccagctcaaattggagccttttcttggcttcgagtctcaagatcaagagcaaactcaaattctcgggagtatcattttttccaacgagtcgagttctaaaatgatcaatcttcgtttgggctgtccgcggagttttgttcacggcttggttttgggcttggccatcttttcccgtccccatcaagtttccgtatttctcccttcttccagatcagtgtcacttcatcggccgatccgatcagattgcaattcacccgggacggactcttgaaaagggtgtccaacggaacggaccgaacattcttttcatatgacgacgaaacacggctgccaatttgggcaaaattcccggatggaaccgaatttgaaatggcggcgaatgaatggaaagcaaaaggggaaaaacggagaggaaaaagcgaacggaggagcagggcactttggacactgggaaagtactcagatgaccgcgccgcgcgagtgtttatgggagacggcgaaggtcggtcaattcagtcagagacggaccatccgccgaaggcgttaaatcccgaatttgtgactttttggtccaatttatacatagagaagaatggcatttggtga

SEQ ID NO: 83370 - DNA, 3887 bp, Heterodera glycines
  Genomic contig location: Contig_ID=SeqID_3138; Location=1..3887; Strand=-
  SCN-specific regions: Sequence locations=1-477,500-636,675-879,901 -991,1013-1360,1382-3101,3123-3577,3599-3887
  Gene Ontology: Mol. function=heparin binding; Cellular component =extracellular; Biological process=negative regulation of cell proliferation
ccaccgctctcgcaaaactctcggcttctgatcaacctcactgtgtcgccaaaagcgcgcattgtgctgttggcacggcattccgttaggccgacccccggggcgcatgattggcagaaaattgtttccggtgaccgaatgcacccattgacaaccgatcggaatggacgcgacacggtaggagagcagagatcagaatggaatgaaagcataaagtagtgattagaaaagagaccctgattaagtcaagttgagctatggccaagtcaacctgatcagacaaagaataagacatgagatttgggtttttggggataagaaatgaattcagaaaaatgatcgagatcgggagtctatagtttacagtaaattaatttaatgaagactgattgaatcattataaccaaatgatccaaatgactaaagtgtgttgactttttcagacgtttcttcggcacacaatgatcagtcactttctgacagctggccgatggcattttggctttttgaatgaccgggaacaggtgttttttggcggtgattcctctcacaatttgccccattccttcagaatgaagcggtcactttgttggctacagtcacagaaaacggtgccgaaagtgatccccatcatttggcattgtcctcctcctcctcttcgtcgtccgatgatgcgccgtgccaattcgactgtttcggcaagggattgtgccgtgccgggcgctgtgtgtgttaccccggctacggaggcgtcttttgcgaggagaccgcttgtccggtactgtgctccggcaatgggatgttcagcaacggaaagtgccagtgctatgccggcttcaaaggggtcgagtgccaaatgctcgacaattggtgagacaatgggagggaacagcagggaaaggggacaaagtattagtgattatcgagaccaagcgattgtaaattgggcccaaaaacaattgggcgggggacggccgataaaattggaatttttaattaaaaatgcacttttaaattcaaatttagaactttaacgaaaaagctttcttattcaaagtgatgaactgcggcgcattttaaaatagactgattttgaattttcttaaaaccaaagggcgggccaatttgatttgcaaaatgatccccgaaattttggggtttgctcatcacgaatcttacatcacttttgatcaattccgacttcctaatttcaaaaaaatcctggatcgaaaaatttgaatttttgacttttgttcgagctcagtttggggcttagactggtaaacataggtatcagattcatgatcagggactccaaaaatacacccgggaacaataaaagtcatctcattggaaagggttcttaaatccaacaaatccttcgaaggtgtgaggatccgagctgtgcagggcatggcaaatgcgattcttcagacggaaagtgccattgccgggagggatggactgggccaaattgtgcggaaaggcaatgtccgggccgaaacgattgtgccgggaggggcatttgccacgggggaaaatgcttttgcgcgttgggatggacaggcgaaggctgtgagaggaaggcaacggaggaggaaaagcatgaagaaaagggcgagcaaaagccgaatggaaatgacaaaattggaccgaccaatcggaaaaaaacggaaatgccatccaacggaccgagccaatgcccacacggatgtacggaacacggcacatgcacagccgacggacagtgccagtgccaagcgggatggaacggcgagaattgtcaaattggtcggtagagaggcaatagtttgggaatttgactgattgacggatttttattcaaaatgccaattgatcccccgtttccgtttcgttggcattgtgagtgagtcataagctcaacaaacagcaactcttttcagaaacgtgcgcgcgaaactgttcgaatggtggccaatgtgaactgttttcggatgggtggcggtgccaatgcgacacggcacattttggggaccattgccaattcgcaaagggcgaacggagttgcgacgacggacacgacaacgacgggggtgagagagaagcattgaaaggacggcggaccattaacagaggcacaataataggatgtaaatcaaacttttagccccgactttccccccctccctcccttcaaattggcatttccataaaaaattgccaattttgccccttcagatggccttaccgattgtgaggattccgtcgagtgttgtgcccacccgttttgcgcctccgattcgctgtgtttggccatgcctttcccaagcgaagccgtcgatcgccgctcactttccatcagcgatcgtttggcttctccctttttcgatcgggtcaaatttctcttcgatgggggcgaacattcggtgcagcgatacgcggacattcgccttttggacagaaagtgggcagatatcgataaataaatacaactatatatcaatcactgatcactcattttccctaatcttcgatcaattttccactcattttcaggcgcatttccgtcctccgcggccgcgtcttttcctcccggggcggtccgttgacaggcgtgcgcatttctgactcagaaaatcctcaccacggcttttcgttgtcccgcgctgccgcaatggacgaaagtggtgaaacaacgacaacggctggcacttttgaattggcactgaacggcggcggaatggtatcagttcaggtaggggagagactaagccctgaaagtgtgaggcggcaaaatttatgattgtctcccatgttccattggcatgactaagcccagcccttcggggaaaaatgccatgaattggacattctgtccaaatcaatcggcttcttcttttgattttcgtttagttcgttcggcaaccgtttggccgtgttccgctcactttttacttgccaccaaatcgaatcgtcagcattggcaccgtttggatggaccgtcctttctcgacatcgacgagaagcggctttttccccgccgccccttctgcgtccgcgtcgcattgcgttgcgtctctctccgattggcactttcgtccgtccgtctcgcttctccgcccgctctcctcctctcccactgtccctcttccatctgatcactcttcttcttcttcccctacgctttctccacaattgtccatcgattctcgcgccatttcgctctctgtgctcattcccggcactgatcagttcctcttttattcctcaaactgtgccgacggtgctcggagtgtgctgcgcgtccaacttttgggcgaccgtttgcccgccgggcttttgcgcgtcgaattggcactacaaattgacggagtgcggcaccagcggacattcgcaccgcgcgagtcgctttcgcatgaattcgtgtgggaccgacaaaatgcgtttggacaacacgagtacggacttcgcctggcgcaatgtgagtttaaattattttttgacaattctcgaacaatttcccgcctctctgatcacggacattgagcctcgagccgagaaatgttcctttttgggttttaaatgaattagacgacattttgccctctgagtcaacatttcttttccctttaagtcgacatattgtccctttgagtttacattttgtccctttaagtcgacatattgtccctttgagtttacattttgtccctttaagtcgacatattgtccctttgagtttacattttgtcccctccgttcgcttcagtgaccatcagttttcatctgtccacttgtgcgtcgtccgtccgtcacttcgtttccctccatttgtccgctcactctctccccgcttctccgatgccgtcgttttggtctctctcttccgtccatcggcttcatcc

SEQ ID NO: 83371 - DNA, 81 bp, Heterodera glycines
  Genomic contig location: Contig_ID=SeqID_18698; Location=518..598; Strand=-
  SCN-specific regions: Sequence locations=1-81
gctaacaagggaacattccgagctgtgagtgggaaaatgcatataagctatataccattggatagagcggggtcgacttgt

SEQ ID NO: 83372 - DNA, 1952 bp, Heterodera glycines
  Genomic contig location: Contig_ID=SeqID_18698; Location=1..1952; Strand=+
  SCN-specific regions: Sequence locations=1-204,242-300,325-402,424 -782,835-838,861-966,990-1365,1401-1466,1488-1494,1516-1594,1659-1952
ttcatcaataagggcgtccattggaataggaggaggaagaaaatggccaaagaaatcggccggagagcagtaggaacgggggggggggggggggaggatacccctcgcatacctaatttgcattttttttggtgtttctcacaattgtttcggtacgattcttccttttttaatagcattgaagactccgatttattttttaccaaaaaaattatttttattcttatttaattcaaaaattgttcgagttcgggtcaggcgttcggtattgggaaaaataaacgtcaaattcgtgattagcggcccaaaaaaccccaaaaataatcaaaatacaacttttacaggcaagaggatttgaacccacagcccagaaacccatttttaaccaaccgagcaattcgtttcccttcctttccctctgtcgagaatgtgccccgaggcaatgaaattccaatttttgagggcctgtaacttttgaagcaggcaaaatgcaccgctaaaattaaaaattcacaatacaagtcgaccccgctctatccaatggtatatagcttatatgcattttcccactcacagctcggaatgttcccttgttagcataggaaattctggggccatcctaaaaagtgacacatttttctgtatcccttcagctatttgttcgtctcccaggagcgtttcggcttcgccctttggtccgcccttttgcagggaaatatcacttggcaagagaccggcattttcccacgcgtcacttggtgcgattttgatgtgagaagaacaatatatttacattttttaattttttcaaaaaatgaacatttaaaatttttagaatgaaaatttgtaattttccccccaatttttcgtgttaaggtgcgcgagatgggccaaactgtcaaccacacggtgcaatgtgtgctcacactgaacgttttcatggagaaggtgtgtgtgcaattgacattaatttttcatttaatttttgtctcaattttcggtagaaattagtttagcccaaatgatttatgactaattggggggcggcacgggtttaattccattccatgaaatgatcattttcctattttctacgccactgaacaggtgttcctgatcttgtgggcttggtacgctgtgttggccgcgttgaccctggccaacatcaccgcttggctgtacggctatttgagcgtggcgtccgctgaccatttcattttcaaccatttggagatggccggcgctgaacaaatgctgctgttcgacatggacgggcggacgaaaagcaaacgtaggcttatgtttggagcaaaatttttttaggtttaattaccccctattttactttaatggttaatttgcatcaaaaaaattaattgaaaatgaatttattttttattgcaattgttgtctagtggtaggccagtgttcagacaaagacaaaaatcacaatatttattcattgaaaatttttaagagaaaaagaaatttggatttattttaattatggtaaaaattctgaaacatgtaacattaaaagaataaatatttcgggagcagctcgttacactccccgtgtcgttccctccaaaagtttttaaatttcaaacttataaaatgtttttttgaaattttctaatagaaaattaaaaaaaataccggaaacgatacgggaggagggcgtaatgaacccaaatatttcattttataggcaatttaggggggagctaattgtgtgggataaatgtgtgaaaatgatcgatgctgtttgttcatttatattttttgttgcgcagatatgcaattcgccgtgcgtcgcttcgtggccgaatatttgcgctccgatggcatgttcattctgcgcctgattggccaacatgcggacgttgtgttcaccaccgaccttgtccaccggctgtggacatcgcactacgaaattgagaaacagcgcg

SEQ ID NO: 83373 - DNA, 339 bp, Heterodera glycines
  Genomic contig location: Contig_ID=SeqID_18700; Location=2318..2656; Strand=+
  SCN-specific regions: Sequence locations=1-339
atgcatttgcttattattgttttagtgttctttttcataaagaattcaattgacaaaactttatcagttaatttatatgaaaagaatggaaaacttaggccaacttttgctgaaatatttggccaaaaatgggacaatgaaaaaatggaatgtgaaaatgaaactgatcaaaatgcaaattatctccaaaatgatcaaaatgaattaaattcggtcgattcaattagcagtgatcagaataatcaattagatgatcaacaaaaattcgaaattgttcacaaattcacgcaataaaagaacgaattaagaaaaaagggaaatattcagcaaaaattcaga

SEQ ID NO: 83374 - DNA, 291 bp, Heterodera glycines
  Genomic contig location: Contig_ID=SeqID_18701; Location=155..445; Strand=-
  SCN-specific regions: Sequence locations=1-137,170-291
atgaacttggatgacctgacgagttggccagcggtcaaggaagcgttctgcagcggaatggaaaatccaaaaaaattagaacgctgtcacaaaatggcagaaaaattgcatttcatcgaggaggaagacaacgaagctgaccatgatgaggaggaggatgatgaagataaaaacgaagttggcttgtccacacgttcaaattttgtcgattcacaatttgggaacaatgagcagatccatccaatcatgtcgggcgacgccgaggacggagaagcggaaagtcgagaatcg

SEQ ID NO: 83375 - DNA, 1001 bp, Heterodera glycines
  Genomic contig location: Contig_ID=SeqID_18701; Location=529..1529; Strand=-
  SCN-specific regions: Sequence locations=1-276,298-497,520-731,765 -1001
atgatattctttcttataattgtcatcatcacgttaattattagtgattcatttgcagcaattgaagaatttcgatttagccgtaggcaatcagcgggagatgtgctccgcagagcaatgtcagcgagaaattacacatttaatgaaccattaattgtgataaaccatatggtcaatgatggacaagaaagtaatgagcaagtgagtttttacggggttatgtaaatagattattcgaggtgacaaactaaactttttaattgattaacagaccaatagttctttttctttgtcgacacttatcgttgcaaaagaattgtcggacgaagaaagacggataaaatcagcaaaagaaattcaacaagaattattggcaaatttgcgcaaaatccgcgaaaatattccccgtccaaagggtgtaaaacatttttttaagcggtttattgaatcaagaaaaacgaaaagttttgagaaaaaattggcaaaaaatcccgatttggaaacagaaatcagtgagacggtgctggacgaaaccaaagggggcccatgtgaaaaactgttgcccgcacgtgatgaaaatgggaagctgttcaccgattatgagctgagaatgaaggcacgttgacaaatgtctatttttgcggggacgtcaaatgcttttggccaactccgtctcagccaaatttaagattctcagtccaatagtttcaagctttttttggcattatcgatcccttttcttttgtaatttttgaatactaagcattttggtgcttatttgttagcaaaaaatggaaaatatgcccaaaattggaggcagttttttgttgaaaatttgtatttgatggcttttttataacgcctcagcaccctcacagggagttagcccgcttcaccattttgtatattttataacagagatgatttccccttctccactcaaaagtgtacaaatttcttaaaaaagcttcaaggttgcacataaaaatataaaaaataaa

SEQ ID NO: 83376 - DNA, 569 bp, Heterodera glycines
  Genomic contig location: Contig_ID=SeqID_18702; Location=190..758; Strand=-
  SCN-specific regions: Sequence locations=1-25,48-569
atggcaaatgggaaaacggcgcagcggatacgggaggacgatgcgcgacggatggccttcatcacatctcaggtgcaacaagtgctcgtattttgggagtgcgaaatcaacgcggagaagcgcaacaacaacgaaatgaagcgctcctttgcgcagtacaaggacagcggccctatccgtttgaaggactgctaccatggaggacgtgtgggtccgcagcgactgcactacgaggtgccggaggggtggcggatgaaatattacgacgttcgttcgctctacccccacacgaatgccgtgacagcataccccgtgggtcacccaacacgagtgaacatcattggtgaggcagagcaggcggttgactggcgacgcgccgaccaggtgccggtccgtggcattctcaaagtgttcgttgtgccggcccatcacgttgatgtgcctgttctgcccgtgaaatttgatcagcggcttcttttcccgctgtgccgtacctgtgctctgcaacacccgcatggagcggtcaatgaagactacgagtgcacgcatcgcgaggatgatgagcgggg

SEQ ID NO: 83377 - DNA, 843 bp, Heterodera glycines
  Genomic contig location: Contig_ID=SeqID_18702; Location=827..1669; Strand=-
  SCN-specific regions: Sequence locations=1-522,552-843
atgctcttcgcccatttcgggggtcgctttgacaacattatgctgtttcggcagttcttcctcaacgggttttgtccacagatgatccgtcggggtaacaaattatacgaaatgaaaattgcgaggggcgaaaaaaacccggagatcatcgtaagagacagctggaaccttatgccggtgccgctcggcgctctgcccggagcgtttggactcaatgtgcaggataaggaatttttccctcatttggcgattgttgcggcgaattatgggcacattctgcagtcgctaccgccaaaagctgactacttatacggcgggatgacgcccgaccgacagcgcagattcgaccagtggtacgcggaacaccaccatcagcacttcgacctgtgtgaacagctcgcagcctactgcaccaacgacacgcgcatactaattgaggcgttggtcgcttttcgcacggagttcttgacgatcagtgacccgctggagcggcatggatgcttggatgacgacaacgacgacgaagaggaggaggaggaggaggaagaagacaatgcatttgaagtgatcggcggtggcattgacataacgtgggagccgatgaccatcgccagtgcctcaatgagacactttcgacttaatcacctcaagagggatcagctcgcgatcgtgcccgagtgcggctacgacactacaaacacgcaaagccttgtagcgcttaaattcatggactggtacgccaaaaagaacggggtgagcattcagacggcacactcgccaggcggagagaaaaaattggccagtacactgtggacggatacatcgcggcgaccgacaccgtga

SEQ ID NO: 83378 - DNA, 821 bp, Heterodera glycines
  Genomic contig location: Contig_ID=SeqID_18703; Location=807..1627; Strand=-
  SCN-specific regions: Sequence locations=1-685,707-821
atggaaaaagtggtcaaatttgaggaacatcggcacaatcggtggcgcagggccccagcggtgtggggagagccggcgccggattattcggcagtcagcctcggcattccctctactgcctttttcctctatgctctgctgtttgtcgacttgaagacggtgaagcactaaagtgggctaaaaattggcattttcctttcatttagcaatgggaattgcataggtaattttgggtcaatttaaatattatttagtcggaccattatcgccgagaacacgaagtcgtgaagcgagaagtgatgcgactgcgaaatgaggcaaacactgtgagaccgaacattaattagcacgccaatggcactaattaggcccaaataagcaaaaaccaaatagaaagttggaaaatccgccataattcttgtcggcgccgtcagattaacagggattattaaaagcgaatctgcttcagtacttcttccaaatcaacatccgtctgcttgtcgtggacattttggagacttttcgcgacgatctgtccgcctcactgtattctttcgagcagtaccgtaaccagcgtgttgcccagttgcccttccacaatgttgccgttctgatcagtcatcgccacgcgggcggactcgcattcatcggcgggctgtgctcagggcgaaatgtgatgatggccggggttggtatagaacaataaatttaaaatattctcacaaaatgtgcaacaatttcagttttacccgcacaaccccgaggcaatggcgtccattttcttccacgaagtcgcccatttgatcggtccgtctcaatga

SEQ ID NO: 83379 - DNA, 733 bp, Heterodera glycines; identical to SEQ ID NO: 18709
  Genomic contig location: Contig_ID=SeqID_18709; Location=1..733; Strand=+
  SCN-specific regions: Sequence locations=1-733

SEQ ID NO: 83380 - DNA, 946 bp, Heterodera glycines
  Genomic contig location: Contig_ID=SeqID_18710; Location=829..1774; Strand=-
  SCN-specific regions: Sequence locations=1-131,153-335,357-543,570 -591,618-812,849-857,879-946
  Gene Ontology: Mol. function=nucleic acid binding; Cellular component= integral to membrane; Biological process=transport
tcggatgagttttgaagtgaaagcgggccaaaccgtggctttggttggctattcgggctgtgggaagagtacggtgatggctttgctcgaacggttttatttgcccacccggggaagcattgtaagaacgaaaggatggaaaagggagggaccaatcaaagacagtgctaatttcagctgatcgacggaattccaattgaggagataaacattcacagattgcgcaaccaaattgcgatggtttcgcaggagccgacgctgttcgactgcacaattcgcgagaacatcacttacggaatggcggacagagaacgcataacgcacgagcaaattgtgagggcggcggagcaggcgaatgtgcacaatttcgtgctgggactgcccgaaggtgtgcagttaagggattggcggaacagcataatttggcggatgaccgcccaccaattagcccctaattaattgccttaatgtttgttttgttgccccattttgggctatgagacgcgggtgggcgaaaggggcgcccaactgagcgggggccaaaagcaacgcattgccatcgccagagcactgatcagagagccgaccgttcttctgctggacgaggccacctcagcacttgacacggaaaatgagaaggcaatcaatccgaatggggcggaaagggaggaaattcctttgttttaaaggccgtcaaaaaggcattggaaaatgcccgcaaggggcggacttgtcttgtgattgcgcaccgattgtcgaccatccaaaattcggacattattttcgtgatcaaagacggccgagtcgtcgagcagggttagcagaggcagagaaagaccaaagaaaaacatttgctcacccaaacacaggtgggcacgacgaactgatgagcagaggagggatttacacgacactctgtgagacacaaattctgaaggaagaggcg

SEQ ID NO: 83381 - DNA, 1035 bp, Heterodera glycines
  misc_feature (1020)..(1020): n is a, c, g, or t
  Genomic contig location: Contig_ID=SeqID_3140; Location=665..1699; Strand=+
  SCN-specific regions: Sequence locations=1-66,93-187,210-1035
atgcgcaactttgccttcattttcatttggtttctgatccagttggggaatcatttgctgagtgagttaaaatattaataaaaatataataagaaataggcaaaatggataggaatcgaatcctcgctatgccaccatttcgaaaatgacaaattcatttagttgatacgggagttttattaagtacttaatatttataatgtttagaaaatgttcgtgcttttccaactgcagaaaatggaagcggaatggtaagtggagtgtttgtggaggaagaactagcagttgaaatagaaaagcccaacgaagcgaaccagaatgtcaatcctgaacacgatcaaactaaacgcgaaggagctgtaagcgaggggaacatgaattccaatcatggacatgcagagaccgtatacgagggaaacatgaatgccaatcatgaacatgctgagaccgtacacgaggggaacatgaatgccaatcatgaacatgctgagaccgttcacgaggggaacatgaatgccaatcatgaacatgctgagaccttacacgaggggaacatgaatgccaatcatgaacatgctgagaccgtacacgaggggaacatgaattccaatcatcaacatgttgagagtgcacacgaggggaacatgaatgccaatcatgaacatgctgagaccgtacacgaggggaacatgaatgccaatcatgaacatgctgagaccttacacgaggggaacatgaatgccaatcatgaacatgctgagactgttcacgagggaaacatgaattccaatcatgaacatgctgagaccttacacgaggggaacatgaatgccaatcatgaacatgctgagaccttacacgaggggaacatgaatgccaatcatgaacatgctgagattgttcacgagggaaacatgaattccaatcatcaacatgctgagaccgtacacgaggggaacatgaatgccaatcatgaacatgctgagaccttacacgaggggaacatgaatgccaatcatngacatgctgagactg

SEQ ID NO: 83382 - DNA, 531 bp, Heterodera glycines
  Genomic contig location: Contig_ID=SeqID_3141; Location=221..751; Strand=-
  SCN-specific regions: Sequence locations=1-531
atgttcatgattggcattcatgttcccctcgtgtacggtctcagcatgttcatgattggcattcatgttcccctcgtgtgcagtctcaacatgttgatgattggaattcatgtttccctcgtgaactatctcagcatgttcatgattggcattcatgttcccctcgtgtacggtctcagcatgttgatgattggaattcatgtttccctcgtgaacaatctcagcatgttcatgattggcattcatgttcccctcgtgtacggtctcagcatgttcatgattggaattcatgttctcctcgtgtaaggtctcagcatgttcatgattggaattcatgtttccctcgtgaacagtctcagcatgttcatgattggcattcatgttcccctcgtgtaaggtctcagcatgttcatgattggcattcatgttcccctcgtgtacggtctcagcatgttgatgattggaattcatgtttccctcgtgaacaatctcagcatgttcatgattggcattcatgttcccctcgtgtaa

SEQ ID NO: 83383 - DNA, 1652 bp, Heterodera glycines
  Genomic contig location: Contig_ID=SeqID_3142; Location=297..1948; Strand=+
  SCN-specific regions: Sequence locations=1-72,95-650,711-714,736 -1024,1068-1091,1113-1193,1220-1226,1248-1652
atgtactccatttggaagcatttgcgcgaaaattcctgctacagactgctgttcttcatcggaatcactgacctgagcatactgtggattcttggattcctccgggcatggtttaatctgcacggatatgtgttctgctcctttccgacactgatttattttgttggcattgcgacaacatgtgaacaatatatataattaaagagttatcgaagcgctttattcaaaatcccggtgtttgaatttttttttctgtccaaaaaatgccaaattccgatgaatggtttgcggcatttttagtgatatgatttattattctgaaattttttcacctctattttttcatgatctagcttggctcaatttaaaattttggggctttttaacatttaaaaaattgagagacttgttttatgatcgattttctggaatattaaatgtcttcacaaaaaatattaatatccatacaataaataaatatttggtataattcgtgaatttcgatgaataattaattccattcatttttctattttagcgctttggatggctgaaagcactgctgatttggtaggaataattaacatacaattattaaacaatgaacaaattctcaaaaaggaattattaatatttagtctgacacattgtaattttatcatttaaataatttatatttttaattttattttatttaaaaatgattttttggcatttcacccccaaaaggttttggcattcaatcgctgtgttgacttcttctcaccccattattcgcgacttttgttcagtggccatcgaacattgttttggaatggcgcctgcgccgcctacgcattatattgggcaattttcctcaaaccgggcatctacagtagcgtttattttggctcctttttcaacccattcatgggctaccgtaacgatgaacaaattgaggttgacaccagaaaaaataggaaattttaggagaatttttgcaaaataaaaagttataaaacacattttgcgggaaactttcttgaaaaaataaaaaatttttttattttttttattttaatttatttccctatggcattgaccgaatggaatcccgagaataatttaattaaaaacatcctcccattctccaatattcttttttgttcgataacagcatatttcttaaaacaaaaaaaaatgcaaaaaaaaggaaatattatttaaaaaatttatttttcacatggaaaaataaattttttttaaatgtgaattttcttctagggaaaatcccggtttaattacgcgatttttttttatttttacaataaatagggtaaagcgaaatgcgtaattgaaaatgcgatataaaaaaagagcgaagtaattcggcaaatccctttgtccatacaatacttctatttttttgtaccgattacagtaccaaccggtgttgcacattttccacaacactacggtggcagtgctaagcccgagcatttatctggtctttatcataaaactgttgtacgacatacaaataaatcgcagacagctgagtgctgttgtcaccgaattgagcgctgtgcagagaaaggtggtatatgattggatttttttagattttccaattttttaagttttggaataatttaatgatttttaggtatgaa

SEQ ID NO: 83384 - DNA, 1595 bp, Heterodera glycines
  Genomic contig location: Contig_ID=SeqID_18712; Location=1..1595; Strand=+
  SCN-specific regions: Sequence locations=1-126,224-371,395-427,450 -812,853-970,992-1595
attagagtgcgccgggacagggaattttgggcaaaaccgggaccgggccttgccgggacctgagaagccgggaccgggacctcgatttttgttcgggatcggaaccgggaccaaccgggaaatttcaaaaattcaaaaaaattttaaaaaattcaaattttaatttttttaaagtgaaaataatataaaattatttttttaattttatttttattttataaaacccaaaagttaaagctaattaaattaatgaaaattttcaaatcgaatttacttttattatttcaaacaattaatcaatttttgactcaaatgatcgaatattattagaaattcagatttgcttttcacatcactttatttcggcgcgctttttccaaaaaacttttgggaaagaaagggggtccggcggtaccgataggcgccgccgggggaaattttgaaaatttgagtgcaatttgttaacagattttcaacaaaaaatgctgatttttgggattaataggctcattttgtactgattttctttaaaaaatgataaaatacaattaaaaaattgaggaatcatattttgtcggtaggaaacccatgaatatacaaaaagaaaattcaaaatattttagtttctgtaaagggattgaaccaggggaaagatgaagggaaagtcaaggagactagccactaggccatttttacagttggtactactacttttatcaaatatcttaattattatttcaaaattttttcttttcactccaattttattcactaatatttcactcagaccctcattcctaccagtgcttgttccgggacctcggatgaccgggaattcccggcccggtcccggtcccgacgcactctaatatatataattaattggataatgcccccatagaattggcaatccgcttgtgctttctccgcttgtcttctctccggccattttgtccccgagcattttggggttctgttttgacctaattgtctaattgctttttatttatccatttcacaccttttggcctgcaattttgtcgcctcgttttttctctcccctggttcgcgttcattaaccctttaattatgtttaattggaccaaatcatattttggattatatcgcctcgtataatggctcccatcgtgttgtctccgcttgtcttctcatccattattttgtctccgatacttatggagccattcattttgtcgccaggtcaaataaaaatttaaatgaaaaacaattaaatcaacttttttagggtttttgaacagtctcgtaagttttcaatttgaaaatccacatatttcattttcctgtcccagattttgagtccggccatcttgaccccgctaataatgtccccccagttgttacatccggccattctgtccccgctggtgctgaccccggccattctgcacccgacagtgatgtcgcccactgtgctctccccgttcgtgctaaccccgcaaattttctctcccaaatttctgggcggtcttttcctctccccctacgcactgtcccccgtttttaagtcgccccttttcgtttattcgatcgttttgtcgccgagttggctgagc

SEQ ID NO: 83385 - DNA, 1286 bp, Heterodera glycines
  misc_feature (1286)..(1286): n is a, c, g, or t
  Genomic contig location: Contig_ID=SeqID_18713; Location=13..1298; Strand=-
  SCN-specific regions: Sequence locations=1-781,803-1286
atgtccgatgatggctcatgcgagactgagtcaattgatgcatcagatgctgagtcggtcgcatcgaccgaatcattgattgatcgcatcgataagacgagaaaattcatttctctgcgagattactgcaagtaccatctcgcaataagggatgaaaatttggagtggcaataccaccacattctttcatgtggtggtggtcttggacagcgctgggtcctagaccaagctgcaaaaattgactggcaaattgccacttttttgcgccgtccagacatggacttgcgcattagtactccaaaaaatttgctgcattatttggtgaaccaatacaataagcagcaagctcggcaaaaccccaatgcacaacaaaagagtgttgatgacattggcagtgttgttcgcctttctgaaaagaatgtaaattcgcttcagtattggaaaaaaaggtatgaagactgtaacaccatttttgcacgttgccataacccaaaaaaggcgcggctcttcatcacattcacgaacaaccgtgagtggccagagttcaaggagaacatttacaaaaatggtcagatgttcactgaccgttttgacatgtggatgcgtgtgtggtccagcaaaattgctgttttccaccaggagctctatgaaaagagtttcttcggaacaatccttggctcaggcgagtcaatggagttccaagggcgtggtggcccacacgcacacattgtagcccagacggacctggacgcagtcccagaagtcatccaggaatacatatgggctcatattccacctttgccagacaaaggcgatgactccccaattgcacaaatgcatcgcgaaatccgcgaattgatgcatatgcaactgcatagatgcagtgatagttggtgcggtccacgtgaccccaactttgggcggtgtaaaaagggcttcccagccccgtactcgaaatgtacgattctgcacccagacaggcccgcgttgtattaccggcctagcccaaccgatggtggtgcccaaattgaggttaacggcttaatatacgacaactcacaggtcgtgccgtacaacccatacattttgctgcgttaccgagtgcaccataatgtactatttgcgtacggtaacaaggcaaatataaaatatgcactcaaataccctttcaaagggcctggacattgttatgtcgagtgcaaagaggagtccggcagcaaaatcggtatcgatgagccggcccatatgccaaatgaacttccgtggagctacggaagcttttgcan

SEQ ID NO: 83386 - DNA, 504 bp, Heterodera glycines
  Genomic contig location: Contig_ID=SeqID_18714; Location=762..1265; Strand=+
  SCN-specific regions: Sequence locations=1-107,129-328,351-504
atggacaaaagactcataccgacaaaagacctatggacaaaagactcataccgacaaaagacctatggacaaaagactcataccgacaaaagacctacggacaaaagaaccacaccaactaaaaaccattcacgtataaaagacgcaaaaaaacccattttaattaaatttacaggactcaggttacccgaccgagtcagacctggatacccggattttccaagacccggacccgacctttttaaaatacaatatgtcgtacctgacccggcaggtccggatccaaaaaaatgcactgccaagaatggaagtcgggtcaaatttgagggaaagaaaaatttagaaaaattaatttactatataaatacttttactttcttttaaagtggcgttgtctattgtctctctctgcttattgtcaatatcaatttcttcacatagcgatgaatattaacagctatgtttaatatttttgttgaaaaactgccacagtatgcaagaata

SEQ ID NO: 83387 - DNA, 525 bp, Heterodera glycines
  Genomic contig location: Contig_ID=SeqID_18717; Location=11..535; Strand=-
  SCN-specific regions: Sequence locations=1-118,141-525
atgctgaggtgcggtgtttcttccgagagtgactcgtacattaatgcttccccgttgcatttgccttttgcgcatcgcaattacattctgacccagggacctctgcccaacaccacctgtgacttttggcagatgatctttgagcaagaaggttggttcagctctcattgtacattcaataaaactcgttttagtttcaatctgcattatgctcagcaaagtcatggaaaaaagctttgtcaagtaagaaatcggcaacgttcgttaaataaaaatttcattttcattaatagttggattatttatttctttttaggtgtcactcttatttcccttcaaaagatgagaaaaaaattgcatttaacaattgggaatgcgaacttgagcatgaggaatcaaagccgaattacatcattcgccgtgttcgactcactcggctggaaaatcagggggaaaagcagcgcaactcacctccaaaggaacaagcgacagacaatgcgggaaaagagcgaaatagccgaataa

SEQ ID NO: 83388 - DNA, 484 bp, Heterodera glycines
  misc_feature (223)..(223): n is a, c, g, or t
  Genomic contig location: Contig_ID=SeqID_18718; Location=1169..1652; Strand=+
  SCN-specific regions: Sequence locations=1-29,53-182,205-311,370 -402,426-484
atggcttgggcttatcagcacacccgcgcactgtttgtacagaaactttttcgtgtccgccgtacaatagcgaaaggcacggacaaaaacaagccacggaaaacggagcgatcttcatcagcagcagcaagctgggcatgtgcagttgcactgctaacagtggttagctgacgagaaaatgcaaaattaaattaaaataattaagttgttaggacattttttntagaggagcatctaagctaaatataattttctcaaaatagactaagtttattgcctaaatttaaaaaaatagttttatccattgtttcattttttatatattttattatgaacataattttgatattttaattgtttaaaataattcaactcgtttataacgccctaatttatgtaatgaattaattaattaacatttggctgtgcttcatccagctcataatagtcggaagtcgcacgcgcacagaaaaaaacatttgaa

SEQ ID NO: 83389 - DNA, 1151 bp, Heterodera glycines
  misc_feature (944)..(944): n is a, c, g, or t
  Genomic contig location: Contig_ID=SeqID_18719; Location=59..1209; Strand=-
  SCN-specific regions: Sequence locations=1-159,181-976,1007-1151
atggttcaagctgtggttcaggcacgaatgggcaaaatgctttctcacccttgcacaccaaatcctgaacaagcagattatttcaatattgtaatcgatgagattggtgaaatttctgcatatctaaagtcgacagttggcaaaaagtcatttaattgacaatttaatctcattattaatatccaaaagattgttttagctatccgccaaattccacggtaatgacgctcgaattcattttgtacacggacgatggtgatactttgccattagaagcctggttttgcaatctgaacgattccttttgtattatgtaatgtttagggtcatccgactcgattctgagtgccaagattggtcagcccatcatggcttatggacgcaaagtgcccggacaagtttctaccaccaattgtccactctgctgaggtctttggtcgttgcgtcacgctttacaccgacttatcgtcattatgtgcgacaagaaaacccttcccatgagtcggagacttttgtcatcacttacagggttcataaaagcgatagtgcattcctattttacaatttaaggtatttaacggtgaaccagacctttctcagcttggcgatgaatttaaatctaaaaaactcggacaattaccaactccttttggtgttatgttcgtcgagttaaattatagaacaaaaatggaaatccaaccgcagccttttgtcgatgaagccgctaatgttcaaaatattgtgaatgctatcggttaacttttttttgacaatattacttaattagttgaatccatttttcattttaaaatcaacagatttaaatttctttttgatcataaacgttggcattttgacgaagtcggaggtctgaatgtgactgaaaaatgatcattattactgcaaaaaacgaatccaaactaaccctttaacctacacaattntaaagaaaaaaacctagagatattaaggtgtattttttataatttcaattattttcaggaaaatgtcctttggcgattgctgtgccgcaagagggcagtgaaacagtgccaataagtccaagcttcacgggtaacatcaacatgttcagtgcgagtcccatcagtcaggtggaaaaacactcgaaaaaaatactagtctaaaataaa

SEQ ID NO: 83390 - DNA, 465 bp, Heterodera glycines
  Genomic contig location: Contig_ID=SeqID_18721; Location=66..530; Strand=+
  SCN-specific regions: Sequence locations=1-27,52-465
cacgaaactgcaatcaccacctccgcgcttcaccaccattaccaccaccaatccaccgacatttcttcgtcctccccctcgctgcttcaaaagcagcagaacccattggtcgacatggtcaatccgccgagcaatggcagcatcagccaacactcgtcgacctcgccgcccagcctcacaaatgtgctgttgtgattgatattcgaaaataaatgcattataaaattccctatttttgtacatttgtgaatttatcattttagagctttattttttattgttttgttattttgctgttattaatcctcgagatgtttcctctgaacctttttttctgggctttagctaattgtttcccgagtacaaaaaataactgttcatatgttctaatatattcctatcctttctcaattaacgcatacctcaaaagcataaatcactgaatatataaattcatttatttta

SEQ ID NO: 83391 - DNA, 461 bp, Heterodera glycines
  Genomic contig location: Contig_ID=SeqID_345; Location=380..840; Strand=-
  SCN-specific regions: Sequence locations=1-103,126-461
atgtcccaccaaccatttgctaatttcgaaattgtacggcttgaagcgatgatcattgggttagaaatcgacaaggaccaactgcaacgagatgtttatcatcttaaaaataggaaaacacaaatccataacaaaaaaatcgaattgctacaacaaaaggaacaattaataagagaaataagtgtgttgagagagacaaaggcaactttggtcaacgagacgaaagatttgagagaagaaatattggaattacgagatatggatggttccaatgacgacgacccactttgcgccgtttgctataccagaaaagtcgtcagcgtttaatgcaaaactaattttggatattttagagaaattatgcatgcattccatgtggtcatcgtgccctctgcaaccgatgcgccgaaactgtttcaattgatgggcgttgccccttttgccgtgaagaacttattggg

SEQ ID NO: 83392 - DNA, 3017 bp, Heterodera glycines
  Genomic contig location: Contig_ID=SeqID_345; Location=966..3982; Strand=+
  SCN-specific regions: Sequence locations=1-312,334-1529,1551 -2064,2086-3017
atgtttattgcaccattcactctaattttgtctggagctactggtagtggcaaaacgcaatggttgatgaaattgttgagaaattacaaggaactaatagacccgccgcctgcaaaaattctgtattgctattcagagatgaatgagtcggttcttgatctgatgaagcggggaattgagacgcacaacggcttgccggatcaagcgttgatccagagccagccgaaaccactgctcctcgtgctggatgatttaatgctgaacgtgggaagcgattttctggatctgctgttcacacgcggttcacataactggaatgtcagcgttatttttgtcacccaaagcctgtacgggcgtaacattagaacagcgcgagctaacagccattatttggtgctgacaaggaacccgtctggtcaactccaggtcagaacggttgggtcacaacttttcccaaaacgactcaattactttatggaggcgtacaatgaagcgactagtcagccgttcagctacttggttataaacatgcacccaaatgctccggaaaatgagcggttgacaagcaaaatattccccggggagagccgtgaggtatatttacctgtagaataagcgtaatgaacgaaacaagtgcgctaaaaaactatttaaggaagggaaatttttttggttcgcaaaatgtacgagttcagtccatacattcgcgcaaattcggattttttcaaaaaattagcctcaacaaaatcggataaaaggaaaaacgatttgctgaaaggcgcatccgtagaacaaattctcggattggttgagatttgtgcaaatattttaaaatttaactttcgcctcaaccggcgacagaggagacgattggccgtgtacgcagactattaccgagcaattgcacgttcacgtagtgagcgcacagccagacagaggctacaacagggcagcggaatagctttaggagctattttggcgccaattttgagcgttttagctgaacagctggtccagaaaattgttgcaactccatcagcacaacaacaacaaaatgaagcacactaaaaagatgctacttgtaccggagagtgaatatttggcgcttatcaacctgctgaaagggggcgcaggtggaacggactcacttcaagccgaaaaagcagcgatcgatgccagcatccaaaaaaatctaaatgacaataaaacgggtgcggacgtgaaaatgaaacgtcactcgtggttgtacaaacagaggcatcagatcaaggacatgattgagaacaaaccacaaaaggtgattgtggaaaacgctacaggcacagcgccacaaaacattgccccgtatatgggcatacagaaaccaaacctcaacaagcttgaagaattgaacgggcaggatggcaaaaaaaaaataaaaaaataggacgaaaatcggtccaggcttccagaattcaaactcccaatggtgccagctttggtgaagaaacggatacgtctgcgcctgagaccgatttgcggctaaccaaaaagagacaacaaaaatttttggagcttaaaacaggcccagagcattatgataagctgcacgaaatgattgaacgaaaccccgaaaagtacggagtcgataagtcgtccggcgaaattctaacaaacttcaaaaagccggtgattaggtccaactacattgactcactgatgtacttgacaggacagagagcagatgtgccgaaaggtcatcgattttttgttcaaaaaattggcagcgacccgcaaatgatgaaatttttccattcccaacggggagagggtggtagtaagcggagcaagcgcaaaaaattcgttcttgttaaatcaagcgctataaaaacggtaggactcagccgaatggagcaaccaaataacacgcaacgtaaattctttaaaccgcttctatgggcaaagctgtagtacaaaaattactggaacaagtgtattacgatcttaggtcgccggcaagttacgctggtattcaaaaagtattgaaggaagcgaagaagcgaaatccgagcattactcttcgtgatgttgaccattttttgcataaacagcgcacctacacgttgtttaagccgcgcaaaaaccgcttccgcagactaaaaactgtgcctagcggactacacacggactggcaatgtgatttgtgcatcatggacgcgctgaaagagcataatgatggatttcgttacatccttgtgtgcatagatgtgctaagtcggaagattttcactgcagaggtagagtccaaaaaaagtgagcacatgattgcggcatttgagaagattttcaataaggcaggtgtgctgcccaataagctgtacagcgacgctgggcttgagtttcaggcaaagaaaatgatggactactggaaacaaaaggagatcatcaagcacgtgatgtacagcccacatttgcatgctggagttgtggaacgcgcaaaccgtacgcttaaggagcgactttacaagtattttagcgaaaagaacacaaagcggtgggttgatgtgctggacagcattgtgcgtaacctgaacagctctgcgaaccgaacaaccggagtaaggccaatggacgtcaactttaaaaatgccgctgctctacggaatcgcctatataagcaaggcgagtcgagtcctaaaacgccaaaatttaaggtgggagacatagtgcgaataagcaaagaaaagggtgatttttcgaaaggttattttccgaattttacggacgaactgtttcggatttctaaagtgaatccgaccgatccaccttcctacaggatccgtgatcaagacggggaagacattaaagggattttttacgagcaagagctggtaaaaaccgttgcagaaacagcgcatagagctgaagtgctgaagactcgacgcagaaacggcgtcaaagaacactttgtgaggtggattggctactctgacaaacacaatcgttggattcgagacgaggacattgtccaaaattaa

SEQ ID NO: 83393 - DNA, 2242 bp, Heterodera glycines
  Genomic contig location: Contig_ID=SeqID_345; Location=9118..11359; Strand=+
  SCN-specific regions: Sequence locations=1-105,127-844,866-1244,1269 -2216,2238-2242
gtataaaaggccgaccaaaagtggggagggtgccacattgtttctttcattgtgagaacagaaggatgtcattcttttatttcttgctgatcgccttcattttattccattttctccatctatctgccggagaatggattaatgttgagctgagtgtggacccaccaaattcttttgaccgttcattccgcaccatttccaagaattcacctgcgcaacattggttcggctataatcgggacacagcatgtcatgttgagctggagaggaatatcaatcggctgtacaccaacccggatacgtggaacattgccctgacagatgtggataatttaatgagcctgggacggacaacaattgagataccgtcaaccgccttaccatgggcatgttttgggcatggcggccatagttttgtaattttcaacctccaaaatgctgcgggtgaggtgaccgtactgcgtggacaccaacaaaaaatagcacggcaattgagcgcgtatggccgcattttgtttgatcatattgccgcccgattgtacattgtggacaagagcgaacgcagaatcaatgagttgctcattgccgatttggagcggtggtggactctgaataatacggacgatgcgttgaacaggacgtcggcacatgttctgagaagcaattttgttggctttttgccggagcaaaaaacggattatttcattgcagctgatcatgtgtacctgatttggcgaaggcgagtgtacaagttccgcattggacactatttcaacgatccttcgtcacagctccagtttctgaccaactcaagcgacatacgcttcaacttcctcttatttgaagcaggtgcagaaaggctgggtgaaggcggcgatcgtagaaatagcagatcagctgttgttgtaccagcggtgtcgtcgaacggaattgaacgtctcttgctcgcgttgacttacctattcgatcttgtcgtcatattgattgccatttgtgcattccgccagttccgccgattgggaggtggtgcagccgcacgaaatggggatgacgcgattgaactaaatgaatacgatcttttccattcactttcgttgcaaaacaacaacaatgggggcggagcctatgacgtatctgctgcatacaatccaacgaatacagcaccaaggaccgcccaccagctgagatcttgtgcaactatttaaacggctcactttttttttgaattttccaacacacacttgcataaatttactgttattttatgacagccaaaaaataattatattgggtatttgctgcggctatttcatgcaaagagcgataaaacattttcaagaatccttggcactagacaccgttgaacagctgtatgcgcattttaaagaggaaattttgagcgcacctggtgaatattatccaaatcctctttgtgggcttggttgtgtacacattgtcaacgacgatcatcctgatctgccggtgtgcgtcgaaggaacgcttgatttgatcgcgggacttgaactgtactccacatgttatccgaggacggaagcagggacaatcaactggtcagcaagcagagcaatcacaatcatagattataaaattttcaatttatgagcaaagtcctgtacgtggagctgaaggacatgatgatttgcccgggcgagtcgccttgctgtcgctgcgcacaacccatcaacaacaacctgtcacactaccagctgatcgtggacgagctggaccgttggtgggtggacaaccaccaacacaatcgggggcacgtcgtcgaacgagaagaagaggaaagcgtcgaccactcaacctggtgaaggcactgtgtcgtttcaacggaggctgcatgccatcagttttaccccagatgattcagaggagacgaatagaaaatttgtgctttcttcgtgatctcaggctgcgaacagtgcacctgaagaataacattatgatttccgccaactcattgtcatttcacagtgcaggcagtttgcttgcctaccgtggctatttgtccataacggtagagcagcacttgtacgttcgccatcgtgttcgtcttaggttccccttcctgccctgcgttgtgcaatatgggggaaatcaccatcactattattttccattagaactgcttgaaatatgttctcgtccaactgacgaatcctcctaatctacacaccttccgaatactgttttattgttgctgttgctattgtgaaaa

SEQ ID NO: 83394 - DNA, 306 bp, Heterodera glycines
  Genomic contig location: Contig_ID=SeqID_3143; Location=449..754; Strand=-
  SCN-specific regions: Sequence locations=1-306
atgtctacggcggaacttcaaagcagcgaaaaacccattgagaaagctggaaaagctgataaaaaatcatcaaagccaaccttactggatcagcagcgcttcttctggaaattggcccgcccaaagtttgccgtgatcaactttctctgccctggatgtcgtcgactcaattacaagcacaaggaccaattcaaactgatgggagatagcgaattccactttacccaagtgatgtgcccaggatgcgtaaagtacaatatgatgcaaacagatatctataacaaacacacaaagaatcctcattaa

SEQ ID NO: 83395 - DNA, 414 bp, Heterodera glycines
  misc_feature (10)..(10): n is a, c, g, or t
  misc_feature (19)..(19): n is a, c, g, or t
  misc_feature (21)..(21): n is a, c, g, or t
  Genomic contig location: Contig_ID=SeqID_3143; Location=1082..1495; Strand=-
  SCN-specific regions: Sequence locations=1-414
atgtccatgnacaactggncncgcacctgggcgacctctcagaccgaatatcccgggcatgaacttttggaatttgtgagtggaggatgtaagcagtacgcgctgagaatgcggagcaaaagaacgggagccgaagacactgttttgaaagttagaggaattacattgtccgccgacgcgtgccgcctactacacttcaacacattcaaacaagccgttttacggtatgccactgcagaagaagaagaagatgcttttgaagaaataataattgactatccaaaccagcttcgccccaatattcgtgaaggagcagtgcaatctgtaagcatttcgaagcgataccgtcccgttgtgaccaaaggaattgtatcagaaaattttattgtacgtgattttggatttaaattgtag

SEQ ID NO: 83396 - DNA, 1171 bp, Heterodera glycines
  Genomic contig location: Contig_ID=SeqID_3144; Location=84..1254; Strand=-
  SCN-specific regions: Sequence locations=1-193,216-514,536-580,603 -895,924-1171
atgacttccgagaagcagcgccgttttgatggatggtacaacgagcactgcaatgcccccttcaacctttgtgaacaacttgcttcttactgcactaacgacacacggattttgatcgaggcactgattgcctttcgggcagagtttttggctgttacggatccaattgaaaaccacaacgccgaagaagacgcagaggaggaggatgaggaagacgcaattgatttggctgggaacaacggaatcgacatcgtcaacggtccaatgactatcgccagcgcatccatgcagcattttcaaatgaatcatttgaagaaggagcaactcgccattgttccggagcgcggctatgactcagcaaacaaccaaagtcttctggcgctgaaattcatggaatggtacgcggaagagcatggcgtccaaatccaaacggcttattcacgttgtggcgaaaagcagtttgggcgatacacggtggacgggtaatatatttttttacaataatttgcccttaaattatttatttgttcttagttatattgctgagacggacacggtcattgaagtgaatggatgcgtttggcatgcgtgttctgctcctcatcaccgatttgatccacaagcagtcatgccaaacggaaagacggcccagaaaatccgagaagacgacgcgcagcgcctacagtttattagcggaagatgccgggaagttaaagtcttctgggagtgcgaaattagtgaaatgctgaagcgggatcagcgaatgagggagtcgttcaacagctatgtggacaaagggcctatcaatctgaaggactgttatcacggtgggcgcgtggcccctcttcgtcttcgctacaaagtgccagaggggtgcgttgattttttgtaaatgtaatataataaaaaaaaaataatattttcagttggaaaataaagtattacgacgtgcgctccctctacccctatacgactgccgtcacgtcctacccaattggacaccctacagccgtccacatcatgcagggagatgactcaattgtcgactggcgccgccctacagacgtccccatcctcggcattctcaaagtcttcgtggttccgccacgaagggttgacgtccctgttctccccgccaaattcgaccaacgactactgtttccgctttgcc

SEQ ID NO: 83397 - DNA, 644 bp, Heterodera glycines
  Genomic contig location: Contig_ID=SeqID_3144; Location=2957..3600; Strand=+
  SCN-specific regions: Sequence locations=1-127,149-364,387-598,621-644
atggacaacaccgccccaaaaaaattcttgacttcccttgaccaacttcaaattccccccgaaattgacaacgacagcgccattcccgactatgcaaaactgcttattaagcagttgcactcgctgctggccaccgcgtcgtctctggttcaatctcaagtagcggcaactgacgcgattgaggaggaccgccgacaacgaaccgttgtcatcaccaatgtgccggagttccaatctgggaaagcgtcggagcgtggggaggcggacagtgcactggtcaatttgattttggacactgtggacctcgaccaaaccccaatggtgttccgggtcggcatgcgaacgcccaacagagcgagaccgctcaaaatggaatttcccacaaagcatgcggcgcggcaggtgctcagaatgaagggcaaggctttgtcgttgaatgctctacatggtgcgcgcatcagagaaagcatgaccaaggagcaattggccgaacgccggaaactaattgaggagtgcgcaaagaaaagaaaagaagatgcgggagattggattgtctacgcaaatcaggtcatcctgcgcagcgaaattgacacaattcgtaaaaagaatttttaaattttcatgccaaatcacaaaaaactaaa

SEQ ID NO: 83398 - DNA, 3040 bp, Heterodera glycines
  Genomic contig location: Contig_ID=SeqID_18723; Location=123..3162; Strand=+
  SCN-specific regions: Sequence locations=1-50,73-146,168-272,298 -387,409-753,788-855,879-1007,1043-1739,1761-1884,1906-2217,2239 -2639,2661-2668,2691-2958,2980-3040
atgagtgaattaaaatacaacaaattatggtggaatggaccaaaatggcttaaactggaaaaggaaaattggccacctcacagcttttacagtcctgatcaagaagaggctccatatttagataatacagaggaaataattaacactcaaataaatttaataaaaaacgaatataacggaattatcgaatgggataaattcagttcatggcttaaaataactcgcatttgtcaaactttattaaaattcatatttttcaaattgcagaactctaaaaagtttaaagaaaaatttatttgctctaaattcaaaaatgcattacaattaaaaatcatggcacaaaaaatacttatacgaattattcagaaagaaatggaaccaaataaagaagaagaaagacagttaagaatttatctcgataatgatatgatactgaaatgtgaaggccgattaaaaaatgcacaaattcaaggtgttaatcctatttttctaccaagaaaacactatggaactcatttattaatcatggattatcacacacgaaatttacatgcaggtacaatgacaacattatcggaaataagaaaaacttattggataccaaagggaagaagaattgttgatcaaataaggaaacaatgctatcattgtaggagatataataccaaaccttttcaacaaccacaaatgccaccattacccaaatcacgagttgaaataacggaaccatttcagaacattggactagattatatgggaccaatacaaataaaaaatttcaatgaaaaatgctggataattttatttacatgcttaacaacacgaggtattcatctcgaattagtcacttccttatcagttcaacattttctcaatgcatttagaagatttatatcaagaagaggcacacccaaacatgtatggagtgataatgcagcacaaataaaacttgcatcaaaaattctaccagaagtgttaaaattaagagaaattctcaaagacgaatcaattaaaagttattttttaaatgaaaatataaattggacattttctatagaattagccccttggcaaaacggagcaattgaacgacttaatcagaatgtcaaaacagcaatgagaaaagtaatcggaaaaagatttattgagtttgattcttttcaaactctgacttgtgaaattgaagcgttagtaaactcacgaccaattacatttatatatgatgaaattaactcttatcaaattcttagaccaatcgacttcatacttccacataaaaatttatgtattcctccgattttggaaaatcaggaaactaaagacccaacatattacccaaaaaagacttcatacgaacaaacaattgaattatggaagaaaaccacgaaattattagatgactattggaaaatttggactgatgaatatataccaagtctaagagaacgttataaaatcgaaaacaaaaatccacgaaattgtatgaaatcttttccagaattgaatgaaattgtaataatacatgatcaaactcccagagcaatgtggaaaactggcattgtcaaaaatgtcataactggatcagatggtatcgtaagaggcgctaatatcgaacttccaaataaaacagtactaaatcgacccttaaaattaatttacccgttagaaattaattcaaatgatgataaagagcaagaaactctctctaatctaataattaatcaaaaacccaattatttcaacagaaaaaggaagatggataatcccttagtccctataaaaatgaatagactgtttcaaaactcgttaacaattatatcattattaacattaatttcattatgttcatcttattcatacgaatgtccaaaggaacctaaaatatggaaaacgagatatacaactctatgtatcgaaaacggttttacaatcagacaaaataaaataacaaaagaattttgctataaacaattggtatgcaaagacaaacatattattaaacgacgaccaccgtattgtggtaaaaaatgtaattgtcccgagggattcaaattttgtagtttcgcatcttataataaaatcaaaaatgaatcagttggaagaattaattaccaaaaaataatttcgttctacaaaccaaatatctgctcactaaataaaactgaaaagtgtccaaatatgcagagaaaattatttaattcaattgttcttcatgacaattcaattcatatggtgaaaactttaaatttacttttttcccaaattgactcgataaacaattttcgttgttttggggagggcaatctgacgattggtactccaatttactgtcgagaacatgactgttttaaaaataattcattcaaacaaatatatggaacgaaattttgcttttacgatccatacgaaaaaatttaccttgttaaatctgatgaagaattaattcaaatcaaagcatggggaactattgaaaaaatattttacttgccaaataatttaaatcaaccattcattgaaaatagacggaataaaagagaagaaaactcttcaatcactgaagaatcaaccattgagtgtttaaaaggaggcattattattaaagcaataaatgatatacaagaattacaaatttccattgaaaattatacaattataaaaaagaaccctcaaaaagaggaaataatttatttacccccaaaacttacatcctttgaatataaacctgtcattaaatttataagtaatccagataaaactaatgagaaacaaatcacatgtcaatcatctccccgtatgtgaattaattaactgtcgattttgtatggaatatattaaaaaaccacaatgtgtagaccagattccactgggcattaatgcttgtaattataatgataaatttatatggtatttcatttaagcctcccaaattattccaaataactcccccgttttatcccttgggattttaccaattatttttaattgtttttaaaagaaaaacccaaaagaaaaccaaattaaaatttcagaaccaaggtaa

SEQ ID NO: 83399 - DNA, 1514 bp, Heterodera glycines
  Genomic contig location: Contig_ID=SeqID_18725; Location=123..1636; Strand=+
  SCN-specific regions: Sequence locations=1-116,166-210,232-409,431 -505,529-678,794-816,945-1514
  Gene Ontology: Mol. function=structural constituent of cytoskeleton; Cellular component=neurofilament; Biological process=N-linked glycosylation
gagcacacttgctgtgaatacgtatcggccttgtccagcattgaacacgaggcgccatcgcctggaggtgtacccgggttcgtaagtttcttcaaataactcatttttaatggatcaaaatattaaaaaaaaatcaataatttttaaagttttttcataaattttgtaaattcgaattctaaatgatcaattatttctattaaaaaaatttgtaaacacagaattaaactatcaacttctgatccaaaagatttaaaacttaaggcatgagggcaacgactgttttgtgtacaaattgcctgacgctggcactgacaaacaaacaaggccattattggatgagcagtacgagcagttcacggtgctgaacaatgttgaccatgtgccggtacagttggacggcgatgatcagcagcacggacagcaacagtttggctatcggctaaggctgtttctattgcgcaacaaaagcccaccagttttgctggtgaagagaatccatagggccaagtaattgaaattcattttacaaatttataaattatgcacatttgatttcagggaaggctttgaagtaaccatctgccgaccacgttgtagcaatttggaagaagctgaaactgttaagcgagaaaaaggatggggtaaaacgagagcgaatcggttgataagtgcaagaagaaaggaagaagaagaaaaggaatcaaagatacaaaaagaaaaagagcagaaaagagaggaagagacaaataagaaaagaggaaaggacagaagagaaaggaaaaaggaagaagcaaatgtgagagagattcacataaaaataataaacgaaaatgaagagaaagaaaacaacggaacggaaaaaggaggaaagggagagaaagaggaaaaaacaaaaggattaaaaaccggaagaaatacagaaggagaaggaaaagacaaaagtcacactgggagaaacacagttgaagagggaaaagacaattctggaaaaaacacagccgaagaaggaaaagacaaaattggcactggaagaaatacaactgaagaaggaaaagacaaaattggcattgggaaaaacacagccgaactgggaaaagaccaaattggcaacggaagaaacacagccgaagaaggaaaaggcaattctggaagaaatacaactgaagaaggaaaagacaaaattggcactggaagaaatacaattgaagaagaaaaagacaaaattggcaccagaagaaatacagccgaagaaagaaaagacaaaattggcactggaagaaatacagccgaagaaggaaaagacaattctgaaagaaatacaactgaagaaggaaaagacaaaattggcactggaagaaatacaactgaagaaggaaaagacaaaattggcattgggaaaaacacagccgaactgggaaaagaccaaattggcaacggaagaaacacagccgaagaaggaaaaggcaattctggaagaaatacaactgaagaaggaaaagacaaaattggca

SEQ ID NO: 83400 - DNA, 926 bp, Heterodera glycines
  Genomic contig location: Contig_ID=SeqID_18728; Location=1875..2800; Strand=+
  SCN-specific regions: Sequence locations=1-84,124-229,252-460,484 -741,763-926
atgtcaattgaagtatttaaattctattactaccagaaaaaaatcttcgtagagggaacgaaaggtaggcacaaatgcaatttcttaatttgatattaatttataaaaaataaataaattattgtcatgaaaaagtttaaactgaatgaggatcggtgctatgtcgatacttaaaaaccatcataatgggcgatacttaaaaaaccatcataataaaatttgggcgatacttaaaaaaccatcataatgggcgatacttaaaaaaccatcataatgaaatttgggtgatacttaaaaaaccatcataataagaaatcgatatacctttaattaattacaggttcctttaattaattatatgattacaatttgaaattacatgagttaattacaattttaaaccaattatcccttttatttttattattttcctcaaattcacacattttttatttggaaactttaattttaaaaaatatttcagccttgcttaagggcaaacaacaagcatttttacatgatttaatagccggaaatacgtcattaaaatatgaattagatttaattgccggaaatacgtcattaaaatatgaattaataaatgttaatataaaagcaatgtaaatttattatttggcaattcatttaataattaacattcctgttatttcataaaattttcaacaaagcctattaaattttacaaattcaatcgaaaatgatacggtaaaggtagaggcaaatgcttttattatttatttacaaaaacaatggattgataagtacgatgaaagtaacttatggaactttcaccggttggcaagaacgcggagtataaatccagcggaaagttttcattcatctatgaaaaggtgaagatatttttaaaattgcacaaatttaaatttatatagagcccatctgta

SEQ ID NO: 83401 - DNA, 847 bp, Heterodera glycines
  Genomic contig location: Contig_ID=SeqID_18730; Location=833..1679; Strand=+
  SCN-specific regions: Sequence locations=1-96,153-323,371-494,518 -786,808-847
atgatttttgctttcattttttcttttatttcttccaaattcaacaccttcgcttttgccttattttggtgttttctcgttaataaagtaagtacctttttaatttaaaaaattaaaaaatatttttaaatttttatttttatttttattttctccctttttcatacgttgtctgatgatggtcagtcgaatctgctgacgaacccaaaagaaattgtcacatttttgatggacgaccaattcccgaagtttcgtgatcagaccaaccaatattgggccgacaccgttctcagttatctgaacgccctttacccgaggccggcaaaaaattttaaaaaacataaattaattgttgtattaattaattattccgttttattgccttaggcatcgctttttggtcattgttggttcgggtgccgtggcgtataataatcggttggccattacttttcaagaagggaataagtgagaaaattgagaattttaaaacgaaatttaattatttttattttatgccacatgtgaccgtttacatggcattcggagctgaccaatttgagggcagcaacaattgttacggggacataaacagcaaattcaacaggtaaagcgaaggcacacggaaatagtgggataagaaatgcgaacaaaaccatgcgccgatcagctgctacccggacatcaaccaaatcctcggatacattggcgaaacatgcggctatcccaagtcagaattaatattgtagaattagttaattcatccgaattatcaaacattttgtaggaattttttggcaatttttgctacatgtatcataatttgttgtcatggatttacatttaa

SEQ ID NO: 83402 - DNA, 497 bp, Heterodera glycines
  Genomic contig location: Contig_ID=SeqID_18730; Location=1802..2298; Strand=-
  SCN-specific regions: Sequence locations=1-267,315-337,381-389,411-497
atgccaaaacttcaatttgactttttaaaaggttattattattattattacacacatcgcaatcaccagcagaacatttagtgccaatgccgtggccaaaattgcgataaaaatgccattcggctgccacagtccctcgtcaaagtgatcggtgtttggcaaaatgcaatttgagtccgaagaattgtatgagtaatgttgggccaaagctttgacgaaatttgctgtgctgtttctgttagaataaatttaactcgcaaagcagtgaataataaattcaaaaataaaataaaaataattttaaaataaaaaatcagcggtaatagccaaatggatcattaaaataaatcatttttaatatcaatttttatcttattttagttgctcgtcttgactttttggttgctttactttttctggagcagtgcgatgatcacttgccattgccttttccccacttcacaattccgcttgatcacttcccttcggacggctga

SEQ ID NO: 83403 - DNA, 417 bp, Heterodera glycines
  Genomic contig location: Contig_ID=SeqID_18732; Location=647..1063; Strand=-
  SCN-specific regions: Sequence locations=1-3,28-55,77-417
atgattatttttgtcataattatcattgtaccaccgattatcaatgggatgaacgatcatcatctcttatcacgaattgagaacaaacgcgatcaagaacacatgcagaatttaaataaactaattaaggctgaccaagataaattcaacgctgttcaaagtcaatcaaagcgaaaggacaagcactctattgaatgtgatcaatccaaaaatattacccaaaatgatggacaggaactgatcagtgaagaaacaagggaatgggcgaagcaattaattaagttcatcgacaaattgatcgccaaaggccgcattgacttggaggaaaacgaccaaagtgatcaaaagtcgtatgccatagattttagagagacgaaaaaggaattggtcaaaaaattgagaaatcccaaaactgag

SEQ ID NO: 83404 - DNA, 1163 bp, Heterodera glycines
  Genomic contig location: Contig_ID=SeqID_18733; Location=157..1319; Strand=+
  SCN-specific regions: Sequence locations=1-85,107-573,595-1163
atggtttcagaacttctgctgacccactacgaccccacacttgcgatcgtcgtagcggcagacgcgtcaaaagatggcatcggcgccacaatcagccacatttttccggacaaaaaggaaaaagtcatcgagcacgcctcaacagttctgaccaacgcgcagcagaactacagccaaattgagaaagaagctctggcgcttgtgttcgcagtccaaaaattccaccggatgcttttcggacggaaattcacactgctcacggaccacaagccattgctggccatcttcggctccaagaaatgcatccccatttatgccgccagccgactccaaagatgggccctaatcatggccaattacgattttgaaatacggtacatcaacaccgcatcatttggccaggctgacgttctctcgcgcctcatcgccaattatccccgaccagaggaggatattttgatcgccaacatctgcaccgaaactgagtgctacataagcaccattctgcaaaccaaaacggaacaacttcccgtcactgcagacgaaatcgcagaggcgacaccgaaagatgagattttaaagaaaattttggcattcacccaatcgaattggccaaagaaatgcagcgaccccgacatcgcaccgtattttccaaaaagggaaaacattttggaaatcgagggctgtttgctctaccaaaatcgcgttgttgttccccaatcgctccgcaaccgaatgctgaagtccctgcacatggcacaccccggaattgtgcgcatgaaggcactcgcccgccaacacgtctattggccgggcatggactcggaaattgaacggattgtccgtcaatgtgaagaatgccaaaaggctcaaaaagcaccgataaaggcaccgcttaccccttggactccaaccgacaaggtgttccaacgggtacacatcgattttgcggaccatgccaagacggtcacgtctatttcattttggtggactcattctccaaatggccggaggtctaccaaatgaattcaatgacggccgcggcaaccgtcttcacactccgttcaatcatccaccgactcggaattcctgaagaaattgtttcggataacggaactcaatttcgttcgtcagaatttgcggcactctgtaaggagttcgga

SEQ ID NO: 83405 - DNA, 2070 bp, Heterodera glycines
  Genomic contig location: Contig_ID=SeqID_3147; Location=2465..4534; Strand=-
  SCN-specific regions: Sequence locations=1-706,732-868,891-1564,1586 -2070
atggataaaattctgaggggcattgctaatgtaccagtttatatagacgacattttgattcatacagagactttggaggagcatttggagagtttgagtagtgtctttgttcgcctacagaaaaatggcctcaagctaaaagctgagaagtgtaagctattccaaaggaaatgtgtttatttgggacatatcctatcagaaataggttatcagccatcgctcaataaccgagaagttatcgagaaatttcctcagccgaaaaatgttaaagaagtgaaaagatttttggggatggtatcttttttcagaaaatttattccaaactttgcgacaatcgcccacccattaaatagcctcactagaggaaaccaattaaaaattgagtggggacaggctgaagagagtgctatgagtgagctgaaaaagcacttattgaagtcgccgtgcctaagggcaccaaattacaatttggccttttaccttttcacggatgcctcggcagttgcctacggagcggccctcatgcaatcagttgatgggaaagaactatatgcaattgcatattggtcccgtacactttcggcaaccgaaagcaaattaccagcaacacacggagaattggcagccattgtgaatgcaattcaaaattttaggccaattttgtatggggcagaattaataatcttaactgatcataggccactcacatttcttttccaaaaggccagcattaaccccaaaataaatcgatggctaatggcattacaggagttcgaaccaaaagtggtctatttggagggcagggctaacaaagtggctgatgcactatcaagggtgccgataaaatgggaaagtatcgagataaaatttaaagaagaaatcccatatttcttgacgctggaggaatttaatttggaccgagaaaaggtggaaaaggaaacaaaaaatgacaaaacattgtcaaaaataatggccaaaataaaggacaattgggtggaaccaatagaaaatgaattggaaccctttttcaaaaacagagatagcctttatttggaagggaatttgataaggaaacatccccaaggacaaatcgttataccggacgtgttaaaagtgccaattttaaaattagttcataaagcacattttgggatggtgaaaggaaaagctaaagctcggcgattcgtatggtggccaaaaatttccgaagatattgaggaatttacgggagaatgtgaaatctgtcaaagaaatgcccccgccccgccacgttcatgtcccgagtataaatggcctgaggcaaagtatcccttcgagagggtccatgttgacttggccggtccgatttggggaaccaactttttgataacagtcgatgcctattctaaatttcctttcgtccatcaaatgaattcgacaaattcatcggcactaattactgcatatcgtgaaatatttgccgtttttggttcacctcggactttggtatcggataatgggccacaatttgtgtcggctgagtttaatatatttttgtccgaagaaggaattaaccatctcacatcacccccataccacccaccatcaaacggggaggccgaacgttttgttaggacattcaaagaggggatcaaaaaactgttggattcgggtaaaacactgcaactcgcccaatttatccttctacaggaataccgctccaccccatgccaaatgttgggaggcgaaaccccggcgcaaaagttcttaaaaagagaaatgaggacagaaatggataagataaaaattatgccgccaatgggaaagaacagaaaaggatcattgtcagaaaatcctaaggcacttgagccaatggcacatgtgccgacaaaagaggtacaatccagaaatgagttttatccaggagatgcggtgtgggtccgagaccaggcgacgaagaaatggataccgtccatccttttgcagccaatgggggagcgcttatggaaagcggaaatggaagggggcggagaaagagtcgcgcatagcgaccttataaaaaggcgaaagttggtttctcgccacatatga

SEQ ID NO: 83406 - DNA, 280 bp, Heterodera glycines
  Genomic contig location: Contig_ID=SeqID_18734; Location=492..771; Strand=-
  SCN-specific regions: Sequence locations=1-280
atgtctcatacgctgcctatggtggtaagttcttttgcaccatttttatcgaatctttacggattattttctgggaatttaatgaaaatgcgagtgtaaaataacactcaacttttattttattgtgtaatttctgaaaatccggctgcatttcaactcaaatattcctcttctttttcagcctctgcttttcttgtgttggtttacgttacggaatggaagcgtttcgcccgttatattcccggactccgttcgcagatcaaatcggacgaatgaatga

SEQ ID NO: 83407 - DNA, 119 bp, Heterodera glycines
  Genomic contig location: Contig_ID=SeqID_18734; Location=142..260; Strand=-
  SCN-specific regions: Sequence locations=1-119
aggggcgttggcgagaatgagtttcaagtggacagcattttggcacggcgcgtgttacgggatgggcgcatggagtatttgctgaagtggaagggctgttccgatagtgagaacagctg

SEQ ID NO: 83408 - DNA, 506 bp, Heterodera glycines
  Genomic contig location: Contig_ID=SeqID_18735; Location=74..579; Strand=-
  SCN-specific regions: Sequence locations=1-138,160-399,427-506
gccgtggtctgggtgaaaaggaagatgagagtaagaaaaccggaaacgcaggggctcggctggcgtgtggaatcattggacttgcaaaaccatgactcgccagcgacggagacgaacagtcgaaatgacgacaccgtggaaagaagagaaaagggaaaaccgacttaggacactccatttataattgtttaatcagaccaatcttccgttttttgctttgataaatgtttcacctattttgttttattttttctcaaataacgcccttgacttgacctggccaagaattttttgataatatttaattttctctcgacacttctataaaatttcgtctttaaattacctacgtaaaaattattatttttggatagatttaaatttttgacaatattggcgttttattttaaaaaaatataaaaatatctgtgcgtactcatttgtcagtacgttttctgagtgcacaaaaaaattcattaaaaaatttcagagcataacagaataaa

SEQ ID NO: 83409 - DNA, 503 bp, Heterodera glycines
  Genomic contig location: Contig_ID=SeqID_18739; Location=1439..1941; Strand=+
  SCN-specific regions: Sequence locations=1-283,305-324,350-503
atgtctgcatcaaatacaacgtctacaactgattttgaaacattccttctgttcctttgcggtgtcgttgagctgctcatccattttgttggcattccgttgtccattgtcaatttaattttggtggcacgcacttcggtcattcatccgaacatgaaattcatcctccttttccagagttttgccgttcttctggtaaaatattcgggattttttatataatatatgcccgcatttttttttaattttagcgcggtttttgtcgttttgtcatttgtctgttcaaattcatcctttgggatccgatcagtgccgaaatgggcttgtttttcccagccatcttaaaaatcggctatttcggcatttacagtcgtaattatgtgccccatattctcatcattgagcgcattttggcaactgtttttgtccgaacttatgagcagcatcggggctttttgttcacaattatttggcttccatttgcggtaaaatttaaattttga

SEQ ID NO: 83410 - DNA, 917 bp, Heterodera glycines
  misc_feature (417)..(417): n is a, c, g, or t
  Genomic contig location: Contig_ID=SeqID_18740; Location=412..1328; Strand=-
  SCN-specific regions: Sequence locations=1-331,374-585,609-661,690-917
  Gene Ontology: Mol. function=structural constituent of cytoskeleton; Cellular component=actin cytoskeleton; Biological process=cell motility
atgtcttcaaaatcggttaatgtaaaagtggtaatgatggacgcaggtgagaatgataaaaaaaaaaagaatttactttggttaatttgttaagaattggaatttgccattccgccatcgacagttggcaagcagttgttcgaccaagtggtcaagacaatcaatttgcgcgaaatttggtattttgggctccaatacacagacaccaagggcatttcttcatggctgaagctgaacaaggtgggttggagttggagcgggtcccacatcattcccactcaccgccgccaggcccgtaaccagaaaaaaaaatttcgggggtggcacccgaagagcctttgtttgctcttttggccaaaaaatttttcaattgacataaattttcagcgccatggacaaaaaatggaaaacctcccngcaacatttattgtataattcttgctgaatttttcagaaagtactgaaacaggacatcaaaaaggagcagactttgcagttcaaattccgtgcaaaattttaccctgagggtaaaaaaattgaaatttaagtcaaaattttacacaattttttttatagatgttgctgaagaaatcatccaggatgtgaccctcgtaggttgattatatgtaaaaaaacataatcatataaaaaagagttttaatttgaggcctctgaatttgtttacatgaccgtaaacaattgcatgacaaattgacagcttcattaatttcatagatgtaacaaaatcaaaaaattttgcctatcattcgaaagcgccaatggttttctataatgtgagcctgttaaatttgcaaaagcttcgtcaaattacacaaatttatggccataaacatgcgaaaaatcgtatttttaatgttttgggctaacaaagaaaggtccccagattcaagaataaa

SEQ ID NO: 83411 - DNA, 594 bp, Heterodera glycines
  Genomic contig location: Contig_ID=SeqID_18740; Location=1946..2539; Strand=+
  SCN-specific regions: Sequence locations=1-42,65-134,167-594
atgactacctccgatgagaaacaacttcaagtggttgtggctagcaatgaaaagaaacaaattaagaaatcggaagttgactttcccgtggtattgaagcgtggggtgcagggacgtggtctgtgtttttctgatggcattttaaatttattttcttatttccagtgaaatggtactcgcccgaggatgcctatgggttcatccatcgttacgacgtcgacgaagacattttcgtccacggctcctccatcgtccgtttcaacattcgcaacaaaaaccagcatcccgtccttagcattcagcaagaggttttaactttgaatcaacaaattgtcattttgaaagaccaccattttcccattctgtatagattcgatttattcatttggttaaccgtttcgttaacttcttccgtcgttcaggtggaattcgatgtgatcaaagtccgcaagggtctcgaggcgcgttgtgtctctggcccgggtggccgacttgtcggacgcttcttcaatattcctcgtcgaagtgtctcgggtgctaagaagcaagtttcgaaaaaaaacattaaaagggtcccccgtaatactgccgatg

SEQ ID NO: 83412 - DNA, 314 bp, Heterodera glycines
  Genomic contig location: Contig_ID=SeqID_18741; Location=949..1262; Strand=-
  SCN-specific regions: Sequence locations=1-167,192-200,223-247,269-314
atggggtcatgggaaaatttgatgattgaagaaaaaattgacaaaaagataaaatcaactgttgtcaaagtaaaagctttacctaaagcaattaaatttggtaattggtggtaattattggaggtaaataataagaaaaaaactagaaaatttctatataattcagcgtgaaaattttgttatggactaaattaatgtgtaattttttcctttaaatttttattattacgtacataattaatcataaagcacatattttgcttgttttaattcctattaatttctgaaatataagattaatttttggaaataaa

SEQ ID NO: 83413 - DNA, 675 bp, Heterodera glycines
  Genomic contig location: Contig_ID=SeqID_18742; Location=13..687; Strand=+
  SCN-specific regions: Sequence locations=1-233,256-281,311-561,600-675
atggctcggtgccacctcatgctgtgctgcctcccgtttgtgcctgcggcgtgttcggcaccgtgagtcctggtggtgctgccagccggctgtctcctcatggccatgtttcatctgttcggcgccgcccatttcccagagtcgcccaagcaactgtacatcggcaacggtgccaaggaggaggccaaccagtccgcaatgttttaccatggctccagcgcaaaccttggtagttttttatttgaaaatctaattatggcaattagagcttactcttacactaatttatattaatattcttttatatttagccgaactctttgacgaatttgagcatgaacgtctaattgtgcaccatgagaaagtgggatggaccgagttttggacaagccatcgattgaggtggagtccattaaaaaacaatggctttttgtttaggcattctaggttaactttaaacgtttagggtttcatggaaaattaccaatttttaaacttgatgaaattttgaagctaatagctatcgaaatcaagaagtttaaactttgctgatttgagcaaagttaggacattatttgtttaaaaaatgccaaattagtggattttacgaaacaacctaccattaaatatattgccgtaagcttgaaaaaaattcataaattgatcaattaaata

SEQ ID NO: 83414 - DNA, 148 bp, Heterodera glycines
  Genomic contig location: Contig_ID=SeqID_18742; Location=1046..1193; Strand=+
  SCN-specific regions: Sequence locations=1-9,31-148
atgaccgcactgaccgccccgttgtgtttggtggcaccgtgtctgatcgaaagttggggacggcgtccattgttcctgctgatcactgctctgtcaacgcttgagctaacgctgcttacggttgctcagctactgtatgacgtactcg

SEQ ID NO: 83415 - DNA, 276 bp, Heterodera glycines
  Genomic contig location: Contig_ID=SeqID_18743; Location=124..399; Strand=-
  SCN-specific regions: Sequence locations=1-276
atggactcaaatctccggaattctaaacactgggactcaacacaccaactttcaatgacattccaatcactgaaaatcaacccaacagcatttcaatctctgggactcaattatcagactttccaatcgctgggactcaacccaccagcatttcaatctctgggactcaaatctccggcattccaaacaatggactcaaatctccggcattctaaacactgggactcaacccaccaactttcaatgacattccaatcgctgggactcaacccacca

SEQ ID NO: 83416 - DNA, 370 bp, Heterodera glycines
  Genomic contig location: Contig_ID=SeqID_18743; Location=2000..2369; Strand=+
  SCN-specific regions: Sequence locations=1-245,269-370
aatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttagaaa

SEQ ID NO: 83417 - DNA, 1377 bp, Heterodera glycines
  Genomic contig location: Contig_ID=SeqID_18744; Location=324..1700; Strand=-
  SCN-specific regions: Sequence locations=1-1,350-365,395-654,676-1377
  Gene Ontology: Biological process=N-linked glycosylation
gaaaagaagaggcaagaagaagagaaagaaaaaaggaaaaaggaagaacatgaggaacataagaagcgaagggaacaggaaaagaagagggaagaggaggacgaactaaagaagagggaagaggaggagaaagaaaaaaggcgaaaggaagaacttgaggaacaaaagaagcgaagggaacaggaaaagaagagggaagaggaggacgaacaaaagaagagggaagaggaggagaaagaaaaaaggcgaaaggaagaacttgaggaacaaaagaagcgaagggaacaggaagaggagaagcagaggaaggaagaggaggaggaaaagaaaaagagggaagagagagaggcgaacgaactgcctaccgaagaggacgacgaggaggagatggaagccgaactgttgcgcaggatggaggagcgcaacgaagaggaggcggcggttgcctctttgggactccaaacgaaagctgacctaaggcagccacaggtgacaccatttgtgtctttgattattcaaaacaataaacaaaaaccccattcttaaggacaccaatcagccgcaaatcgatgctatcgggcacgatattggttggaaggttttggaaagaccttccgaaaaagaggtgaaattggaaaaagtaacggaaatggtggaggaggaaaaggagaaaaatatggaagaaaaggtagaagaatgtgccgtagaaaaacaaataaaacgtgaacaggtggaggaggagacagtttcacgagaaaaggacaaaacagccaatgaagagccaccagtggacaaaagtgtcggctttaaattcgaaactgttgaaagacgtgcatcgaatgaggtaacaataccccatcattcagcatttccctcattgtctttgttcagtctgtggacagtcacatggctggcgtgggcaatggttttgtggaggtcgatgctgagcatttgcgacaacagaaacgtgaacaagacgcgttggaacggctggcggaagaaagacggagaacggaagagacagtgaaacgaatggacgagacagtcgacgcggtggccacaaattcggcactgctgcagcaccaaaaccaagaatcgacagcattaattatgcagcaaattgcctctcccaatttggcacaacagcaactcacaattgacttattccaacgggccaaccaacagcaaaacgcacaccaaataacgacgaccacgaacggtacttttccacaacaacgggaaggcgttgttgtcgagtgcgactattattatccaacaaacatggcaatgagtggccaagcccaaaaccagcagcaaccgcagcgagaagcagttgttcagacagttcctgtgaacgcacccattaccattcagtaa

SEQ ID NO: 83418 - DNA, 1773 bp, Heterodera glycines
  Genomic contig location: Contig_ID=SeqID_18745; Location=42..1814; Strand=-
  SCN-specific regions: Sequence locations=1-856,883-1070,1092 -1184,1217-1293,1319-1447,1472-1555,1588-1650,1672-1722,1744-1773
  Gene Ontology: Mol. function=chaperone activity; Cellular component =Cajal body; Biological process=nucleocytoplasmic transport
atgttcaacggaattgacatgagggagcagaagcggatgatgaagatgatcaaatcgggcattggctttggcctttcgatgtacgaccgggtgaaacggcgttcttcgcaacgccctgacgatgagcagaagaaaaagacggcattagaagttttgaacacgaagcacgcgaaaaaggtaattacacaaaatgacgatcaatttacctatttactagtaagagacaattacaaatattggtgttttagagaaaagaattctctcgtgttcggctgagttcgacctcaaccgattcggaaggaaatgaatacgcccaagcaacaacaacccagctaaaaatggcggagaggtctccaaaaccaaagtcggcagaagaggacgaaagtgacacctccgatgaagagaacggagagcaaaacgcggaggaaaacgatgacgcaatgacgaggacagaaaaaccgaaaacacacttggacacttcgggcgatatgagcacgaaaagcagtgccgacgagaaattagaaaagacaactgctattttgaccatcagacggcccgaaatagcgccccgaaaaccattcatggacgaccgaccaacaaaagaggagggggcgaactcctcgccttcttctgttgaggaggaatcagccaatgggtccgaatcggagagcgaagccgaggacggcgaattggacgcgggagacagggcaatcaaaaaagtgaccaacactagcaatgagaaacccattaatcaaaatgtactttagcttaaaaatgtgttgtcgcgataccgaaaaagttccgaatcatcggcggacgaagccaaacaatttaacgaagtgcgtctgtcgcttgaataaataaaatgtttaattaagaaactgacgaaggtcatttcaatagcgactgaggggtgccaaacccgttcgtcagattctcactctgaaaaaagtgattcatcatcggacagttcgtcgtcatccgaaagtgtcactgacagtgagccaaagaaagagcgaccaaaattgagtgccggaatgtcgaaaaaattaccatcacaggtcgaacccattttttcaaacttatactatatttttttaactgaatttagaaaaaggtgaagcatctttcgatggaagatgtcttcggggctgactcatccgaagaatcgtctggtgaacgcgctattcctcttcctcctcctcctcttcgtcagaacaaagtcgagctttcttcgtccataaccaaacacaaaggcgtcgtcaatgagacaattaaaaagggaattgttgtaccaaaaataaaagttggaaataaacacgaagaagccatcaaaattcggaccgaaaaggctcaaaacaaatcccttctcacgaccaatgagcaagggaaacggactcgcgtctcttcggtgtcgtcggtctcttcggtcgaacagaaacgctttaaaaaagtaaaggttggctttttcaactgggaaaggggcattaattatattttggtatgtacgtttgaatttagagcaaaccaaataccgaaaaagaaacggtgacttcgccgccagcaacaacaacaacaacgacgacatctgtgagggacagaagcaaatcagacgcaactgcactcaaaacggcacacttccaacaaaagcaaatgacaagcaacaaaagcggaaccattgacacagtggagagagtggtcgagaaaacggcagaattggacaagaagatgaagcagcaaaagccgtcgaaaacaacagttgggactacgaaa

SEQ ID NO: 83419 - DNA, 1847 bp, Heterodera glycines
  Genomic contig location: Contig_ID=SeqID_18746; Location=110..1956; Strand=+
  SCN-specific regions: Sequence locations=1-564,586-1003,1025 -1761,1783-1847
atggatgaggcgaagaatatggcgctgttgttctttgttgaccacctaatgcaaaaggggggccagcggactatccacgacttgagctgtacgtgcagacaaatcggggcaaagggcgcaaatcgaagcgcgacacaatgccaatttgaaagattggcattccctccggtcattgcactcgcccccctccccaaggccaatttggtgcacgcggattcaccgatgaaatgcgtcaggcggtcggcaccacccaagagggcctctacgagttcctcagccagtacccgtccctgttcaccctccaagacggggacaaggtccagctgaagggctacggagatggcgacgagggccgcacgcatttgtcgcacattcctccgtccggccgccaacgcgactacgtcgcggaggcagtgcaattttttgtggccaaattggagaagttcggccccgaaatgcaggtctggcaaagcaaaagagcaaatccatccgaattcgagtcgatgcttttgtcgccttaggtaaaatcgctgctcggccatcgttctcaagctgcccccgaagtccggctcgtttccggacgccatctgaaggaatttgccgactttttggccaaccaaaccaaccatttcacggtggagggcgaccgggtgaagttgaagcacatgccggaaccgaatggaacggatgccaaacaatttttggacgaggagggccgcccattagtcggccatcgggcgaaattggcggccgtggactttatgagaggggtgcttgaacaggtcgaattcgggggaggcaaaagcgacgcaaataacgggcaatcatcggcagaacgaagaaatgcccatccctttggacattttctaccgccgtttctgcgaccgtttcccgcacagtattcgccaggaagtggccaccaaccccaaggagttgctgctgttcctcaagctgaaccggcacgtgttcttcatccgctccaacaaggcatctcttttcgcacttctctcatttttaatctgtggacctttcgtttgagtatttaaattgcctttttctttggcgttccgtctcaaccgttccatttcttcgcctttttcaggtacaactcgtccgtaatcggcctggcgatgaacatggttccgagagtggtcgttcgaccggcgaagacggcgggtcgtccgatcgaagtgccacaagcccagcggagaacggaggcggctgtgcgccgccgagggcaccgacggacggaatgtctcccgagacgaacgctcttttcccgctgaaccgcgacaatttgcaccgcgtacaaattgtacaaacgctgcagcaggcacaggaagcggtgcgttgcctgcgcgtcgacctcgactccgtcccgtcttccgccttcctcgccctcgacttcaaattgctctctttcggctccgttccgtccgctgaccttccgctcgtcgttctcgccgttgtcgcgtcgccgctgcgtctcgtcgtttttgacctcgcccaatcggataaggttctgtcggagagcggactgcgcacccttttggaggacgacagcgtgctgaaagttacgcacgacgttcaacgaattgcgccccttttggccaaccgatgggacattcgaattggccgactgtttgacactcaggctggtcattcaattcattcactcattagtcctttttgggttccgaacatgctccaaaatcctttgcctaattaccctaattgttttgcctttgatcctccgctaatttatccccctttttgcccttctcagatcgcccattcggtcattcagcacgacaaattcagtaaacccctcggcgacttgcgtgcca

SEQ ID NO: 83420 - DNA, 1501 bp, Heterodera glycines
  Genomic contig location: Contig_ID=SeqID_3149; Location=619..2119; Strand=+
  SCN-specific regions: Sequence locations=1-102,125-758,786-833,856 -1277,1303-1407,1440-1472,1494-1501
  Gene Ontology: Mol. function=glutathione reductase (NADPH) activity; Biological process=response to oxidative stress
atgtcccaggcattgaccgatgcgctcatcgctggaccagttaatctcaaacagaaaacgctggtatgtgttggaaatgaaggcccgcccatcagggaattgtgatccccaggattctattacctgggattaatttttcaattaaatcttgctgaacaactttttccaggtgtccaaagttgagcgttcagaaacgaccggcaaactgactgtccatatgacggacgaaagcaaattggaggatgtagacaaactgatttgggcaattggacgtgaccctttgacagctgagctgaacttggccgatgttggggtcaagctaatagctggcgactacatcaaagtggacgattaccaaaacacgaccaaggagggcatttacgcggttggcgacgtctgcacaccgaaattcgaactgacgccaggtacaacaataaggggaaaatttgaggagatgcaggccaaaaatccagggaaaccgaatcaccgaatctgaaaaaaccgaatggcagaagtgaacatggatactgtcctttcggatattgaatttgagtcattaaaattgtcggatattctatgccagacatggcattgttctcaattccctctattcattgtcagttgcaattgccgctggtcgccgtttggcccatcgtttgttcaacaaggaagcggagaaccgtctcacctacgaaaacattcccactgttgtgtttagtcatccgccgcttgccacaacgggcctcagtgaaagtgacgaatttgaaaatttataaaagggttaatgaaagcagtctctttaccacagggcctcactttactagcatagatattagttgtttgtgttttctgattttttccaaaattttagaggaggcagtggagcgcttcgggcgtgaccaggtgaagacgtacaatgccggcttcacgaacatgtactttgccatgactcaacacaaagagaaaacccacatggttgtttccacaatcgaattcattcgaataataattttggcgttttttcccttcagaaaatcgtgtgccacggaaaggatgagaaggtttgtgcaaatggcccaaattttttcgtgacatagtcaagaattttccctttaaggtgattggattgcacattttgggcatgggtgcggacgaaatgttgcaaggcttcgctgtctgtgtgaaggcgggtcttaccaagaaagactttgacaattgtgtcgccattcacccaaccgcctcggaggaacttgtgacaatgcgctgacaatcggttgacttatttttgtttgtttttggtggtgaactgctctaatgaatttctcttatcacatggacacatagttaggttaatgaatttgcatatttattgtttaattctttgtgacaaaatgaaacactgaaatgatttaaattaaaattattttttttgaatttttgtgatgttgcgttccttaattaatcaagagattgtttcagaaacgtttattgaattacaaaa

SEQ ID NO: 83421 - DNA, 271 bp, Heterodera glycines
  Genomic contig location: Contig_ID=SeqID_3149; Location=2151..2421; Strand=-
  SCN-specific regions: Sequence locations=1-271
atgtccattcaacgtcaaatgaaggaggactgggacaatcgcgaactgaacagcattgtgagattcatcggaatggaatttcggcccgaatttcatgaaatttgccgttcttcagatatccgacaacatccgccaaatttccgagtttttgagtcatttcgacgagacctgcaaggcaaaattggccacgctgaatgacaccatcacatcgatggagcgaaaggtggaatttctcgagtcgacggtgaccagaggagaaacgctgaattga

SEQ ID NO: 83422 - DNA, 3060 bp, Heterodera glycines
  Genomic contig location: Contig_ID=SeqID_3150; Location=146..3205; Strand=+
  SCN-specific regions: Sequence locations=1-523,560-1345,1367 -1547,1569-1916,1945-2259,2281-2316,2338-3060
  Gene Ontology: Mol. function=cell adhesion receptor activity; Cellular component=integral to membrane; Biological process=cell -matrix adhesion
atggtgaaattctcatgtccgagccgggcttcccgtgccattccctgtcccaggagaattacacatgttccggctgcattcagttgcacgactcgtgcgcatggtgcatggactttgtgagttatttatttctttcgactcatacaattttatcaaacaattttatttaattttgtttttcaattttcccccttttccgcagagtttcaacaatttggcccaatattcgcgctgcgattccgcccaaattctgctcgagcacggctgtgcccctgaccaaattgtgaacccgcaaagttcgctgcgcaatttgctcaacgaaccgttcactgacgggacggaggagggcgaacacacagtccaactgaggccacaggaggtggagattcggataagaccaagtgagtcccgctgttttgggttattttttcttatctttgagcatttttattttttgccctccgtttcagagtctaaggcccgtttcaatgtccgatttcgccaaccacacgattatccggtggatctgtactatctgatggatttgtcatactcaatgaaggacgacaaggagaagctgtctcaactgggcgacctgctcggtatgcattttcacgtttttcataatatacgacaaaaaattgttttctttgcatttcctattacagctgaacggatgcgttcaatcaccaaaaactttcggctaggctttggctctttcattgacaaaaaagtgatgccatttgtcgacccgcgccgggagaaacaggtttcaacccccggggcaatcggtgccttttttggggacgaattgtgtcaaaacattgtctttttggcgggttttcaatccatttttgtattttgattggtactggatttacggcttttatgaaaataggagcagccgtgcgccgagggctgtgcgcccacctacggcttccggcaccaaatgagtttgacatcgaacacggccaaatttgccaaagaggtggacaaggcgcagatttcgggcaatttggacgcgcccgagggcggattcgacgcggttatgcaggtggatacttgattagccaacattatttggattaaagccaaggagagggtccagggattgaggaatggggctgaaaatgaccatgactaatggtcaaaccgtgaaagtcatgaatttttcgatcacgaaatgaacgaacacgggttttgattttttaaattttcaaaagtttggggcatttttacaaaaaatcatttaaatattgaaaaacctcttccaattcaccttttcacttctaggccatctcttgcaacagttccattggatggcgagagaggtcacgaaaaatgatcgttttctccaccgatgccgggttccattttgccggcgacggacgcgtaaaaaagggggagggcgtggcaatttacggggacactgataatgcccgtttaactgttaaagttggccggaatcacaacgccaaacgatggacagtgccatttggactcggatggttattatacggtgagcaaaaagaaaaaggcggagccgacccgggattttgtgtttggctagggaatgccatccataggaaatggttttttgtatgctctccatgcaaaactcactctcgagaaatttattcaacaaaaaggtagtatttaaaatttgaggaaaaatgcacaatttgttgtttttgtctgaatttgtggcgagaaaatgaacaaaaaagtgccttttgcgtttgccttacaattagcccaattcccttaaaacttctgcccgtcctccctccattctcgtgccatttgatggatatgccgtggcaaccctccgttgttttgtttattgtcattctttgcagaagtcgatagaacaagactatccgtccattgcactgctccatcagaaaatcaaagagaaaaaggcaataaaaataaagagattaaaggtttcccaatcccccgaatttgtcaggtgaatgttatttttgccgtcactcggagcaaccagcgactctaccaacaggtgagggagagagagagagagagcgtgccctcgcacaaatcaatcagacaaaagccttccattgtttttcccgatcgcttacttattgattggttcattgatttttcggcgtctcttttccccattcatttctcttccgtttcagttgaccgacgcgttgcctgacgtcagcacagcggtcggtgtgttggccaacgactcgtccaacattgtgacattgattgaggaggaatacgggaaaatcgcagaaaaaatcattatggtgagtcatctcgcatgagaccgaaacttctaccaaaaaacattgttttttcgagtccatggcgaaaataaaaaaaagcgtttcctttgctactttacatggatttcgggtgtacgatcagcgatggaataataaaatattccaaaatcctcctcccccccccccccaggtggacaatgccaacgcgtcgatgggccttcgcttgtcctaccggtccacgtgcgtggacggtcgaacgctgcaggacacgaacacgtgtgacggggtcaaagtgggcgacacggttgcgtttgaagtgacgctggaggcgctgcactgtgtgccgcaaagggacttcgtcctgcacattgggccctccgggctggaggaggtgctcacgctgtacgtgcacgtcatctgtgactgcgactgtgaggacgaggtggaagcacgcactttaataacaccacatcatcccatggcatttcaaaaagttgctcattgacagattgtttacaatgcgcccgaatgcaacggacatggcaatttggtgtgcggcatttgccaatgtgccgaaggctatgtgggcacccattgcgagtgcgaaagtggcggcgagtcggcggtggcgttggaagcgaagtgcaaaaaggacaacgacaggtgggtgtgctggtttggtttaccgcctgtggttgaatcgaactgctcgaacttgattggattatcattttagatgggccctggatttaaggtttaaggcattctatgcctaatttgaaataacgcatgcgaa

SEQ ID NO: 83423 - DNA, 1276 bp, Heterodera glycines
  Genomic contig location: Contig_ID=SeqID_18749; Location=951..2226; Strand=-
  SCN-specific regions: Sequence locations=1-452,474-717,740-841,863 -1081,1138-1276
atgggtgccggctttgaggatggccgcgtgggctcggcacggaagaaaacgccggaggaattggcggccgaaatggcggcggaagaggactccatcattggccaactgggcctaacggaacaagtggaggtctctcttccatggaaattttttgaaatttgccgcaaatggagtgtgtggggggctgtattagagcggacaggggaggaaattttcgaagaattttgtgtatatattcgctcaaaaaagcccgaatttgtaacccgaaaatgggtcatttttggcgaaaatttgtaaaaaaaaaagtacatttttcactcaatgcctatatttttctgaaaaaatataacatcgggaaaagaatttgtggtcggtctcgaaatttcaatgcatttttcaaaaatcggcataacaatttggacacaattttcatttttttggatgcgaacgaaagacacataaggagaacaaaaagcgggagggaaatgactaaattaaatgggagtaaatttctctctcatttttgaaaaatcgaaaaaatgggaaaccccgtgaaaatttattaggggggaggggggggggggaccggctctattccagtttacgcgtccaatgagtgaccaccctcacttttttagctcataacttttttgttacttgctcaaaccaaacatttttgctatcaatcgaaagcttaaagtttagggaatttataaatacaagaaaagagcaaatatttgcattaagaaaaaaaaattggaatgagagatcccgaaattcataatttttcgcatatattcatgaataatttttgtctgttgcctttatcccagaattttcttttaaaaacttcccttttaagcaaaaaaacctatttcggaaacaaaattgcctaaaaattaaactaatacggtaatttgcataaattatgcactttattgtagttcaaaattcaaaattgttaattagactcatctctgtcgttgccccgggcggcttcgcatcaaacgcgaaaaattcggtggcgatgaaaaaatcgcaagaaaatggtggaaacacgccactttttcaatcaaaacggtatttaaattactaaaaaaactaattataaaaaaaacaattaaaaaatatatatttcagacaaagttcggtcgacgcaaagaaaagcgaagggcgaaggacgggaaaatcgtttaaggtcaatcggatgaaaaataagcaattaataattaattggcccattagccattactgagggttaattaacccaaataaa

SEQ ID NO: 83424 - DNA, 394 bp, Heterodera glycines
  Genomic contig location: Contig_ID=SeqID_18750; Location=785..1178; Strand=+
  SCN-specific regions: Sequence locations=1-123,152-301,327-394
atgagtgccgcccgtcgcaaccgccaaccggtgagcgcgccgactccgttgatttagccggaaatgttggccggcgtttctcttcgcccgaccggcgtcaatttgacggtggacagggtgggcaattttaattaaaatttttatataatttcatttctctatcattacaatacacaaatcttaatcgttttaaggcagcggggcagcgccgcgcggatggtgcaattgagaagggcgaagagcccgtgtacgatgaggtgccgcttgacaccgtggtccaaatgcgtgatgaagaaaatggggaggaggatgaggaagaagatgacagttatttttagtgattcggcaagcgatcaaccaccatttaaccaattgatcgatttttcactttaaa

SEQ ID NO: 83425 - DNA, 687 bp, Heterodera glycines
  Genomic contig location: Contig_ID=SeqID_18750; Location=1580..2266; Strand=+
  SCN-specific regions: Sequence locations=1-161,195-432,457-648,670-687
atggtcaccaaggatggaatcaccttatggtgcacacgaatagaaaaggctcagtttgtcccttttgatgttgtttacgcgcttcccggtcattgtttctttcgcgtgaaaaataaggcacgtgtgttcagtgttccatatagcaaactgccgtcctcagacaagtgtgcacagccgccaccacccccatcatcaaaacatcaacggacaccggacgacgaggaggagaagaatttgaggcgtaaggcaaaagtgacgcttgacttagtggaagctggtctaatggaagacgcaatacaggatgggacgcgctggaagaaagccaaaacctcgatcaatgtgctgggcaatctgcttttgccggaatcattaacagatgcctcaccaacttttcagcaacaacaacaacacttacagcatcagctatcgtaaaaagaggaggagaagagggaggaatgcacaaacaacagcagtgctggagcaacaactgaatctgctcccgatggtgatgtaatgaacgatttcgtcaatagcattcaagcggcgacaagcaatatgcaatagcaaaaaaaagcttaaacgatggactcgctctgccctatatataaaagttgttgattgctcaatttgtggttctccatactattattcacattttaaaaatgttaaattctcaatcgttcagta

SEQ ID NO: 83426 - DNA, 171 bp, Heterodera glycines
  misc_feature (166)..(166): n is a, c, g, or t
  Genomic contig location: Contig_ID=SeqID_18750; Location=2901..3071; Strand=+
  SCN-specific regions: Sequence locations=1-19,43-171
atggagcggtataaacggaaacaacaacaacaacaacaacaagctaaagttagtcaactaataaaagaaaatgccaactggctttgcgcactgtcgaaggcaaaatgcgtgaaacgatgcgggagactgatcagaaaggcgaacactgataagctgctgtcacttngtgaa

SEQ ID NO: 83427 - DNA, 254 bp, Heterodera glycines
  Genomic contig location: Contig_ID=SeqID_18752; Location=316..569; Strand=-
  SCN-specific regions: Sequence locations=1-69,92-171,193-254
caaaaccatccaaaaaattgtcgctacacaacgccaacacttggacaaacaaagaaacaaagtcatcgaccaaatccacaaatcctcaagtttcctttatccgagtgcctcgaaggatcgaaatttaagacccccccaccctacttatttcagcggaagatgagcgtgaagaagaacgcctttttgagatttaatcaatttgctcaggaggcatggaatctaatcgtgaacctcgctttggacttagacagagg

SEQ ID NO: 83428 - DNA, 516 bp, Heterodera glycines
  Genomic contig location: Contig_ID=SeqID_18753; Location=509..1024; Strand=-
  SCN-specific regions: Sequence locations=1-215,238-246,268-387,412-495
aacattccaatggttacgcatatcctctccagcatcgaagaatcagcacaacatagggacaaaaaggcggagaaacagcgccacttcgaggttaaagaaacattcggatttgttggtggataaataaatttaagattctcatcggcgatccgaagtataatccgaaaattttagcggtattttttatcactaatgttcatttcatttttaaaatttaaaaaacggactaaaataaaacggacgtcaatttcagggaaaagaacaattgctttctctgatttataatttgggtggccaggaacgcttcgtggacttgttagaactacgaaaattgtatgaacataattatttcaaggaattaaacaaagcggtgagaataacgaaggagtgggagtgatttgactgatccgaagattacaggcactgaaagagtttttcccaacgggacagttgaaaggcatcatggacaagtatctgtaccaggacattgaattggcaactgaccaaaacaaaaat

SEQ ID NO: 83429 - DNA, 492 bp, Heterodera glycines
  Genomic contig location: Contig_ID=SeqID_18754; Location=1566..2057; Strand=-
  SCN-specific regions: Sequence locations=1-336,359-492
atgaaaaaacatttgacgcaaaaatttgaggcccatcttggcgttatgtatttaatgcaaaagaattggcactgtgacaaaattgctgaccaattaactgaatataaactagggttgagcggtaccggtaccggtactggccggtaattaccggtttttttggtaccggtaccggttttttcaaaaatgaaagtaccgttaccggtttgttgtttgtactggcccggattgttcattcaattcccgccacatctgtgtcatcggaaaggctgttctcgaaagcggggctcatttatggcaactcattaagaaatcggtatttttgatttctgatttctgtaaaaccaaggaatttaagcctgagcggagacatcaaagcaaatatggaccagttgtttttggcaccatctactgagcccgatgcagaagaaaaagaattagaaattgattatttggaaataaatgatgatgatttttgttaaaagtaataaa

SEQ ID NO: 83430 - DNA, 882 bp, Heterodera glycines
  Genomic contig location: Contig_ID=SeqID_18755; Location=195..1076; Strand=-
  SCN-specific regions: Sequence locations=1-9,31-78,104-118,142 -163,188-206,232-250,280-882
atgagtgagaaattctgcgcatatgggctgacttttgttcgtcgccgtttctctactgctaattgcgcccggctgcgatggcatgcaaattttcgtgaagacattgacgggcaaaacgatcactttggaggtggagagctcggacactgtggacaatgtgaagacgaagatccaagacaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgggtaagaacaagaaaagcaacaaaaagcttgatcagaattgatcagcagcgaacgcaccatcacatgattgattggcacagtgattttccaccaccaaattcacaacacttttctcttttccgggttatctttgatttccattttcggttattgttttctgtttttctcctctatcttttgtaaaattctgttactttgatccttagttttatcatttatcatcgcatatatagaagttatcatagtccatatttctgtccctttttatttatttttttgactataaaacttttggacatttcgtgccaatatttttttgtgctaatcacttgctgaggatttaattattctttgccctggcctttcaccacctcattaagtgtcgaatggagaagcacagcttcgaaaagtcctcgtgcaaatattccctgctgtccatcgtcagtttcatcgctaggaaagtattccaaactgacgatgatcagtttgatcagcgaattgctcgtcgatggtttaagcgcgagttcgtagaggctaaacttaactaaataaa

SEQ ID NO: 83431 - DNA, 413 bp, Heterodera glycines
  Genomic contig location: Contig_ID=SeqID_18757; Location=403..815; Strand=-
  SCN-specific regions: Sequence locations=1-88,111-191,213-220,242 -317,339-413
atgtttgatggacatttcccctcttttgtacatgctcatctcgacctcaaattggcactgctttcgctccgtttcgatgcgctggtgtgcaaatttttcaagggaaaaaagcggattgttgcgcaagtttcatttttttcaaataagccggtcaaacctttctaagctcgaaaattatagattgaattcgagttcaaaaatagaaaaatggaaacatttttccttgaattgaagaaaatttttatttatgaaattgtatatttcaaacaagaaatcaattagtgtaattttttaaaaaatgataccatttccatcccaaaattttccaaacttaaaaaattctctcaggcaatctctgtgtttggccggttaaaatctttaaaattcatcactttgaccatgaatagaataaa

SEQ ID NO: 83432 - DNA, 245 bp, Heterodera glycines
  Genomic contig location: Contig_ID=SeqID_18758; Location=1312..1556; Strand=-
  SCN-specific regions: Sequence locations=1-192,223-245
gatggtcccacacatgaggaggatgactcggagctgttcggacggcgagtgtccaaattcttgcgcagtttaagctctacacgccgtaggcgccaagcatgcattggtattgagcagctgatgatggactttgacgaagaggaagaaaggaacgccaacgggacggctaattgaccaattaatgactaattaacccgaccatcctccttttaattcctttttgaccattataaagtaaacgcaaa

SEQ ID NO: 83433 - DNA, 252 bp, Heterodera glycines
  Genomic contig location: Contig_ID=SeqID_18759; Location=197..448; Strand=-
  SCN-specific regions: Sequence locations=1-11,33-50,89-252
atgaaggtgcgattcaactgtccatggcatcggagcggttacacgccaaattttttcggttttaaagtgaaaagaaaactgaaaatgcgaactgttgaacggttgagtcagacagaaggaagtcggcacattttgatgagacgcgtcctctcagagaaacattttgtcgcatggaattggccatcaaagaaaccgcggaatgatcgactgaattaccctctctgatcgttgacattttgttgatagaataaa

SEQ ID NO: 83434 - DNA, 127 bp, Heterodera glycines
  Genomic contig location: Contig_ID=SeqID_18760; Location=1179..1305; Strand=+
  SCN-specific regions: Sequence locations=1-66,88-127
atgcttgtgatcagcgggtggcagacgctggtacaagggcgacaggacggagaggagtcagtctggtcaactgatcgctgtccaccgccgcggagcggatcttcacaagcaacaagggatcagcctg

SEQ ID NO: 83435 - DNA, 189 bp, Heterodera glycines; identical to SEQ ID NO: 63372
  Genomic contig location: Contig_ID=SeqID_18760; Location=804..992; Strand=+
  SCN-specific regions: Sequence locations=1-21,56-68,92-189

SEQ ID NO: 83436 - DNA, 101 bp, Heterodera glycines
  Genomic contig location: Contig_ID=SeqID_18760; Location=1698..1798; Strand=-
  SCN-specific regions: Sequence locations=1-101
gtcgggaccaaacagatgcaaattcggcccggcaaaaattttggcaaaatagaaattgggacaaacagtagacaagcaggggaatgatgttttattccgac

SEQ ID NO: 83437 - DNA, 2145 bp, Heterodera glycines
  misc_feature (1461)..(1463): n is a, c, g, or t
  misc_feature (1467)..(1468): n is a, c, g, or t
  misc_feature (1493)..(1493): n is a, c, g, or t
  misc_feature (1499)..(1499): n is a, c, g, or t
  misc_feature (1513)..(1513): n is a, c, g, or t
  misc_feature (1522)..(1525): n is a, c, g, or t
  misc_feature (1530)..(1531): n is a, c, g, or t
  misc_feature (1533)..(1533): n is a, c, g, or t
  misc_feature (1542)..(1542): n is a, c, g, or t
  misc_feature (1562)..(1562): n is a, c, g, or t
  misc_feature (1571)..(1571): n is a, c, g, or t
  misc_feature (1573)..(1574): n is a, c, g, or t
  misc_feature (1579)..(1579): n is a, c, g, or t
  misc_feature (1581)..(1581): n is a, c, g, or t
  misc_feature (1592)..(1592): n is a, c, g, or t
  misc_feature (1595)..(1595): n is a, c, g, or t
  misc_feature (1608)..(1608): n is a, c, g, or t
  misc_feature (1618)..(1618): n is a, c, g, or t
  misc_feature (1623)..(1623): n is a, c, g, or t
  Genomic contig location: Contig_ID=SeqID_18761; Location=1..2145; Strand=-
  SCN-specific regions: Sequence locations=1-136,174-407,431-465,487 -618,685-763,785-834,856-951,989-1113,1135-1374,1400-1574,1688 -1798,1857-2145
  Gene Ontology: Mol. function=phospholipase inhibitor activity; Cellular component=plasma membrane; Biological process=skeletal development
cagcgccaaaaattgagtgaagtatataaaaagatatttgagaaagagatgattgctatgctgcatagagagttcactggcgactttcgggaactgatgtaatttttttaaacataattttctcattaaatcatgcatattttaaataaatttataaaattttaagtttttatctgatgcaaacgcccattgtttatgatacaaaccaaatgcataatgcattgagcggcttcaacatcaataagtaaaaagcactgatttgtgaggtgtttaggagattaaccttaattccgccaaggtttaggaaaaaatatataaattcattagatttgctcaaaaaacaatcaaaataaaaatatttcatggtatcatttaacaaattttagtgttctctatcaaaaaatccaatttaatttattgtaataatatatcaaaaatttgaatcagaattagtttggccacaacttatttgttctttaaaattttaacaaagaattttgggctattgaatgaaaatcattaattttgacaataaaatatgcataatcatggcaaaaacgtgtggttcatccgtttaatgcttaattaaatgcttcagtactttttttcagaagcaaattaatatttttaagaacttgaaacccttttaacacttaaaaaattctgacccaaaatttattggaattttttgacgagaacttttttttttatacatttgtgaaatcatattatgtttaaaaaaatgctatcgaatgataccattaatattatttttgttgaatttaagccaagttatgaatttttatgtacaatatttatatttttttgaccccttggcagatttaggaaacgtcaaagcacgaagcacggaaacaaagtcacacaaaaaccaaaaaattttttggaacgaaaaagaaatgaaattaataatttttcatgaaacccaaaaactaatttaaaatgaactaaaatttaattaatattttatcaccgaaaaggaaatgaaaaatttttacggaccaaagcgaaaaacatgaaaaaaaaagtcaaatggtggctaaaattgaaagtctacttttttttgcttaaaagcctacccttgttggacaatttatagagatacaaaataaaaaatgagccctaattactgcgcggaccatttcaggccggtgctagccgaaattttgataacacgcacaaatggacaaattgctgaactaattgatacatataatcatgtgtttgatggccttgagaatgacattaaagcaaaaacaagcggcccatttcaaaatttgttgctctcattgctcagacattctcgtgatgagactgagctggtcgacgagcaattggctaaggaagtaattagcgaaataaataaaatgtttatcttgaaatgtgcccaaatggcacaccatgcaacatggatggtacggaattcggattttgacatttttnnnatcnnattcccaatttccaaaaaaattttnccatcnattaactatttccnaaaattttnnnnccttnncntcatctctnccacccaaccatttttcaantatttttcntnntttantnaatttttttanttnatatacaaatatnaaataatttnatttnctttttaccaataatttcttttaatttgaaaatatattttattaaaaaattatttaataattttcgttactatttgtttaggatgctatgaagctgatcaaagaaggcgaaggccaaaaaagcattaacgaatcagtgttcaacgaagtgattgctacaagaaacttagtccaggtatataaaaaaaattattttaaataaaaataaaattcccatttaaaatatttaaaaatgatgagtcatttcgttaagctccgactcacattcgacttttatcatgaagttgcagaccaagacattgagacgggaattaaacaggaatttggcggtgacgacgaagcggggtaattaggataacgatccgagatctaattaggctttaaatttataataatttagcttgtttgtttacattttttatttagctttttggcactgattaaatgtgttcgcaatagctctgaatattttgcggatttgttacaaaaatcaattaaacggaatttgcacatcaaaatattt

SEQ ID NO: 83438 - DNA, 461 bp, Heterodera glycines
  Genomic contig location: Contig_ID=SeqID_3151; Location=1160..1620; Strand=+
  SCN-specific regions: Sequence locations=1-75,107-108,155-184,209 -271,293-461
atgtcaatgttttcgaaatgaagttctttaacctgcgagaacattgaagcaattctcttcaaaaccacaaaattctttttataatttaaaattttaatgaaattttgaaaaaaccaaaataaaagtgaaaatctaaaaattaaaaaaaaattaatcgaaaaattcctaaatgaatttttttttcagctcttccccattcaccatgggcatttttggtccatcttttgctgtgccgaaatgcgctgccaaaccttcttcgaccacttcacaattggattggctttaggggggtcaccctccccccgggggccaagccgaggcttcttccttcctcagggcgggggaggacaaattgtggtggcgcggcaccaccacaaatttggcaattgaaaatggacttaccaaagtagaaattgttgctaaacaattgaaaaaaaagaaaaatgaatttttgattttga

SEQ ID NO: 83439 - DNA, 275 bp, Heterodera glycines
  misc_feature (8)..(8): n is a, c, g, or t
  Genomic contig location: Contig_ID=SeqID_3152; Location=112..386; Strand=+
  SCN-specific regions: Sequence locations=1-85,107-275
ctcttccncattcaccatgggcatttttggtccatcttttgctgtgccgaaatgcgctgccaaaccttcttcgaccacttcacaattggattggctttaggggggtcaccctccccccgggggccaagccgaagcttcttccttcctcagggcgggggaggacaaattgtggtggcgcggcaccaccacaaatttggcaattgaaaatggacttaccaaagtagaaattgttgctaaacaattgaaaaaaaagaaaaatgaatttttgattttga

SEQ ID NO: 83440 - DNA, 1431 bp, Heterodera glycines
  Genomic contig location: Contig_ID=SeqID_3152; Location=625..2055; Strand=-
  SCN-specific regions: Sequence locations=1-256,287-420,468-490,743 -788,900-918,942-1040,1062-1303,1349-1431
atgccatttcggacgggggaatggccaagcccaggaaattggttttggccaaatcccaccgaagacggtggtgggggccaaggggtgggtgccgtcgtaattggatttatggggtggccaaagaatggcgcccccggagggatggatggaaggggacggattagtgaatgctggacgggaatatggactcatcctcctcttttcatgcatatatgtttagtgcattcattcccctgtacttcgtacaattttttggtaaattttttgaaattaaaattttttttttgaaatttcattggaaaaaaataaagttttaaaagaatgaaaatggcctatattatgaaaagcttagttttttgtattaagaattttttggaaataaaaattttactttttaactcgaatttaactagttaaaagaaattaaataaataattttaatttattgttttaaaaattcaatatatcttttcatatttcctacaatgtgtatttatattgaaattaaaatgaaataataagatataaataatttcatcatcaaaataagaaattaatatatttttataaatattaattttaattaaatttaaattttctatcacttatattttctttatgaaatttataaatgaaataaataatataaataattcaccattaaaaaagaaaattaaattcttttttatttaatttttttatctttttaaaatttttattaaaattaaaactaaaatttttaccacatacattcatgttgtttatgaaatcgtacataaataaagaacatataaatttttatcattaaaagaagaaattattatttttttatatatatatatatatatataatctctttaaaaatattattttatcaaatttaaagttatataaattttcttttatgaactcttaagcaaaataataatatataaataattccagcatttatttgtgctgtccttctatggtcattcgatcctcattatttcaattggaccaaccacagccaaaacattggcacaacaaccgaaccaaatctttgtcccccctcctcagagagtgccattgaaaggaaaaacctaattaggcgctcatctggccccatgttttgggcgacatatttggggggcaaaaagccaatatttgcgattcatgccattcttagaattcactactcccctgccaacagatgggaaattcgggaattttatacatttttaagtagttatgactaatttcttaccatgaacttaattttttttaaatttatgcgaaagtaattttaattctatcaaaatggaaaaatttaaaaatttctttaaaatatgaaaattaatttaaaattcgagttttaatttttgtatctttataataacgaaaacctgttaattgaaaaagattttttaagctttagcattcttaaataaa

SEQ ID NO: 83441 - DNA, 960 bp, Heterodera glycines
  Genomic contig location: Contig_ID=SeqID_18763; Location=776..1735; Strand=-
  SCN-specific regions: Sequence locations=1-146,178-239,262-284,306 -357,379-546,568-631,653-811,833-960
atgaccacaataaaaacaatttcaaccacaactcccaaaccaaaagtggcggaaacaaaggccaaaaaggcattgccaaacaaaaatgcaatactttcaaagatttctaaaaaaaattcgaaaaattctgggagggaaccaatgaaaactgaaacaattgaaattaaaaatgaaagcggagaaaaagactcacaatttcaaaaattgtcagaagtcgatgaaaaagaaagtgatgaagtaatttttcaaaaggcgaaagacaatttagaaaatgcaattaagtcagatgagtaagaaaatatgagaaattctctggaaaacgaataatccaagaaaattgccaacaatcaaaatccatttaaatggccttttggcaaaccttggttgactcttgcgcaagtgtttcttactgcagagaaaaaacagctcaaaaagcggggttaaaaatcgagccattagaaactgacaaaacaaatttggccgcggcgaatgactcaaaaattctaattttgggaaaaacaaaagcaaatattcgaattgaagatccactcacaggaaaaagtggagaatgggaagcaactttattggtatcagtggacaaacattgtcccggtccacttttaattggattacccattttaactgaattaaagggagttattgcatttggagaaagaaaagtgaaaattggcgaaatttggacaaacatcatttcggtaattggcacagaatcagagaaacccatgagagtgactatgaaaaatacagaaattttggaaccaagaacggaaacaattttgacagcaaatgtaaacgggaatttcaaaaatgatcagaattttttggtggaaggaattgcacatcaatatcccggagtaattgtcggaaggactttggtttcacccgggacagcaaaaatgttacaattcaaattttaaacgctggaaaagcaccaataaa

SEQ ID NO: 83442 - DNA, 1341 bp, Heterodera glycines
  misc_feature (845)..(845): n is a, c, g, or t
  Genomic contig location: Contig_ID=SeqID_18764; Location=497..1837; Strand=+
  SCN-specific regions: Sequence locations=1-334,357-622,644-791,813 -892,914-1341
atgaatttatttaaagtaatatttattattccattatttcttttcataatttctgttttttacaaaaatgcaaaagctgagaaattgaaattgcgcgtcatttacggacaattggatgcaaattggaaggtccaattggatttgatgattgtttcccattaccacgaatatggtaattaccataccaaagaaatggtacaccgtaacattgaaaatggaaagaattttgaagtaaatttggagaacggggaacagacggagaagctgacactcggcttcggattctcaatacaattaagcagcagcagaagaagccaatttgagactgtgagacttttaaaaagataattggggaagataaatggaagtaattaactgattaatttattggcaagcaagaaaaaattaattgtcccggtcaaactagtacagctagatttgatttacattcctaaatacgaaataatgagcttttgtaatcctcttatgccatcctcgccctctccccgcttcatttttggcactttttccaaagtttagttgggaaatgcgagtgacaccgaatcatcggatgatgcgtcgcctttccatcagcccacttcaatagggacacaattgaatgctgaacgtttcagaaaggttgtccgggttgatctgtacaggccgaactttgcgaaacggcaccgaatcgaattgggcaatgtcgaagtgccaatgccgccaaatgggacggcactgttttggaatcgcagagtgatttttgaggcgaacaaagacacgggcaattatcatgcctttttgtatgcaaatgttggcaaaaatggtcggagcaatcgcaactctanaaaaatgtttatgggctatgcaccgctattgagaattgggcagcacggggaaggaggagaagcaccgacaatagcagcagcagaacaacaacacggggtaattagggggtaattaagggaagcaagttggagagagcccaattaggaatttaatgggatttgccgaaagtctaattgaattgtaaatcatttagacctctgaataccaagtgacaattcctgtcaaatttggcgaattcttcaaacataaattgtggaatctgaaagtgtttatttaccaatttaaagaggtaataaaatagcaaaataattcaattaaaaaagattaattcagctgccaagcgcaggccaaaaccgaaacgcaacagaaaatgaccaaaatgaggaagaaacgtgcccaatttgcttagattctctccagttggagaatcgtcaaataatcaaattgcatggaaaaaggacgaattatgaggcgaatttttttgcaattttttga

SEQ ID NO: 83443 - DNA, 243 bp, Heterodera glycines
  Genomic contig location: Contig_ID=SeqID_18764; Location=2117..2359; Strand=+
  SCN-specific regions: Sequence locations=1-243
atgtacgtcaatccaaccgcgcaactgtttaaaatggcaaattcggaaggaaatgatcgcttcagccatggccaagcactgcacgcatttgccaacatccgacgcaaaatggagcaagccgaaagggcagtgaagcggagtttggccacgatggaagtgccattgttaatggacaaattgtttggcgaaacgttttttgaagtcggatttaacggatttggcgagaagcaaagcattgaaaat

SEQ ID NO: 83444 - DNA, 1462 bp, Heterodera glycines
  Genomic contig location: Contig_ID=SeqID_18765; Location=38..1499; Strand=+
  SCN-specific regions: Sequence locations=1-78,100-393,416-868,892 -956,978-1066,1088-1356,1378-1462
atgggctcgggagaaaacgtggcctcagcgaaagtccgcattgatgtacgtgtcgtacaaaactacatgaacataagcgaagaagaaagaaacaaaattcgcaacgaggcatgcggcaatgcaaaagcaacaaaaaaagtaggcgtaaagattacaacgaaaaaccatttcacatattacaggcgctttatcgagcgcaaacaaagcgcttccttcatgaacgtccgcactcttcaaggactggcacaaaacgattgtcgtgcgctgtggatcactctccgagcaagaagcgccgcaccggaatcgccattctatgacgaactgcttatgcgctacttggacgatgatctggccatattcgcatcaccgcgacaacttcagttactgaagaaatcagctgtcattgtgtcggatgggacgttcaaacaggcgccaaaaggaatttaccaagtatagttatcatcctatttttttcaattttttaaattagatttatcatgtcttcggctttgtagcggcgactcatgcggtaccgctgtgcacggcactgatgcgtgggaaaagtcgtgtcatttaccgacgcttctggtcaacgttgagacaggaacttgaggacacagaaggagagctaatggttgctatttctgtgaaatttatatatttttcgtgctttagataaaccaagccaattttgattttgagcccgcctcaacgcgtgaacaagaaggccgcgcatttcaagcacttcttcgcaaaattggcgccctacaatttgcacccccaaaccacgtcaaccgttcattgcacttgatacagcaattgatcaacgaaagcgagttggagttggttattcgattgtcgttgttggacatattagaatattatgtttgccttatttttttcttaaaaactaaacttaggtcactacttgggtacgcaacagcattggctccgagtttttctctctttttgatgttccggttcatcggacaatcaatcatgcggagtcttatcacggccgacaacgttggttttatcaaccacatcaattactcggtcgttggcttgtgaatttccaggttaagaatttatttttttcaaatttgactgttttgcttaggaggttaatcatgcagaagaagaatcagctgtgtcaattgaagagggacgacagccaccatctcaacagttggcagtcaccgcagaaatagatgccagcatcgcgcgtgagaaggctgacattttggcattcttggacagcgattacgaagatgagcaatttacggagacaatgtcacgctactatggccgtattggacatttgattgggttcaatgtgcctccaagattagaaatagaagagcagatggaggaggcagcagcaatggaagaagcggaagcgagtctcaatgagagtggaatttatgttgtgccaaatgatgaaaacctcgatccttgttga

SEQ ID NO: 83445 - DNA, 713 bp, Heterodera glycines
  Genomic contig location: Contig_ID=SeqID_18766; Location=108..820; Strand=-
  SCN-specific regions: Sequence locations=1-85,107-147,181-218,271 -419,452-713
atggtcaaggtaaaagcctttggcggacgaaaagcctgacaaatctctttaagactgcgataatgacctttcaaagaattcttagggacctaaaaatacataaaaattctttatttgggctgttattaagataaatttttgcgtttgcagggcctatttatttttaaatgtttttgaggatttgcgaaaaaaatgcttacgttaaattatgttttgggtttttattttgttttaaaaacacttaaaaatattttaaaataaatataaatacaaaaacattcctcttaaaattgtcatttttgcaaaaataaaacaaacatctacaagaacttgccttttttttgccccgtccgtacttgttttttgagaggcccatcagcagaagaattttcggaataccggagcaaatgatttttggcaaaatattttaattttaaattttatatttttagtacgatattatacagtagcgaatataattgcttccgcaaagcttatgaattaatcaaattctcaattttttcagatgacggcatccgccagccgaatggcattctcgtcagacgctgcccggcacacaaaggccaccatgtcggcacgcccgggagacccgaacacggctgagcatttgtcgagggtattgaaatttgcaatggtcattatgtcaattttagtgatcgaaaattgcaaaagaaattaaatttctcaataaa

SEQ ID NO: 83446 - DNA, 533 bp, Heterodera glycines
  Genomic contig location: Contig_ID=SeqID_18771; Location=751..1283; Strand=-
  SCN-specific regions: Sequence locations=1-187,209-533
atggccggaaatggaaatgaatcaatgagaaccgaggttgacgaaaattctgttaatttcatgaatttgtttgaaaatctggaattgacggattctgaaaaattggctagtctaagggaaattgagaaaatatttgcggacacctcaccgccgccagctggtccatcgccaattgaaagctcagttttggggtttgtgttcatctcacaccccatactgtgggcactggtacaaccggacattttgggcgaacaaaatgagctattggaccggaaaaatttaagcctagaatcggatcaattggtcttccaaagtactccaagttatgtgacgactattacactggaccctaacaataactggccacatttcacacaaatttcgttgattggaataaacaatctctattaggaactcgggtcaaaacaattgatttgtagcaaatgacttctcctccaaaactgggaccatcagtgagtcaaattgtcccttcgagctgctgtggaataattagggaagtgaaccaaaataaa

SEQ ID NO: 83447 - DNA, 440 bp, Heterodera glycines
  Genomic contig location: Contig_ID=SeqID_18773; Location=48..487; Strand=-
  SCN-specific regions: Sequence locations=1-140,173-288,310-440
atgactggtgatgattttttgaccattctgatcaatttggcctccgtcagttcccccaacacttttgtgagtccgtcgtttgaatttggcaaaatgatggaaaggtgcgcattccctcccacaaattccatccccaacagtttgaactgaattttgtttattttgtataattagttcaatttttatataaattttacattagtttcttccaggtaaacaaatttattagtttggcgcatcatttccaactaaaagtgaatcactcattttaaattgtaaaatatggctttggttttgaaaaaagccaatttttggatgttattaaaatttgaaagttcgtttcttatatttttaatcgtatttttcttatagaatttggataaaattataaaaatattctttaaaacaatttctcgtataattcatgaaagagaaataaa

SEQ ID NO: 83448 - DNA, 321 bp, Heterodera glycines
  Genomic contig location: Contig_ID=SeqID_18773; Location=650..970; Strand=-
  SCN-specific regions: Sequence locations=1-321
atgaacagcgaaccatggcttatgcccgagaaatcggcactgttcggatcgaacgcacttttgagcccaatggcatattcatggaataaagggcaaaaaatttatacaattctgcggtactaattggcactgccggccccataaaaaaccttttcttctcttaaattagcctaaaatccctaatttggtcatttttttagacaaaatctgtgcactttatgccaaaaggaattaaatcaaggcgatacattgactaaagatccgtccccgcgaaaagccacccccgcccacggggctcgaaccctaaaataaacaaataaa

SEQ ID NO: 83449 - DNA, 58 bp, Heterodera glycines
  Genomic contig location: Contig_ID=SeqID_18775; Location=54..111; Strand=-
  SCN-specific regions: Sequence locations=1-58
ggattgctggggtcgtgggttcgagtcccaccgggcgagttaccttttatggtctaca

SEQ ID NO: 83450 - DNA, 995 bp, Heterodera glycines
  Genomic contig location: Contig_ID=SeqID_3154; Location=177..1171; Strand=+
  SCN-specific regions: Sequence locations=1-124,187-207,237-768,829-995
atgcttggcccggcactgttcaacatacattttccgcttttgtcaaacgtggaatttgcgaaggatattggtaaaaaaaagagattaaaaccaagtttaaactctttcaacaacgactgccaactttttaaaataattaatttaaataaattaaaataaaaatttaaaatgatttttcttatatttgcagtgcattcaaaatgaaacatatttttttaaaattttattctatttttcagttccaaccaatgtgttatcaaaagatgaagtgctcgctgtttatcagttcaaatccattccaaattgtcatgggatatccgacggatttttcccaatgcaatttccgacaaatgaacggtttatgaacacgggcacacttttgctggacattgaaaaagtgtcggaatttggacaagagcctgaagatagtagtcggtgcagcaaaaaaatgtacataaatggactgtcatggaaaataagggcagaaattcgaacgaaaatggaatccgatgatagaaaggtcggcatttatcttttgtgcgatgctccaaaagaaggtgcaaattaagggctaattaatattaattaaccaattaatttgcattgagcagaaaattggagttgcaaatgttcggtaaccattcgaattatctcacaaaagtgtggagtggcggatttaagaagagaagtttatgcatattttggaaacaatgaatatgatagctggggatgccgcgattttagatggagatacagatacctcgatttcattgaatttgctgtgggtggcatttaaatgtctttctctaattaaaatattaaaattaagaaactgggttgacccgaaaaatggcttgtacgacatgcgtggggcacaaagtgacattttccattgatgtcaccgtgaaagaagcacaaacgggcaaagaatgcttatattcataatcagtgatcccgaaaacccttcgaaaacatatgtattttcatgtgtttga

SEQ ID NO: 83451 - DNA, 1875 bp, Heterodera glycines
  Genomic contig location: Contig_ID=SeqID_3154; Location=1782..3656; Strand=-
  SCN-specific regions: Sequence locations=1-97,140-547,571-665,712 -804,826-1040,1062-1086,1129-1483,1525-1613,1635-1665,1687-1808,1831 -1875
  Gene Ontology: Mol. function=ubiquitin-specific protease activity; Cellular component=nucleus; Biological process=pathogenesis
atggatttccatggaaaattaaagcagaaattacgaaaggcattgatgagaagaaatatttgggattttacttatggtgcgatgcaaaagaaggtccaattttaattactattttaaaaatataatcattattaaaataggaggaccatggaactgcgttatttcggcaacctatcgaattgtgtcagaaaagaccgaagcggagaattccattgggacattgtgtgaccgggttatcaacagatcaaacatcggccggggatttggatttttcattacttttgctgtgagtaataatttaacatatttacttaattggtataattatggttaatcaaggaattgatggactcgaacaagagcttttacaacaaagcagaggacaaattggcattggccattgatgtcataactgttgatgagccaaaaatggagaaattcatttccgatcccaacaaatccaacggcacactttcaatggaaattgaaaaagtgtcggaatttgcgcgtgaaataattgggagtcaacgtaaaagcgaaactgtgcacatcaaaggattgccatggaaaatatggacacaaataaatccgaaaattggaagcactgacaaaaatgagaaatggttgagcatttatctttggtgcgatgctccaaaagaaggtgcaaaattactaataattaatatatatattaacaacaattaattaattgatattgagcagaaacttggagttgcaaatgttcggcaactcttcgaattgtctctctaaagagcggagtgtcggatttcggaatggaattcgatgaccatgttattgacaataaagagaacagctggggattcccgaatttcatttcatttgctgtgagtgacaattaaacattcccttaattgacccaattatttatgatcaattaaggaattgatggaccccagcaaaggcttttacgaccaaagcgaggacaaagtgacattggccattgatgtcacagtgaaagaagcaaaacggaagacgaaacataaatgcccaatatgatttggggaaaaatgcccattgaatatcctccatcctatgatgaacctgtttttttatttattaatttttcttgattatactttcaaaactgctgatatatgaattaattaattgtcggagctgttttagtagactctcatttttgagtaccgaatttcaatgataaacattttagtcataaacccaattcaaattttaccattttaggtcaatgtttacaattttttggacttggatttattgcattaattttgttaggatttacgtaaacttttttttaaattgaaaccattcctaattgactgatcattttttccttttatttaagcagaattttttgggaccagaaatttgggaaccgggaagtttgggctcattaaattaaaaattgaaaaactattactaatttcgctatgatttcattcttaaataacctaagctgcgcttaaaaatttatatttactacaaaattaaaaattaaaatatggaaaagtgacaattttattatttagtcaattcttacagctgtttaaacgtggtgttgagtgtcaattgtacataactccttaattggcataattattattaattaaggaattgatggaccaaagcaatggtttttataacagagaagaggacagagtgacattggccattgatgtcacagtgaaagatgataaaaaggagaaatgcatttctgatcccgacaaatccaatggaataatttcgatggaaattgaaaaattgtcggaatttgcgagagaaatcgacagaagtgaacgtaaaagcgaatctttcacttacataaatgggcttccatggaaaatattggcataa

SEQ ID NO: 83452 - DNA, 657 bp, Heterodera glycines
  Genomic contig location: Contig_ID=SeqID_3155; Location=439..1095; Strand=-
  SCN-specific regions: Sequence locations=1-6,31-115,137-421,446-657
atggtaatttttgttgtgtttttaaaatttcatcctcttaagcttgtgccagcccataagctcattttgaaacacgcttccgacgtttttgaggcgatgttccgttttgatgccaaaaaggaaaaagcggaattcggtaaaaacattactgaatgacatttacaatttagtctctgcaaattaccctaattaattttcaatagtcctccgctaattgctctaataaattttcaattagccgccgctaattacactaataattttcaattagcctctgctgattgtcccgtggaggtccccgacgttgaagcagcagcattcaaagtgatgttgagcttcatttatacggaagagttgaatgaactgaacggagaaaatgcaatggctgtgctttacgccggtggatttaattttatgtgacaaaaataattaaattatttaattagccaataagtacaatatcccctctctggtcggctcatcttcgcaaattccaatttccgaattgcgcaatgttttcttcgcttttgctcaggcccgtcttctcgacttgaaagtgggtaggaaaaattgaaaaatgcgaaagaattaaaaatttgctaatttttaactattttgtcggtttacattttccagttaactaaaatacataataaa

SEQ ID NO: 83453 - DNA, 847 bp, Heterodera glycines
  Genomic contig location: Contig_ID=SeqID_3155; Location=2025..2871; Strand=+
  SCN-specific regions: Sequence locations=1-182,205-226,259-312,337 -441,463-490,517-541,591-595,617-655,677-751,833-847
atgaaaatatgcctaattaaaaacaaaagttgtgagaaaaagcaagggttattctgttccaatttatccattgatctgtcaaattttttacaaaatcagaacatcaaattcaaaaaatcgcattttgaggtcaaaaaatatgcaaaattgcttcaaatgattaacttacaattttttcgttcaaaaataataaattatttttatctttcgtctctcatctctagggttataaattaatatgatttttaatatatttttctttgcgcatatgctattaaaaagcggctcagaaatagcatttctacgttaacattttttggttgttttggtgtttattctcctgatgagataacacaaaaaattattaaaaaaacaaagattcatttttagagaaagggaaaacattaaaatagtgtatgccagagatattttctgcttttccaaaaaatccaaccaaaaagggggaccaaaactaatttgtaagacaacattagtaccaaaaatatatatattctaaatttagtgtaaataaaggcaaaactttttttctaattattttgttgaaattataattttaaattaaaaaaataggaatgaaataaaagacaaaattgaaccttttttatagagggaagagagcgcaaacaaattatggaaaataaagttaaacgaattaatctatcttatttcttgtaaatatgaatgggattaggtatgtactaaatgattcatgaattttataagaccaaacttataaaattaatttaaaaaattaaaataaaatgattaattttagtgcaaaactttaataaattaaatttattaatataatccctataagcttcaa

SEQ ID NO: 83454 - DNA, 697 bp, Heterodera glycines
  Genomic contig location: Contig_ID=SeqID_3156; Location=449..1145; Strand=+
  SCN-specific regions: Sequence locations=1-183,206-227,260-352,374 -443,465-562,671-697
atgaaaatatgcctaattaaaaacaaaagttgtgagaaaaagcaagggttattctgttccaatttatccattgatctggtcaaattttttacaaaatcagaacatcaaattcaaaaaatcgcattttgaggtcaaaaaatatgcaaaattgcttcaaatgattaacttacaattttttcgttcaaaaataataaattatttttatctttcgtctctcatctctagcgttataaattaatatgatttttaatatatttttctttgcgcatatgctattaaaaagcggctcagaaatagcatttctacgttaaaatttttttggttgttttggtgtttattctcctgatgagataacacaaaaaattattaaaacaacaaagattcatttttagagaaagggaaaacattaaaatagtgtatgccagagatattttctgcttttccaaaaaatccaaccaaaaaggggaccaaaactaatttgtaagacaacattagtaccaaaaatatacatattctaaatttagtgtaaataaaggcacaactttttttctagttattttgttcaaattataattttaaattaaaaaaattaagaccaaacttataaaattaatttaaaaaattaaaataaaatgattaatttcagtgcaaaactttaataaattaaatttattaatataatccctataagcttcaa

SEQ ID NO: 83455 - DNA, 684 bp, Heterodera glycines
  Genomic contig location: Contig_ID=SeqID_18777; Location=4..687; Strand=-
  SCN-specific regions: Sequence locations=1-245,267-557,579-662
atgccttttccctctcttttggctttctgttttgcgtcgtttgtcgtcgtttttgccaaagtcgcgaaccccaacaacagcagcaacttttcattgaatgaagcagcagaagcattcggggtgcaaagcagcaaaaatgcgccgactcgcaaatcgttcatggacattttgcacagtgaggtgatcaaaaacggaaaacatggagagcaacagcagcagaagcaagaattggaggagatgctaagtgatgtgagtgaatatgaaaaggtgatcgaaacagcattgggggacaactcggcacaggtaatcgctccgaatagacggtattatattgacaagattttatccctattttatctatgcgaatgataaattattatcaatgttaaaagggtaattagtggtaagcctttaactctaaaatgattgagtgaaatttgtctttgaaagttaaaaatttcgggtttttgaacttcgagttttgcgtgaacaactgaaattcttggaaaatacaccccctaaagatttacagcccggccatgagccaggaatacgaagcaataaaagcactaaatgagaatgacaagccgatggccaatttactacacaaattgtacaacgaaatcacagaactaaagaattctattgacaaaggtaattagttaaaaaaattaaaataataaa

SEQ ID NO: 83456 - DNA, 1779 bp, Heterodera glycines
  Genomic contig location: Contig_ID=SeqID_18781; Location=543..2321; Strand=-
  SCN-specific regions: Sequence locations=1-264,286-603,625-898,935 -1069,1178-1779
  Gene Ontology: Mol. function=microtubule binding; Cellular component =microtubule associated complex; Biological process=protein biosynthesis
atgaagaagcaaaaggctaagcccgaagaaaagcctgaggcacctgccgaaggcgtagccgtagtgccggaagcgaagaaggcggaagagacaaaggaaaagctgaagcaggaagagaaaccaatggaagtgccaccatctccagcagaaaagaagagaaaagaggctgaggagaagaaggatcagaagtgtgccgaggctaaagccaagaaagacgcagaagagaaggctaaaaaggatgccgaggctaaagccaagaaagacgcagaagagaaggctcagaaggatgccgaggctaaagccaagaaagacgcagaagagaaggctaaaaaggatgccgaggctaaagccaagaaagacgcagaagcaaagaaaaaggaggaagaaatgaagaagcaaaaggctaagcccgaagaaaagcctgaggcacctgccgaaggcgtggccgtagtgccggaagcgaagaaggcggaagagacaaaggaaaggctgaagcaggaagagaaaccagtggaagtgccaccatctccagcagaaaagaagagaaaagaggctgaggagaagaaggctcagaaggatgccgaggctaaagccaagaaagacgcagaagagaaggctcagaaggatgccgaggctaaagccaagaaagacgcagaagagaaggctaaaaaggatgccgaggctaaagccaagaaagacgcagaagagaaggctaaaaaggatgccgaggctaaagccaagaaagacgcagaagcaaagcctaaaaaggatgccgaggctcaagccaagaaagtcgcagaagataaggctaaaaaggatgccgagactaaagccaagaaagacgcagaagagaagtctaaaaaggatgccgaggttaaagccatgaaagacgcagaagcaaagaaaaatgaggaagaaatgaagaagcaaaaggctaagcccgaagaaaagcctgaggcacctgccgaaggcgtagccgtagtgccggaagcgaagaaggcggaagagacaaaggaaaggctgaagcaggaagagaaaccagtggaagtgccaccatctccagcagaaaagaagagaaaagaggctgaggagaagaaggctcagaaggatgccgaggctaaagccaagaaagacgcagaagcaaagaaaaaggaggaagaaatgaagaagcagaaggctaagcccgaagaaaagcctgaggcacctgccgaaggcgtagccgtagtgccggaagcgaagaaggcggaagagacaaaggaaaggctgaagcaggaagagaaactggatgccgaggctaaagccaagaaagacgcagaagagaaggctaaaaaggatgccgaggttaaagccaagaaagacgcagaagcaaagaaaaaggaggaagaaatgaagaagcaaaaggctaagcccgaagaaaagcctgaggcacctgccgaaggcgtagccgtagtgccggaagcgaagaaggcggaagagacaaaggaaaggctgaagcaggaagagaaaccagtggaagtaccaccatctccagcagaaaagaagagaaaagaggctgaggagaagaaggctcagaaggatgccgaggctaaagccaagaaagacgcagaagagaaggctaaaaaggatgccgaggctaaagccaagaaaaaggatgccgaggctaaagccaagaaagacgcagaagagaaggctaaaacggatgccgaggctaaagccaagaaagacgcagaagagaaggctaaaacggatgccgaggttaaagagatgccgaggatctag

SEQ ID NO: 83457 - DNA, 479 bp, Heterodera glycines
  Genomic contig location: Contig_ID=SeqID_18782; Location=435..913; Strand=+
  SCN-specific regions: Sequence locations=1-3,35-95,118-237,259 -262,303-336,358-479
atgaaaaatgaatttaaacaaaaaagaaaatattcatccaaagaatgggaacaaaattatgtcgaaatttgcaaaaaaattggagttagtgatttcactattatgaaatggaagaaacaatttggcatttgctgtaaaataacggaggatgaaaaaatggaaaaaatgaaaatttattgggaaataaaaagagaaaatccaaaaatgagtgacaatcaaattgctaaaacattgagaattagtctaaatagcatttataattggaagaaacaatttggagaagaaatggcagaagaagaagagtgatttagtgatttgttaggttttttatgataaatttgatttactgtttaatgcaattttcgcagttttctcgtttcatttgaaagatcataaaatgtaattcttttactaatacaatattttttcatcacccgagaactaattgcaattaagtatctttatttttaaatgtttaa

SEQ ID NO: 83458 - DNA, 621 bp, Heterodera glycines
  Genomic contig location: Contig_ID=SeqID_18782; Location=1344..1964; Strand=-
  SCN-specific regions: Sequence locations=1-37,60-331,361-407,454-621
atgattgaactgttgatcagcggtagcacgagcggttcagcagcaacaacagcagcgactggcaacaacaagtccaagcagtacaccaacagcagttggacgatgattaagccggatgaaaaaaggtaggaaaagtgcataaggacaatgtttagcgtttttatacttgaatggcaagcaaagtccttgaaaagtttggcgttaattaaaataaggtttgatcttttcaacaacaaaaaacggacttgatctgggtttaacatttgacatgcgtacagaatttctgatgaaaaaaatccaggaaattcaacaccaagctaatctcgagtagtttcttcaaataaaaatgtaattttattaaaattccaaaaaaaaactcgaaaaatcggcttattgatttcgaaatcttttaaattttctaatgaattaatttaataaaaatatttaaattttcaggattgaccgtcgcgcctctgatcggtcgtcgactcgtccgaacggttgttgcctcgcaacaacaccaattggttatgacgtgtttctgagttgctcaagctcttcagaattggactggatcacacagaaagcagtgcctgagctacagtatgcataaataataaa

SEQ ID NO: 83459 - DNA, 738 bp, Heterodera glycines
  Genomic contig location: Contig_ID=SeqID_18783; Location=62..799; Strand=-
  SCN-specific regions: Sequence locations=1-245,276-305,384-413,480-738
gtaatttgcttgaggcaattctgcaacggcactctgtccttatgctaacatcaattagccaagcattggactttgtggacgcgaaaatcattggcggcaagcgatggttgcacgcgttgctcacgcccgcgcagcgggtgccgttcattaagttacagacgcaacgatgcgcgatgcgttgcagtgagcggtggcattccgttgcgcgtctgtgccgcttacgcttgttaacgcatttgaaaaggtaattaattaattcatttaaaattaattaactatgcatttaaaaagattaatagtgagcgattaattaaatattattaaattacagtcattataatatggcatttaaattttaatagtgaattttaattaattataatggacacttaaagactcattagtccctaatcattaaaatattttaaagattttttcaataaaatttatttaaatgaattcaataattaaattataatcacttttaacagattcgcacttttgctgatgtttgaagcattaattgtgatgagttttggttttttactgtcgacaaatacgcttcctctggctgttcctatgtgggcaattgtgctaccacttttggcgctcaactatttgttacttcttggcctgatcatctactgtagatttaaggtatactgtatcatattgttggaatattgtaccggtacaggaaataccgtaatttcatagtacgcagaattgtaaattaaa

SEQ ID NO: 83460 - DNA, 481 bp, Heterodera glycines
  Genomic contig location: Contig_ID=SeqID_18784; Location=1167..1647; Strand=+
  SCN-specific regions: Sequence locations=1-103,147-264,288-302,396-481
atggtaataataatttaatggagtcttcgaattgatctctcaaaatttcggagcatttttagggggctctaagctagaaaccttctgacatgacatgaatagcttttatttaaaaaattattgattttctcatttaaatttttttaggtttttggtaaaaatcctaatccagttcacgcacgatccgggccaaagctttgggacccggatcaggagccctgaaaaacaggatttttcatcctgaaatccggtcctggtcaaattgtttattaaatttgtatacaatattagtctattcaaagtaataataataattattattattttttagttttttttttgaaattttgattttttattacaaaaatttaacttaaaagttcaaaattatatttctgttcttcactaaaggcgactacaacatgtattctcggctggacggatgttggattgaggaaatcgctggcattaaatgcggaaa

SEQ ID NO: 83461 - DNA, 515 bp, Heterodera glycines
  Genomic contig location: Contig_ID=SeqID_18787; Location=9..523; Strand=+
  SCN-specific regions: Sequence locations=1-140,165-373,396-515
atgagcagcagtcgaacgaattggcaactgctaatggtcgaagaggaggaggtcattaataaactaattagacgaataattaattaaatgctaaaaagtaacgaccaattttcagcaggaaatcgcacaaacattcacattgatcagcaacaatatgatgagaacagttacttgagcgtgaacagaacgcagaatatttttggatggagtgacgaggagggacgacgagcattgggtgaacagttggggaaaggcacccgcccacgggggggggggggaggggatggcacagaattccgagttgcgacttccgacatttttggggtcggaattccgacttccgaaaaattttagggcggcatcggaattccgacttccgaaaatttttggtgtctcggaattccatcacctattcattaacgtttttgtcttccctaaaaaccaatttgccgaagtgccaatatttggattttaaattttatgaattttgataattagccgcgtttttaaattta

SEQ ID NO: 83462 - DNA, 192 bp, Heterodera glycines
  Genomic contig location: Contig_ID=SeqID_18787; Location=3344..3535; Strand=+
  SCN-specific regions: Sequence locations=1-192
catcattaaagatactaacaaataagcttggatttatctgcaaatcattaggaaattaaaaatgcaattctttgttggctccaagctcccattggcctttctgctgctgcttttggcatgttttaagtgctagttttgaactgtttattttttaagttgtcttttgtgttttccaatgccaaaaaccaaaag

SEQ ID NO: 83463 - DNA, 397 bp, Heterodera glycines
  Genomic contig location: Contig_ID=SeqID_18787; Location=1506..1902; Strand=+
  SCN-specific regions: Sequence locations=1-300,322-362,394-397
atggctaaagctgaaaagcgagcgaagccgactcagagaggaaaatttgcgactgcgaaatgcgttggcattcgcaaaggcacgcgccgtccgttttctttttttcaacattttgtcgtttttaggttgaacttatcggccaaaaaaattacgagaattcttccggcgaatcggccaaaaatattcataaaaatggaaaattaatttctttttcagcaaaaattgacaatttgcaaaaaaatgcgaaaataattcaaaaagaaaacgaagaatttggaaggagaaggacaatttgaccattggtggaatgccaaaatgacaaccaacaacatcaaaatcgaaatgttctttatcttttgcgctttaaaaatttgaagaaaaaagtaagaaaaacgaa

SEQ ID NO: 83464 - DNA, 1470 bp, Heterodera glycines
  Genomic contig location: Contig_ID=SeqID_18788; Location=467..1936; Strand=-
  SCN-specific regions: Sequence locations=1-77,100-231,253-366,388 -502,524-755,778-1090,1133-1298,1320-1430,1453-1470
  Gene Ontology: Mol. function=RNA polymerase III transcription factor activity; Cellular component=transcription factor TFIIIB complex; Biological process=transcription initiation from Pol II promoter
atgcaaaaactgataatcgtaaatataattgctttcgctaatctcggtaccggaattaaactaaactctctgacgatcaccgaatgcgaatttaagtataaccctagaaaattcaatgccgcggttatcaaatgtacaactcctatcaaagccccggcattattatgggaatccggaaaaatgatatgtctggggacgaaaagtctgatagactgcgaaaatgctattaaaaaatttatagaaataattaagggctcggggtgtccgggggcttcttacaccggacacacggttgaaaatattgtttcgacctttaaattcggacatgaaattgaactgaacgagtttcgaaaaaatcgtcgtgccttttatgaacccgaaatattttgcggtttaaatttcaagcggggtaaaagcatgacagcgctaattttctggaccggtaaagtcgtaattacgggaacaaaaaacaattctggaattgatgaaatgtatcattatattcttccctatctgaaaatggctcaaaagaagttagggagacgataaaaaatttttcatttattgggacggtcccccaatttatagttctgttgggtatttattttgttatcgattacttcgcgcgcgccagcatcgcggcgcaccggcggggcggagaggaaatgcatggttttggcaaattttcaaaattcagaaaattcatcataaaaaaatcaggattgagaaaataatacagccccaaaaggtttgggatttaaatttgcaaaagaaaaaattgaatttcttacacctgtcacttttggtgacaggtggatgattgatgaccttcccgcggcgctgcgcggcgcgggtgaaaaaaacacccgcaacaatttggggaaattttaaatccacaaggcggcagagttcaaagaaaatcccataggctcaggatgtgagcgggcggcaacttcaaagggctgcacccctcccataggttttggctcttggcggcatcttcaaaaggttccacccctcacataggcacgggtttgtgcggtaaacacccgcaaccaacccgcaacctttaggggtcatatactactgatatttacatcgatttttatttaatttattgaaaacctattttgatttttttcgccctaaaagccgccgcttaatgattaggcaatactaaggcttgttatcgcatatggtcccaatgaaaaccaaaatgacaagatttgatcaatcatatagaattgcatgaaagacttcgaaggaattaataatgaatatcaatcgattcttactcgaaatcacataaatttattttaatgagagcgcaaatgtcttttttcgctttacggcgcaaatggcacggcgcaaatgttcgcggcgcaaaagtcggctaaccgactccaatccataaatttttgctttgtaattttaatctaaaggtcattatttcgttgttgaaacaataaa

SEQ ID NO: 83465 - DNA, 804 bp, Heterodera glycines
  Genomic contig location: Contig_ID=SeqID_18789; Location=188..991; Strand=+
  SCN-specific regions: Sequence locations=1-3,25-502,524-726,749-804
atgaaatttgcaaagaaaatgttaatgattcccgaggcggaatatttggctctacggagtgcgatgaatagtggtgattatctccaaaatgaaaaagcgagtttagacgcaaaaatttctcagaatttacaagaacccggcataagcgaggacctcaaggcgaagagacacgattggctctataaagaaaggcgtacggtaaaggggatacttgaaaatagaccacagaaggtagtgattgagaatcatgtacccggtccgaatgttgcaccatatctaggcctcaacactcaatccaaaccacaggagaccgatgaaccccggaaaataattattcctaggaaaagacttgaagagcaaactcctgatcctgaatcagataatgatacaataaatgagttaactccggagccccaaacaacatccacattaaaaacacccattccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatttggggacgtggaaggaaaaaggcaataaaatctataaaaacacccggcatagtgcgagagaagaaacccttcaaaccactaatatgggcaagactgtag

SEQ ID NO: 83466 - DNA, 1257 bp, Heterodera glycines
  Genomic contig location: Contig_ID=SeqID_3157; Location=140..1396; Strand=+
  SCN-specific regions: Sequence locations=1-1257
atgtcacccgtactactgccagccaagctcattcttcaagaagtgcaaaacttaaacccaaaatgggacgacgaattgccagcaaacatcaacaaggactggctcaaattgatggcacagtggctcgacagaggcgaagcaatcacaatcgaatttccacggcacatccaagccatcgattcagtggaattccactgcttctgcgacgccagcaaatacggcatgggaattgccgtgtaccaaaaggccaaaacaataatcagaaaggatgaatgcaacctcatctacgcaaaaagccttgtcaaaccaatcaaagtggcagcgcacgacggtacaatcccaaagttggaactttaagcactgactctcggagtaaaagcagtcaaattcatccaagctcaaatcaaattcgccgatcatcaagtcatcatgtggacagacagtcaatgctcagtcgaacgacttcgagaaaacaagcgccaagatcgatttgtggcaaatcgattacaaaaaatccgagaagcgaattttcaagtccgacacgtcagaaccgactcaaacccggcggatatggcatccagaggcgcagatccccaatgccttcgaacatcactgctttggcgctttggcccgatttggctttcaaaagcagacaaatggccagaatccaacgtcatctaccgaccccgagatgaattcaaagaagtggaaaagccaccaatcgttgatattccagagcaaccaattcaagcagtgcacagcttcatcgcatcagtcatggacgactcagtttctcttgccggcagcaacgacgaaagccaacaaccacgcccaaagaagttcaaaattccgaaacgacgttcggcactgttacgacccatcggccagcagcaaagtccattgcaaggacaacacaaacgccgcaagcaactacaagactcaggcttacgcaagttatttcaagccatctcggaccaacaaggaagcagcaaggccaccacaaaggccatcgaggaaagccgagaaatgcagaaggcaccacgtcatgaacagatcgagcatgaacaacgaatggtgaagaaaagtcaacaagaagcaaatcgacatcttcaaccagaaaagcggcagcaaaaaattcaagaagtgccacattcaacaacagaagagcaacaacgagaaaccaaacgccaacaaatcgaaagacaacaaaacgacgaacaacatgccatcaatcaacaaacacgcagtaaggcttga

SEQ ID NO: 83467 - DNA, 487 bp, Heterodera glycines
  Genomic contig location: Contig_ID=SeqID_3157; Location=1..487; Strand=-
  SCN-specific regions: Sequence locations=1-487
caactttgggattgtaccgtcgtgcgctgccactttgattggtttgacaaggctttttgcgtagatgaggttgcattcatcctttctgattattgttttggccttttggtacacggcaattcccatgccgtatttgctggcgtcgcagaagcagtggaattccactgaatcgatggcttggatgtgccgtggaaattcgattgtgattgcttcgcctctgtcgagccactgtgccatcaatttgagccagtccttgttgatgtttgctggcaattcgtcgtcccattttgggtttaagttttgcacttcttgaagaatgagcttggctggcagtagtacgggtgacatgagtccgagcgggtcatagactttggcaatttgcgacagaattgtccgttttgtgatttttccttcgaagattggcaatttgaagatgagccgattgtgttttggtttccatcgaatgccgagcactttgttgtcttcg

SEQ ID NO: 83468 - DNA, 576 bp, Heterodera glycines
  Genomic contig location: Contig_ID=SeqID_3158; Location=1222..1797; Strand=-
  SCN-specific regions: Sequence locations=1-109,131-576
gtgagtgcgggtggtggtcggcagaatggtgagttttccgggcccttcagttcccagagtgtgctgccgtggttggaacaccaaaaaacatcgcgtccttcttcggtggtgattgggcttttgggccagcggatcaacttgattcctgggcgtggctgttgttgtggacgtgatctgtacactgtagttgttcggtagtccatgatccgtgacattggtgtcgtcgtggttgtccaggcattgggccgtgtggttgttttggttgaccaaattgttgagcgtgttttggttatggtcgccgttgttggatttgtagtcgttgtccacggtggatttgttggtgccggtggagtcgtttgcggcggatttgttggtgctggaggagtcgttgtttggctcagactccgattaagtgcgaggactttgtcaatgtatcgctggacgtatggactgtgttttgttgccgtcctcttgtcacgttccgtgaataggttgaggaagttggaaatgtagccgccgtgccatgttttgacttccgcaaatttcttttgtcgaattggttgtccttgtgccgaa

SEQ ID NO: 83469 - DNA, 2418 bp, Heterodera glycines
  Genomic contig location: Contig_ID=SeqID_3158; Location=1187..3604; Strand=+
  SCN-specific regions: Sequence locations=1-481,503-2418
atgctgatcagcctcctttgccttctattcaccagttcggcacaaggacaaccaattcgacaaaagaaatttgcggaagtcaaaacatggcacggcggctacatttccaacttcctcaacctattcacggaacgtgacaagaggacggcaacaaaacacagtccatacgtccagcgatacattgacaaagtcctcgcacttaatcggagtctgagccaaacaacgactcctccagcaccaacaaatccgccgcaaacgactccaccggcaccaacaaatccaccgtggacaacgactacaaatccaacaacggcgaccataaccaaaacacgctcaacaatttggtcaaccaaaacaaccacacggcccaatgcctggacaaccacgacgacaccaatgtcacggatcatggactaccgaacaactacagtgtacagatcacgtccacaacaacagccacgcccaggaatcaagttgatccgctggcccaaaagcccaatcaccaccgaagaaggacgcgatgttttttggtgttccaaccacggcagcacactctgggaactgaagggcccggaaaactcaccattctgccgaccaccacccgcactcaccgcgcaatggacaccactgacaatcacgctgtacaccaagatccatcgaccggaaccaatcgcaacggcatggcactgcttcatcaaaacgacgacggaaaattattacacaaacatcgtcggcgataagttcgtcgaaatcaacaaagaatttccgttggtctccaaacgactctgccaacgaatggcacatcaacaagaatgcccactcgccaaaacggaaatgcaccacgtcggcaaccacatttgggcaacaaacgaccaacttcaagtggatttccctggaccaatcactggactcttcaaagggaagcaaaccagctcagtaacaaattgttttgcgcaaccagcaacactgttcgtcaaatggcacagtctccaactactgtcgccaatccatcgcgcagaccactgcaattacgcttccgagtattgccagctgcaagacaatagttcactcatctggacttcagcatgtccaaacgacaattgtttcatgtgcgatttccaagaagccgaagaaatccacggagaattcaccaagctcaacggtcaaacaacagcattttggatctcggatgatcgacaaaaggcactgaccttcaccgagacacatgccgtgcaagcatgcgacgggagacaaatcgtcttatcagagcagaacttcggcattccaaaagagcaattcgacatcatcatgagtgaccacacaagagcgaaacgcaacgtacaacccgaacaactcgcttcacagctttccgctgctcaacttgccacaacaatggcactctcacagctttacttaaaggaatgccagcgcaacgtgagcgtcagcaacccaacgcttcaggcacgaaaactcctcaagcgcgaaaatctgcaagcccgatggatcagcgaaacaacaatcgaagtgtttccctgcgttccaatctccctatccaacatcagctaccgaaaaacaaaggactgctacaagttcatccctgtcacaatccatctgccaaacacaacacaagacgcattcctcgacccggagatgcgcatcctctcactcatctcaaggagcgcaagttgctctcaatttcgctaccatcatctgcaagtgcaacaaaaacccaacttgtgggtgcgaatcgactcaaaaaatggaaacgtccaacgattggcacaaactgccatccatgagctctacgagacaatcctcaacaaaacggacaacgacttggatctccacccactgatcttccatcagtggcaactcgacaacgacaccgacttcgctacctttccacacatcgacgaattcgaggattcggaagagttcaaaaataagctggaacaacacacgacccaacgagccgaagcactcggagctttacccggcggaatcgaaggatggaccgtcagatggctccaagaacggctacaggaaataatccaatggtggatacgtctcgcctcggcatattccacattcctactttgccgtgacgtcatcctaccttgcctaatcgcttacttcctgaaccccattcgcatcacactcatgaccctgattggatttcgaccaaagaaacaaccaacgcctcaaatccaagcacaacacgaggacatgccattgaaggaaatgccaagcacaccaatccggcgtaaacgacgtcaattgcccgagcaatcgactccaccaatacgactggacacgacgacagcaacggcctcattccgaacaagagcaagagcacacagcgcaacggaagacacgcccttcggacgcttgcgaccgatgaaattggcggacgactga

SEQ ID NO: 83470 - DNA, 1703 bp, Heterodera glycines
  Genomic contig location: Contig_ID=SeqID_3158; Location=4423..6125; Strand=+
  SCN-specific regions: Sequence locations=1-25,48-1449,1490-1599,1621 -1703
atggcgaatgggaaaacagcgcagcggatacgggaggacgatgcgcgacggatggccttcatcacatctcaggcgcaacaagtgctcgtattttgggagtgtgaaatcaacgcggagaagcgcgacaacgacgaaatgaagcgcgcctttgcccagtacaaggacagcggccctatccgtttgaaggactgctaccatggaggacgtgtgggtccacaacgactacactacgaggtgccggaggggtggcggatgaaatattacgacgttcgttcgctctacccccacacgaatgctgtgacagcataccccgtgggtcacccaacacgagtgaacatcattggtgaggcagagcaggcggttgactggcgacgcgccgaccagttgccggtccgaggcattctcaaagtgttcgttgtgccgccccatcacgttgatgtgcctgttctgccagtgaaatttaatcagcggcttcttttcccactgtgtcgcatgtgtgctttgcaacatccgcatggagccgtcaatgaagactacgagtgcacacatcgcgaggatgatgagcgggggtgggtgtccactgtgacgtcaatcgagttggaagaggcgcttcgcaacggttaccggtgtacggcctactatcgctccgtggaatgggacgatacgcggtggagcgaccgcgtttttcgaggctacgttgcagaattcatggccatgaaaacgcatgccagcggcttcccggacgaaattggcacaaccgaggaagatcagcagcaattcatagaggaatgtgaggaaaaattcggaatccgaatcgagcgggaaaagatggtgcacaacaaggccaagcggaccatcgcaaaactgtgcaacaactccctgtgggggcgcttctctttgcgcaatgggttgtccaaaacgattgtgaccgactcgcccgcggaactgcgcgctctgcttgacaacccagcggtggaggtcagctccgttgacccgctcaccgacgaatgcgtactggtcacctatgcggccggaaacgaatgggtggaggaacacgaatgctcaaacattgtgctctctctttggacaacatcggtggcacgcctccacttgttgcggctaatgcagaaggttgcgtgcgcaccaaactcggtgctcatctacaccgatacggacagtgtgtgtttcgcccatcgtgaggcggacgggtgccctctggagacgggacctcacctaggcgacctttcggatgaatggccggaccacgagctcgtggaatttgtttccggtggatgcaaacagtacgctctgcggatgcggcaccgtcatagcggggaggagaaaacggtgctcaaagtacggggcataacactgagcgccgatgcctgtcagcttctccactttgccacatcaagaggagtgtcctacgctacgcaatgtgtcattcaaatgaggatgatgatgatgatgatgatgatgatgatgacgaagacatttgttcaattttgattgagtaccccaatttcctaaggcccaacattaaggacgggacggttatttatgttaagctgtcaaaacgctatcgccctattgtaactaagggggttgtgggaatgaatgcaattgtacatgattttggttttataaagacgtaatttatacggactgcactttttaaaaatgcataattaacaaatggaaga

SEQ ID NO: 83471 - DNA, 1003 bp, Heterodera glycines
  Genomic contig location: Contig_ID=SeqID_18791; Location=181..1183; Strand=+
  SCN-specific regions: Sequence locations=1-50,72-593,622-686,708 -906,930-1003
  Gene Ontology: Cellular component=secretory vesicle
attagcgacaaagcatcgcccggctcatctccgtcccgacatcaaacgccctcctcgccgacgccaccacctacggctgaaaccactcaaaaagctatagctggttcttccgcatccacttctcccgctgcgccgtccgctgttgatacaacaacggttactgctgctcgacccgcggcgcgtcgacgcggctttggcggcttcgccgccggctcgacagtgccaccgccgaccattgtccaggcgttgccggccccgccggcaaccaccgacccaactccccacgcgacaacgacggcgcctgctgctgtctttgccgctgcttcaaacgctgttcaacaaaatgtgttaacaccgccgggcatttttcaaccactgccaccgccgtccttggcaccttcgctcgtcatgccgaaattacaccagcaaacatcagcatcaatggcacagcaaagcccgggcaatacggtggcattgcctttacccgcttcagcaccggcagcggacacaacagcaacagtggcatcaccgaccacagcaattacgtcgatggcaccagcggaagtaccagagaaaccagtgattgcaccacaaccaccgaagaaggccaagaaggaaaagcgcaacattttggacagaattggggacaaggcacacattggcacgttcgatgcaagcaaaccggccactttcgccccattggacccacatgtggcgccgcgagacccaaatgcggtcgattccgatggtttgtactggcaatttagttggcccattatttgttgctctttcattcagatgagcaaggcgatacgctggccattggcgggcccgattcttggtatgcgttggcacttcgtgataccggcacggtgctgaagaaggacaccggtggcactggcaaaggcaaaaagcagggcaaagagagggacccgaacgcaccgaagcggcgccggacaaagaagccgaaactgtcctcgggacccaaggcaagggataaagc

SEQ ID NO: 83472 - DNA, 2043 bp, Heterodera glycines
  misc_feature (1642)..(1642): n is a, c, g, or t
  Genomic contig location: Contig_ID=SeqID_18792; Location=655..2697; Strand=+
  SCN-specific regions: Sequence locations=1-167,192-203,226-442,483 -491,514-535,610-643,665-667,689-722,744-1310,1332-1796,1818 -1827,1850-1909,1931-1987,2031-2043
atgcgacggtgtgccgttaacaactgtttgatgggcattgccatctgtgacatatgcacaatgtccacctatttggtgtacattttgtacttcgaagtttatgcaaaagtatacgaaacgaatattaggtaaattcggaggggagggggataaattccgatgaattaaaattaaattttggaaatgaatcccgccccaattcgttcagccatttctgggccacttacctgcatttccatgccaccgtgtccatttgtctgcacacaatcactttgtacacgtgcgttacaatggcactcattcgttggcgcgtgatgagccaaccgtactcaatgattgttcagccggcaatggcctggtaacaataaaattgttagactctgaaaattaatttttttgaaatttccatttaattaatagtgcacggattaatgaattttcctatttattatttgttttattttaaaataattctattaatactgattgctaaatttttggaggaaaaatgttaaaatagaagagaaaaaaaagtgcgaccctggcagggatcgaacctgcaatcttcagctccgtaggctgacgcgttatccattgcgccacagggccgatgtcctagaatagaaatttgtcttatttcaatataatttttctttcaaaaattactacagaaaataacaaaaataaatcctaaaccgacatttaggaaaatctttgtgctcgtcactgtgctggtcgctctgttctgtgtgcccacttacctcgtccacgaagtggtcgaattccgttactctgacggcacagtttttttcaccgtggacatttcggaatgggcgcggacggaccgttgccactatttgaagacgaatttgtttattattggcattgtgcttaaggtgagaaaggcccaatggaaaattgaaaattcgctaccccaggcgattccctgctttttgcttctttggttcaccacggcactgatgttcaaactgagggaaaacaatgcaaaaagggcacttctgttgagggacaaaagcaaaaagatgcgaaactatgacagaacgacattcactctcattgtgatgctgggcgttttcttggtaatttgggatgaatttcaagaaaaaaacaaatcacatttggtaataatttagatgacggaattgccgcagggcattctgacaattctgaatggcattttcaccaacgatgtccattccgtgttttacatgaatttagccaatttgctggacattctttcgctgatcaattgctacgtgggctttatggcctattgttttttgtgctcaaaatacagacaaacatttgttatgatgatcctaacaacgtaaaatttaagttggcgtacatttttggtattctgtccattcagtttggactcctaccgaaaattgggttgctctgaaaagtgccggcagcaaaggcatcggcaacactcacagcacggcacccgaaataggcataacggactgctggggcgggcggggaacggcacggcccattccgcatcaaaagtgccgatcttcgaaccgacaacgattggatcggctcaaagcagcagcatacaatcaatagaagatccatcagcaggccaaattgggggtaaggaaatggcgggggnggggggggacaccgtcccggccaactcaattaaaacgcataaatttaattgttggcctatccataaaactaatgccgttttcttggttcaaatttataacttttaagggttgataagtcgtaacggccgaaataaaaatatcctcctaaattcgaatttaaaaattttttataatcatttaagaaagagaaaagaaaatggaattggtagtgacgatggatgggcgactaccggacgaacaaattggccaaatgacggacacccatctgtaaaagtcaaaaaacaccaagggaaagaaacgtactactgtaaaaactgaaccatccattaaaatatatatgggacaattattttaattatttatcatttaaaagatttattatttattcgtttattcgaaa

SEQ ID NO: 83473 - DNA, 229 bp, Heterodera glycines
  misc_feature (229)..(229): n is a, c, g, or t
  Genomic contig location: Contig_ID=SeqID_18793; Location=13..241; Strand=-
  SCN-specific regions: Sequence locations=1-229
atgcctaaactcagcagcttcggcctttgctgcctttccaataaaaatgaaacggacaatgtgaaatttttgacgcacggaggggacaaatcgtgcggcggcgaggacatttataaattatcaataaaaacagaattttttggcatttcgaaaacggacagcggatttagtggaatggaaaatgaagagaaaaagcagcaacaaaatgaaaaacaaatggaacatccan

SEQ ID NO: 83474 - DNA, 2776 bp, Heterodera glycines; identical to SEQ ID NO: 18796
  Genomic contig location: Contig_ID=SeqID_18796; Location=1..2776; Strand=+
  SCN-specific regions: Sequence locations=1-467,489-844,866-884,906 -1048,1073-2522,2546-2568,2590-2696,2718-2722,2745-2776

SEQ ID NO: 83475 - DNA, 742 bp, Heterodera glycines
  Genomic contig location: Contig_ID=SeqID_18797; Location=64..805; Strand=-
  SCN-specific regions: Sequence locations=1-220,242-484,506-742
taatcagggcttatttgtggaattatgcaattcaatccgtgatactgtaatccccgagataccggacactccaacgcctgatcaatggaattataatgggaatttggcaaatacaactgatcgttgttacagtaatcagggcttatttgtggaattatgcaattcaatccgtgatactgtaatccccgagataccggacactccaacacctgataaatggaattatgatgggaatttggcaaatacaactgatcgttgttacagtaatcagggcttatttgtggaattatgcaattcaatccgtgatactgtaatccccgagataccggacactccaacgcctaatcaatggaattataatgggaatttggcaaatacaactgatcgttgttacagtaatcagggcttatttgtggaattatgcaattcaatccgtgatactgtaatccccgagataccggacactccaacacctgataaatggaattatgatgggaatttggcaaatacaactgatcgttgttacagtaatcagggcttatttgtggaattatgcaattcaatccgtgatactgtaatccccgagataccggacactccaacgcctgatcaatggaattataatgggaatttggcaaatacaactgatcgttgttacagtaatcagggcttatttgtggaattatgcaattcaatccgtgatactgtaatcccccgagataccggacactccaacgcctga

SEQ ID NO: 83476 - DNA, 1358 bp, Heterodera glycines
  Genomic contig location: Contig_ID=SeqID_18798; Location=456..1813; Strand=+
  SCN-specific regions: Sequence locations=1-298,321-381,403-534,611 -782,852-1040,1062-1118,1140-1192,1243-1358
tttatgattcggtgatttgcgccaaccaatacggtgtttccgccgcacattacagtaaccaaacaacactggatggaacaatgttgacaaacaggtacggtagtaatagtatgggcattactgtatttaaatgtagctcaattttaggtattcaacagaaaaattgtggttccaacgtgtgaatttcacccacaattcggaggccgtcatttgggtacattcgcctgaccatgccgtactggacggtactcagtttgccgagattggatggcacattgacaattgttcaattgtcgagaatcaaggcccaattttggacacacatcgagatttggtaaaaacgaataaataaaattcaatcaaaatttgaatttttgaaacacaatttttaaatttaaaaatcggtgcgtacagaaacggccacaaaactataaaaattcgaaatttacgaaatataaaagttagaggttcaaatttttaaacccataaaccttaagtgctcttatgatcacttttttgatgtgttatatctgcaaaataatcttataataaatttaaatatatatatatatatatatatatatatataaacttaaaattaaaattaaatcaattttgtttttcacagttcgccagtgccaatgtgttccactggaatttttggtcaaatacatttgccaacaattcaaatggcggtgtccaagtccatctgccggatccgtgggatttacaaaatcggcgccatcattctttttggatgaccgaaaatcgttttgaggtggaaaatatttttacaaatattagattttaaaaaatcattttataattttttaaatttttcatttaaatttgcttaaagttacaacaaaaaaaaactcataaaaattggaattttgtatcttacgaaaattgtacccttagtattcaaaaaaaaattgccttcttataaaaatttttctgtaaaaaaaatatttactacaaaagccattttgctgaaaatttttgctcttttaaatgggcttaatgattttccgggaaattttttaatcctcttaagttttttgcagaatcggtacgacttttttttcagaccttatgaattttttaagcgataacctatcattgtggcacttctgtataatatggtcttacatttgtaggacgcagaaattattttattatttcgcatttctaaatatttttaaaaatattttttaattttatttttacaaattaaattttgtcacatattaattaattactttttttccattcatttagcgcaattatgatttcatggtgcagttgtcaggatattttacgtttgcaaatatttcttccaacaatttcacggataa

SEQ ID NO: 83477 - DNA, 697 bp, Heterodera glycines
  Genomic contig location: Contig_ID=SeqID_18798; Location=948..1644; Strand=-
  SCN-specific regions: Sequence locations=1-50,72-128,150-338,408 -579,656-697
atgcgaaataataaaataatttctgcgtcctacaaatgtaagaccatattatacagaagtgccacaatgataggttatcgcttaaaaaattcataaggtctgaaaaaaaagtcgtaccgattctgcaaaaaacttaagaggattaaaaaatttcccggaaaatcattaagcccatttaaaagagcaaaaattttcagcaaaatggcttttgtagtaaatattttttttacagaaaaatttttataagaaggcaatttttttttgaatactaagggtacaattttcgtaagatacaaaattccaatttttatgagtttttttttgttgtaactttaagcaaatttaaatgaaaaatttaaaaaattataaaatgattttttaaaatctaatatttgtaaaaatattttccacctcaaaacgattttcggtcatccaaaaagaatgatggcgccgattttgtaaatcccacggatccggcagatggacttggacaccgccatttgaattgttggcaaatgtatttgaccaaaaattccagtggaacacattggcactggcgaactgtgaaaaacaaaattgatttaattttaattttaagtttatatatatatatatatatatatatatatatttaaatttattataagattattttgcagatataacacatcaaaaaagtgatcataagagcacttaa

SEQ ID NO: 83478 - DNA, 491 bp, Heterodera glycines
  Genomic contig location: Contig_ID=SeqID_18799; Location=1523..2013; Strand=-
  SCN-specific regions: Sequence locations=1-35,99-110,132-168,191 -261,354-450,472-491
atgttaaaggacaaattcgcgataagtctggtaactaaaaaacattataaaaatttaaaaatattttcgatgtataaaaaattaaaatttaattttaacttaactctgtaattagaatttataatcaaattcttcttttcatattaaatttcaagcaaaattttagtcttatatttcataatttgattttgcttaatgatttattgacaatgcaaatgaacagtgttatatgcttcatgttattgtaatatgaatattgtcaattttaataatataattataatttattttaaaatcaaaaattaaatatttttcagaatttatttttacaaaatttcaacatttattaaaatgtaaaagcactgaatcgccaaaaaatttatagcgcttgctgcataacgcacggatacatgagatttgtaatccaaagcttaaaaatctttagttctgattgcaaatatatttaatcatggaaaacttataaaaataaa

SEQ ID NO: 83479 - DNA, 792 bp, Heterodera glycines
  Genomic contig location: Contig_ID=SeqID_18800; Location=98..889; Strand=-
  SCN-specific regions: Sequence locations=1-530,553-792
atgaaggtaatattgccgatggtatcatacctttctgaaattttgaaaaaaagtcataaaacatgcttcgtgagtttttcggggttccgcgatttgaattgcacgaaatgagggccagatttgtgattaacgaccccgaaaagccctagaagcatattttatgctttttcaaaattaaagaattttttagaaaaggtatgtgatgcaatcgacaatattaccaaaatgaaaatttgtttctgagggtttcgggatcgctaatcctgcaccattttgacaaattcaaagcccccccccccattttgaaaaattcctcttggcctcaaaaaactacaaactgacaatgagctaaaagtctcacatcttcgagccatgattaaatattctatagaaaattaaaaagaagttgcggaaaaaaagctcatgagtaaaaaatgacaaacattattcttttaaaaataccgcttttttaggctaggaaaatcgtagcttttgctgatttagaatctatttgtatcaatctttgtaaaattcatttttctgattttgtaagagttcactacgagtccacattcaacagcatcagagacgacatggcgatgcttgttcgtgaacagcaaaatcgagaaacaaaattaatgggccacttgcgaaatgtgcgtaagtaaaacgacggagttctaaattgaactaccaaaaggtgtggctcggaggttcttgtagaatttttactaagaaaatgtatgacaccatttaaaaaaaacaaaatgaacagtaaaaaatactaataaa

SEQ ID NO: 83480 - DNA, 899 bp, Heterodera glycines
  Genomic contig location: Contig_ID=SeqID_18802; Location=287..1185; Strand=+
  SCN-specific regions: Sequence locations=1-121,244-271,293-437,474 -512,534-899
atgcagctgatcattctgatcagcactacggctgaacgctcggcagcaggtgagtggagagagtggagaggagaatgtaaaatgaatgtttcccccattttagtcgatggtttttattggccaacaacaacaaaaacaacagcagcagaaaacagcaacaacaacttctgggccaacaattacaataacaacaacaacaacaacaacgacttcaatgttggcgatcaacaacagcaacaacaattcggagcagtacaacagccagcaagcggtggaggaggaggcaaggaaaacggggacaaagaaggagaccgggaaacggggttgtgctgtctgtgtgcaagtcccgtcattacggaatccataatccgtattatgcagattttctaaattacggaagtccctaattacggggtccaaaaaagcgtaattctctgaataaaaataaataaaatttaacatataaatttattgattaacaacatttttggcaaatatgtattgtaaattcatttttaatggtttttctaatttcttaaaataattgtccatttgtttcttttgcacagtttttggaattattttttgtctatatttatgtccttaattggcatttttcagattcctccttcaacactctgtcctccctgttgtttgcgtccgccggccttggcacagtgcctgccgccagcgctgtcgtcgctccgggcgctcccattggcattgtgccgttgtcgcgcggcgtcggcggcggcactgatctcagcccgatatttggcaattttgaccggaacggacgcaataatttcaattttggtggtgctactggtgcggaggagaccaccgacgacactggcgaacagttcacacctttcccgacactaatcccggccgacaaa

SEQ ID NO: 83481 - DNA, 628 bp, Heterodera glycines
  Genomic contig location: Contig_ID=SeqID_18803; Location=568..1195; Strand=+
  SCN-specific regions: Sequence locations=1-277,308-374,396-462,504 -544,566-628
atgtcatcggcatcaatggttggcggtgccggctcattttatgtgggggacggagatggcggtgcgtacgaatatccgttagttgacgagaccgacgcatttggaggagcaccggggcgacggcaccagcagggacaaacttttggggggtcagtgttatgggagaacagcagagttgccaagttggccaagaaaaactgggatttttgaacaagttttcgggctcattgcccggcacttttgggttcactcattttattttgaatttaaatgaacattttgccaaattttttaaaattctaaaatgccgagggtggactgaggagcgggagaggagttgatgctttgtcaaatattttggtatttatttgaaaattttgttttttcagttacatgcgaggaagtgccgaaatgcgtgggggacagatgccgtcgccgtcctatcccaattttggcggctttggaggaggaggaggaagaggaggagcatatgggggaggagggagggaagagtcaccggaagagtgggaggatgaaatggtcggaggaggagaaggagggacagaaatgggacaaatcgaaaggggcggcggaatgccattttggatgggtggcacaatggcggcag

SEQ ID NO: 83482 - DNA, 956 bp, Heterodera glycines
  Genomic contig location: Contig_ID=SeqID_18804; Location=936..1891; Strand=-
  SCN-specific regions: Sequence locations=1-180,202-480,502-777,799-956
  Gene Ontology: Mol. function=histone binding; Cellular component =cytoplasm; Biological process=mitotic chromosome condensation
atgtgcacgcatttgttgctgaaggatcagctcaaagtgagcgcctgcgttgccgacattgcctactcactgaagcgcgacgcgaaccctccacaaattgtcacagttgccaccggactgttctgtgaactgagcaaaaaggtcggtttttgtccgaaccttccgacacttacgccctgagacatttgcctgtaaaaccaattttttgaaatattgcagcacaacgccctgtacaacaacgtgccggccatcattgacagactgttgacaaatgaggaggcgctggagccggacggcgaggcccaagtggaggaaattctgcaatttctgctccaactggttgacaacgaccagcagaagcgggagaaattggtggacaaattggtggaacggcatggcgatcggttggccggctggcgatgtgtgacccaagtgttgaaggccaaggaggcggcggccgagagggagcaacaacaaattcagttgcagcagcagcaacagggtgagtctgtgtgctgttgcggattggccagtggagttttggtggcacgcttttttggcacaatttgacccggccgagccccctactgtttcatgtataatattattgcagcagcagctcaaaaggccggtagcagtcgtgccggagggagcagaggccgccctacaggcaaaacgccgaagcgatgctaatgcggcggagagccagggaacccatgcagatgatttatttcttttcttgaaccatttttagctttcgatctctatattcgtttattatatgcaaatatatgtattgttttccttttcggaacaatgaattaaacttattattacgaaatatgtattgggcatgggcacaagcattatatcaaaaaccaagttataaaaaacaaaattgaactatgtaccttttttctgctccgaaatgaagtttttttaatgagactaataaa

SEQ ID NO: 83483 - DNA, 155 bp, Heterodera glycines
  Genomic contig location: Contig_ID=SeqID_18804; Location=1..155; Strand=-
  SCN-specific regions: Sequence locations=1-155
aaaataattgatcccaaatggctgctttaatgatgctaacatttttactaatgagttcatttgttgcccaaatggcaaacgctttgaaaatattagtcgtccaacaaaattacatgttctttcgaagtcattttggattcggtttaaacttggcc

SEQ ID NO: 83484 - DNA, 117 bp, Heterodera glycines
  Genomic contig location: Contig_ID=SeqID_18805; Location=332..448; Strand=-
  SCN-specific regions: Sequence locations=110-117
atgttgcgcaactccgtcttgtttgtgttcactgagattctcctccattgcttcgactgtcagcagttggaccaaacgatgagtgatcagcgggacatgctttttgcccatttgctg

SEQ ID NO: 83485 - DNA, 1881 bp, Heterodera glycines
  Genomic contig location: Contig_ID=SeqID_3162; Location=128..2008; Strand=-
  SCN-specific regions: Sequence locations=1-77,124-231,276-926,1059 -1120,1142-1361,1383-1476,1518-1566,1668-1715,1737-1831
atgcgcttcacaagtgtcttctgtttgttttttgcaatggcccttggcttaatccaattggaccgaggttagcctggaaaaatttttaaaaaatttgtaaaaaaaaaattgttttttttttttgttttctagccaatggtatggatgttgatgtttgcgagaaaaaggaggactgtaagtaacgttgtttctgtaatcaattttcattattagaagaattttcgatgggctaatatttagaaaattctcatgaattttttttttaattaaattttcggggtaaacccaggtcccaggcctctctcctttacaataggaaaaaaacatcagaagaacaaaaaaaatttttaaaatttctgttgtcccaaaattggtttttgtctgattttaaataaattaattgttgagggacgaatcttctcgaaaaaaattgcaaaaataaaaaaaagcagggtaggtcgggaactcgcatttttgaaaatgcggaacatgaattctggttctggattgggaaatcgccaaaaacgggaaaatgggaaaatccacgtagcaaatacggaatccgggacgaaaaaactgacaaattccgatagaaatccgggaccagaaaatcgggaaattctgacagaaaaatccgggttccagggggtgaaaatagtgaaatcctaatataaatccgggaccagagacgtcaaaagcgtgaaatcctactagaaattctggatgctggactaacaaataagttacatgaaaaaatcgaaaattatatcgggagcaatggataaatgcgagggtaacggaagggtatcggaattccaaattccaaaaaaaattctttttttttaagttttaaattttcatttccttccatttgctatgggcctggatcagggctgcacgaaaacttgtaaaaaaaaatttcgtatacgaaaacgaaacacgaaacgaaaaataaaattttgaaaaccgaaaatgaaaacgaaacgaaaattttaaactcaaaaacgaaaacgaaacaaaaattttttgacggacgaaaacgaaacacgaaaacgaaactcaaaatgtgccgaaaatttatgacgaaacgaaaacgacaagaaaatttcgtgcaaccctggcttggattggaatccattttaatccaatctttaatctccgatataaattggacagcagaaaataaatcatatgcaaatcggcgaccgacacattcattttctctccattgagaaatgggagagacgacagacacaaagccaatgattaaaaacggatttttaaatgaaaaaaaaggatttatcgattggttttatccgattgtatccgagcaaaatttctttcattccgtgcacctgcactctttttaaaaagataaaaagttacagaatttaggatcctaattcctcatgaaactgttctacaaaattttaaagtgaacaaaaaaatgaatatgctttaccaatctcgtcggaattttattttttccccacaaaaaattcaaatagtttattaaattttttttgtcttagtgctccgatattctaactaatctcatcaaaaacgaaatttaaaatttacgattatctatataaaaataaaaattaaattaacattataattattgtctaaaattcactaaaaaatatattttcttaataatttttcatcaaatttttgttaaggtcaaacaatgaaaatcaccaaaaacaaattggaggaggatgctgacaacttggataattacctaaattcatcgcaatccgggcaattagcagcaaaaattaaagaagcaattagtgcaattaatggcattttggacgaatatgggtaaaattaagatataaaaaatatttatttttaataataattcaaaataaa

SEQ ID NO: 83486 - DNA, 740 bp, Heterodera glycines
  Genomic contig location: Contig_ID=SeqID_3163; Location=437..1176; Strand=-
  SCN-specific regions: Sequence locations=1-197,219-327,349-467,521-740
atgcatcttttcgcaaaagcattgtgtttgctgcatcatcatctgctgtcgtcaatgatccgtaattaattattttaatttgatttgatccgtccgaaaatttccgatcagaagaaaaacataaacaccaagatttgctggctaaaagggattataaaaattcacttttaaatcacctataatccgctgatgaacgcaaattattatttaaaaattttgcccagggtcccttggcttcgggttggtgccacaggtgaaaaaaaaatagcattttagtagatttgtcgccaaaaatgccaattttggtgccattttagtgtcaattattttaaaatttaacaaaaaatactcgtttttccctaaaagttttcatttttcttctagtaggggggggggagggggagtgcagaaaattctaccctcgttttttaaagaaaatctcgaaatttttgttgggtcaatcaatgtattaattttaatttaattgtaattgaattaaaacaaaattaacaatttatttcttcagcaagaatttggggagtgaaagtgaggagacattgtgccaacagtatcatgaatatgcgccgccggatccggcaccgccaacttccggacaatatgtcaacttggccggcggggatgggcctacaaaacggcggagaccaatggcacaaaaaccgatggccaagtgcgggaataaattaatgaaatccgttttttatttcccaatagtaaagtaa

SEQ ID NO: 83487 - DNA, 1608 bp, Heterodera glycines
  misc_feature (1469)..(1469): n is a, c, g, or t
  misc_feature (1497)..(1497): n is a, c, g, or t
  misc_feature (1567)..(1567): n is a, c, g, or t
  Genomic contig location: Contig_ID=SeqID_18806; Location=1..1608; Strand=-
  SCN-specific regions: Sequence locations=1-830,852-1439,1462 -1472,1494-1608
  Gene Ontology: Mol. function=protein binding; Cellular component =endomembrane system; Biological process=receptor mediated endocytosis
aataatgttttcttggctaggcaaaaacaccactaagaaaaaggaccaagatgttctggaaactgtcagcgagggcctgaagaaaatctacaagcagaagctgtatccattggaggatttttatcggtttcacgagttccattcgcccgctttgggttttgtttaaatacgcattattccatctttttgcattaccatttcagatgatcccgactttaatgccaaaccgatgattttgttggtcggacagtattcaactgggaaaacgacgtcttttattttaaactgattatgacaatcaaaagatttaagattcattcgctatctgttggaacagaactttcctggaattagaattggtccagagccgaccaccgatcgtttcatcgtaagaccagcataacataaaacatttacttcgacattaaatgattttaggtggtgatgtacggcgaaggttttgaactttgcccgtttctgttcatttgagcaactttagaagaagctgttattcctggcaatgcgcttgtcgtcgactccactaaacaattcagagcactgacaaagtatttgtttaatactttatcattagaatggttttaatggcgtttcagatttggaaatgctttcttaaaccgttttcaatgttcgatgctgaagaatgaagtgctaaatggtgtgacaataatcgacacccccggaattttgagtggcgaaaaacagcggtttctataagacattttttccatttacttttttctttaagaattgatcgtggctatgatttttctggcgtccttgagtggttcgctgaacgagtgggtttttaaatatttgttaacattggagttcggtattcggaacgtgatttttcaaggtggatcgtattattttgcttttcgacgcacataaattggatatttccgacgagttcaaacgctgtattgaggcactttcaggcatcattttgctatattttgttgcttaactcaaccaaatccagggaatgaagacaaaattcgaattgtgttaaacaagtcggacatggtcgaccatcagcaactgatgcgtgtttacggcgcactgatgtggtccctcggaaaagtgaacactacaggaagtttgttgtttactttcttttcaaggtgttcaaaacgcctgaagttgcgcgtgtttacattggcactttttgggaccatccattgcactatgacataaatcgacggcttttccaagatgaacaacacgacttattcgtcgatttacaggcatacaagagttgaatttaaaaatttcaaattattttagtctttgcctcggaatgcggttcttagaaaattgaacgaccttataaagcgagcgcgacttgccaaagtgcatgcctttattattgccgagctgcggaaacagtgatattacttcaataaaaggtcattcgttttatgtaattttgtatctagaatgccttncatgattggaaaagaaaagaagaagaangaacttattcagaaattggacaaaatatttgaacagcttcaggttgttgggcgattaatctaccctttgngaatatcaatttgttaccacttaagtcttaaaaacccttat

SEQ ID NO: 83488 - DNA, 129 bp, Heterodera glycines
  Genomic contig location: Contig_ID=SeqID_18807; Location=88..216; Strand=+
  SCN-specific regions: Sequence locations=1-29,52-129
gacattactttcgtgttccatcaaaagtcccatgatggtgagacaaacagatcaaattcaccgccagcagacaacgggaaaggacggagagatggggcggaagaagaggacagagaaagcgagggatga

SEQ ID NO: 83489 - DNA, 1817 bp, Heterodera glycines
  Genomic contig location: Contig_ID=SeqID_18807; Location=1307..3123; Strand=-
  SCN-specific regions: Sequence locations=1-220,243-449,472-489,511 -808,830-1054,1076-1081,1103-1274,1296-1347,1369-1817
atggctttacttcgttctcacttaaaaaatcaccatcaaccaaaattgaaagaattggaagaaaaagataaggctgcagaaagcctcaaaaataaggaagcgaacccgagacaaccgacgttaaaacgaatttttgcgacttcaagtccagtgattaaaaaaatagcgagggctgaatctgctaactcgtcgcaattaaccatcgaaaaaaccttttgtaggaatttaattttaaatgaatttacataacattttcagctcaatggacacccgacggagaaatgactaagaaaattgacaaggcaattaacgatttggtatgtactgctggattgcttgtggaagaacctgggctaaaaaatttattaagaatattggttcctcactataaaactaggtattaatttgataaataaaactttcgatgatcaacttttttcaggggcagaaaatatttcacaaatgatgttttacagtacagctattccttgatgttgcaaaatgttaaaaggcgaattgaaagcaccgattacattacaattgccgttgattcgtggtcctctgacacaactttttccaacatggtttcaaaagttaatttttgggtaaagcttaaaatgtatgtctgtgtttttaagactttgaacgcttatcaaattactgataaaaaattacacttgattctacgtgatgacgaaggtgcgatgaaattggcgaccaatttgctcggttataattccatgcaatgttttgcccacaaaattcaattggtaaataaaatacatttaattttgtgtatatttggctattttaaggctgttggagatggcttaaagctccttggtgggattttcgatgtaaaggaacgaatgaaaaaagcaatccgtcgcataagaaaatcgcgcataattgctgacgatttcaaagcattgcaaattgaaaatgatcttccactaaaaactttacaaaaagtaataaaattcaaataaataacaatgcaaaatctatgattaaggatgtcgaagtgcgttggaattcaacttatttaatggtcagccgttttcttgaaaacaaataggccattgaaatgatgccagcccaagatgccaaattcccttgttttaccagtatcgagtggacaatgatgagaacgttatgcaaaatactccaaccaatttaacgcgcaacaatgcacattcagaatcggaaaagcggtatttccggtgttcttccgttatacaaagttttgaaacaaaatttgacacactggacggctgtggatgattttccagaaattagaaaaagaattgccgaatctttagaggaaagaatgaaaggtattttgtattaattctggaaaattccgtaatttttaagtatagattgggagcggaataaggacttgttattggctacaattctcgaccctgcatacaaagtgcaatattttgaccacatttacatggaaattttcaaggatatgttattgcaagaggtggaacgtgtggccataagtggtattgatgaacaacaagaaacaaccgatgggacgacaaatttggagttcactgaagaaaacgacgacccttttaaagcattccttatcgaacagtccaccagtaattttgtatttcgaagcattccatcacctacgccgtcgctaattgataccaaagcaaaagctgcaggggtaatgtcaattatttattttttgtcttatcgtttattcaaaaatttagcaagttgccgattatttgaactcggccttattcgagggcacatcggctgttttttggcgtcaaccaaccatttggtaa

SEQ ID NO: 83490 - DNA, 653 bp, Heterodera glycines
  Genomic contig location: Contig_ID=SeqID_18807; Location=1892..2544; Strand=+
  SCN-specific regions: Sequence locations=1-130,152-157,179-403,425-653
gaagaacaccggaaataccgcttttccgattctgaatgtgcattgttgcgcgttaaattggttggagtattttgcataacgttctcatcattgtccactcgatactggtaaaacaagggaatttggcatcttgggctggcatcatttcaatggcctatttgttttcaagaaaacggctgaccattaaataagttgaattccaacgcacttcgacatccttaatcatagattttgcattgttatttatttgaattttattactttttgtaaagtttttagtggaagatcattttcaatttgcaatgctttgaaatcgtcagcaattatgcgcgattttcttatgcgacggattgcttttttcattcgttcctttacatcgaaaatcccaccaaggagctttaagccatctccaacagccttaaaatagccaaatatacacaaaattaaatgtattttatttaccaattgaattttgtgggcaaaacattgcatggaattataaccgagcaaattggtcgccaatttcatcgcaccttcgtcatcacgtagaatcaagtgtaattttttatcagtaatttgataagcgttcaaagtcttaaaaacacagacatacattttaagctttacccaaaaattaacttttgaaaccatgt

SEQ ID NO: 83491 - DNA, 1461 bp, Heterodera glycines
  Genomic contig location: Contig_ID=SeqID_18810; Location=139..1599; Strand=+
  SCN-specific regions: Sequence locations=1-247,270-379,413-744,766 -1461
  Gene Ontology: Mol. function=electron transporter activity; Cellular component=extracellular space; Biological process=gametogenesis
ttgacttcgttcatcgacgggtcagcaatttacggctccacccaatgcgaagcggccgccctccgagcatttgaaggaggtcggctgaacacgaccaatttgggctcagtgaacacgttcgttttgagttgtcttttgtttcttgcatattcacgtgccactattttccagcgaggcactgccccagggggaccaagaacaggactgcaggggaaaggtcggtaagggggtgagggatttggaatagtttaaaaaattcgacattttatttttaatcggctgactaagtttaaagtagggtttcccccgacccagccccgaagcggcgaatctcgactttttaagaaaatttactcccgaccaaggggttgctccccgacattttttaaattttctccagccacccttgaaacaaatttgtcgtggcatttcctccccgatccttgatttttctctccccgagggtcggggagcaacccatcctagttcaaaggatgccaagaattgtttcagccccttttcccgtgttttttggccggcgatgagcgcaactcgcaccagcccggccttaccagcatgcacaatgtgttcctccgggaacacaaccgaatcgcgcgacaattgcaggttaattaatgcacacaaaataagagacaagagagtacggtactcagtcggagcacagcatgccaaataaagggtgacgtaatttatttgagaaatacgctactataccgtatctacctcaaccaaacacagaagatgaactcggcatggaatgacgagaagctgtaccaagagacgaggcgcatcatcggcgccatcttccagcacattgtcttccgcgagtatctgcccaagctgatcggccaacgcgaaggtctgtaaattattgtattgtaaaatgtatactgtattatattgattataccgtagtttctaacctcaaggcttaattggccaatttgattaaaccgcttaaacccttccagtggaccggcacgacttagccccgctaagtgccggctattttgcccgctatgatccgacttgcgacgcgtccatttcccatccgtttgccaccgctgtaatgttcagaaaatgccaaatttgactgctctaaatcattccaaaggcatttcgcttcgggcacacactgatcagacaaatgttcccccgactgaatccgtccaatttcgccaatttcactgatccggtggatttggtggagcacttcaacaacatggaatcggtgtacgatcagagaaggggtctgcataaagtcgagactattcgagaatgggcctaagtgttggtttggcaggtggcatcgacaccattctgatgggtttgttgggtgcgcgggcgatggcatttgaccggcacattacggacgcggtgcgcaaccacctgttcggcttccgtggccagcccctgtccggacttgacctgatcgcactg

SEQ ID NO: 83492 - DNA, 377 bp, Heterodera glycines
  Genomic contig location: Contig_ID=SeqID_18811; Location=70..446; Strand=+
  SCN-specific regions: Sequence locations=1-267,290-347,369-377
atgcgtttagagcagttggaagagatccgtaaggtcaggctgggctccctcttttgtcaggttggcattggcacttttctccccttttccatcgttttttttgtccaatttcggcgcccctttgtttcagaatgtcaaatcgttgtccaaaatccaaccggatgtgttctccgtgcccgaccttttggccaacagtcaaattccatgcgccgattttccacgaatgaatttggccaaatggatggaacgacgtttggcaccatttgaactttaaaatttttattttcccgttctttcagccgtttgttcgattggcaacgcccaagtgccccgaggggccaccaaattgaggtggaattgttttgtaggaagtcata

SEQ ID NO: 83493 - DNA, 294 bp, Heterodera glycines
  Genomic contig location: Contig_ID=SeqID_18812; Location=784..1077; Strand=-
  SCN-specific regions: Sequence locations=1-39,62-294
atggaagcgcaaaatgtgcggatcaaattggaagccgaactgagaacggctcaactgggaatggtgcagcaaagtcgacggataatgaatttgtacgagggattagtcggacaactgaagtgaggaggcccaatttccctcttaaactacattaatttttttatcagaattctgttgcgaaaattgcaaacgcccggtgaaagtacggagacgaaacgccaacaggcgaacgatttgatcaaaaggattgaaggcacaaagttagttagtgccgaggcaccaatgattaattaa

SEQ ID NO: 83494 - DNA, 613 bp, Heterodera glycines
  Genomic contig location: Contig_ID=SeqID_18812; Location=1406..2018; Strand=-
  SCN-specific regions: Sequence locations=1-117,141-474,496-613
atgactaataaactcatacgtaagcctgcgcacccaaagcaccgacgcgcccaatgccgcgacttttttggtacggatacatttgtaatttaatttgcttacaattagtttttgcatcatttaggaaaaggattttgcttgcgaggttagtgatttcagttcaatttcaacagattatgaagacttgtccctctcccattttgtttgtttccaggcaataagtgtcgctttaaccacggtctgaacccaatcgttgtcgacgactcggagcgtttcaaagtgcctgcgacggtcaacccgaatccgccgccgcccggaatggaggagaaaggtggcgaacgaagcgcgaggggcgaaaccaaacgaagcgtaggggcagggggtggcctttcattcattcccccgtccccactgaatccatttgcataaagcttcagtagttggcgcttagatttcatcaattttagcttaactaattttcatttttcagccaaaacgacgagttttgtcgatttgttgctgactcccgccgtgggaagagaaactgtcactgatcggccgatgttcgtcccattttattaactttcacatgatttagcaagcgaacattaaa

SEQ ID NO: 83495 - DNA, 111 bp, Heterodera glycines
  misc_feature (78)..(78): n is a, c, g, or t
  Genomic contig location: Contig_ID=SeqID_18812; Location=2888..2998; Strand=+
  SCN-specific regions: Sequence locations=1-111
atgcaaattgacagatattatgaggactacgcgtccatcactgtcaaccaagcagttaacgacatcaacgccatggancaagacgggcgttttgcagaatctgaagattgc

SEQ ID NO: 83496 - DNA, 1177 bp, Heterodera glycines
  misc_feature (4)..(4): n is a, c, g, or t
  misc_feature (15)..(15): n is a, c, g, or t
  Genomic contig location: Contig_ID=SeqID_18813; Location=72..1248; Strand=+
  SCN-specific regions: Sequence locations=1-196,218-286,308-336,358 -590,612-886,908-976,999-1010,1043-1177
  Gene Ontology: Biological process=regulation of protein activity, epigenetic
atgnatccggatcanaagcagcagcaggatgaaaaaaagacagcagcggcaactggggactcaaacagccgctaccaccagggatgggccgctttgcctgaatacaatgtatgtcgtctaatgttcatctggaatcatatactttcacgtcaaatctaatgatttttatgctcacatttcccgggtcatctatgttacaaaatctatgatttttccaaccggtccctcttaatgatttttccactgtcactttccctggtcatctatgttactaagtctatgatttttccaaccggtcccttttcccgtttcatctggaatcatatactttcacgtcaaacctaatgatttttccactgtcactttccctggtcatcgatgtcacgtgaaatctcatgattttccaaccggtccccgtttcccatgtaatctggaaatcatataattccgcgtcaaatctaatgatttttccatggtcccatttcccgtgacatcgatatcacgtgaaaactcatggttttaccaaccggtccctaatcatatactatttcacgtcaaatctaatgattttcactgtcagatttctcgggtcatttattttatgtgagatctcattatttttctaaccttccatcaatgtcacgtcaaatctaatgattttcacaactggtccttttttccgcgtcatctatgttaaatgaaatctcaattatttttctaaccgattcaatcaatgtcacgtccccgtgtcatctatgttagatgaaaatctcatggtttctcaaaccggtgtcatctatgcttattttagccgccttttatctgcgtggacgcgtccttccaacggcatttgcatcggcactccaacaaaatattgaacagaatccaacaattacatttcctgcacacaattattgtcacgtcgacgccgacttcggcgacgccaactgagtccaaggaggctggcgctgaactgtcacataaagatgacaaaaaagagtcagcaaaagttgctgccaacaacagcagcagtagcagtggctacgagttgaaagtggaattgcccgacgcgttggacaaatggcaaattatgccgaattgggacagggattgtgatcgcgatctgttgatcggtgtacacaaacatggtaaataatgccaaataatcaatcagtca

SEQ ID NO: 83497 - DNA, 1257 bp, Heterodera glycines
  Genomic contig location: Contig_ID=SeqID_18813; Location=1520..2776; Strand=+
  SCN-specific regions: Sequence locations=1-449,473-481,503-843,865 -971,993-1010,1033-1093,1138-1257
atggacctgaacaatcgctttaaacacctaattaatgtgctgcaaagagttgccgtcgagtcatcagcaaaagcaacggcaaaagccccaccgcccgaaacaccaccatcagtggtgtaagtgttgctggggtgtcgttagagcccggacgggattggaattttgtaggattttcccgtggtccccgtcccgattttttttttgaagaaatgcctggattggaatcatgaaaaattggggtttgaattagggttaagccccgactccgagcccccgacccgacccgagacgttttttggacctattccccgacccgacccccgacatgtcgtcccccgaggtccccgacccccgactttttgccccccgaccccccgacactaattcgggggattgtggactcggagcgttttaaaaaattcatctacgaaggcggaaaaatattgaaaatttttgagattttgaacaaattttcttaataaaattcattaaaaattacaaaaaactttccggcggctcctatcggcacccggcggcccctcaaaaccatggtttcgatcggtaatttttcaaaatatgaacaccaaggccgaaaaataagattttagggtcaaaaataataacattagcaacattttttcaaatcagtaaatttttacaatttatttgatcaaaattcccattataaactaaggacaaaacgaggttaaaacgaagattttggacccaaaaataagattaaaaaaacggctttttacattgtaaaaacagggctgctaactgaaaattttcaaaacctgcatttagccaacaagaagcatcatttggggtcaaaatcagcactttggaaattttagtcaaaaaggaaaaacatgctttttttgtgacgcgctttttccgaaaaaaatttttgtacacaggtgccggcgggagaattttttgaaaatttgagttcattttgctcacagattttcaccaaaaatgaccaatttttgcgcaattttgagaaaatttttaagaacaattttgcggactggctgtgccgataggtgccgccggaaaaaaaaattgaaaattgggagtttttgatagcattttttacataaaaaaaatttttaaaactataaatatatttaagaaatttgaacaattttcgtcgctaccccaaaatcagaacattcttataaataacgtactcttgttggcgctaaatcagatgattaaagtgaaaaaaggaagatttacgagcatttaaaa

SEQ ID NO: 83498 - DNA, 2604 bp, Heterodera glycines
  misc_feature (96)..(96): n is a, c, g, or t
  Genomic contig location: Contig_ID=SeqID_18814; Location=361..2964; Strand=-
  SCN-specific regions: Sequence locations=1-6,36-77,183-243,277 -301,323-439,466-550,730-947,970-1114,1148-1201,1331-1790,1831 -2110,2132-2207,2229-2265,2287-2604
  Gene Ontology: Mol. function=acetylcholine receptor activity; Cellular component=nicotinic acetylcholine-gated receptor-channel complex; Biological process=synaptic transmission
ggaaacaaattttaaattcttaaatcatttgccaagttttagcatgaattggaccaaattatgactattccaggttcattttaattaaaaacaatntaattcgatatttttaataaatagatttttttatagcatataaatattaagttttatgaaaaactttctgtttttattatttttttggcatttttatttttgtaaaaaactttttttttgtgttagcttttttttaaactttggcacataatataattaaattttatatattttaaatatgaatatgtctgaaaaaagtaattaaagttattaaattaaattccaagtttggctcaaacagtcgtggaccgaccgtaaacttgcatgggacccggacgattacggtggcgtatcggtactttatgtgccatacgaaatgatttgggttaagcaaaacaaaaacaaaaataaataaatttaaaattaattcctttttcaggtgcctgacattgtgcttatcaatgtaatttttttaaaattatcctctttagtaaataaaaaaatgtttgttcgcattttattaaattttaattttaccaaaattattaattgtttttaataattttaaaagattattttgtaaatttaaataatttaaaaatttaattttaatttttaagattatttttgtaatttttaataaatttaaaaattagtttttttaaaattatcttaaatgtttattaaattatagaatgcaaaagggaccttcaatatcacaattgacacgaaggtacgtaaatctctaataaaaattaaaactcgaaatctcgccagatagagactttctgagatttgatacaccaaaaacttgagataattctcgactcgagatcgagacctaacaatctcgaatagccctattgaatttccaattgttggcacccgagcaaataaattttggcacaatgtttattgtaatttttaaattttttaggcaactttgcatccaaatggacgcgttgtatgggaaccgccagccatttataagtcactttgccaggcaaaaacgttttcaaaaaataaactaattattaattttttgttttttgtttagattgacatccaatggtatcggttttaaattatttaaaaaattagatattaaattctcattaaattaggttcccatttgatgaacagaattgtcttctcaaagtcagtcaattttatattattaaatatttgacaaaatatacaatttgaaaaagctatcaaattatttattaattttaaaataattcatggattttttatacaaattattttaaaataaattttaatatcaaaaataggatgactaattatttgcacatgcatgcaaaataattgggaaatatgcataaaaatcgaagttaattcggttttgctcctatatctcagaatttaaaatcaacaaaaaggcgcgcgtaaagcacaatctatgggaatgaagcttttgctccattcccactgcataaattagcggaacgatcaaaaaagccgccttcaattctctccgttttacgcttaaataatcggtggtgtttaatgatgatccctattccttctcgttttactatttttaccatccccgatttaccaaaagtctagtttggatttaaaaaaattatgaaaagaatttccgaaaaatgcgttctcaaagttagctgattgacccatagggatgtagaggagagtctcgattctcgatccgggaaatttctcgggtttttcgcttctcggtctcgtgttttttgcctcggaaaccgagcaattttttttttaatttaaaaaatacatttaaattaatttcattaagatttctcgattctcgagtcgagaaatctctagagttttttgggtctcggttctcgtatcgtttctcgtgatcatttctcggtctcgattctcggtaaaaatcatttctcgcacacccaaacgtacccatgaaactttagaatgacaccaattatatgtcaaaaaaaatgtgaaaattcagaaattttttgtaccgattataatcgaaggatgcttataattatgagatgacctaatatatccaaaataaaattggatgcagcaatattcattcttatgtaaaaatgacataaaattcgtgaaatttttttatcaatgccaccaaaatagcggtgagcgctaaatggctttaccgcatgcacttttgttgattttttaaaattttgagctataggaaggagcacaatcgaaaggtaccaaaattttccaaattatgtttaaaacttgtcaaattagttaaaattaagttaaaaatctcgaatgactaaatatggatggaattaatatcgaaataggcacaaattttcatttttaaattttgccaaattttaatttaacctttaaaaatagtttggctcatggacctacccttccgggctgcttcatctttcgctaatggatgctgttaatgagactcaaatggaggtgaccaatgaacggggcgagttggaacagcttgcgctggtcgaggatggcattgatttggacgattattatccatccgtggaatgggacataatgtacggtattttgttttggcattctgac

SEQ ID NO: 83499 - DNA, 2185 bp, Heterodera glycines
  Genomic contig location: Contig_ID=SeqID_3166; Location=1640..3824; Strand=-
  SCN-specific regions: Sequence locations=1-829,852-933,966-1031,1053 -1186,1211-1456,1497-1662,1684-1794,1816-1830,1907-2074,2120-2185
  Gene Ontology: Mol. function=glucose transporter activity; Cellular component=membrane; Biological process=glucose transport
atggccattcatcctcacttttggcctggggtcgtcgttcgacccctcgggggtcgtttggacgggtggtggaaaagtggtcggtcgaagagcgtccatttcgttgaaagcaaaacttggatgctttttatattacgggtggtgcccggggcaaaggaagcgaatgaggggggagagaaagaaatcactgataatggggacaaaaattgtcggaagacaattaattagttcattgataagtgagtgagtgaatgaacatgacccccccccccggactaattgggtaattgagaattaatatgatagagaataaaaaagaaaaacaataaataaacgaaattaataaatctgtttaattctcgatttggaaaaggcaatggaacaatttgggttaatcgttcgttaataactcaaagaattaaattgcagaaaattgtccgaatggcaaggccgtcgcaacgcattgatcatcaacggatttgtcaatgtttttgcggctctgctggagtatttgtccaagtcaatggcttcccccgagtttctgattttcggaaggctcattctcggcgcaaatatgggcctttctgtaggaataaaaaaaaacaaaatttaaattcgcttaatccgtttggcttttcgtttagacaggcctcgtgccgatgtatctaatggaaatcactccgacaaaatatcgcggcgctgccggcacatttcacatggttctgcaattgccattagcacttaacgaaggtcatttattctttaggttgcggttgccttctccgattggttttcgcttttactcggactgccggaagtgggcaaaacattcaaacaattttattttatttaaagttacttaattgactcattaaggtgttgggcagtgccgacaattggccattggcttttgctttccccggctttcccgcctttttgctttgtttggttttgcctttctgtccggagagtcccaaatacacacttttcgcaagagggtaattagtgctaatttatttatcattttaaatgaaaaattttgaaattttagtgagcatgctaaagccatggaggacttgaagaaattggtggacgaagacgaggctgaatttatgtacgaatcgctgcaaagcgaagcagcactcatgcaagtgggcaatttattattaattgacataaatatggcaataattaaaataataaattaattcatggttaattagtatatatatacaaatgtgccttttaaatgacattaattatcatattaataaatattctttttttgaggatggctcctgctgcactttccgccaaattttcttcgaacgccaattccgcctgccccttctgatcaccatcgtggtgatggtcacccaacagttcaccggctgttccgccgtgttcgcctattccactgatatgttcatcgacgccgggctcgacccgtaagtccattttaattattattataataaataatttttaaattatttggcatttttcagacgaaccgcgcgcttcagcactttggccgttggcgttgcttattttctgttcgcgtgcagtgcgcccattctgatcgaacaagttggacgccgtattttgctgattgtacgtgcccaatttatgattcattttattatttattactatgttttttaagggtcaattggcaatgtgttcggtttctttgttctttttgagcatttttgtcgcacttcaacacgccgtttgggtaaagcaatgtttttaaggatataaccgaaatggttatgaaattaaaattcaattaaagaaaaaaggaaataatatccaaacgtataggcgaataaaataacattttaaacttttaactatttttattttagaaatcataattatttcaaatattttaaatttatttccaactcaaattgtttttcttcccaatttcagcaaaacttcgccagttacgccaccatcgccgctctgatcgtttatatgtgtgcctatggcgtcggttgtgccattccgtggctaatttccagtgaaattttccccaccaaatttcgcgctgctgctgtgactggtgaaaatattatatatttttttaaattttattttttaatttaattaagtcgctgttacggtcgcttggtcattgtcttttgtcgtctccacgtgctatttgccattccaacaa

SEQ ID NO: 83500 - DNA, 384 bp, Heterodera glycines
  Genomic contig location: Contig_ID=SeqID_3166; Location=4059..4442; Strand=+
  SCN-specific regions: Sequence locations=1-146,168-331,353-384
atggcaccgatggcaatgctggagaccacaaaggaccagtacaggttcatctccgtcagattcagtcccggccctccgccgttcctccgaatgtaagtcatgttaatccattgggtgagcagttctgttatatggaaaaagcgcttaatttaatggtttttgaaattgaacttctcctaaccctgctcggggttgatgatgccaaagctgtagaattgggtgctggccccaaggcaaacggtggcgacggaaacgaaataagtgggcgtgaacattttaatataaaagtgtcaaaataaagctaaaaatataaattgaaataaaattgttagcatcaaagatcagcagacgatcagccaaaacatttggggagaaaagagaaaa

SEQ ID NO: 83501 - DNA, 304 bp, Heterodera glycines
  Genomic contig location: Contig_ID=SeqID_3167; Location=671..974; Strand=+
  SCN-specific regions: Sequence locations=1-72,103-265,298-304
atgacctatgaaaacggaaaagtgagcaaagttcgttttgatagttttgtgctttttaattcacaaaaaaggtaataattaattaaaaagataattttttttgcattttaattcttagattgtcatgtgccaaatttaaaactaaatctcattctttattctttcgttttaacataaattccaactcttgtatttttggtaactcggaattcctatattcatttaaaacaattttttgtcttgtttttagtgtcgttgttttttgtattatttttatatattaaattataaaattaacaaaaaa

SEQ ID NO: 83502 - DNA, 450 bp, Heterodera glycines
  Genomic contig location: Contig_ID=SeqID_3167; Location=1429..1878; Strand=-
  SCN-specific regions: Sequence locations=1-450
atggtctgtccgtcgtttgcactgcgcccgccgattttcttttcaccactgttgccgacccaaaacggcacttggaagcaagccaactgttgggctctgcactcccggcacgttcgctagccaatgctttcactttttttggcattttcatctaatcacttttgtttttgtttgtcttttagtccactgcaagcaccgatttgatcgctaacactttggctgatcaactccgtgccttcatgtccgattttggctgtcccaatgggttggccaaaatgggcttcgatcggcgtgacacggactcgttggcaaatgccgcgctcaactctttccgatcaaacccaatctcgccccgggaaaccaacttcgactcaatcgcgagcatttacgaacagtctctcaacgtgtactgatcaattattgggctgataaaaaaaaatactcaataaa

SEQ ID NO: 83503 - DNA, 884 bp, Heterodera glycines
  Genomic contig location: Contig_ID=SeqID_3168; Location=72..955; Strand=-
  SCN-specific regions: Sequence locations=1-301,323-884
atgacctattggcattttggattaattattctgccaggcgctgccatcatcgacattcccgagaagcagtgcaaggcgggcattcgcctccgctgcataaaaccgtttttggccatcattgacccgttgaatgtgaagagtatgccacggtgttaattaagcattttgttgcttaattggccattttttatcatttagaaatgtggccgtttacagcggcttcgacgttttatgccacgcgctcgaatcgtacacggcgaagccgtacaaaatggtcagttattccattgtaatacaataccctaaccgtagccaaagagaactgctgctgaatatgtggggaacatcaacaaactttggtaaaattgaaaaatattgagatagagaagaaacttgttcgaaaggaagattaattggaccaattgaggtgatgctcctattgtatttgatcgagcaaattggggaactcgagaggacagagtcggtggttcagctggtagaacattgatccagaaagcacagagactccggttcaaagccggaccgtccaatatttcattcaaaaacttctccagctcgttcatatattatcttagtgtttaatttataataaataggcaccgccttccaattgttttttaagatcatcttaaaaacaatgcggggttttttaaaccaactttgaacctgaatttctttctttttatccacagtcatggtcaattgtttagttttttcagctgatcattttaattttgatcactttttggctattttgtgcagcgatcgcctcgccctctccgccccgacgctcgtcccctctaccaagggtccaacccggtcagcgatgtgtgggttcgtgaagcattgcgcgtcatcgagaa

SEQ ID NO: 83504 - DNA, 699 bp, Heterodera glycines
  Genomic contig location: Contig_ID=SeqID_3169; Location=160..858; Strand=-
  SCN-specific regions: Sequence locations=1-223,274-437,488-699
atggcatcaatagcaaactcaacaaagctcacaattggctcatttaaaactgtgccactgatgatttctccttttgttacgcgatttggtgtcggtggtttctgtgctccaaatttggcaattgccaatttgacagtgaggaaaagcttcgcgagctgcgcttttcccccgggtaattattgtaattagtgaatgcaaaacgatggactgacatttgtaatgcatattaataattaatttttaataatgattaatttaatttaataattttttcagctgaatgtgaagacgttgactacgcttttgaaatgatgagctcaactttgcgctgtggcaacggcgtgaccagcgaaattggcttcgatgtgcaaaatttgggctccaaaaatgcactaattgtaacagacaaaaatgtcaccaaaacgagggcatttaagtaaatattttttatgataaaaatatatttttaattttatatattatataaccaaattatcatccaatattaattagttgcgtgtagttactctcggcaaattaatgattaattaataagcttgtccattaattagggaagtcgccgcttcgttcgcccgtctccgtttgtctttcgctgtgtttgatgaagtcaaatgcgaaccatcgcaacaaagtgatttcatgcgtgtttaactgtttttctgatgccaacccattaaa

SEQ ID NO: 83505 - DNA, 66 bp, Heterodera glycines
  Genomic contig location: Contig_ID=SeqID_3170; Location=488..553; Strand=+
  SCN-specific regions: Sequence locations=1-66
atgaattttctttgcttttatttttgtgttctttttacttttcttgtttttatggtgttttatgag

SEQ ID NO: 83506 - DNA, 1288 bp, Heterodera glycines
  Genomic contig location: Contig_ID=SeqID_18819; Location=164..1451; Strand=-
  SCN-specific regions: Sequence locations=1-54,77-206,228-244,287 -525,576-616,639-1016,1038-1092,1114-1288
atgcttcgaaaaatttttgtctattttttaattttgattattacttttttggggcaaattgcaatgaaaaatgaagcgttttcaataacttatgctggcgaagtgacacctcctggcaattataaaattgttatttgggatgaaataagcaaaaatactgcagcaaaatgttacttcattttgaaaaatataacgacaaaagtaataaataatatttctataataaacattctttaaagtatggatataataaatttaattttattgtaatatctaattaattaatcaaccaattaattttaaaggcctataaatttaattacatcacgcaaagatacgctgttaaggaaattaaagtgccatttttcaaatatgagaatggaattgttttggagaatttaagcgattgttttgttcatttttacacaatccaaacaaatggagatggcgaatttgagatcaaaatgtcaagcaatgttcaagacttaattaatgttcacatatttccacttgacaaacaagtggtaaattaaaatttaattatttataaaaaataaaagtaaattttaatttaagaatttgatttcttccacaaacgaatcaggcaccattctacaaaacaaaatgaaaagagagaaatggaagcatttgtatggccacaaagaagttctattcatgttccattttttggaatatcagcaaagagtaaacgaatggttggacaattggctaatacaaaatgccgtgccaacggaggaagaagcatttttcatcaaagcattttttcgttatgtcaccgaaatatttgtagaacgattcaccaaattgtcaacaatttaccgaaatcaattgaatgtgttgggatattacggaacaacattgcttaattaccttctcactaatggtgaaatgaatttggcccaaaaattggcccaaatcaatggcatgccaaatttagtcaaatatttttgccaatttttgggctatggtttaatgaaagatgcagacccaagcgaaaatgatatcaaaattgagctgccagcagaatggaaaatattctgcaaaaaatacatggacaaaaatgtacgagcaaaatcgttgtttatttcggaatttcgggctgaaaccgagtgaaatttctcagattttttgatgtcgaaatcaaaaaagagttttaggaaagaaaaaagctttgcaaaaaattcgaaattggaaatgtttgtactagcacttgtattcctcgttgtacctgtacacttattttttatgcaaaatttagaaaaataaa

SEQ ID NO: 83507 - DNA, 749 bp, Heterodera glycines
  Genomic contig location: Contig_ID=SeqID_18820; Location=905..1653; Strand=-
  SCN-specific regions: Sequence locations=1-671
agattagaagaggtacaacagtgattagaagaggtacaacagtgattagaagaggtacaacagtgattagaataggtacaaaagtgattaaaagaggtacaacagtgattaaaagaggtacaaaagtgattagaagaagtacaaaagcgattagaaaaggtacaacagtgattaaaagaggtacaaaagtgattagaagaggtacaacagtgattagaagaggtacaaaagtgattaaaagaggtacaacagtgattaaaagaggtacaaaagtgattagaaaggtacaacagtgattagaagaggtacaaaagtgattagaagaggtacaacagtgattagaagaggtacaaaagtgattagaagaagtacaaaagcgattagaaaaggtacaacagtgattaaaagaagtacaaaagcgattagaaaaggtacaacagtgattagaagaggtacaaaagtgattaaaagaggtacaacagtgattagaaaaggtacaacagtgattaaaagaggtacaaaagtgattagaagaggtacaacagtgattagaagaggtacaaaagtgattaaaagaggtacaacagtgattaaaagaggtacaaaagtgattagaaaggtacaacagtgattagaagaggtacaaaagtctaacttgttatgagatgtacaaaaataatttcataattttaaatataattttatagaattaggtttatttaaaaattttaaaaaaacaaaataataaa

SEQ ID NO: 83508 - DNA, 1177 bp, Heterodera glycines
  Genomic contig location: Contig_ID=SeqID_18821; Location=221..1397; Strand=-
  SCN-specific regions: Sequence locations=1-124,146-150,347-482,828 -854,1136-1177
  Gene Ontology: Mol. function=DNA binding; Cellular component=nucleus; Biological process=regulation of transcription, DNA-dependent
atgccaaaaaagaaggaaagtgaaaaggaaattaaaaggaggcaagcgacccggtggtcaagtggttagtgtgcttgcctttggtcatggggtgttgtgggttcgagtcccatttcttctgattattttaaagcaaatattatattgaaattattctaatttttgttttttaaatttattttttttattaattaactttatgttattttaaattaatgataatgattttttgaattaataaaataataaatatttttaattaatagaataataaagtctaaattaaatattaaaattaattgaataaaaattaaaaataaacaaatattaataaaaatttaaataatttataaatctcaaaatgagttaattttaggattagacgaatccgggtatttgggcaaaactgggtccggatatttccgggtccagcaaagccgggtccgggtccaagtttttaaaccgggtacgggaggaacagaaagtggaagaggaacagaaagtggaaaggaacagaaagtggaagagaaagtggaagaggaacaaaagtggaagaggaacagaacgtggaagagaaacagaacgtggaagagaaagtgtaagaggaacagaaagtggaagagaaagtggaagaggaacagaaagcggaagagaagaagaggaacagaaagtgtaagaggaacagaaatggaagaggaacagaaagcggaagagaagaagaggaacagaaagtggaagagaaacagaaagtggaagagaaacagaaagtggaagaggaacagaaagcggaagagaaagtggaagaggaacagaaagtggaagaggaacagaaagtggaagaggaccagaaagtggaagagaaacagaacgtggaagagaaagtgtaagcggaacagaaagcggaagagaaagtggaagaggaacagaaagcggaagagaaagtggaagaggaacagaaaatggaagagaaagtgtaagaggaacagaaagcggaagagaaagtggaagaggaacagaaagcggaagagaagaagaggaacagaaagtggaagagaaacagaaagtggaagagaaacagaaagtggaagagaaagtggaagaggaacagaaagtggaagagaaagtggaagaggaacagaacgttgaagagaaacagaacgtggaagagaaagtgtaa

SEQ ID NO: 83509 - DNA, 377 bp, Heterodera glycines
  misc_feature (360)..(360): n is a, c, g, or t
  Genomic contig location: Contig_ID=SeqID_18821; Location=2096..2472; Strand=+
  SCN-specific regions: Sequence locations=1-64,86-101,123-196,225-377
gcctgccggttctcggcacagcaaagcactaatacggtgtttgactcacttcaaaaaataattcattacccaaaagttttttacaaccacatattgccaatctaatttcttgcagattgaaagccatccattgcataccggttctcggcacagcaaagcactaatagggtgtttgactcacttcaaaaaataattcattacccaaaagttttttacaaccacttattgccaatctaatttcttgcagatttaaagctatccattgcctgccggttctcggcacagcaaagcactaatagggtgtttgactcacttcaaaaaataattccatacccaaaagttttttacaaccacatattngccatctaatttcttgc

SEQ ID NO: 83510 - DNA, 535 bp, Heterodera glycines
  Genomic contig location: Contig_ID=SeqID_18822; Location=1126..1660; Strand=+
  SCN-specific regions: Sequence locations=1-14,36-103,125-132,208 -298,340-395,434-490,513-535
atggttttagtcttggaaaaacattttggtatcttattgttatgcaggaggcgggagttagtagattgaaaatgccaattgcataaaattactaatttgccatttctatcgattatttttacttttcgaaccttatattaattaattttctttaaaaattatttggccttataatatataaaattaattatataaataatttataatgaaagctaaggtaatatttcatagttttagtaaatgttttttttattactttttgataatcagcagcttaatgttttaggttgaacctttataatatttaagtaattttaagatttcttattttcagattacagaattaacaacaatttttctcggcgcaaataacacacaaattgaaattttacttgaattaaaatattttgcttttattattataaataattttgagataaactcactacctgtctgtatttgcgcacttgcgccttcattaaacacgaactttagcattgtaaattaatttacaattaattttaaaaccaaaaaa

SEQ ID NO: 83511 - DNA, 1444 bp, Heterodera glycines
  Genomic contig location: Contig_ID=SeqID_18823; Location=1024..2467; Strand=+
  SCN-specific regions: Sequence locations=1-68,91-234,256-270,292 -394,417-491,513-558,591-693,715-1444
  Gene Ontology: Cellular component=nucleolus; Biological process =embryogenesis and morphogenesis
atggaagaaggacaaatggaaaccggagaaaatgctgcagttaaactcgtggatcaaaagaagtcggctaaaaagaaagtgcgtataaaacgaagaatttaatcgctatcggttatcacttaacaggtttatgtgccggggaattagccgaattttgaaggcgagcgaagaattggtatacgatgagaaggcgtatttgttgtttcacacattcgaaacgagtgagtggtcacttttggggtgtgccctaagcctagtatttgtgcaattcgttcattttcgtatttattttagactatccgtgtttaagttttgatgttttgcccgactctttgggcgacaatcgctccgattttccaatgaccgcttggcttgctgctggtactcaggttcattttgtgaaatgtttaattccaaaaatcttttttaggctgaccgagcaaaggacaacgaattgctggtgcttagactgtcgaatttgcacgcaaatgaaaagacattggaaaatgcaaagaaaatggcccaaggaaagggcgacgagtcggagagcagcagcagcgaagacgacgaggaggaggaggagacggagggcggcgcaaagagtgcgcggatgcacgcggcagtgatccctcaccacgggggcatcaatcggatgaaggcgagcggagggactgacagaacgggcgaaaaagacggcgggggggggggggggggtaaaatggcacatttttgccactaaccttagaaaataaattctaatggagtcgaaggtgataccgaaaaagtttgtagattttttgcgggagaatatctccttccttctttgcatggcatctgtaaaggagtccaatttttgcaatttatccggtcgtgagttacaataaattggtcacagtcaaaactcaatccggtaatctccgactttttttttgtcagtgccaaacaattggggctagcaatgtgtgcgccgtgtggaatgaccagcagaaagtgcagttgtggaacttggacccggccattgaaacagtgaaatccattggtacggaaagtccgtcgaaagtgcaaaaaatggagaaagacgcggtcaaacaaaatttgttgtttacctttgccggacactccgccgagggatttgcactcgcatggtctccgattcgtctcggcacacttgcttcaggggacctccgcaacaaagtgagtgatcggttggcttttcagaaattatggcaaacatttcgagaatttcatttcgccggcaaaacacaaaaagaaaactgaataatgttgtttgcagatatttctttggagaatgtcggagggcggccaatggttggtcgaccaacgtcctttggcagaacaccaaagttctgtcgaagatttgggtaattcgccatcggtggccaagcaaaagaattcgtttattcctctctttctgctaatttag

SEQ ID NO: 83512 - DNA, 91 bp, Heterodera glycines
  Genomic contig location: Contig_ID=SeqID_18823; Location=3250..3340; Strand=-
  SCN-specific regions: Sequence locations=1-91
ttgattgttttgaaaacgtggaagccgtccaacgcagtggaaaatgccaacccagggcactgtttgtgccaatgaacttccttcacttctg

SEQ ID NO: 83513 - DNA, 446 bp, Heterodera glycines
  Genomic contig location: Contig_ID=SeqID_18824; Location=101..546; Strand=-
  SCN-specific regions: Sequence locations=1-20,43-62,84-97,119-446
atgagttggcttaaaatcatcgaggaggaggaggagcgggcgagggaattgcaaaatgatcaaatggaactggaacaagtgaaaggtttatttagttatttttagacattaaaaacagttttttaaatttagacaacattgagttgccaaagcacccgcaaccacaaaacaagtgcagttgcaatgaaaagcagaagagtgtgccgttgattgattttctctgcaaacactacaaatgttcaatgaatgagcttcacgttctgctgcagacgctgagcaaacgtagagaaatttcggaaatgttgcgttccaatcttcatttacgcaccaatcatctgcgccctgcctggaaaaacattcgcgtccattgcaacgaactaacaattcatccagctcaaactgcatatgctatgcgcggttatcttggcattacggtttgtctttga

SEQ ID NO: 83514 - DNA, 1135 bp, Heterodera glycines
  Genomic contig location: Contig_ID=SeqID_18824; Location=832..1966; Strand=+
  SCN-specific regions: Sequence locations=1-195,217-395,418-1135
atggcagacaattttcaaaaatttgatgaaaaacacttacaactcagacacccgtttacgctgacaatctcagggagcacggggagtggaaaatcggaatgggtgctacgaatgctgaggaatgtgaatgcgctagtttcggaacccatctcggagattttctactgttatggggagttgaatccaaatataatacagcttcagaaaagtggacacatcggcggttgtagggttattgtacatgctggaagcccaaccgaagagcaggttaatcggcgcgcaaaagagtgtgatggaaaactgttgatggtgttggatgatctcatggttggattgggccaacaatttcttgacactgtgttcacccggggatcgcacaattggggggtcagcgttgtgttggtcactcaacatttgttcgcaaaagaactgcgggttgcgcgcaacaactcccactatttggtgctgatgcgtaacccggcgggcgcgctccaagtgcggacgctcgcctctcagctatttccaacgaaaagcaactatttcacggaagcataccgggatgcaactgaaaagcaatttggctacctactaatcgacatgcagcccgagagtccggaattgttgcgcctgaaaacgaatatatatggagagcagggtggtcttcccccattggtttatgttgcaaaatgaagcatgtcaaaagaagaagactaacagataaacatactatgaatgttagcccgctgatgttgaaaaatgctgacttcttacaccactttcgctcaaaatatcgctcaaaaagcagacagcgcaaaatgatagagaacgctttggatgagcagttgctctgttttgtggagatgggtttcaatgtgttgaagggtcgtgttccgttagggaagcgacaaattcaacggttgggtgcattgaagcaccagttgaggcgcttagcacgcgcacgttgcgcaaaaaccgcgcgcagagtactattattgaatcgtcaagaccaacaagtacaacaacaacaccaaaccggtgctggctttccggtggtagccagtatgctgacgagcattctcttaccaatgttaatggacaaattactgccaaaaactaattgataaatagataaaaa

SEQ ID NO: 83515 - DNA, 908 bp, Heterodera glycines
  Genomic contig location: Contig_ID=SeqID_18824; Location=2033..2940; Strand=+
  SCN-specific regions: Sequence locations=1-68,90-289,311-595,617 -622,651-908
atgcgtcacgcaatgcgaatgtttctcgtcccggaggacgtctttcagtcggtatttgttcaaccccaagcagcagcagcagaatcagacggtgccgacggtacaccaattgggcttttgcgctcacgcatccaacaaattgagcgtagcagggagctgaacgaagagcagaaggccgcgcaataccatcaggaattcaaacggctcaacaaactggtgcgcgagcaggaggagcagccgatcaatgttcgacttcagcacgaaaaggagaaagaaaaaaattcagcaacgccgccgccgccgccgccgcaaacgatcgatcattcaacgccaaaaagattggagaaaaacattgtaccatcagcgtttgggttgaggaggcagagacaccactacacacaaaaggcgggggcattatcaaatcgcagacctgcccaaaaacaacaaagaaaagcagcagcagcagcagaaacaccaaacagcagtggaaatggagaaacggaaaaagaagagggtgatgtagatgatggggaacagtgggacgatgcacaatcatcatcgtccacggcgtcaacaggtggtgccgcagcaaaaagagtgctcagagcaagagatggggaagcaggaaaaggaggaggaggagaaacggctgatcgccttcaaacaaaacacaactaccagatgaccaaaaatgcactgatcacacacattcgaaaaaaggggcacagtctgggagtcagtgatcagggaaaggttttgcgcgcagatgggtccgagtttaaaacgagcaacgtggaggcaattgtcagccatttgttgaacagggacaagcgaagcgaattcaaagggccgcctgtgggctataaggaatttgctgaaaaggcaagagaggatccgttgctaaaaaa

SEQ ID NO: 83516 - DNA, 1613 bp, Heterodera glycines
  Genomic contig location: Contig_ID=SeqID_18825; Location=79..1691; Strand=-
  SCN-specific regions: Sequence locations=1-40,62-797,819-875,908 -1298,1330-1363,1448-1613
atgtctgacaatccgaaagaagctaataaagaaatggaaaaagcgatgtaaatattctaaatttgtattcccatgctaatcattttccgttttcagcttcatcgctgccgactgttggttggaggtgttcgatttgcttccgccatctcaacttggcctcggaattgcgatgatcagtcaccgatttgactatttcgttgacgaacatttcaaaacgcgcaaatggaaattgggcaaaatgaaaattcgacgcaaaattggacagaatggcgcaaatgaaatgaaaattgtcaattccgatggaaaagaattgccaatcccacaaaatccgttgccgaacaaagtcatcggattcggaagcatttttatcctgtaaaaaaaaaatgaatttttgtaatgatttgtgccaatcacaatttcatttaattttcagcttcatcgaccaaaatgtgctcacttttcttggccattttcaccgttttttcgccatttgtgcaacgtcattgaccattggcactgaaaatgttcgaatttcggagttccttctgctcaccatttggccaatgctcaagcacaccattcgcgacatgattttgaaccccatcactcttcgtcaaatccgccaattggtcccgtcaatgctcaacgattgcccagcccttcgtattgttggtttggctggtgtcggaattttgcccgaatttccgcccgacgacagtgccaatgcgtcggatggccaagcggtggccaaatggctgttctcgcctcgtcccgacaatttgatgaaggtgctgtatgtcagaattgagaattcagcggtggaccagtggttatctatggtggagcgaatcaaagcggtattattgattgactactaatatttctttttattttattttaattttttgtcttcgttttaggccttttccgctgcttcttctcctgtttatttcgccatttctgttttaattccgccgtcctcttcactttctttcgctgtgccatttaaactgaccaacgaattctccggggagacattggcacttttacaaaaagatgcaaattgttttgtgttcatccgttgtccaattttgcccgatgagagacagcagacgattaaggaattgggtgaacgatggaaccgaattgacatttggatcggagacgacggattcggcgatgggtgattaatagagatcggaattttaggcaccaaaatttttaaaataagcacgaaaaaagtaagtaaaggtataaaaaatgaacaaaaaggcagcaaaaactaacattttttggacatttaaaaaattattttattaatgatttttagggagcaaaacaaaaacaacaacttagttttgtcattttaatgattataattaaacatattataaattcgaataacgaaaatttttaattttaaaatttttatctataaaaaaaaattgattttgcgaaattttttgtacaaaattttcaattcttaggggtgcatttctgaaattttttcgagtcatttcttaggggtttcccaattttgtttcatttttaatggaatttttcggtaaaaaaaagccaaaaaacgcatttaaatcccgaaaaggcataataaa

SEQ ID NO: 83517 - DNA, 639 bp, Heterodera glycines
  Genomic contig location: Contig_ID=SeqID_18827; Location=780..1418; Strand=+
  SCN-specific regions: Sequence locations=1-639
atgactttatactcctccgttatctttttgctgccagttcaatttctgctcgttgtcatcggcgctgtgttcatcatcctcagccaatgctgtggtggcggttcgaagaagaaaaaggtgccagtttttgacccctccctattcacaaatgaaacgctccctttttttcagaaagccggagcagcaccgacgccaacgccatcaatatcggcgagcgtaggatcggaagcgccgtcgtcactgaaaacgcaagagaaaagcgcaagcgccagctcaaaaacaggtggacgaaacaacgaacgatttagggatgagaagaaaaaaatttgtcaactttaagcaccaccagcgaagaaaggcgccgttgcacaaaaaaaaggaccgactgaagcaaaggcagggaaagcgaccgatgaaaagacagtgaccacaaaaaagaaagaaaagtcgagcaaatcagcgaaaggaaaaccgacgagcaaaccaaagccagagcgaactgagccttcagttaaagaagattctaagccggttgcagcggagaaaggagttgaagtgccgcattccatgatgtcgaaaggagactcagttgtcgatgaggaagacgaggtgggctacaccaccaccactgatgtgtaa

SEQ ID NO: 83518 - DNA, 751 bp, Heterodera glycines
  Genomic contig location: Contig_ID=SeqID_18828; Location=5..755; Strand=+
  SCN-specific regions: Sequence locations=1-102,124-429,451-717,739-751
atgcccaaaaagtacaaaaaagcgaaaaaggacaaagttggtcctgcccttcctcctgctcctcccccgtctgtcgaaccaccggccgcggccattcagtacgaggatttgacctctgatgaggatttggactcaaaagacgccggaggcaccgccacttctcaccttgttgatcagcagatggagtcgcttttggcactttcacccgaaaacagcggcgttttgctggcactttctcccgattcggttgatcgcctacttgaagaccaaaatgccggagaggtgaaacaaaatccagaaaaaataatgaaaataattgttaagtctgtgccaataacagcggagtccaatgaaaaggccctcgagtcgacagttttgaatgaggaagacgaatttgtccaagcaaattcgggcgaaaatgacaaaacgaatttggaaattgtcaaaattgtgagtccgcttgaaaccatgggggcgctaattggggtcatttcccaaaaggatgatgaatcggtcgagaaagggcctcaaggttcttctgaaaaggcaaatgccggagagatggaagtggaaggaaatgaaaaggccctcgggtcatcagttctgagtgtggaagtccaaatggacccaaaaccaatggcaaattctgaccaagtcgagaatgagaatgagaaagcggataaaggcgagaatgagcaattttcaaaggaaaattctcgcgaatcagatgaagaggaaaatttcggtggtg

SEQ ID NO: 83519 - DNA, 591 bp, Heterodera glycines
  Genomic contig location: Contig_ID=SeqID_3171; Location=1661..2251; Strand=+
  SCN-specific regions: Sequence locations=1-84,106-275,312-488,518-591
atggctaaggagaaaatttccactaaaaaaaggacccttcgtcttacaacccctttggcgaaggagcgcctacagcgattgcgttttgaaccttttcctgaccaatacgacttaattggattatcgaaaaaaatttatgacgcactacgcggtgcattctttactgatttaccccatgtaaaagtcgtcacttttaaattattggacgcttccgcgcccgcgagcaaagaaatttgggctctaagctcctgggacaaaatcccgtaaattatgagtttatatctaattttttttttaataataaaataaatcaggattgtgatcgagattcacccggagcagggtgattgtgaacagcttgttgcgatgctggcacatgaaatgtgccacggagtgacaagcaaagaatcgcgcgaaaatcgtccgtattcggcgaaagaaaaggccgagcggttcgaccaatgggtgggaataaatcttacaaaaacaaaaaaaaaattcataaaattattttaaaggccaaattggtgcaccaaacactcgggatcgatccctggcgcaaatgcgacaaaccgtaaattaaattattaa

SEQ ID NO: 83520 - DNA, 2392 bp, Heterodera glycines
  Genomic contig location: Contig_ID=SeqID_3171; Location=2334..4725; Strand=-
  SCN-specific regions: Sequence locations=1-238,262-269,291-592,615 -846,868-910,932-1088,1110-1293,1315-1454,1480-2067,2089-2392
atgaatttcctaggctttactctgacaaatgcgggttataaaccatcattgagcagaattgaaattgttcaaaatgaaccaatccccagaaatgtaaaagaagttaaacgtttcttagggaaagccgggttttaccgtcggcatatcgaaaatttttctactattgcagaaccactcttaagtctctcgaggcaatcagtcaagtttgaatggtgagaagcacaacaaaattcatttgacaaattaaaagaattattaggacaaactccaaatttaatttttccaaattataacgagccttttcatatctttacggatgcatctacaacgggattaggaggagtcctaatgcaacaaaacaaaaagttgggaacattttcggcaatttcttactgtagtcgcaccctatcggcacctgagagacgatggccagcagtccaaatagaaatgtgtgcaattatttatgatcttagggaatttcgcccttttatttttatgagtgatatagaattgcacactgaccataagcctttggcatttttactcaaaaaatcagaaacacaccctcatttggctcgatggctaattgagcttcaaaattatcagataaaaattgtacacgttgctggaaaacagaattctttagctgatgcactttctcgtgcagctgaagattcgcccatccaagaaatcgagaacctttcagaaatggaggacataattgagttcccggtgtgtctttccctacgagcacaccctcgtttggtattggatgaatttgtcaacacgatgaccctcagacacgaggatggtaattcctatcaaattgatttgagtaaagaacagaaaaatgatccagaaatattggcattcattgaatttttaacaaatggcaatatgccaccagacttttcggaaaatgaaaaagaccgattttcagccctgtgtttaaatttagtttacgaatcagaggtactttattttaaaacaccctcatcaagtacacgaatttttgtaccaatttcgttaagggccttaattttcgaatcgttccatacatctccattgggaggaggtcacatgaacataaaaaagacactacggaaatgcaaaaaatatttttggcccaaaatgcattctgatatcgtctcatggacacgtcaatgtattacatgccaacttaggcataatcccacccctgcatatcgtgctgaaatgcaactcgcacctagcaataccctttttgcgaaagtcggcttagatttggcaggtccatttccaaccacatcgcgtggaaacaaacatattttgaatataatttgttggttttcgaaatatgtaatatctgttccaattccggatgccaaagcaaagactattgcaaaagcttttctttcaaattgttacttaaaatttggaggttgtactgagctcattagtgacaatgccactgcttttacctcagaattttttaaggaattttgtagtatgttatacataaacaaaacttatgcaattccccactggtcacagggtaatgcggtaacagaaaggtcatttcgtacatttcataatattttatcaaaatacattaccaaagaggaccctgattttgacgagtttttagactttgcatccttttgttataacacttcttgtcattcatccacatccgaatccccgttttttccttgtttttggtcgggacccaattttctgtgtagaccaaatattggatgctcgcattcacagtcaagtccaacaagcggaggaaaccgatttcaaacaaaaattagtcagctcattaagaaaagcatggaaaagtgcagccgatgccaatgaagcagctcagcagaaaataaaagagcaatatgaccgaacagttagacaacctcaaatttgtgtaggagaccgagttttattaagaaattatgcaggtaaagttggaacttctaagaaatttcatctgccttggaagggcatttttagagtgatagaaattgatggcatatatgccactatcgttagctgcatttcgccacaacaaaacccgaaaagagttcacttaaatcaaattaaaaaatgtttcgaaaactttggtcctaattgcaccttgccaaaattaccaatcgacgaggaagagagtcttgataaaatgcatgcaacaaatttggacaatttccctggtcacaatcattttcccaggactaacagacaacctagtaaaaatcctgaacaggaaaatgattcgcaaaatttggccgaaaaaacggattgccaagaagaagatggaaataattcattagacgaatcaattaagcccaaaaagagaccggagtatgccttgagagaccgaaaacgcctaaatcttccatcacgctttagagaataa

SEQ ID NO: 83521 - DNA, 2680 bp, Heterodera glycines
  misc_feature (2564)..(2564): n is a, c, g, or t
  misc_feature (2654)..(2654): n is a, c, g, or t
  Genomic contig location: Contig_ID=SeqID_3172; Location=50..2729; Strand=-
  SCN-specific regions: Sequence locations=1-31,55-70,96-225,247 -625,647-896,937-1022,1045-1692,1714-2013,2035-2156,2178-2575,2601 -2680
atggcaggggaagtaaacacgaatatgggagttttaaatgctaaaattgatacacttgctgaaattgtcaaacccaaaataacaccaaaccaaacttctcatgttcgttttaattcttgcaataatgccaatttaagccaagacaacgaggaatatcttgatccgtttgcggaagacagttttgaacttggcagagttaacactttaaccggaatgattggtcacttagaggtatttggtgaagattcggtgatcgcttttgatgaatgggctgagtggtttactgattatgttggagctgtaggacgaaattggaatgaggatgagaaagttgctcgatttaaaatgtcattaattgggacaccaagacaactttttaaacaattaatccaagcggaggcagctgcccttaactcagcgatcactgggattaggcaaaaattggactcaccccaaagacggcaacttactaaaaggacattggcactttgcaaacagagagaaaacgaaactgtttcagaattccttaagcgccttaccccgcttgttgaaatgacaaacccaacattgaatgataatcaaagaaaagagaggacttgtgaagaatttttggatagaattaaacccaatattggatttttgcttcgtttagtcggtctcaattcgaccaaagacttagaccgaataaaggcacaggccgaggagcttgaggctctgctcttaactgaaaaaggacaaatctcggataatttggcacacactgttcatgcacttagtggacaacggttcggaaaccgacagactgaacaaaacagagaatccaattatcggggaccaccttttgtttcggaagctaatgcgacaccactcaatgaccgttttgccccgcgtaatttcgacaataacaacagaaataacaacggcaataataataaccgaacacaattcaggcgtaaccagagaccgaacgacagaaggccaaattctcaacaaatccaaagccagcggaggtggagtaacagaccaatttgtaatttctgtggcaaacttggacatattgcaaacttttgtcgcaacagacggtctcaatttatcaacaatagacctgacccacaaccaaacagaggcagaaatgggcgcaatgctaattatggcactgtcaattcagttgatgctatcccatcaaatgtttctgtcctcgattctgaccaattataccaacagcccttgggcaattcagtcaaaagagaagatgctaatgcattgaatgcaattacaactgttaaaagtaaaccaaaaatcgagcccaaaggagttatgaatgactcagaaaactgcgaaattccagtcattgattcaaaaaatatcaaaccaccttcaccccaattaaaagcttcaagctgggagggtattggaccaaaactcacgaaatttttaatgctccttttctttattgttatcatcaaatgtgtaccggtctcagtagaggcatcatttgatgtcccaattccaaaaaacccaatgatgtgccaaactcaaattgaaggaacggtttggtctcttccatcacctactcaatgtcccactcctcttttcaatcaaccgaagggctcacgaaaacaaaccatttggctttataaaccaaatgcctttcagtatgaggtagaagcttgggcgtgccgaaaagttcgtaaaaatattcaaaaacacacttccctcacaaatattcccataattgagaaactagactccgaaatgttaagcatggacagagaagaatgccaacagatgattaaccaccaaaagtgcagttttggcacacttaaacaggaaggtgaactatttcacactgacaataaaatcgatatgtctcctcgggtttggctcttcggatcattcagttggatgaaggcaagcagtgaaaattgctacctatttaaaacgagaataattaataagttcgggagcccatcaattcaaaactcaattggagactccaatcactgctcatttgagaaaggtcaatgtttcttagaagacaaaacattactcctttggaattcctcaatttcgaaaaaatgtgagtatttgccgctaggtccattcaaaggacaaatgcttggcactatatttattgcagacaatgacccaattcttttaacttttgaggaaaaaccaaaaattataaaagcatgtaatacaaatttaactctctctcaccaaggttatgcctttatcaacaaaacgacaaaacgaaaacgcaccagacgagcccaagaaagcattgtgaccgactcacagcttcagacagaactttcctatttgagttggcaaatgactgaagctcttcgcttttcatttgtccaagctttctttgctatctgtgagcacatacatgagatgaaattatgggccttgtcgtccgccttgtcagaaccaacaattcttgctcgaatcttgttcaacacatcccttgtctatgccaaaaatttaggaccaggaataatcaaagtttggccatgtgtcgaacttaaaaaagacgattttaattttgttcctcttgnggatgccagtcaagaaaataaatgttttgaaaatgtgccaatagcattcaagtctgatggggttgaacatatggcattcatagctgctanaaacatggaagtagtggcacactcgc

SEQ ID NO: 83522 - DNA, 644 bp, Heterodera glycines
  Genomic contig location: Contig_ID=SeqID_3172; Location=518..1161; Strand=+
  SCN-specific regions: Sequence locations=1-35,57-178,200-499,521-644
gagttaaatttgtattacatgcttttataatttttggtttttcctcaaaagttaaaagaattgggtcattgtctgcaataaatatagtgccaagcatttgtcctttgaatggacctagcggcaaatactcacattttttcgaaattgaggaattccaaaggagtaatgttttgtcttctaagaaacattgacctttctcaaatgagcagtgattggagtctccaattgagttttgaattgatgggctcccgaacttattaattattctcgttttaaataggtagcaattttcactgcttgccttcatccaactgaatgatccgaagagccaaacccgaggagacatatcgattttattgtcagtgtgaaatagttcaccttcctgtttaagtgtgccaaaactgcacttttggtggttaatcatctgttggcattcttctctgtccatgcttaacatttcggagtctagtttctcaattatgggaatatttgtgagggaagtgtgtttttgaatatttttacgaacttttcggcacgcccaagcttctacctcatactgaaaggcatttggtttataaagccaaatggtttgttttcgtgagcccttcggttgattgaaaagaggagtgggacattgagtaggt

SEQ ID NO: 83523 - DNA, 612 bp, Heterodera glycines
  Genomic contig location: Contig_ID=SeqID_3172; Location=2372..2983; Strand=+
  SCN-specific regions: Sequence locations=1-112,134-263,289-304,328-612
caattaatgacattttaaatcgagcaactttctcatcctcattccaatttcgtcctacagctccaacataatcagtaaaccactcagcccattcatcaaaagcgatcaccgaatcttcaccaaatacctctaagtgaccaatcattccggttaaagtgttaactctgccaagttcaaaactgtcttccgcaaacggatcaagatattcctcgttgtcttggcttaaattggcattattgcaagaattaaaacgaacatgagaagtttggtttggtgttattttgggtttgacaatttcagcaagtgtatcaattttagcatttaaaactcccatattcgtgtttacttcccctgccattttatttaaggcccttgtgtttgcatatgcccttcgatttacaattctaaatgatctatttacagcttcctctaggcgtagaacttctatgtgggctctttccaaatcgggaacctttaccgacgttttaccattccaaaaatttcggtcaatgattgttatgtttatttcttcatccctctcttgactggtggccctagagccagtcttttttgagtgtgacataagccacgaaaatgtgcactgattgctgt

SEQ ID NO: 83524 - DNA, 144 bp, Heterodera glycines
  Genomic contig location: Contig_ID=SeqID_3173; Location=16..159; Strand=-
  SCN-specific regions: Sequence locations=1-46,112-144
atggataaaagtgtgccgtgcaatgagcgcgctaaaggatatggaaaagaccaaaaacaacaacaacaacaaaacgccaaaaaagggaaaaattcaaaaagaaaacaaaaaggagctaagaaggaacacagaaggacaaggata

SEQ ID NO: 83525 - DNA, 467 bp, Heterodera glycines
  Genomic contig location: Contig_ID=SeqID_3173; Location=505..971; Strand=-
  SCN-specific regions: Sequence locations=1-257,301-434,465-467
atgtggctatttgtggtgggaaacattgggcgttcggcagtgggggatgggctaatccaattcgcaggccgttttcgtacgagcacaaattttttgggctataacttttttcttcgtcaactaattaggaagtgcaacttttttaagcagggcaggcaggcccgaaaggcatgcgagtctcaatttttcagaaaattctaattgaaaatttttcaaaaaaagtcattttatatgggtatcgaaattttcgtagtgcgatttaaaaaaaaatacaaaaatttaatatttaataattttttacagtgcaaggaattagataaaaaagcggtcggtgattttctaggaattctcagaaggatggacaagatacgaagcattatagggatagagcgcgctgattggctaccgcagtatgtttaaatgaaaataagagcaattaaattaaattaattattaaattaaataaa

SEQ ID NO: 83526 - DNA, 1170 bp, Heterodera glycines
  Genomic contig location: Contig_ID=SeqID_18833; Location=2019..3188; Strand=-
  SCN-specific regions: Sequence locations=1-45,109-436,458-479,501 -604,632-732,754-1054,1076-1170
atgatgattttggttaaaaaggttagtattaaatctaaatccaacatttaaaatatttgatttaaatctttcttattttgttattttattcttttaaatgtatatattcttgcattatatccttcaatattcataataaaataaattcgttgtaaattcattcattaaattaaatttcattaaattaattcttaaactcatcatttggatcaagtttttgttcaattttctcaatgatattttaatttaattgcattatttttcaaaaataacgtgcacatatatttatccaataaaattcttttagaaatttaaatgtttttttcctaaaagcaaattttttgttatataaattgcatttttatttactattttagatttaattttctgtcaccaaaatatttaagaaattgctttgaatcgtcgcaaaaattttcacttttaatttgaaaatttatttgtgctttttgaactcacataaaaatttgaaaatttcttgtaaaattagcagcccaacccaatactttaagttaatcttggtcgtacttgagttttattttttgcgtcaataacattcttcaagtacaagaacatacacaaacaactttagaaattttctttacaaaattaaaaccaaccataaaacttctttacactttttttatattttattgattaccataaataaaaaataagctacgcaaaaaagcaaaaaagaattgaaaaagtgtgaaattacaataattttttaatgagactattaacttaatatatgtttatttgattaaaattacgaaatttgaaaataccaagtttagttttagtattagtcaacgttataaataataataatagaaatagaaatggtcaaataaacaaataataattaatattgaaaatctagaaattttcatccgaaaaaattgcaatattccgagaacttgaagaggaacagatattggcagaagaaagaggcgcgagggtcttctgcagaatgataaggattactaatgattttgatatgtaaccaaaaaaaaattacgatataatgtataaacatatagttttatattaaattacgataaacttataatcacaaaatttatggtatttattcgtgttcgaaattgaataatctaagcttttctagaacatacttataaaaataaa

SEQ ID NO: 83527 - DNA, 1173 bp, Heterodera glycines
  Genomic contig location: Contig_ID=SeqID_18834; Location=1815..2987; Strand=-
  SCN-specific regions: Sequence locations=1-116,138-222,244-503,764 -830,874-1085,1115-1173
atggtttttaagggaataactctgatttgtgaggtggtggcgcagagcgtgactgggcaatccgacagtaaaacacacaaaaacgatatttaaatgccatcgccgcatgggaccgattgtgccataatccagaagacggcattgtgtgcgagtaatggcaagaaaaagcttttatattcttcaaatgagcaaccatcatttatgaaatgccaaacttaaactaattagcaatgaaataatgttttagactacattcgcacttttttatttgcctattttccttttttctttatatggcacaatcggttcccttcagcgatggcttttcttatcttttcgtgtgatttactgtccgattgtccgggagccgtgcggaaggataaaaaaataaaaacaagaataattcaaaaaatgcatgttctaaatgtgttgttaatatacgcaaaaaaatctctaaattttgaaatttcaaagtcaaaatctcattgaaatgattgaaaatgtttttttctataaaaattattttaaattaaaaaagttaaaaatttttatttttttcctaccataaacttttttgttgttatttttttttgttgttgtattaaattaattgactcatttattaataaatttatatattataaagttaatttattttcgtagaaatttattatattatctttaaatttagttaaataattatatttttacgattttattttgtatattatttgaatacaattaattggtttttaaatttattcacgatgaaataaaaacaaaaaataaactgataaacaacccagaatttttagaaaaatatccaaaggaataaaaattcattaaatttaaatacttttttcattaatatttcccaacttaaattgtattttcgatttattttattaggcatatttttagagaaagaaaaaaactctcatcattaggttagttgagcccggagttttgaaagtaccgggcgggcccgtgacagggcttagacaattgaccgggtccgggccgtgacctaaattcccaaaaagtctatccttagaggtgtttctttcgctttttttgcgtttttcttgtgaaaatttccaaaaatttccaaaaatgtcataatatgcatttattcacgaaaaccccagaaatactcactttaagtaaaataaa

SEQ ID NO: 83528 - DNA, 952 bp, Heterodera glycines
  Genomic contig location: Contig_ID=SeqID_18836; Location=1044..1995; Strand=+
  SCN-specific regions: Sequence locations=1-208,230-359,384-851,893-952
atggccgaatttcgcgccgcagacaatttcgatggacttcgagttggcaatggtcggtgcggtccgaacagtgcttccggcatgcagtgtccgctactgtttttttcatcttgtccgcaacatgaagaggcagatcagaatccttggcctcacacatgtcaattgaatttttcagatgataaatttttttcttagtagtttaggcttacaacactgatcctgctttcgccgagaagtctaagatgatcacttcattggcctttctgcctgtgcaccaccttcaaaatagccttaatgttcttcaaggacaaattccaccacaacttaacggcgttttcaattggttaagtccgaaggcgaattttataattatttttatttttctaggtttttggacaactacatgggccgaatgcgtttcaatgttccaatggcggcgcctctgttccacccgcacgaatggaatgttcatcagcgcaccttagatggtgctgttcgtaccaacaacttcgccgaggcattccatcgcaaacttcagcggcaatttagctgcactcatccaacaatttggcgcttcattgacacgatcagatgtgagcagaaggcaattgacgcggacatttcacgttgtgtcatgggagaatccgctccacaaaagaaaaagaagtatcgcgaagccgacgcacggattctccgactcgtccaccgttataacgaaatcaataacattcacctccctcaaaatgatcacaattatgccaatgccaatgtgaatcccgaaaacattatcaattttctcactggtgtttcccgaaactatgaaatgcgaccttagtttgttctgaaatttgttattttttgttatatttttataaaattttaattattttttccgtttgatgcacatccgaccaaactgacaaattattgtagaagatactagccgcaagaa

SEQ ID NO: 83529 - DNA, 134 bp, Heterodera glycines
  Genomic contig location: Contig_ID=SeqID_18836; Location=993..1126; Strand=-
  SCN-specific regions: Sequence locations=1-134
atgccggaagcactgttcggaccgcaccgaccattgccaactcgaagtccatcgaaattgtctgcggcgcgaaattcggccatcgttccaaaagaagctgtaacatacgcgtataaattgcggcacacttcgat

SEQ ID NO: 83530 - DNA, 103 bp, Heterodera glycines
  Genomic contig location: Contig_ID=SeqID_18836; Location=1917..2019; Strand=-
  SCN-specific regions: Sequence locations=1-82
ttcttgactttttaatttttttatttcttgcggctagtatcttctacaataatttgtcagtttggtcggatgtgcatcaaacggaaaaaataattaaaatttt

SEQ ID NO: 83531 - DNA, 55 bp, Heterodera glycines
  Genomic contig location: Contig_ID=SeqID_18836; Location=2612..2666; Strand=+
  SCN-specific regions: Sequence locations=1-55
gaaaatattttaacgcagaaatgcgttttttgagctcctttcttcaaaacaattg

SEQ ID NO: 83532 - DNA, 111 bp, Heterodera glycines
  Genomic contig location: Contig_ID=SeqID_18837; Location=1105..1215; Strand=-
  SCN-specific regions: Sequence locations=1-111
atggcacattggcaaaggcaccgaagtgcacgaaaacatcaccgcttcgctgaggggccaattgaattctgtccaaagtgtcgaaatgcattttccgatatgccattcaaa

SEQ ID NO: 83533 - DNA, 368 bp, Heterodera glycines
  Genomic contig location: Contig_ID=SeqID_18839; Location=2113..2480; Strand=+
  SCN-specific regions: Sequence locations=1-38,69-160,182-194,216-368
atgttagcaatgtttgacctgataaatgccatagacaatcaacaggctattcagaaaaatgaaagaaacaacagcagacaaaaccccaaacgtaaaaataaggaactcggacatagttagctaaaaaaacataagaaactaatttgtataaaaaataatatctaccttttaatttttctttcagctttaactataaaactttaaaaatagttaaaatttaggattcaagagataatttgtcattttcaacaaaaaaatcaaaaatatttaacaatcaacaatttattcaaattaaacactcaaataatcaaatgaattgacaattgatatttcaaagtcagtggcgtttattgagccatcctaaaaaa

SEQ ID NO: 83534 - DNA, 514 bp, Heterodera glycines
  Genomic contig location: Contig_ID=SeqID_18841; Location=1046..1559; Strand=-
  SCN-specific regions: Sequence locations=1-170,193-194,218-277,299 -459,484-514
atgtcctccccctctccccgttttcacatccttcttctgttggtcatctgctgcttttcagcctttttgtgtttggcattggcccacgttgttggcgaaagtcaaattgacacaactggtattcgcgctcgtcgtaagctctcttcaatattttggcacattaaattgttaaaaataaaatttcggctttttcaacattcactaaaatgatcacagtgatttctcgataattaatattttccctgacaaatttgaaccaaaatttcaatgctttcaccataatttgacactttacgccgttattaaaactaagatttccattgtccccattttaattctttgcctttataattgtcaaaattaaagcagagattgttgaaattttcattatttaggccaatattatgaccaatggggcaactattggagcggtggcaataccaattggtggaactggagaaagaaataaatggaagagaatgggcgacgaagtgatcactaatgatcaaataaa

SEQ ID NO: 83535 - DNA, 1052 bp, Heterodera glycines
  Genomic contig location: Contig_ID=SeqID_3174; Location=951..2002; Strand=+
  SCN-specific regions: Sequence locations=1-788,819-1052
atggaggaagtcgcagacaaattgcgtcaaagtgcgcttcagtcgtccaacgctaagcgaaggcatttgtcattggcagaacaagcgatggaaaatgaggcggagatggaaatgaatgaacaaccgtcggtaagtgcaaaagaattaaaagtcgaaattggccaacaaattgtcatgcaaaaaaaggaatgcttaaattgttccaatccgccgaattatttatcgaacatcttatttttgaattattgagaagctttttaaccaaaggctcacaagaactgggcgtttcaagagtgctctgaccacgaatttgggctcagatttgtcataagattgtttaatcggtatttttcgaatatattttctcgaaattaggattctattttctttaaaaactcatgaagaaaagttttttaccaacaatttctcggcatttctgctgacctccctcccttttttcatgtatgattgaattttcaaatgtttgagttgtaattaattacgagtcatttttttttttattagtttccacaaatctctataagattggttggagaaaactgcttttgtgataaattaaaaacttgcataagttctctatcatttcaaaaaaaaaaaattcatcagaaaccgactggtttgggtctaaatggtttaaatcggttttccggtgatttttttttttgccaacaaaatcccggtttatttttatgatttaaaaagatatcaccaaaaaattattttttgagcatttcgaactaaatttgctgttttaagattttggggagaattttttaaatcataaaaaaaaaattaatgagctaacattgtaagaagttcataagttttaattatcaccaaagctatggaaactaataaaaaaacggctcataattatgttatcaatataataaattttgtatattttcaagtctgatgacagcctttcgcagtcggttgtctttgaatgccaaagttgcgacaatggcaaaggccgtgacgaggacgaaatgggcataccgcccccatcaaaacatggaaggacggagtga

SEQ ID NO: 83536 - DNA, 2438 bp, Heterodera glycines
  Genomic contig location: Contig_ID=SeqID_3175; Location=307..2744; Strand=-
  SCN-specific regions: Sequence locations=1-55,77-1256,1280-1577,1602 -1613,1673-1712,1737-1955,1978-1987,2009-2135,2157-2401,2423-2438
  Gene Ontology: Biological process=jump response
atgactgtggttgaccacgttcagctacgtgcaaaacacttattggatcccaatggaggaggacattccccgggaggtttattcccggcgcaaccgacagattggatactatcaatgggtacggtattccttccgtccggtgacagtaccccgaaactctttggccaattaaggtgccatttattttggccctccaggcgctgttcttttacattccgtgcattgtgtggcgaggccttctctattggcactcgggtcagtgccaaaagaaattccaaagtgccgaactcattacgccatttgccaccaatgagcaggcatcaacctgcagggattagtccaaatggcatgtgacgcgcgactgatggaccccgagataaagtcgcggacggtgtacaccatggctaggcacatgcaggaggaagtgcatgttggtcaagtgccattgccttttgactctttgattttgcaaatgccattgacctcctccccccgcctattcagctgacccaagtgcaacggcaaagtcgcaatcgtttgcccattttgcgacttggcaaacactgtggatgttacgtcactctcctctcaattggcataaaagtgagcagtcagtgagtgaatggcatttcaaacaaaatgccccattcagctcctttactccacaaatgttatggtccaattttggtacgcttttccttcgtcacttttttgcttttttccaatttcagcttactcaaccacattttgggctcgcgcgatttcacttacggattcactcttctgagagacattgtcaacgaaatcgaatgggagaaaacgggtgggttaaacgagggaatgggccaacaccagcagatgaaccattggcccataactttattggggttgtccttaaggggtgcgttttgcgtcccttttgttgtgccttaggctcccgactttagaggaggaggaggaatacgtttctttttggcattggaattggcagaaccgctgatgaagataaacgtgtcacttcggtcgccccccccacccccgggggtatgtccatccctcgcctctctttgggtccgtccgtccgggagccggaaaatccgacactggaaaatctgacaccggaaaatccgacactggaaaatccgacacaagcggaaaatccgacaccgatggaaaatccgacacaagcggaaaatccgacaccgatggaaaatccgacaccagcgggagacccgacactggaaaatccgacactaactttaaattaaaacaaaattttagattgtttgagttaatatctgcctaggcttagcaagttcttgaattgaatttgccgagaattgtttttttgcgtggattttttcacgaatgatctgatcaacttcggttgcctggggagtattaggtccaggtgaatatgaagaatatcattcattcatatgttaaaaattgttaagcactatttacattctcgtttcccaaggatcacagagattattttatttttttgagataatcaaaaaagggcatacaaaaaatattcatatgcccacctagatagaatagattatggcaataagaatatttattttaaataacttcagtactgtaactttttatatgtattttaaatattaactcatagaatcaaaaattatttttaaaatttaatgttagtgtcggattttcctgtgtcggggattttcctagagccgtccgtccgtccatccgtccgttctgttcctttttgtcctccggggcgcgctccctccctccgtcctttccccgctgttcacatctcagcaaatcctttgtttttctagggatgttcccacgtgtcactttgtgcgactttgaggtgcgcgtcctcggcaacatccacaggcatactgtacaatgtgtgctcatgatcaagtacggtcattctgctcactcatctccctcttttgcaatttacatttatacagcatgttcaacgaaaagatctttctgtttctgtggttttggtttctcaccgtcggctccgttaccgtaatccatcccttttgtaccgtaatcagttccttttgtccgcctttttgcaggtcaccaattgtctctattgggtctacgtgatgctctacccgaaaaaggtgctcctttggggtttctctcatcacaggttcggcatttgtttgctcagagtgtcattttcatccgcaaatatttgcgagtgctcagcgaacatccgcaaaaaccaatggccgacgacgtttcgctgcgcaaattcaccaacaattttctgcgcaaagacggagtgtttatggcgagaaagcattcattagactaattgtaagtttaatcatgaattttacagcttcggatgatctcaacgcatgccggagaactgatgacttcggaactgattttagcactttggaacgacttcaacaacatcg

SEQ ID NO: 83537 - DNA, 2385 bp, Heterodera glycines
  Genomic contig location: Contig_ID=SeqID_18842; Location=33..2417; Strand=-
  SCN-specific regions: Sequence locations=1-744,766-929,951-1183,1205 -1998,2020-2126,2168-2248,2270-2304,2327-2385
atgggttcaaaaaagttttatacagcaatggacatgcaaagtggtttcatgcaaataccaatggcacctgaggacattgaaaaaacagcatttatctcacaccttggaattaatgaatttataactatgccttttggtttaactgccgcaccagacacttttcagcgtgtaatgaattcccttagaagacgcttgacagcagcaatgcttatttatttagatgatataataataggaagtgaaaatgaggaaattcacctaatagacatagaaaattttttgaaactcttaaaagaagtcggacttaaattgaaaattgaaaagtgccactggggaatggccgaaatccgttacctaggattcttgctaagtgaaaaaggaattcgaatggaccctaagcaagtacaggcagtccaaaattttagaccaccgaaaagcctaacggaattaaaatcgttgctcggtgcacttacctattttcgaagatttattaaaaattttgcccatatagcaaggccactccaaactttaacacaagacaaatttgagggaaaaatcgaagaaaattggggaaatgaacaagaagaggctctggaaacacttaagaaaatgttgacttctgccccggttttacaatccccaagatttggtaaaccgttcataattgagtgcgacgcatccaaaaaagcaattggagcggtattactccaagcaaatggtccagtcgcatatgcttcgcgcgctttaaacagacatgaaacaaattacccgtcaatcgaaagagaagcattagccttagtgtatgcggtcaaagaattttcgccttatattgttggttcaggcgtaactaaaaccattacggattgtagcgcactgacgagcatgatgaaagccaaagaattaaaagggcgactagagaaataccagatcactctccaaagttttgaccttgagatcgtttaccgccctggcagcaaaaacaaggcggccgattttctttcacgttataatataccaggcaatgagtccgaagacacaaacaaaaagggtaaaaaagaaaacaaaataaaaatttcaagtacagaaaataaacccaatagtgataaaaatagtacaagaaacggacaaacggacgaaagtagaatttctttaatgcaaataattgatgctcaacgtaaagtcaaagaattagtaaaaatattttatatcctgaagactggacaatatccgaaagaaatttttaaatggaaaggagttatgacagattattgcctattaaacggagcaatttactttcaaaaaggaaaagaaaatgcagaaaacccaaaattggttataccctatgaattaagacaaaaaattttcaatgaaatacataatgaaggacattttggttttgaaaaaacttggttcgaaattaaaaatcgttttcattggattgggatgaaagaggacataaaactgttaatcgatacttgtgaagcatgccaaaaaagaaaaattcaaccaggaaatgttaaaagtgctcccagtgtaccaatcaaaattgccaaagggccatttcaacgtattcattgtgatttaatgggaccactgaaaaagagcgaaaatggaaattcgtatatttttctggccattgacagctttacaaaatggataatgggtaaggcaatcccaaaccaaaaggcggaaacaattgtggaaacatttgtggaaattatggtacaccaacactctacacctgagattgttgtaactgaccaaggaaggctattcacctcggaattatttagtgatctttctaaaatttatggttttgagcatcagacatcgactgcctatcaccagcagtcaaatggtcaaatcgaaggctgtatgagaattatggcaaacattatttctcaattagttaatgagaaaggaaatgattgggataaagctctcccacatgcgatttttgtttataattcttcaatacatacagtcacaaaatattcaccttttttccttttgtatttgcgtcatccaaaaatgccaactgatcgcttgcttaaactccctagccaaaacgaagtaacgtctgacatttcaatttacactcgaaagcacgcggaaaatgcctcaagggcttgggagacagcaagagaaaatattttaaaatcacaaattacacaaaaggaagagaatgataaaagcagaaaagcggaggagaaagaatttgaaattggtgaattgttactgctcaaaaaagaagttttaaaacataaatttgatcagcgatggtcgggtcctttgcgttgtgttggaattgataaagacagaaaaaatgtcattttacaacaaattgaaggaaaaggcaaactaaaaaaagtccatcatgaaaaa

SEQ ID NO: 83538 - DNA, 1232 bp, Heterodera glycines
  Genomic contig location: Contig_ID=SeqID_18845; Location=89..1320; Strand=-
  SCN-specific regions: Sequence locations=1-112,141-336,359-719,741 -810,833-895,926-1232
atgaaaatggatttgcgcaaactgatttgggacgtcacagttatggtatgtataaaaagaaatacaatttataatagggatcagtttaacaaatccagctttactggcgcaattgttttaaaatttttaaaaattgggcttaagcctcgaaaccctctgggagcaaattctctgacaaaatttgtcggagatagcatgagaaaatcgagtaaattttcataaaaagagttcagcaaaaaaagtcttagtaactcaataactttttttaggcaacaataaactaaattttcgggttagaccttcccaaatttttttttttgagggacaatgccttaaatttttcccacaaaatttcccacaatttttttcagatgaaggagcatccgctgttgcgcatggcgcacattgcaattttgtgccaacgcgtggacatcttcacggacgacgggctggcctacctgcaacggtttaactactccgtcaccgacttggtcaaagtgacatgctccccggagggcttctacccgctgatgttggccgtccagacaaaccaggactccattgtccgctttttgctcaagcatggggctgacctgaccgcgcatgaccacgttgggaacaatgcggtgagtcggacaacaaatttttttttgtaatttaaaaggctgtgtgtttaggggcacgacactgcccccgcccaatgccgtttctcatctataaattctatttttagttttcttaatctcttcgaaattttgtttagtaaaaagtcttaaaaatttacggttttttggatgactgggagtaaacatttttttaatttaaattttttgcctgtttaaaaaggaaactggaggtcatatgttaccgccgataggcggcacttggaaattggaaaatttaatatttttatatagaaaattttcgttttttttgtaaaatcgaatttttgcgatttactttttaaatttggtaacatcggtgggaatggcagcacatcctcaatattttattgcttttttcaaacaaatttcacatatttttcccatttttagcttcactatgctgcccgggtgtccacccaaatgttggagacactgcttgaaaaggaggcgggcaaggcgttgatcaattcgcggaacaatgcgggcgaaacgccgtcaatggtcgcgctgcgggcggccagcccgttgtgcatgaaaacgctgttcaaccacggggcgagctgttga

SEQ ID NO: 83539 - DNA, 422 bp, Heterodera glycines
  Genomic contig location: Contig_ID=SeqID_18845; Location=1..422; Strand=+
  SCN-specific regions: Sequence locations=1-422
aaatccccaaaaaccccacatactccaggcgtgctgcccttgttggactggatgagttcgatgagtgggtttttgtccgccgatttgttcaacagctcgccccgtggttgaacagcgttttcatgcacaacgggctggccgcccgcagcgcgaccattgacggcgtttcgcccgcattgttccgcgaattgatcaacgccttgcccgcctccttttcaagcagtgtctccaacatttgggtggacacccgggcagcatagtgaagctaaaaatgggaaaaatatgtgaaatttgtttgaaaaaagcaataaaatattgaggatgtgctgccattcccaccgatgttaccaaatttaaaaagtaaatcgcaaaaattcgattttacaaaaaaaacgaaaattttctatataaaaatattaaat

SEQ ID NO: 83540 - DNA, 1210 bp, Heterodera glycines
  Genomic contig location: Contig_ID=SeqID_18846; Location=135..1344; Strand=-
  SCN-specific regions: Sequence locations=1-90,112-221,246-451,475 -749,807-856,878-903,925-984,1008-1030,1061-1210
atggcccaattggcgacggcaccgaagggcgtgttgttcacggcactttgccgaccgttgagaactaccgtattcactaccgtacgtgacgctgctgctgcagctgtccgaattacggtggtcgacgagagaagcaccgacccggacacttttcgactttggttttcgccggctttgcaaattgtgcaacaatgcacaaagtgagaaatggcattggcataattagcaaaaattggcatttgatttgatcagccaatctgctcacgtgtctgatcagtaaagaacggatttttacacctaaatatgctaaaaaaatgccaaaaaggatactaaaattccaagaaacccacctaaaattggcgctaagtaggtggaaaaaacttgtcgtgttgaaagatgccggcactacgaaaaaatttagagtttttctgggaagtttttcgaaaattgcaaaaattaaatttaaaaaaaaaactattttcaaccattttggcgatttgaacaaaaatttaacagaaattttattaaaaaatcccaaattttcaatcaaaaatttgcctaaatttaaaatttcaagactaaattgtttaaaaatccataaaaaaggaaacgattttggcattttttagcacctaaaaattccatttccgttaaaacagtgccgaattccatctgagccgcttggtcccaaccgccgtcacttcttccgatttgccatcactttaccatctcatacacccgtaaattggaaaaatatttatttaaaatgaatttaattatttttaaaataaattttttcattttttgtaagaaattgtgcacccacgctcacgaccattcacaaaaaatgtgcgtaaaaattcataaaatttaatttaacaatttttcaactaacccattcagttttctttatattttatgaaattttttttttgtataatgggtttttaaaatagaaatcaaaagaatagatttaagaataagtttctgagttttaaaaacttctcatacaataaaaattagatagaacttttttaatgaaaaaaaaataataattattgacaggttttaaatgcaaaaaaaaaaaaatttgtaaaataagcataaaagtcggtacttgtaggttttgtcacccacctgaaattttttttcaaaaattttttctaggcttattttttatgctgattacgaatctgacgtttatttttaa

SEQ ID NO: 83541 - DNA, 734 bp, Heterodera glycines
  Genomic contig location: Contig_ID=SeqID_18847; Location=136..869; Strand=-
  SCN-specific regions: Sequence locations=1-389,432-470,493-734
atggcactttgctgtgtgtggattcgaaagcatcatgcgctcaacggcacaagtatgcatttggccaaattggccaaaatgaaattttattttttgtttttttgcaaagttttaccctcgctcaaaccgaaagtgccatccgtggtaaaccatcatcttgcagccttacttgccgaccttctccatgatcgattcctactcgtgaccactgatcatggcaaactgatcactctgagcgacaatttccactccgacccaacatttagcactgtaaatctgatcactcattagcaacgagaacaaattatcgattaaacattttcctgatctaccgactctaataatttgagattcgtcgatcgctagaggaaaggggcagattaagttccaaaaattttaaaaatttaactcaaattttcaaaaaaaaaattcctttgcggcgcttaaaaaaaactaaaaaaagattgaacacaagaaaatatttcagttaatggttttggtgattttttttttgttattttttagaaggttatttttttaaaaataactcattattgatcaaagattctaaattaggcatataaatgcaaaatgtggcatattttcaggacgaatttgttgcccaaggcgattcattatacgatctggtcgatccccgggaccatcaaacattgtcacacacattaatcgaagctcaaaatgccaaacccgcggtggcatttgttcgtaattga

SEQ ID NO: 83542 - DNA, 1320 bp, Heterodera glycines
  misc_feature (1283)..(1283): n is a, c, g, or t
  Genomic contig location: Contig_ID=SeqID_18848; Location=329..1648; Strand=+
  SCN-specific regions: Sequence locations=1-88,110-269,304-363,385 -638,703-1223,1245-1320
atgtatcatacagtaattttactgatcatttgccatctacttcatacagtaatctcgctggcttctgtgctcgtttcatcgccgtttgataatttccgaattgagtgcccacagtcatcgggcgcacaacggttgtcaattcgtatggtcgaatcgcaaggccagaagcgccaggacactgtattcgtgctcagttgtcagcacattgttgaggtaatgtgtagtacggtatacggtagtttacagtgagaatgggtggcagtttttccaaaataattaattattttaaatttcttaataattgcaaatctctgtgaaatgtgcaaatcaggagtgggtttgaggcttactgcaccactcttcttaaaaattaacacaattttttaaaattaatcattttgctaaaaaatttagaaataaaagaggaaaagtgcaaataattttaattgctaatctttaagtcccgctttacatttgaaatcatttaattcttaatgtcatcatttcaaatctattaaaccaaaaagtaattagccgattatacaatattttaaattcatgaaaataaaatcagttatattttgcaaaatttgtcaagctttatccatggctttgtcttccacaagaaagaaaaaaggaaatatacaaatatttttaattaataatgaataagtcaattttttttattaaaatcatttaatagttaatgtctatcatttatcaaaccaattaataaacagtccccaaaaacaattagccgtttccataaaatgattgaaaataaccaaaatttttcaaatttacagctttatccatggcttgatcttccgcaagaaattgctgaccaagaacgcgaagattgtcgttacactaaacaatttgacattttgttggagcaaaaatttgatttgacgtgcaaagagcatgaatatttggcaggaattgctcgactggccgataccaggtcaattcaacagcgggatttgttaatagattttgtccaaataatgactaaattttgcgattatgagtttttttttaaagaaagttaagcatttttcagctctgatccacacagctaggaaattttgggcattttctctcagtttttaaaagattttcgccaaaaattgataattttttagattttaagaaaaatttcgcgaaattttttgggaattatgatgaagtagatatttgaggggtaaaacaaaaaaaattgaaaattttttacaattatttccccctcaatgaatctaaaaatctttgggagcccctattanaactaaaaaaaaaaaagaaatagcaaatattaaaaaa

SEQ ID NO: 83543 - DNA, 278 bp, Heterodera glycines
  Genomic contig location: Contig_ID=SeqID_18849; Location=866..1143; Strand=+
  SCN-specific regions: Sequence locations=1-48,98-278
atggcaaagacaacaactcgactaaccacaacggcacagaccaccacttttggctggtggctaaacaaaaatgatgaaggtgtaattatttaaaattattgtaattgatgattttgataaattaggacaattagcaacgaattttcagacctataagtgccaaaataagaccaaaaaaggagcgaaaattgtaaaatttttgatttttacatttttggacaaaattatttatttatagtgtttatttttcatttttttcattttttaaggaattttga

SEQ ID NO: 83544 - DNA, 306 bp, Heterodera glycines
  Genomic contig location: Contig_ID=SeqID_18850; Location=117..422; Strand=-
  SCN-specific regions: Sequence locations=1-239,261-306
atgtccgttctgctgctctcttcccaattttccgtcgctgttttgctaattgcctttgcctcgtctatgggtttgtcaaatgcgcgaacaataatcgccgccgatgggtctttcggcgatgaaaatggccaattttccaccccgaatagcttaatcgattcgtacgaaaggaatattccatcacttgtggcattaatgagggaatttacggaatcaaaagaaaggacaaagcaaaaagccattggaaaagcacaagagaaggaggaaaaacggatggaggagggaaaagtaaaagcgggggatgaa

SEQ ID NO: 83545 - DNA, 718 bp, Heterodera glycines
  Genomic contig location: Contig_ID=SeqID_18850; Location=1441..2158; Strand=+
  SCN-specific regions: Sequence locations=1-60,113-333,461-718
atgtttaattattttttgctttttcttctcctttcaatcgctttcatttctttgagtaggttaattaattattattaatccaataaaaaattgacatttaatattttaatttcagtcagtttttctgagcaaaaatcattttttacaaaagttggcgatggtttcaaaaaaaccgctaataaaattggcaaaggatcgcataaaacgtggaacaaagcaaaaggaacagtaaaaagaggaccaaaaaaagcatgggagaaggcgaaaggaacgatgaaaaagggatggagaaatgtgaagaggaaagtgggatgagaatgaaggaaaagcggaagagagaaaaggaagaaaagtgaaaggaagagagagagagagaggaaaaggaaaaacggaagagagaaaaggaagaaaagtgaaaggaagagagagagagagaggaaaaggaaaagcggaagagagaaaagaaaaacggagggaggaaaaggaaaagcatgatgtaatttgcatttttttttttggcttgatgctattctgttttaattgtccattttattatccgtcctcattagtctcatttatgtaatttgtttaacagtgatttatttttttattttattgtttgttttctttattacttgctcttttactacaatttcgatagttacagattaagtggtgtccccgcccttctgtgacttatttttcttgctgaaattaa

SEQ ID NO: 83546 - DNA, 538 bp, Heterodera glycines
  Genomic contig location: Contig_ID=SeqID_18851; Location=45..582; Strand=-
  SCN-specific regions: Sequence locations=1-301,323-405,430-483,506-538
atgtcggacctaagcccgaatgttagaaatagcatatttcaatttaatacggtaacaatttgtgcgattccacgggccctttggtgcatattttggccagcacgggaggcattactcggtcaaaattcggatccaacacatttgaaatgtaagtgagcaattggcggtatttggcgcccatgttgaagagaccttcgattagtcccatcagttccacgtaccgtagggcacccggcgcagcaccgtaatttatctaaatggtgcaaattagaaaaaattaagtctaaatcagatgacttttaaaaacgaaaaacacacccctaagaaatgaccaaaaaaaaatttcagaaaatacacaccctaagaattgaaaaaaattttcagaaaattgatcaccaaatttactattttttcatgataaaagtttttgactaaaaattgtccttattcgaaaaaactttaaaacaattgaaatataagaaaatttaattttttgattaggtttcacgtgatttgctacctaaaaaatgttaataaa

SEQ ID NO: 83547 - DNA, 1530 bp, Heterodera glycines
  Genomic contig location: Contig_ID=SeqID_18856; Location=1180..2709; Strand=+
  SCN-specific regions: Sequence locations=1-367,389-514,543-642,664 -751,773-859,881-983,1005-1107,1130-1217,1239-1508
  Gene Ontology: Biological process=cell proliferation
tgcatatttgagctcgatccaaaaactgtttatgcagaaaaatttaaacttgaaaagtttagctctgacctcgattggttctctttgtggtaatgaggtggagatgccgtaaattgcaatcttggcgatttaccattgatgtcttggaaggagtttttggagatcttgtttgtcgtagagatcgtcttaacggcaagtgaggaaaatggaacatcggacaaatgcgaaggggatggagaatatgaggaagacgatgttgaaatatccattgagtcagagtccatcggtttaattaggtcggcttattatgcttaatatgtaaattaaaataggtcataacaaattgtaattaggtacctaattagcaattctaaataaataaatataagtgatgaaagcatctcaaaaagatattcatacatttgtattacctatatgcagaattacaaattggtctcatggttttatgcttatcagaaatttgacaaaaacaaaattaatttctaaacaagagattaaaatttgaaaattaaaaaaatataggttttaatttagtttgattcttagcttagggataggtgttagccgatttccgaaattttgtgagggaagcggtaaaaatcctgatgtagagaagtagataagttaaaattatttaaaatgctgctactaaagagtttgtgaacggatgataaaaaagtattctattaatgtctctctctgtccatcagaattatgtattatttttttcatatttttctttaattttcagtcaaaatgagtgatgatggtcctgcttccaagcgatccaaaaatgacgactcatctcaaggagcggcacaggttgtgtaaacaattgtaaaaacaaattaaatgtttttaaattggttaggattgtctcaccgagtctcagaaagcgcttgaggatttggacaaagtgcagacggaacttgacactttaaatgaaacagccagcgacgaaatattaaaagtcgagcagaaatacaatcagatgcgaaagcccttcttcgaaaaacggacacacttcatcaaacagataccaaatttttgggtgacagtggtgagtcactacgagcaattgcccattttataatgcattttgtcagttcataaaccatccacaaatcagcaatatcctcgaggaagaagaggaagaatgcttgcactatttgacgaaagtcgaggttatcaagcccaaaacattaaatttattacttttatttcaagattgaggaaaatgaagacatcaaggccggttataagttgaaagtaattaagggacagacgctgaaaagttggaccatcaaaacaaataaattctttcttttagttttctttcgacccaaatccattcttcgagaactctgaaatagtcaaagaattcaattggactgcagcagaaccgaacagtgtgacaactgaaatcaaatggaagcaaggaaaaaataaagtaagtattttcttgaaaattggctaaaaataacaaatgttcatttttggacaaaactt

SEQ ID NO: 83548 - DNA, 945 bp, Heterodera glycines
  Genomic contig location: Contig_ID=SeqID_18856; Location=519..1463; Strand=-
  SCN-specific regions: Sequence locations=1-353,375-715,737-789,811 -838,860-945
atggactctgactcaatggatatttcaacatcgtcttcctcatattctccatccccttcgcatttgtccgatgttccattttcctcacttgccgttaagacgatctctacgacaaacaagatctccaaaaactccttccaagacatcaatggtaaatcgccaagattgcaatttacggcatctccacctcattaccacaaagagaaccaatcgaggtcagagctaaacttttcaagtttaaatttttctgcataaacagtttttggatcgagctcaaatatgcataacattcattttgaccaattctgaacccgacctgaatatatcgaaaatcaaaaaacgaaattcgagaaatttgggttttgactttttgttcataaattgttaattttgtttactggggaactacaattccaaattatttcttctacaaacttttagtgttccatctacggctccaaatccgttggccgtttcacgtacaatgatttctacttcttgcaaaaaggacatcacggaaaggcattccccttcagtgaatgcaaaccgtcaaaatcaaatgcaaaaagaggtgattaaagattttattgaagtctttctgaataaaatttacagcacagtgttgcagctgaaatgtttcttgcgactgatccaattttgatggatctgcaaaaagcaaacaaaaaaagtgaaaagcgaaaattaaatgacgaagaacaagacaacacacgacaaatgaagaaattaaaaaaaagcggaacaaagaagaccgattgtgaccagaacgcaatgtcaggcaaaaagatggaacattctgttttgaccgggcacaaaagtgacaattcaaatgcacaaagaccgaatggaaacacttcaaattgcaacaaaagtgacaagaaaagtgacgctacatcaaattctgtgcaccctcaagtaattaattga

SEQ ID NO: 83549 - DNA, 3301 bp, Heterodera glycines
  Genomic contig location: Contig_ID=SeqID_346; Location=474..3774; Strand=-
  SCN-specific regions: Sequence locations=1-96,141-145,167-561,595 -781,810-931,961-1161,1183-1244,1267-1548,1575-1647,1687-1812,1849 -1866,1888-2009,2038-2041,2075-2082,2122-2141,2200-2251,2281 -2313,2340-2569,2612-2981,3004-3144,3168-3301
atgtcttcaaattttatcggttcgccaaattgctttttccgtccaacagctgatcagggtaagagaaataattaaaaaaagaattacgaaaaaaggaaaattattttatcttttttaaataaaataaaataaaaatttatcaccattagcagcagcagcagaagaagtggacaagtatgaagtgttcagttggcacggagatttgagcgaccaattggcagcacaatttttggtcagtgatcagcagctgttgaaggtgggacatttcagaacggacaaatgagcacagaggggggagcacaaatgatcacagtgggggggggggagggggagagaggccggacggatcagtcacggacaaagggccgaccaattccgagagcaatcaagagacattttgccaaaaatcatgcaattaatgagtgaaggaaattggaaattatttagtggactgaaaaaactttttttatttaaggaatgccgagaaaaacttgccagtgccgaattgagagaaacgaaattgctgtgcaaaaacggggaattgaatgcagagaatgtaagaaaaattaattattaaaaaaaaatttaaaaaatgacgaaataactgagagcgaacgcgcataaaacagaaactttcaaattttgtaagaaaattcagaaggcgcttaaagcagagttggagaagcagaagctgatgtcggaaaacagtgaattgaaggcgaaagttgataagatggaccaggaaaagcagcagcaattggacaaaaaatacggtagagacaatttaaaaaaataaataatttttattaccgtactcggacagtactgtatgcttcaaaattatttcagtttctgtcgatgtgttcaattcattggtggagcgaatcaaacaattggaaaatcggcagaacaaagaggagggcagaaagggtaaataataaatttaaaataaataattaacggaccgaaattttgcatactttaaaaaggcgaaaaaattttaacggaccataagcttttacaattttgatcagttacaaattttaaatgaacatatttaattagctgaccaatgccaattatttttaattttcattttctattattcaattggatacattttttagcagaggaaaagcagcagaaggaaagtgttggtcaacagaacaaaaacaccgaacagaaattggatggaaaatatgccgtggtggacaaaaacaatgttttgggtgggcacaattggcaaattatttaaaattaaaaattggcgttataaaaaaaatgcattttttgagaggggacaaaaccctcgtattatatcgggattttatacatatttggtacatatttcggacttttttcttacatattttcatttttttacatatttgaggattttttacggaaatttttggaaattctcaaaaaaaaaatccaaaaatttcggcaaatttttcatttttttacatagctattctgagaatttttgaaaatttttagaaatttcttgtgaaaaaattaaaaaatctttttttaaatgtacccctccaaaaataatttttcaaatgttaaaaggtgattttaaacattttggtcatttttatggcattttgtgcctatttaacactttatgaaaaaaaattttccaaaaaataacaatttaaaaaaattttatttacatattttcgtacatattttgggtttttatacatatttcttacatatttcgggatttttttttacatatttatgtacatatatgaccactttttgtacatattttttacagccctaattataaatatttaggtgttaaaaaattaatttttttttttaaatgtatttattgctaatttagttgctttagtgacgtcatcgggcgaccattcgccgccggcggttgtctcagcgaaagttgcaaaggtgggaaggaaaccttaattatttcacaaatgccatttaatttcaggaagtgcctaattcgcagcaacaaaatgattgggatgccaaagtttgccacaaagacatcgaaatcattggggaaaagcaattgacgatcaattgcaagggcaacagatttggtatttaatataaaaattaaaaaatgtaattaattaattactttcttaattaggatggcactctgtttttgcgaaatttccaattacgaacttttgtcgtcccggaattttctacttcgaaatgaaagtgttcaaattgaaaaggtgttcattttgatgatttcttagcgttttatttataattttgaatttattttaacagttttgctgcgattggaagtgccattggacgggtcaattggtcaaattttgaacagttacgggtaccgaagcgatggctcatttggctgtaatggcatcaatcggccgtgcaaaatgccaatgtcattatttggttcgtcattttcccccgtggcaatgcaatcggcggacgtggaaatggcatacaaatcatcggagttttccactggtgacgtggtcggatgtggcattttcttggatactcgactgatcttcttgacgaagaatggccaacgaatgggtgggccaattaaaatgaaaaaacaaattaattaaaattttatttttaagattattcctcttttttcattcaaactcccgccaattctctcaattctctgtttccgtgcgtttctttgtgggtgggcgacaaaatcgaggcgaactttgggccaaatttcaaattcaatttggcgactctctgaagaaagcaaaaagaatggaagaaggagaaattcatctaattgctgtcatttttactttatttatgtttattttttaaattctttttttcaattttcattttggctttataatactaattactattttatttgctattaatttcgtttattaaaacgtcgattttgtgactcagtttcaagttttttcgaaaaaattcctatgaatcttaaaaattaatacgagaaacttcacaaaataatttaatttctcttaaataaggatggcatttcttgactcttggttttaaaattctgaattggggcattcttttttaggtcatcattttgccttaatttatgttaattgaccccgataaatatgttaatataagcaactgcagaatcagcagatgttcatttattacttctccaatttgttatcagcttttcctttgtccattcgttcaccaattcaaatgtcacaattgatggcgcatgaacagtaaaatgaatttggtaactgacggaagaaatggcattggcacggagaaattgctaaataatttggaaaataaa

SEQ ID NO: 83550 - DNA, 996 bp, Heterodera glycines
  Genomic contig location: Contig_ID=SeqID_346; Location=4825..5820; Strand=-
  SCN-specific regions: Sequence locations=1-169,191-227,262-415,437-996
atgagcgaaatgataactcacaatcagcatcagttgatcaaatgggtgaagaaatggggacagacccaaatgatcaacaaaaaagagaaatcattcgaaaatttgaagtaattaaagaaaaattgaagaaaagtgaaaatttcaatggaaaatacaaacaaaaattgagaggaaaattggatgaattttaggcatatatcgcgaaaaaatatacaaatggaaaaatgaattaaatttaaataaaattaaattcaaaataatgaaacatagttttttatgaagagaaaaagaaagaattcattgaacgatttgatgaatttaaaaggttgtataaaggcaaacaaaaagaatttgcgaaggaattgggcatttctaaagaaacattacgaagatggaaaaaagaattgatgccaaaatatcataaaagtgagagaatttgttttttaattagtttatctttatttttaagtacaagttaaacattcaaatgaggacaaattaaaaaagatgaaaaaatattttaaaatcaaagaaagaaacctaaaaattagcgatgcaaaaattgcaaacataataaaaaaaggagcgaaaatgagagaaaagagaggggaaagaaagcaaaatgttggggtggcacaatctttgactcaaggatgggaggaatgaaaatatcaatgaaaattaatttataaggccaaatagctatgcttacagaagggattgcattttagttacaatatttaacatttttgctgctttgtttcgctgagaaatgcgcgaaaaactcatttttagcccagacattctcattttaatagtattgttcgtaattaggaatcattaattatttttagagatcgacattttgaaaaaagcctggacctggattccatgttggacctggatttcctggacaaaaatctaggaaaatccaggtccaggaaaaatccaggctcctcgggacctggatccaggcctggacctggatttttttaa

SEQ ID NO: 83551 - DNA, 378 bp, Heterodera glycines
  Genomic contig location: Contig_ID=SeqID_346; Location=7028..7405; Strand=+
  SCN-specific regions: Sequence locations=1-154,176-179,210-249,273 -293,347-378
aattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatattgttggagaacgttttaaagaaggataaaaataattattttattttaccgtcaatagatatgcatatgtattttaaattttttattgttatgtaaacttctaatatatatatatttatatacataatcatatgagttggcggttttaagaaac

SEQ ID NO: 83552 - DNA, 2309 bp, Heterodera glycines
  Genomic contig location: Contig_ID=SeqID_346; Location=7840..10148; Strand=+
  SCN-specific regions: Sequence locations=1-233,296-369,394-467,521 -650,704-940,994-1391,1415-1560,1583-1726,1748-1781,1819-1867,1890 -2309
  Gene Ontology: Mol. function=kinase regulator activity; Cellular component=bud neck; Biological process=mitosis
atgagtggtgggccacgctatgaatatttgtggcaggacggagcccagtacaaaaagccaacaaggcttccagcaaaagtgaaagccttaaaaaaaattatgacaacaattttctaagcactgttgcaccagtcggattatgtcattttttggataattttttgggagcttttgacttaacattcaatccctggtttaccgaaaaaaaaatttgtattaattaaaaggaattttgattttgaaagctggtttttataaaagggacaactttttcagaatttattgaaaaataattctgttattatctccctgtaaacactgatttttcactacaaatcatagagaaaaagctactttaaactcatttcttgtccttaattttttaaaggattatatgcacttactgatggattggattgaggagcgtattaatgacgagaaaattttccctaccgcgacaggtgggctaatttttattttatctataaatatctaaaaaaaaaattttttaatttttatacagatgtgccattcccaaatgattttcgtcaaacgtgcaagaaaatcttgtcacgccttttcagaatatttgtccatgtttacatccatcattttgatcggcttgttcaaattggagctgttcgtttttgaataaattttaattttcaaataatttcatttttgtatatttttatttaaatttgattttcaggaaccacatgccaacatgttgtacaaacatttctactatttcgtaactgaacataacatggtgtcccaaagagaactggacgccttggtaagcgcacttggctttggcttaattgatttatttagggtagaaaaccatcatttgaaaatgttgagaaaaagctaatttttaaaaacagttttacgagttgcatttgttcgagttgccattgacccgcgttatattcgcataattaaataaattatttatataaattattaattatatttaaattaatttttcacttttttttagaaggatttgactgctcgattgataacatcacaacacaaccaacagcatactgctatcgatgccaaaaatggttctaccgcaaaacaaatctcaccagccaaaacaaattgaaatttaataaatgataattaattgttgttaccgtatttcctctaatagggtctcggggctctatttttcaaatcgccggccgaaaggtcgccggaagatttttaggacccaaattttttcaccgttaaccaatttaagcattcttggaattgttcggtagttctatgtatttattattattctgccaaatctcaaaaaaaaattcaaataaggtatgctagaggaactcaaaaaacctagtttttcaaaaaaaattttgcccttttttgtacatgaaaaatttaaatttttcaaattaatagagggttatgaattaacgaacaattccaagaatgtttaatttagtttataaagaacaaagttattgtccaaaaattcgtacgccttttgtcctgctccgataaaattgaggaaatacggtattattattaattatgtgatttgaatattgtcctcatttgcatttctatttttaataattggccaaaaaagtaaaaattggtaaatgtggccatagcattttgcccactcccaaaaatgtttggaaaatgtcaagaaaacacccctcccgataattcgtcatcctcgtcgcatttttcatcgtcaacatttgctgctttaagctgcaaaaattcactaatagggcatatgtgtagggcaattatttaaaaataaacacaataaataattgctttttaaaattcggcttttttgcgatgaaaacaataaaataattatgatgcttattgtagcaaaataaacaaaataaaatgttggcgctttatattcaaatataatccatcaaattttctatcaattaatcaaaatttgagactccaaaagcaaatttggaacaacgattgaaccttgatattctgtcattaactcaattcccattgattgtgtgcaaaacgggcattttcctttgattgagaccaaaattttttgacacataatcatcgtcattaaaacatgatatagatgaagggattaagaaggaggtggcatgttttgcactcatttatgcaatacccccccccccccccgctcccctaaatttaattgaatttaagttatgtgtgcatcatcagccagcctctccgacgacgacgacgccatgaactcctctgatgctggtgatggacggtcggtctgtcggcgggtcgtcgtcgtcggagtggacgagaaatga

SEQ ID NO: 83553 - DNA, 2209 bp, Heterodera glycines
  Genomic contig location: Contig_ID=SeqID_348; Location=508..2716; Strand=+
  SCN-specific regions: Sequence locations=1-107,129-141,181-398,420 -679,701-1152,1198-1331,1382-1637,1660-1725,1760-1797,1825-1968,2027 -2209
atgaccagcagtcaaaattcaattatggatggcgcaaatctgttgggcaatttggagtttttgaacagccttaatgaaggccgtaatttgcttcatacacaactggcacaaaaacagcaacaacagcatcatgtaaaaatcgatgatttttgtaaattttaaatgctaatctttaaaatacagtcctcaacattttgccaatcgccgtttccactaaaacaaccgaagatggaacataaattggacatttttgctcaacttcaacaattggtgtcctccagcagcagcagcagcactaatggctgctccaactccacagatcaccagcacctagcatcatcattcccgaagcagcacattgcttcaatgcacaacaaaatgcttagtgagaatttggagaaaattttggctaattaaaatgattacggtcaattacagtacatgcttacagtttcgtgctagcacatttaagaatcattaatttttataatttgtttgaaaattgctcttcatgggcactataataggtattagtctttggaaaaatagacctatcagattaagtataaaaatgatttcaattcagtaaaatactgactttttcgagttttcaagtaggaattgttggcactgaactgtgagtgccaaaatttaaaatgcagtaattgatttaatacggaaaattattaaatttaatatacctttccattttttaggtcgggaaaaaaagaaatttagctctgatgtgtcagattttttggtgcttgaagtgttgaaacggaaagagctgttggttgagaacaacacgagccgagtatgtaaatagataataagcagaagaaattcagcaatttttgatcaaaattccctaattttcaaaaataaaacaaattataaaaatgatttttcacacaaaatttaaaatacaattcaaatttttcagaaaaatttcttttattttacaggatttgtctttttcggagtgcaaaagaaatgcttggaatgatgtcagagagttgctggtgtccagattccccggctttgatctgaacattgaagcgatcaagtcacattggcgctacagaaagcgcaaagtgaccgacgcgttcagtgaaatgtgcaaagggtgcgggaatttttaaattgcataacatttaaaaaatttaaaataatttttaattaattaattaaatttttgttcagcagtgaagccgaacaaaagttgaagctacgacttgcggctgtcgatttcgaaatttatagccagttgaaggattcaaatttgttagaaaggacaaggcttgagaaggacgcatcaccggtgtgaaaacaataattaatttatttacgtatcattattattttttaaataattaattaacaggatcagtgtgatgatgggcattttgaaagtatttcgtcgtcaaattctcccgcaacaagagcaatcaatgctgaatcatctgctgctgcttctacaatgtcacttgcgccaactctgccaatgatttcacaggtgtggttgtttttttttttttgaaaaaaatcgtttttatccgagttcttccaaaatttgtccatttttaatagcccgatttttaatacgaattccccattttccataggctcccttctttctgggccaacttggcccacaacaacagcaacacattggcaccacaaacccgacaatgttgctcgaacgcttaacagccagcttattggagcagcaactgaagcaacagcagcagcagcaacactttaccaaaaaggacgtcgaagaggaggagaatgatcaacagcagcaggagcagagaggacgggaaacagttcagcacagaattaatgattaaaatgaagctaatatggggggggggggtgtgtacaatgagtaaattgaaccctaaatcgtacacgccaaaacgtcgtcgccgccgtaacatcaccggaacgtggaattgtcgcttcaaaaaattagaaaaatttaaaaaaaaattaaaaaaactatctcttaaaattatttttcttaataggctaggtaacaaaattttgattttttttttcttatgttttttctaactatttttctaatattttgctgcgacgatgcgcccaggtgacgttttgtcccgctttgtcacaaaacataaccttgttgaaaaaactagcaattcccatcctgctgctggtcccatttacataatcaaaa

SEQ ID NO: 83554 - DNA, 56 bp, Heterodera glycines; identical to SEQ ID NO: 68623
  Genomic contig location: Contig_ID=SeqID_348; Location=4050..4105; Strand=-
  SCN-specific regions: Sequence locations=1-21

SEQ ID NO: 83555 - DNA, 633 bp, Heterodera glycines
  Genomic contig location: Contig_ID=SeqID_348; Location=2846..3478; Strand=+
  SCN-specific regions: Sequence locations=1-261,283-378,400-496,518-633
atgtccaacctgagcagcacgataatgccaactgcagcagagtaccaccatgttggcaatgcagcaaaggagaacggtggtggcactggcgctggaccggaaccgccggcaccgaagcggcttcgtcttggcagcgcggagaacgaagaagagcgcgagatggcattgctcaaacgagaggcgtacatggtgccgtatttaaaaaaaaagttatggccaaaaataaccgaaaaaattctggccataacttatttgagttaagaaaaattttttgaaattttgccggctcaagagaataattagcgctttcgaatgatatcaaaaattaaatatctgggtcaaaggacgaagctcctatgattataaatcagatttttggattaaatattttggaatttcaatgaataaaagagaaaataaaaactcagaaaaaatgcaattttgttgagtttccaattcctttttaataagcatattaattgaggttgatacatatttgaaattgaaatttatttttaggcgcaagcatcagcatttgatgagatacgatcgctggtgacagaagtgcgttcaactcttttaccgcagatgttaacagctcttcaaaattataattcgcaatttaattcataa

SEQ ID NO: 83556 - DNA, 168 bp, Heterodera glycines
  Genomic contig location: Contig_ID=SeqID_348; Location=4348..4515; Strand=+
  SCN-specific regions: Sequence locations=1-168
atgagtgccagttttgatgacgaacttcagctcgaaatgcaatcaattgaggccatttttccaaatgaaatccatattgaatcggctcgacaaatttctgtccaatgtgcgtcgaatgtacaactaaatttgaacatcccggcagactatccgaggtcatatgatgct

SEQ ID NO: 83557 - DNA, 532 bp, Heterodera glycines
  Genomic contig location: Contig_ID=SeqID_3180; Location=273..804; Strand=-
  SCN-specific regions: Sequence locations=1-106,129-400,423-502
atgaacaaatacatcacaaacagcagcacccactggcagcagcaggtgtttgtatgattaattggttaacattattaaaagccgtggtaattaattccgagtaaaagcgtggaaatttcaattaaagccaaaattctgagaaacctaaaattacagaaaggcaaattaattaaattgaaaaaaattcccacgattcaaaaattttaatttaagccgtacctgcatttggtgaataaggtggcgcatttggtccggcggaatgccggcctgcattgcattttgaagaattgcttgaattgcctcaatggaggagggcatttccatcagccaaatggcacaaaaagtgtcgacgaaagcaaaaaaaaaagttggcggagaattaattaattaattggtgacgaaaaataattaataatttaaaagcaattaaatagttcctctgctacgaatcttctcattcaaccacctttgataggtgattaatacagaattttgctaaatgaaaaaaaaataattttataaattaaataaa

SEQ ID NO: 83558 - DNA, 827 bp, Heterodera glycines
  Genomic contig location: Contig_ID=SeqID_18857; Location=49..875; Strand=+
  SCN-specific regions: Sequence locations=1-246,281-827
  Gene Ontology: Mol. function=ubiquitin-protein ligase activity; Cellular component=plasma membrane; Biological process=sensory organ precursor cell fate determination
atccaagtgaggtgcaacttcaatcgaaacgaacttcgtccaaaaatagggctggattaacgggttccgctcggggtgccattcagccaccctctaaggaaagtgccgaaagttctccggcaccatcgtccctcgccactcatcaccaatctgtcgcttccatgactctgtccatttctgccaacaatttgcttaatttcaacataaattctcctcgctcttcctcctctcgtgcctcgccaatggcaaacggtttttgttttaaattttaccaaaattacgaaacattaattatattgtaagtaaaattggaaaaattatccgaatttccatttgcctgcgtccgtttgtgaattatgccaagacttttatgtggattaaaaactcagggttcttgaccccgacatttaataaaaggtggctttgcttttcagtttcaaagttgcgcttccatagcacgaagggagtgaatgtgtatttacagcatgatgaaactgttgcagttcggaagcacggcgaatattaccagggatacgttttcactgaaaggccaataaaagtcggagaaaaattggttattttggtcagccaaatcgaggactctttttccggcagtttggcgtttgggctgaccagctggtgactgacgacgtcgattgtccgttgtagataatactgatttagtgacccgtcaaaagtgctggcctccagactgcccgtggacagcgacgaactgttagaaaggacggaatattgggtgtgcatcaaagatgttgccgcgacaccgcaagtcggggacacactctcatttcaagtggacgcggaag

SEQ ID NO: 83559 - DNA, 490 bp, Heterodera glycines
  Genomic contig location: Contig_ID=SeqID_18858; Location=1523..2012; Strand=-
  SCN-specific regions: Sequence locations=1-222,246-370,392-490
atggccaatctctcgctgttttttgctcttttaaccccccccccccttttcagcttccgtctctcccctccctccgccgcccatttaccaccaaccgcccgatttgccggtcgcccattggaactttcagtcccatccaacgccattttcaccgcctcagagaagcaaattatcgtcgtcagacgcgaaaaggccaattggaggcgaaagtgttgggagacggacaaacaaagagcagaaaatgccattgatcgaagcacaaaggtaaaaacaacggccaatgccattggcattttcttcgctcagagaatcgttggaaggatggcgctgattcggcaaacaatcacaacgcttatgccacaataattgagcttgatgcatttaatgaagagcttccaaaacaaagcccgccggtcaaaccccaaatagaaaagcattattcaatcagccttttaataatttcttattgttattaaaacatcaaaataaa

SEQ ID NO: 83560 - DNA, 204 bp, Heterodera glycines
  Genomic contig location: Contig_ID=SeqID_18859; Location=405..608; Strand=-
  SCN-specific regions: Sequence locations=1-6,64-204
atgttgctcctgctcctcctcctcctcgacatgttgctgctgctgctcctcctcctcctcctcgtcagagttcccctcgatgcgcactaccacctcctcaatgggcaatggaacccgggggaaaacctggtcctaaatcaaaaatttggctgttgccatgtcatgactcatcattaccaagggtaccctttctgcattgcgtag

SEQ ID NO: 83561 - DNA, 227 bp, Heterodera glycines
  Genomic contig location: Contig_ID=SeqID_18861; Location=999..1225; Strand=+
  SCN-specific regions: Sequence locations=1-139,221-227
atgctcgacagctcaatgccttactcattggcagcggtgggttcaaaaagataatccaaaaatcagaataaaatggcaaaataactttaacattctaaattaattagttcatattataacaaattcagaagcgaattcgtaaaaatgataaattaaaataaattattatttaataattttaaattatgtgaaaatggaaaataattaattatttttaaatcattcga

SEQ ID NO: 83562 - DNA, 878 bp, Heterodera glycines
  Genomic contig location: Contig_ID=SeqID_18862; Location=627..1504; Strand=-
  SCN-specific regions: Sequence locations=1-205,227-227,280-643,665-878
atgtcatctgctgctgttcgcattggcattatttatacggaatttcggattcttgctaaaaatctactgtgagttgtggaacagcaaaaaaaaatatataaactccattatctaccaaaatcaaaaatttacagtctgaatttctttttaatcttttttgtaaaagcagctgagctggacaagaatttcttgaaaacccgggaccaaccggggaaatacaagaaatcaaaaattttatgaataaaaaaaatttgattttatttatttttgtttttttaacgcaagtctttagttattcggttcataaaaattattttcagttttttatgacaaaaaaaatttaaattcagcatacttattggactatcaacaaaagaagtgccattggaccattgggttggaaatggccgtgtttcgtacggttacgcaaattttggcgagattataagcacaaatgccaatggaaatgaaataagcattagggacaatgtgccatcatttcgcactggcgatgtggtcggatgcggactgaattgggcaacacgctgtgtttttcacgaagaatggacaacgcttgagtttgtgttcatgatggcaattcacataaataaactggctaattgcctaattaagacatcaccaatttgtacgttgacgagggaacggctgacctttacccgaccgttacattgtttgatcacttggccgcggtcgaggccaactttggtcccaacttcaaatacgaactgtcaaaggaatttgagactttgtaaatgattgattggcttatccaatatcaattgaacatcaatgatctgattttttttctgatatcactgacaatttttttttggatgttccaaatccgacaaaataaa

SEQ ID NO: 83563 - DNA, 163 bp, Heterodera glycines
  Genomic contig location: Contig_ID=SeqID_18862; Location=1650..1812; Strand=-
  SCN-specific regions: Sequence locations=1-1,25-118,140-163
cttaagttaaaaatataagaaaattatattctgaaagagaacaattaaagctattgaatgataccccgaaatattaatttggttgaatttgagccaagctattaatttaattattttacccattttttgttttcaaacccattggcagttttaacaaacgcgc

SEQ ID NO: 83564 - DNA, 331 bp, Heterodera glycines
  Genomic contig location: Contig_ID=SeqID_18862; Location=2031..2361; Strand=-
  SCN-specific regions: Sequence locations=1-197,237-331
atggaggtgagttttaagtccatgcacgtccaaatgagcacatgactatcatcatcccccactggcgagtggtggacccactacttgctccgtcttcgcatgctcccttttgcgaagttcagattgtcttcgattttgcagataaaaaacatttacccctaagctgtcataaccgtgttcagcaacctcaaaaccccttaataatatgttttcatttaatttataaatttaatatagtgtccgaaaagtattggcagtgaacccaccctggcaccgaatcggcggcaccgaatcgtcctattcggaaattagtagagaatcaaagaataaa

SEQ ID NO: 83565 - DNA, 97 bp, Heterodera glycines
  Genomic contig location: Contig_ID=SeqID_18862; Location=2391..2487; Strand=+
  SCN-specific regions: Sequence locations=1-97
ttaagccaaaaaaattctttactctattaaataaactcacttattttgccatggaattaatcagaggcgtgaccgacagaatgtctgcaatgttttc

SEQ ID NO: 83566 - DNA, 323 bp, Heterodera glycines
  Genomic contig location: Contig_ID=SeqID_18863; Location=91..413; Strand=-
  SCN-specific regions: Sequence locations=1-323
atggacggagcagtggtacggagcatcaaagatttgcccattgatgagctgaccccatggaattgtaagttaaatgatcattcgatccaattgttaagctttaagcgaagaagtgcaaatcgtccactcgcttcagctccgtccaattcgatgctgaaaagaattctctcgtcttcaaccgttacataatctccgacgcggccaatgtcgaaaggccggagtgtctgataggttcccgtccgaccaagtcgaactaatgttgttttctccaattttcagcttgctactattgtaaacatccaatattcaaccttgttaaaaag

SEQ ID NO: 83567 - DNA, 616 bp, Heterodera glycines
  Genomic contig location: Contig_ID=SeqID_18864; Location=378..993; Strand=+
  SCN-specific regions: Sequence locations=1-165,188-616
  Gene Ontology: Mol. function=structural constituent of ribosome; Cellular component=cytosolic large ribosomal subunit (sensu Eukarya); Biological process=protein biosynthesis
atgggattttcgacaaagccaataattattgacggaaaagatcatttgcttggacgtttggccgctgtcacttcgaaacagcttttgcttggccagaaaattgttattgtgcgatgtaagttttttctttgtttattctaaaatactattcgatcaaggcgaatccatcaacatttctggcaacttccaccgttccaagctcaaattcctcgcatttttgcgcaaacgctgcaatgtgaagccatctcgcggacccttccactaccgtgcaccatctcggattttctggcgcacggtttcttttcatatttaggctaggctaagcgtaggcttgtttgggcctaggcttaggcacaggctttgtaaaaaaaaaattttattgcacgagttgccattgactcctccggtaaaatatgatagaaaccaagtaaattttgaatcttattcatttaggttcgtggaatgcttccgcataaaaccgcacgaggtatggaagcactgaaaaagttgaaatgttttgacggatgcccgcagccgtatgacacaaagaagaaattcgtacttcccaattctcttcgccacatcgcattgaaaccgcgacgcaaatattgcacag

SEQ ID NO: 83568 - DNA, 1174 bp, Heterodera glycines
  Genomic contig location: Contig_ID=SeqID_18866; Location=783..1956; Strand=-
  SCN-specific regions: Sequence locations=1-511,538-570,599-869,891 -1174
atgaaaagacgcgttccctactataagcaattctttcttgacctaattgcaaatgattggagtccaaatgcgccaacaattgacgacaaaccgctgcaaaaagaggcagtgcgatggctatttattgactgctttttgtgcattgaaatggccaaaacgataccagcaatttggcaactcccattgattgatcaggcaattaattattcactaatctaattgactaattactacataattacattttttctgctatggtaatccctgctgacgcgtttcatttacttaggatgtcaactaagttctgtgggttttcgatttttttacttggttaactcttattccttaaattctatgttcatggtattgatgtcatacctgaaaatggcaaattttttcgaatgtgatggaaattatttaagtcatgcttatgttttgttgaattttatatcgaagggcgacataactgagttgacacgctaagtaaatccatctaattattagcgaaagcaatttaaaaaattattatttattaatgaggttataaatccatcatataattagctgaagtaataaaaaataataattatttattaatgagcttaaagtgttcatttttagacttctctgctactcaacaacataattctgaccgctgtgttcaacaaaactttctacagctgcgtcaattgtccaaatgccgaaacgctaactcttcccagcggattctctccaatttttttgggcacttttaatgtggcgattcgcgtgttttgcgaatcaattaagtgtttcaaagaaattaatttgagtatggaagaatttgttctcctcaggggcatgattttgcttcaacatggtcataacagttttaaaaataatattattttcattagcaatttttcaactatttaatttaaacgaaaaatttgggtgctttcatattcctggagcccaattgaaatacgtggggatatctgtttttgattttgtgattttaagcttggcactgacggcaagtattaccacttatttcctatttaaaagcttccaattatttttcaatatttgtttgaattcggctccggggttcggttattgggcaaatgggagtttagattcatgctccgcatccactaaaattccccgaaactgtttttgagtactgaataaa

SEQ ID NO: 83569 - DNA, 796 bp, Heterodera glycines
  Genomic contig location: Contig_ID=SeqID_18869; Location=548..1343; Strand=-
  SCN-specific regions: Sequence locations=1-338,360-796
atggaggacttcaagcagaagatgcggaagcaaatcgacgagttcaagtcggagagtgagttgttttggtggggggggggggggaggagggggaagagtgaatttatgagactgcaatttgtgttccccccttttttttgaatgaattcggttataatgccaatgccttctgtagagtttccggatcactggtcatgaatatgggctttacctttaacggatccaaattggttcagggattcgtattgattaggaatgacaaattaatatcacatatttagagataggcgggacttcatatacactgacaatgagacggaactttctctctaaactcaaaaaattcctaattaaaatttcagaaaaaatctctcttattatcattatgggactttgcaaatatacctgtatcacaatcattacgtgaagtcccgcctgatctctattaatcagtgactctgagaagcccttgaaaatatttcgatgccttaacaaatcggcaacatttgttcaattaaagaaaccgacgttgccctttttcagtcgcacttggccaccaggaaattgagaacaagcgaaaagagttggagcagctgaaggccaaattcgatgccgaaatcgacgaaccgcaaattgggccggaagtgaagcgcgagatttggtgggttttggattttacaccagagtggccaagtttttttttcaaaaaaaggacaaacgaggctaaaactaagattttgaccccaaaaataagatttttctacaactaatagtagcgcgaaggaaacgtaataaa

SEQ ID NO: 83570 - DNA, 425 bp, Heterodera glycines
  Genomic contig location: Contig_ID=SeqID_18869; Location=1700..2124; Strand=-
  SCN-specific regions: Sequence locations=1-44,79-425
atgacaaatcaactccaggaaaggaaaaaactattggacgcaggtaaattaatttttaaaaattcattttaataaaaacgaaaaatttgcgcagagattgaacagttgcaaaaggaactgaatgaaattgaagcggacaatgcggaaaaacagaaacagctcagtgacggttggttcggtttcactccgctgggtccaaattttttaggcttcgtattgcgaattttcgaataatttgtcgtaaccccccccccccccccaaaaaaaaattaggggccataattcgaattcagacgaatttgccatgtattttttcagaacagaatttgttgacggaagtgcgtacggaggagggaatccaacagcacaaactgcgccaactgaaggaatcgctcgaatgccatgagaaggcactcgaagagtaa

SEQ ID NO: 83571 - DNA, 75 bp, Heterodera glycines
  Genomic contig location: Contig_ID=SeqID_3181; Location=582..656; Strand=+
  SCN-specific regions: Sequence locations=1-75
caagcactgccgcttccgttgacaatagcacacaatccaccgccgtggagcatatcgcttttcaaacaccaaatg

SEQ ID NO: 83572 - DNA, 1227 bp, Heterodera glycines
  Genomic contig location: Contig_ID=SeqID_3183; Location=9..1235; Strand=-
  SCN-specific regions: Sequence locations=1-86,108-255,277-812,851 -1201,1223-1227
atggcaccagaaattccggaggatctttaccatctgatcaagaaggcggttagtatccgcaagcatttggagcgtttccgcaaggacattgactcaaagtatgaaaatcaattcgagtccaaactcaatttaagcgtccaattaatgactatcattttcctaggccgtaacttttttcttactacgtcattgcctatattcttggtattaagcgcaagcttaaaacctacagaatttttataattaaattacgagctaataacaattgacaaaatattcttttatgttcgaaaatgagaatgatcattggttggacgcctaaactggaattaccgacattgggcccacaattcctaatgattattgacgtttgtgcatgtttttaggtaccgtctaattttggtggagagtcgaatccaccgtctcgcccgttacttcaaaaccaaacggatgctcccgcccacttggaagtacgaatcggcgaccgcctccgcactcgtctcttaatttggcgatgaaggctgctgctaacgcacatttttatttgttgatgattgaattaaactgttgatcttttgtttccctttgttattttttggtatttctccaggaattactttttaatttgttcattatttaccatcgtttttttgcattaagtgaagtaaaaaacaatgattgtcaatggttcgttgaaaatttgccggacagcgctcggtccgtttgttcgtcgggcatcggtaagccttttcccttggaattgtggttaatttttgaaggagaattatagtttattagcgaatttaaaagtcaaatttgaattcatttccattcgttcgtcttttggtgcttcatttcaacatttaattgttttacggctcatctactgtttcacttttgcataattatttcctaaaaattaggcttccgcgctgggtcttccgcttgaggacggtccgtccgtttctccgccttcggtggaccgcgcgaaggacatttcgccgcgcgtccgttcgctcgtcgaccaaattgccgaactttcattggtcgaagtgagtttcgaattgtttcatttttcatggtaaaatttacaggtctccgatttgaattttgctctgaaaaagcgtctgaacattcccgacactcccgcgatggcaatgagtccggaaatgtttgcagctgccggaatgtttggagcacaagcgggcggagcagcgggagcacaaa

SEQ ID NO: 83573 - DNA, 166 bp, Heterodera glycines
  Genomic contig location: Contig_ID=SeqID_3184; Location=438..603; Strand=+
  SCN-specific regions: Sequence locations=1-166
tttcaacgacgtcggacattcggccgacgcgaaaaagatggccgatgattatttggtgggcgaattgaaggaggacgaaggccaaacgaccgctggggtttcactgccggaagaggcgaaaagggacgaaccgacggagtcgtggcggcaaattctgagcagtccg

SEQ ID NO: 83574 - DNA, 1329 bp, Heterodera glycines
  Genomic contig location: Contig_ID=SeqID_18870; Location=28..1356; Strand=-
  SCN-specific regions: Sequence locations=1-65,87-384,406-695,717 -936,958-1329
atgcaagcagttcgtgaacagcttgagaaggaccttgcatccaggttgggttagtggtcgcgtccaatttggcattttgagactttccatactaattttttgaaataaatatgtccgattctcttttcagtaaccgaacaatcgaagctctgcgcaatgagctcgccagcaaggaaatggagttcttggagcaggccaagacgctgagcgaaacggtcaacaaatcggaggacgaacgatcaaaatacgaacagcagcaaatgacgctggagaagactggacacgaagcgcagctcaaggtggcacaatgccaggccgaaattgaaaagttgcagctcgactgtgagcaggtcagttagttcggcacaattcgtgattccaatctaaattgcatttttctgaaaacttgtaaggcacgtgactctttttagaacttggctaaattcacggaactgtccgacgccaacctgcgcctgaccaccgatttggcacgcgaaattgccaaaactgaggagtttgagcggagacttgcggacgccaacaatttgatgaatgccgagcgtgagcaacaccagcaatcatttgtaaattcttatattttttaactttatttattttcattccttttagcaaattttggagcaagaaaaattgcgtttgaatgacgagatcaaggagttcatgaagcgggacgaggagaatgtgcagaaacagggggtctatctggacgaaattcaaaaggtcagttttttttttttatttggaaaattttcaaaaaattctgtagttggtccaacaaaattcattcatggaacgcctcaatcaaaccattgcatcgccgacatcaagcagcagtctcaacgcatcattcattgctggcacaccgaacacatcgtaagtttgggatatttgatttgatttaattggatattttaagcaaaatttaacttttccattcaataacccagaaaaacggaacaaaattgattaaacgaaaattagaaaaaaatttactctttcaatctattttcaggcgtttgtcaaccacggtcaaccagggctcgtaagttttttttattttccgaattgcggaactaaaaatttaaaatttggtgtttttttagttatatggccgagcaacaacagcagcagcacagtgaccggatgaatgtgatcattggctatatgcgtgccgagaagcaaaaggagacggaaatgcgaatgaatgccgagttggaattgcaacgcatccgaacacaggccaacattgaccagcacaaaattgtgcacatggaggcggaagtggccaaactgcgaaaggaagcggag

SEQ ID NO: 83575 - DNA, 372 bp, Heterodera glycines
  Genomic contig location: Contig_ID=SeqID_18871; Location=75..446; Strand=-
  SCN-specific regions: Sequence locations=1-372
agccccgtttttttgttgtcaggatgatttgcgactgctgcgtgacaactatgctaagcaggagctgctcatccgtgagctgagcgagcagcgcgagcagtaccgacagctgtacgaacagcagcagatgatgggtgacaacacaacgccagcaaccacggggttgacggcgcccagcgcaaattcaaacgcatcgtcgctgtcctcggcagcaacaacgaccaacgctgtcgaccaaccgccgcaacaaatgcagaaacgccgggagagcattgacacgctgcagagcgagctgtacatgtggcgttcaaaggccgaacgactgcaggaaacgctgtcctatgtgaacgacgacagacagaccaatgagaa

SEQ ID NO: 83576 - DNA, 1314 bp, Heterodera glycines
  Genomic contig location: Contig_ID=SeqID_18872; Location=237..1550; Strand=-
  SCN-specific regions: Sequence locations=1-875,898-1230,1252-1314
atggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaagcatataagcaggcgcgtgagcagctcagtgagctactccaacaacaaactccggaagagcttcgcttcttccgcatgactttgttgaatgagcgcagggccccagctggtctgaaagacccaaaattgcacccacaccaaataatcaccccttctacgggtgaagggatgttcgctattcatgcggaccccactggtgctcctccacccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttcactcggaagccgagtcagataatgagtcgtgcgagactcagtcaattgcatcatctgatgctgggtcagtcgcaaattcagatgctgaatctgtagcatctgtttcatcgcagcaccggcggattgacaaatccaaacaatttatctccctgcgagattattgcaagtattatctcgcaataagggatgaaaatatggagttgcaataccaccacatcctttcatgtggtggaggacttggtcagcgctggatccttgaccaggctgcaaaaattgattggcaaattgcaacatttttgcgtagacctgacatggacctgcggatcagcactccaaaaaatctgctgcagtatttggtcaaccaatacaacaggcagcaggcacggcaaaaccccaatgcccaacagaaaactgttgatgacattggcagtgttgttcggctttccgaacacaacgtaaattctctccaatattggaagaaaatgtatgaggattgcaacaccgtttttgcacggtgtcatgacgcgaaaaaggcgcgtctcttcatcacattcacgaacaacagggaatggcctgagttcaaagagaatatatataaaaacggtcaagtatttactgaccgttttgacatgtggatgcgtgtttggaccagcaaaaatcgctga

SEQ ID NO: 83577 - DNA, 1520 bp, Heterodera glycines
  Genomic contig location: Contig_ID=SeqID_18873; Location=93..1612; Strand=+
  SCN-specific regions: Sequence locations=1-13,35-238,260-855,878 -1112,1140-1236,1258-1520
atgtcttcgaaaaatgtttttgctttgaaaaagaagcataaaacgcgaaagaattccgaatcgtcgaaagggagcagcgaatcgtcagcaagccagaagagccaccgatcgcaaccgaagtgttggcgttgcggaaaatggcactctcccaagcgttgttcgcatggcaagtccacctgcagaaagtgcaatgagactggacatttggagaggatgtgcgaccagcacaaggcttggcttaaaagaaatagggagaaaaaggatggaaaagccgtgaacacatttcggcttggaggattatttctgccggactcagaaagtcggagaaaactgatcgaggttctgttgaagatgaatggcactgaagtggaatttattgctgattttggcactgaaagaactgtggtcacgaaggacgcacaccgccaaatcggaagtccatggttgagccgttgcactgaacgggcaaaataccacgacggatccactcgccctcttttgggaaaagggcaggcaaagttctcgatcggtgatcgctcatgcgatggacaattctatgttgccaaaggaacaaagaatttgcttggcatagacatgcttcacagtttgggactgttggatagcttcaggaagagcctggaagggaatgtccaagtggcagaagcaaacacgaagtccgattcaactgatgctcaaagtgaaaacccgaagaagaaacaccacggaaataagccaaaatttgctttgggagcaaaggtcattgctagtttgggactgcaaccttggcgcgctggatacgtcgttaaccgtcaagggacgatgtacgaaatccgttttccagatggaacaaccggcaaattcccagaaaaaggtgtagaggcatgtgttttggactcggacgaagaaatttttgatggtttggacctaagagaggcaccatccgatggaaaaacgtcgaagggcttggtcggcattgattgtgaccagcgaaagcgtgaaaacgtgatcgcctgacagccgacgaaccgatgagccaccgccgaaggatgaagcggatggacggatcaattttttttaagggggaaggtgttaggccggtacccaaatgtccgcctcattttatttattttgtatgtttccctcgtcccccttatctctgtctctccctccgtccataaatagcccgctttttgaccttccctcgtcatttgtctcattcgcatcattttcccgcaattttgttatttcattttatttgctccataaatatcgacttatttgtttgccactcaacggcataacaagttctgattctctgttcatcttctatctctcgtataatgcactttgttcagttggttgcatcattagcagccggaccgggaaggtcgttgatctgtcatgtgttcagttcggtcggtcgtttgttcgtccgttgatgttgacgcccgggggtacaaagcaaagctccttcaattttcaaagataaagaaacataagtacagtcgaggataacaaca

SEQ ID NO: 83578 - DNA, 3101 bp, Heterodera glycines
  Genomic contig location: Contig_ID=SeqID_18874; Location=167..3267; Strand=+
  SCN-specific regions: Sequence locations=1-565,595-752,788-811,835 -887,957-1004,1026-1071,1158-1162,1234-1243,1266-1267,1292-1297,1331 -1333,1355-1385,1407-1446,1468-1497,1535-1625,1732-1840,1872 -1940,1962-2001,2044-2191,...
  SCN-specific regions: Sequence locations=...2236-2562,2600-2728,2762 -2853,2876-3101
atggccaacaaagtgtacgtgaagaaaggcatcagagtgaagaacgcgttcaaaaagaaaattgaggaaaactacggtggacggatggaaacggtggactttgaggacatcgaagggacggcggaggtgggaaattgttttattggcatagtgccaaacagttccgaaaatagaaaaatttcgagctaaaaaacgccggccctgctggaatattttccccattttatggtttttttttttgcaaaactaaaaggttttccccatgggtttttgataacggcaatttgcgatcattaaaaaaagctttccacaaattggacagcctttttttgcctttcagataatcaaccattttcgtgaaaagaaacgacccaacaaaaaaaatccacgaattttgtcacccccccgacccactttgaccaaaaaacctcggtaaaagggcaaaaggaaccgcccctattcaccctttttttttaaaaaaaaaacccaaattttttttttcaaatttaccccctcaaaaaaaattttggggaaaaaatggggaaattttttcaaaaagggggagaaaaattaaaaattttttaaattttttttgaggtgtgggggggtgaaaaaaccgccccttcttcttaaaaggggggtgggggggggaaaaaattctaaaaaaaaaaattccccccaaaaagaggggtttttttttttggggggcccgaacacccaaaaaaaaaagggggggggggagaaacaccccctttttttttaatttttgaaaaaaaaaaataaaaatggggtttttttttttttttttgttgggggggggcgggccccccccccaaaaattcccccgcccccctctttttctaaaatttttttttctccaacgcgagaaaaaaatttttttttaaaaaaaatatttttttttttttttttaaaaaaaaaaaaaaaaaaaaaaaaaatttttttggtgggggggaaggagaaaagaaaaaaaaaagagagacgcggtggtttgtgtttttgtttgtcggccttcccctcccccttccaaaaaacaaaaaaaaaaggagtgtgtgttgttgtttggttgtttttgggtgggggcggcgggcgggggggggggggggggaaagaaaaaaaaaaaaaaaaaaaaaaataaatataatttattttttttttttttttttttttttttttttttttttttttttttttcttttctctctcctcttttttccaatccaacaaaaaaaaaaaaaaaaaaaaaagaggggggggggggggggggggggggcggccgcccccccccccccccccccccccccccccccccttctttctttttattttgttaacagatttcgtttaaaagtgacccaatttacaattttgatttttaaaagagatataaaagatagaggtcatccggcggtgccaataggcgctgccgggaaaatttcaacaattttgaatgaaatttgcgatgaaaaatgagttaggtaattaaatttattatttaatttattcaaaaatatttggcattctgtatttgaaaaattttcaaaaatgcaacgcggatccctcgagatcccgcacaaaaaaatcaaatttgcgggtcccgctgcgggataaaatattttaacaattaaaaagaaatatattaattaaattttaatattttaagtaataaataaacgaaaaaagtaaaaaatattttttatattgataaattaacacctgcacaaataaaggacaatcgcatttgatccagcagaagcattcaacaaaatgccagaaatagaaccaacttgccaagctcgaattgggggccttaagaaatttgaaaaatttaaaattcaaattaatttaaaataccccaaaattgagccaaatgcatacagcaattgatatatggccaaattggtcagatatccgccaatattaatggacaaaatgatgatcaatgaccgtaaaactcgtgtgttcgtctgttgggttactgtaaaaaatattttgaattttaaaatgccaaagaaatgaatgccaagatttaccggcatttttgcatctgatgatcacaaaaatggacacataacagcaagtgctacccaatgaaataatgaatgtgccggcgaagaatttataaccaacggggcccagcaaagtttcggccacaacaccggtggttggactgaataaatttaaaattattaattaattttaatttttgatttaattgcgccatactttcccgcattttcgaatgcaaatgcgagcacataattcagtgtaaatgcaccgtaaattacacaaattaacagatggccaagcaaatatgagaatttgtatttagtgaaaatggaggagtgtctaaaatgaacagtccaaataaataaacaattaagtattgttaggataattagggtttgtggcagctaattaaatgagataaattttttaattcgtttccatccgtacttaaatggcaatgcaacagcaaaaagtcggtcaaaagcagcacaaaacattgccattaagccacaattcacagcaaaaatcattggctaaaaattgaaaaattaaatcaaaataaaaataatttgaaattcagaatttaccgtcataattaagtcagcagtgagcaaactgacaaaatttgtgcccaaaatgacaacaaccacaaaaaaagtgtgccacaatttatagcaaaaattggaggctgaaaaataggaaataaaaaaaaaatttgaaattttaaaatataccgtcataattaagtcagcagtgagtaaactgacaaaatttgtgcccaaaatgacaacaaccaggaaaaaagtgtgcccaatttggtggaccaattcacaaaggcaaatcaatgccatcagaaaattggctgagccgcggagggaactgaaaaatgagaaattgaattaaattggtaaacagaaattaattaaattgatttaaatttagaaatgccctggcatttgcctggatttgacagtgaccaccaaaactgtgccgttcaacacaatgccaaccaacgcaaccaaatacaccgcaacggccggcacaatcaagtcggcggacggaccggcgaaacg

SEQ ID NO: 83579 - DNA, 705 bp, Heterodera glycines
  Genomic contig location: Contig_ID=SeqID_18874; Location=2020..2724; Strand=-
  SCN-specific regions: Sequence locations=1-323,368-515,558-597,619 -679,702-705
atgatttttgctgtgaattgtggcttaatggcaatgttttgtgctgcttttgaccgactttttgctgttgcattgccatttaagtacggatggaaacgaattaaaaaatttatctcatttaattagctgccacaaaccctaattatcctaacaatacttaattgtttatttatttggactgttcattttagacactcctccattttcactaaatacaaattctcatatttgcttggccatctgttaatttgtgtaatttacggtgcatttacactgaattatgtgctcgcatttgcattcgaaaatgcgggaaagtatggcgcaattaaatcaaaaattaaaattaattaataattttaaatttattcagtccaaccaccggtgttgtggccgaaactttgctgggccccgttggttataaattcttcgccggcacattcattatttcattgggtagcacttgctgttatgtgtccatttttgtgatcatcagatgcaaaaatgccggtaaatcttggcattcatttctttggcattttaaaattcaaaatattttttacagtaacccaacagacgaacacacgagttttacggtcattgatcatcattttgtccattaatattggcggatatctgaccaatttggccatatatcaattgctgtatgcatttggctcaattttggggtattttaaattaatttga

SEQ ID NO: 83580 - DNA, 821 bp, Heterodera glycines
  Genomic contig location: Contig_ID=SeqID_18877; Location=272..1092; Strand=+
  SCN-specific regions: Sequence locations=1-499,521-551,573-713,736 -781,803-821
gcaacacatcattttcaacttgaagctggaaattatgtgattataccatcaacgtttggaagaaatgaagaaggggagtttttattgcgcatttttacgacagggactattggaatgtagtaagtttttgagtccgagtattttcaaaaatattctccataatgtagtttaattaaatttcttccgtttgaatggtcggcgtcagggatggcattcagaggccccaaaattttctgtaatcggaatcccgggacccaaaaattgttggaaattgaaattctgaccccaaaaagtcggaaattttgaataaaatatcatcaaaaatttaaaagtgaaaggtgatgtcaaaaaatttaggttttttacttaaaaaaatattctgctttttatcagaatctttttcaaattgtggcaggggacccggcggtgccgataggcgccgccgggaaattctgaaattttgcatgcatttgttaagattttgtcaaaaatgaccgaatttttatttgaaagccaaatgaagcagaaattacatacaaaaaactaattgtgtctctattttaaataaatcattttggtttggcaaaaaaaaaaaattcctactttttatcataaatttcagtaacccaaattccggtcaaaaaactttggaaatactgaattcattgccatccctgctggtcagcgtgaccaaatacgaaatggggtattagttttaaaaaagcaacaaaactgcttttggtaatggcagggtaatatgtgtggaggtggaaaagtacaaggggtaaatatattaatctttctcattaaaaaaagtaaaa

SEQ ID NO: 83581 - DNA, 1557 bp, Heterodera glycines
  Genomic contig location: Contig_ID=SeqID_18878; Location=1..1557; Strand=-
  SCN-specific regions: Sequence locations=1-541,565-995,1017-1253,1336- 1557
ttaaccaccatccctttagtgaacctcccgagttaccgtactaattaatgacttattcgtcttcccttcacatttctcccccagcgatgaattgctctggcgacgccccaattcctccgcaaatgatttttcgttggacacacaacggaagcgtggccatttgttattccattgtccgttttaactatgcaattatttgtggaggggcggggaaaatgaaagtgccaaattaattcatttcttactcagagaatgacacagagaatcattttttatttttcaaaaaaggtttttgtgatcgctttgtttggcaatcttttggtgattgctgtgttaatcaggtaaattaatggcttttagagaagcatagagaacaactgaccagacgaactcatctgatcagactattctgctttttaccgaataaataatccatgttcagaaaccaatgcatcaaaaaacgacgagtgaataccattctcttccacatgacaattgctcagcttctcggttcgtcccaatttgttttggctaattgtcgtccatttccattttcatttccaatttttctgtcaattccctccgttcagtgactttggtatatatccccaaagaaattgtgcacaatttgaccatcgcgtggctctggggcgactttgtgagtgttggtgaggtgaatgcaatttctgatgtgctctccccgttttaacagttgtgccgattctgtaaattcttcgatgtcttcggcgtaacactttctgccggcattttgatttgtctgagcatggacaggtgccaatgccaaacccaaccgattggccaccctttcccccccctcattcagtgcctcccgtcattttcaggttctactccattctgttccctctttacgtgatcaatgccaaacggagtgtccagtggatgctctccgttgcctggtgatccctccccttttgcgtcgtctttttccattttgctgcccctcttaggcttgtcagctttttgagcagcatccctcaagttcgccccccccccaattcgttgctaattaatgtccgccctttcagatctacatcttccgcactggttcgattcgtccgtttcttttcctcttccctttccgactttctttccgcttaagctcatcatccgtgctttgttcacttcactcagtgtgtgtcggcagatgtcatcggaatggtgtcgccttcagttgtctattggttttccgtgcttaacattgtacaggtccgctctctctctttctctcccctctctcctcccttttccttgtctctctctttcccctctctctcacaatttctctccccctcttttccggtctacttcatccctctgctggtcatcgtcgtctgctatggctcaattttggtgtccatttctctcaaaagtgccggtattcacgtgccgtcagcccgttcaaaccactcgcagccccaaacaaatacggccaaaaaggcacttttgcgaggcgaacacaaagagacttttggatgacggcgcaggaagagcagtttgacggcgacggtgagaacg

SEQ ID NO: 83582 - DNA, 504 bp, Heterodera glycines; identical to SEQ ID NO: 66584
  Genomic contig location: Contig_ID=SeqID_18880; Location=163..666; Strand=-
  SCN-specific regions: Sequence locations=1-107,134-263,292-504

SEQ ID NO: 83583 - DNA, 521 bp, Heterodera glycines
  Genomic contig location: Contig_ID=SeqID_18882; Location=272..792; Strand=-
  SCN-specific regions: Sequence locations=1-166,188-408,441-521
atggacgctgaggatgggcttttgctgctcgctcaacttggaatacagaaggcgtacaagcggatgaaggcgattttacggccattgtttgtgcaccattgctgccgtccatcaatgttgagcagatgctgttggctccgttccatgtcttccaaggcctcggaaaatgctctgatcaaggagttggaagcgggagaaaatgccgaagtcgcccagaaattcttcagacggatagggccaaggagggaagcgttcagaaagcgagacatgacggggaacagcatccggaaaatcctcgtccacgccgatcaaatggaggcccttttcgagacggaatggggcaaaacaatttgccaaacgatggcacatttggggaaaatccaaattttcaccaaagtgattgtcttcattttttgtgtaaatattttttaatttaaggcccagctattgtccccaggtgatttggacggactggaacagcagttgagcagttcaaggcatttctcgacgaacaaccaatg

SEQ ID NO: 83584 - DNA, 77 bp, Heterodera glycines
  Genomic contig location: Contig_ID=SeqID_18882; Location=1511..1587; Strand=+
  SCN-specific regions: Sequence locations=1-77
tagagaaaaaaagtaatgtttttctctggcactctctatttattggtacacatctcgttttttcggacggtgtgtta

SEQ ID NO: 83585 - DNA, 520 bp, Heterodera glycines
  Genomic contig location: Contig_ID=SeqID_18883; Location=54..573; Strand=-
  SCN-specific regions: Sequence locations=1-2,244-271,311-386,410-520
  Gene Ontology: Biological process=N-linked glycosylation
atgaagaagagggaaaagaagaagaagctgatgaagccgtacaaacggagaggaatgacaaagaggaaaaaggaggagagaaagaaagagccgacaaagagaaaagagaagaagagacaccccggggggaagaggaaggaaaaagagaaggaagtgagggacacggaaccggaactgagtggagaagagacgccaaagaaacagacagacagaggggggagaggagtagaaagaaagagagaaaggagaccaatgatagtacaacagaaaaaggaggaggaagagagagaggaggaagaggaaggggaggcgtatcaaccgttgaagcatggcggagacaaagaattgctgggaatgtcgccgaagagcattctgaagggatcgaaacggaagaagggaatggaagaagcagcggatccgaaaccgcaacagtggaggcggagggacaaatggaagaagccgaccgaggaagacggagaagggcactcccgaggaaacaatgggacgggaagggacggag

SEQ ID NO: 83586 - DNA, 2958 bp, Heterodera glycines
  Genomic contig location: Contig_ID=SeqID_3186; Location=141..3098; Strand=+
  SCN-specific regions: Sequence locations=1-361,384-910,932-1307,1333 -1791,1849-1911,1935-2204,2226-2252,2274-2504,2528-2958
ttgagtgtgatcagccaacttgcgcattttgacgatgtcagtccccttggtcagtttctgcacaaagcggcaacccaaaccgagcgtagcaactcatttggcttcattaaaattgtgccaaaaacggtagaaatcggcactcactttttactctcatgaaacttgtctatgttttgcagacattttcattgaaattgggccacccaaaagtgcgtgacatcattctgcagcagttgcctatgaacaatgccacacattttatcatgtcggcatgctatgggtcaattgtggcagggatcgtaacttttaatgagcgcagtgccatcggcaaaaccgacatttcaaatgcgaaaagggtctgttgaaaaaggcatagtatttttaaagctgtaaatttgttcaagattgttcgtaagtttctggctgggcctggactgagtccttcggacaaatcattcatctctcatctgaataaatcaatttcgtgcagtgttttcgttgacccttctattggaaattgcttgactgatttggttcgttttaagcgaattgtgttcattttaaaacaattccaatcggatttcgttcaggattttgtcaaaggactcaactcttttgccgataagtgggcggctgctaaagacacaaaacatccgactccgatcagtttttcgttggtcccactgtcttctattggcgacaaaacccgattcaatcccgtctctactcatatgatcggtgatttgtttattcttttgattaatcttaattatccctatgatcagcagatgaacatcagtttgaatggttttgtggccatgtgaaaactgtgaatgaatatgattggttgttgcggaaagtccgtcaatcattgaacgaatgttctgccatgttaacgttagattttggcaatttacagataatttaaaaatttgtttcaggaataacgagctggacgacgctcaagaattttttgaacaattggaagagaggaaaaacattttttacgattcgttgaaagatttcatcgtggatttgcgaatgtgcaaagccgaatctcaaaaagaggccattgtgcaaagggcagtcgatgattatgtacatttctgccaacgtatagttggtcattatgaagagttggtgaaagagaagaaggaaatggtcaacgaattgaagcaaaaaggcaaattctttgggaagatttctcatccaataacctttttgttatttaaggcgtcacttacatcggtcgttccactcgccaaaaattggactcgcgttttgcttttgatgactccaattcttccgtttttcattttattttgttgagaaattcgtctgttccgccggttcaaaatcaacacacttcctttttgctttgccttggcaaactttacgagttagtgtcacgtggaaaatgtacttttgtcgatttggatgttctgcgggatggcgaagaagcgcaggcggacgaaggactgccggaggacattcgctcattgaacggatatccaagctttggaatgcgtctgataaaaatgcgtgggaacaaattgttgtcgaatgattacatggcagaggaggaacggaaattgcaatatccaattgctcgggttcgttaaaacggaggagagggcggcattggctcatggtccaaaattaaaaccaaagagaattcagataatttttaatattttcttgtatatggaggaggaaacgattcattctcgtctccataatttttggtttaaaacctgaaatctattaaggaattaaattataaaattcacgttttttaactattttttaaattgaatttcaaaacaaaaatatttaaatgtttttattgggtttcatttgcgcagattgagaacattcgacgaacagaagttggagcagtgcctgaagctgattccaaagacatccaggcctgcagtttgccgtgccctttatgtgaaggctatggtggaaattgcccgaacactgaccatatgtggatgtgcgatgattgttgcgaagcattaacttttgtgcaaatagaaaaagtaattgttgtttggtaatattagaaaaaaataattactcacaggaacaagcacaaattacgcatttcttttgcgcttgtggaaaaacgccagtggacggattttcttttcgctgttccgatgtggcaaaacatggaactgagttcaagcatttttgctcaaaagtgtcgctggaaaaggaattggatcggttgaacaacaaaggcatgctgacctttttgctgcttggtgagacgggtgttggcaaatcgactctgatcaacgcactcatcgcttacctgaaacatgcgactttgaaagaagcgcttgaggtgaccgagtttattaaatgttgtgtttgtaattggcattatctaaatccaaaataggcgaatgaaattgactgggtgatcccggcccgattttgtacgggtcgttatgacagcaaagggaatcggcaaaggattgaagtgcgactgggcgaggagagcaaggaggagcggcttgaagctggtgaatcgcaaaccaaatggccaaatgcatatgtgattccgtcaaaaggtcgaccaaatagttatttctttcatgatcattagtgacactttcagatgggcacaaagttcgaataatcgacgcgccgggcatcggtgacacaaacggcatcaatgaagacaatatcaattttgacaagacactcaacttcatcagcacactccccgaacttcatgccgtttgcattctgctgcgccccaacagtcctcgcgctacgcccgcaatcagatattgcattgaaggactgctcacgtatttgcacaaaaatgcaaccaacgtaacttcgtagtaattgggagaatgaataaatcaaacactttagaacattgtttttgtgttcaccaacgcacgcgggtccagttatgacatgggcaagttttaa

SEQ ID NO: 83587 - DNA, 644 bp, Heterodera glycines
  Genomic contig location: Contig_ID=SeqID_3186; Location=3233..3876; Strand=-
  SCN-specific regions: Sequence locations=1-100,122-644
atgctcgtgacagtgcttcatgtacagcgtgacatcaccagtaagtgtacgatggatggaagtgcaacaggtctaaatgaacacgaacacattttgaaatgtaattccaatgaaaaacaaaggtgagtgttgttaggtttaactatttttcataccgcggcgcaaacagtgcgcgggtaaggcaaatggacaaattcaattgtttcaagagtgggagctttttccacctgctccactccgagttcgatggcctcttcgtattttttgatccggtcaaggtttgtctgaaatggcaaggaggcataattaacaccaaaatgacaactaaatggtaatttgcctgaattttttcagtgataagtgccaacggttcggacaaatcgatgatcgttcgacgcgcttcgttgaccgacacggtttcccacgtgcggtgcggttccaaattggacacatgtttgaacagtcgccgaaattccttctctgcatgggcccaactcctcgaaaaattgtccttctcttcttggtcgtattcaatgccgccctttttgatcagacacaatgcctcatacgcttcgttgtccacacagtaaattcggtcccgatggagtggaattgacacctttttataggggaaagcgaataaa

SEQ ID NO: 83588 - DNA, 1372 bp, Heterodera glycines
  misc_feature (1369)..(1369): n is a, c, g, or t
  Genomic contig location: Contig_ID=SeqID_3187; Location=148..1519; Strand=+
  SCN-specific regions: Sequence locations=1-56,78-134,157-698,720 -1130,1153-1174,1217-1372
  Gene Ontology: Cellular component=nucleus; Biological process =neurotransmitter secretion
atggacggattcggtggcaccgcttccggcgcgattggtagccccaacagcgacgcgggcagcatttattggatgtcaccggacccgaactcgccggacctgcaggcgtggacgggtgcgagcggtggcagtgcggtgggcgccggcgcgccggtgccacagcagcaacaacagcccaccggcgggtgggtactcaaagggcagtgctcggaaatctgatcactataattcggatgatcggaatgatttgaaattgcgtttgggtccgattagaacttggagacagagatattccaatgcattttaaattgagcacgaaattatgatttctagttgccgaaattctttgtgccgtcagaattccgattcccgacattttttcagctgttggaatgccgattttcgattgccaaattttttgagggcgtcggcacacatctccgataggcacacagccgtccactaattgcctaggctatctgacagagaaatttgttgcaaattgatggctatcaaaattcaaatctgtgatcaaaagatccatgtttttggttcagataaggccgtaatcactttgttttgggtctttgtgtgggatccattacagccaaattttgtattgtttaccgtttgccagcactgagtcatttgggagacggtttaagtctaatttgctaccgtaaaccgtttagatagcgtttctaagaattgttaaaattatgaaaagtcgaaatcctttagggctgcttctgtccctggccaagcggttggcggcggcgcgtcatcgccgatgatgaatgccgccgctgtcgcctatggtatccaacaacagcagcttcaacaagcgcaacaatcgctttcggcaccgcaaatgccatcgcaacaagcgcaagcatcggcacaacagcagcagcagccaattggcatggcattggcacagccccaacaacaacaagttcagcaacaacaacaacagcccatgtccatgatgccataccagccgcaggtgggtgcgagtttggcactgaaatgcttcctgaaagtgccggtttatcccttcgaaatcttacccggatttaagccaaccgaatcacgaaaaaacaaattaagtctcggataaatgccaacaatattaaccctttcaaaactttaagctaaaagactgcatttttcccaagggtggtggtgccggtgtctatggctacggtggccaacagggcggctacggtatgggcggcggttacggtagttcttctgctggtggtggccaaatgccggtgtcgccgtactcgtcctacttggagaaacagatcagcacctatccgtaatgcctgatcagcaagttctgatcaatcaaattcatttttanata

SEQ ID NO: 83589 - DNA, 1647 bp, Heterodera glycines
  Genomic contig location: Contig_ID=SeqID_18884; Location=904..2550; Strand=+
  SCN-specific regions: Sequence locations=1-4,26-45,67-1007,1029 -1067,1089-1388,1410-1647
aattgaaaagctgaaaaacatcatccgacagaacgagagcgcttttgtgaaacctggagaagtcggactctttaaaggacaaacgatacaccgcatcgacctaatcgatggcgcacggccggtccaacagaggccctatcgttatcctgtcgcacttcaacccgaaatagagcgtcaagtcaaggagttgctgcgtcaaaatgtcattcgaccatccacttcggcatggtcatctccaattgtgcttgtccgaaagcctgatgcctcctatcgattttgtgttgactaccggaagctcaaccaattgacgaagcgatcgacatattatttaccgaggattcaatcgatccttgacgaagtctctgggaaaaaatatttctccgtggcggactgctcaagcggattttttcatattaaactggcgaaaggacacgaagaaaggagcgcattcatctgccacatgggactgttcgaatggctacgttgtcccttcggattggcgggagcaccaacaaccttccaacgagccatggaagaagtccgacaaatgtgctcagcgacatttcttgtgtatttggacgattgcataatcggctcaatgactgaagatgaacatcttcgggacatcaatacttttctaagaacgatgactgaagttggattcagactgaaaccagagaaatgaagatttgcattgatagagattcgctatttgggacatttaatttcggctaatggcgttcggatagatccaaaggatttggagccaattcacaaattgaggaaaccgaaaaatatcaccgaactccgatccttgattggaatgctgtcatattttcgaaaattcgtctacggatttgcagaaatactccaacccatttatgagttgacaaaaaatgaaagcacgacagaatggggaccaccacatgagaaagccttggaggaattgaagacaaagctgatgactgctccagttttggctccaccaaaattcggacaaccattcgttgtggaaacagatgccagcataaaagcaattgccggatgtcttctacaagaaaaccgtgaaggcgaagtccatccgatttgttacttcagccgagtgctaacaaaacatgaaaagcgctattcggtggtcgaattagaagccttagcaatttgtgcttccctcaagaattttcgaccatatttggaaggagctggaaaatcaacagtgatcacggacaattcggctttgacatcattattccggcggaaggacttggaagggcgactcagtcgataccaattggctatcatggcattcgatgttgaaatcattcatcgccctggaaagcggaaccaattttgtgaccatctttcacgatacttggacgacaacgacacacaaattaattggctgaaaattgaaccaaaaatttcacaaagtgaaatgcgcgaggctcaaaaacaagagacggacacacaaaagagacgggaaactttaaagaaggatcaaaattcagaggaaccaaatgaattctctggaaaatggaaaatacggaagatcttttgtgtgcaatggaccgaggcgaatggaaaatttatgtgcctaatagtctgaggcaaagagtgatgaaggaataccactctgaccctttcccaagg

SEQ ID NO: 83590 - DNA, 2194 bp, Heterodera glycines
  Genomic contig location: Contig_ID=SeqID_18885; Location=344..2537; Strand=+
  SCN-specific regions: Sequence locations=1-4,27-92,114-373,396 -773,799-1270,1293-1962,1990-2194
atggcaattgttctaaaagtttcaaaatattggttaaagaaaattgggaaagtagcaatttcatcacatattagaaatatttcagaagaacaatttattaatccacaggatttcgaaaaagccgaaattttagtgattaaacaaggacaaatgaattggcaaaattatgccggaaaagaccaaattagaacatttattgataatgatgacctgatcagattagactcacgtattaaaaactgcgaaatgcaatattcgtttaaattcccgattgtttttccaaagggagcagcaattctcgagttattagcatggcgatcacacataaaagtcaaacacggaaaagttgatgcgactttaaatgaatttatgtccgagttttgggctccaaatattagagcaacaattaaaaaggttataaagatgtgtgtaaattgtaaaaagttgagtggcccagcattctcattaccaatcatgccatcacatccacaagaaagggtaaaaatttcccaaccatttaattcagtggcaatcgattatttgggaccctcattagtaaaaaatgaaggaaaaacaataaaattttggatagttttaatcacatgtttagttacaagagcagtttatcttgaacctgtcttagatttatctgcttactcatttttgcaaattttgagacgatttgcaagcagaagaggaacaccaaaaagaattatatccgataatgcacaaacattccgattatcagcaaaagttgcaggtgcatatgaagcaagaggaggaaaaggaaaagatgaattagaaaaatatttagttaaaaacaaaattatttggagatttatagctctagcaccatgggctaattctttggcagaacgattagtaaaagtttgtaaagatgcgtttaaagcatcacttggaaaaatggtattaaatttggatgagttgcgcacatttataactgaagtcgagtggactatgaataaccgaccaatcactcatgtatcaattgaaccggaaggcgaaagagccctccgtccgatcgattttataaacccaggattagaattaggaataaatttacaaaatgctgatgatgataaaaatgacgaagaatttactttagagccagaaaaattggaaaacaaattaaaaattcaatggaataaaacgaacaaagttttagaatgcttttggaaaagatggcaaaaagaatatttgaccatactaagagatcggacccaatggcaccacaaagggcctaaatcacaagaaaaaagagagccaaaagaaggcgaaattgttttaattgaagatgaattccatccgaggaatacttggaaaatggggaaaataatttgcctaaatggtcaaaagggatcaattagaagtgcgcaaataaaattagcatcaaaaggaaatgaaacaaaaggaagaataattgaaagaccagtaaataaactttactcattggaagtgaataaagcaattaatgaagaaactaaacccagtcaaaattctaaaagcgaaaaaagtcttgaagaaaataaaataatacaaaacaaaaatacgcatccaatggttacaagggcaaaaactcaaaaaacattcactctataagagaaaaatgtagcctgaaatgacgtttgctaaaaaaataagcgagcggttgctcatagcgggatgcggtttgcgcatccttccggcacttttcgattgcggatcgaatggtgtaaagcgttttttgaaattttcacgtaaaaaaaagtttcttcagaaaatttttgaaaattttcggaaaattttagaactgttcgcacaaaagggtccatatctcggcggggagtgccgaaaccggcttagcgatgttttggaggataaatgtcgacactcgggcggttcgaatgagctattaagcatctttctagcataaatttaaaattgagttttgctctggacacgaattaaaaatttttggaaaaatttttgcctcaagaattaggggggatacgcagggattctgaggggttgatgagtaattataaaaaaaaatttacactggaaatacttaaaatataatattattacgccctacgtgcatttgggcattacatgtcaaatactcaccaagatacttcatgggaaattgtgtccagaatccgaaaaaattcaattttgaaaattaggttaagta

SEQ ID NO: 83591 - DNA, 845 bp, Heterodera glycines
  Genomic contig location: Contig_ID=SeqID_18887; Location=376..1220; Strand=+
  SCN-specific regions: Sequence locations=1-518,540-791,815-845
atgccgacgggtgaatggacattacggggaatgtgttggacgtcccccgcggccacttttgtaagtttcgcttcccacattcatttcaaaaaaaatcattttgctcacacacacacacaattttaatttgatttactgtttatatttttagatttttgtaccccaattgaaaatggaagcagcaaagactggcggcaacagcaaaaaaagtcgcgccatgagcagcagcaccgacccagcggaagctgggggcaagaagcgccgcaacatgcatccggtttgtggccccccccccccaaaaaaaattagcaaatcaggaagagcctgaatatacccccaaccaaaaagtagaatttgggtcccgattccttccttatctcggggggggggggtgaatatggaaaatttgtaaaacaccccaattcatttgttttcacatttttttatagcaaattgttgacatcactcaacagcagcagcaaaatgtcgccgaattttgtccagtttcaaccgggagtgttcatcagcagcagcagcagtcggatccgcgcgcaattatgaacgtaattatggggggggacgcttttttttgctcggttttaattggggccaagaaatgttgaaacatgctgccggtctggccgcaaacaaaataggagaagcctaattaacccctccaaaaaggagtaaaatttcgtgttcatttcattcttatccggggggggggggtgaaaattttaaaccgccaaattactttgttttcgcatttttagcaaattgttgacacccctcagcagcagcagcagcagcagcaaaatgtcgcccaatttcgtccggcttcaacc

SEQ ID NO: 83592 - DNA, 1446 bp, Heterodera glycines
  Genomic contig location: Contig_ID=SeqID_18888; Location=715..2160; Strand=+
  SCN-specific regions: Sequence locations=1-160,182-488,521-1446
atgcttgaaaatgaaagtaggctggtcaattcgcctttaactaagctgcaaaccaacaattctaataacaacaatggtcaacagttgcatcaaaccaaaacaacatttccatcaattttattgcttccggatcgaaataacgaacagattattgtaagttttttcaacttaaaaaatcaaatcggtttaattgcattatatttattaaactaaaaactaacgtttattgttttagaatatggaaagtcactatcattcacaaattgaacgactttcttcactcactgaggtggaaatggctgaattggtatcgagtaatacgaatctgaacaacgtccaggctttggagattcttgatggcttgttttgtgcttttcttatagaaagtcaaaattcttctaaggtattattttgcttttattgtcatgccaagttcgtctttcagtatttgaactgtttgccttcttccgacatgtgttggaatcacatgctttacaatgccaattacgtgttaattgaagaattctcgtttctcaaatctgaatatcgtcatcggatggttcaattcttggcttacactatcaaaatgaatgttccatcggttgattcttgtctttcaaatttatttcgtgcactttccgatggtaattctaaaaaactcattaattatcatcctatcaattaaggaactgaatttgtggagacgtgcaaactcgtcttttctgtttctcagatactcagcacaaatcagaagtggctgattggcctcaaaaaaaattcattggccctggcggatgcttttgccttcatggcacgttttgtcaccgatgtgcctttggtgatcgctaatgtgtcttccgtttctatcgacttgttcaaatctgctttggtctccacttgtgaattactcatccgcgaacgtttcgttgacctggccaccacaatgggaagagacctgatgatttcgctgatgcgactttccaaattaacgcaattccaaaatgtgtggaaggcattgcttcacaacccgacttccctgatgcccaacttcagtatacaacacactcattttaattacgtttgcaattcatttaggtcttaagcaactgatgcttagtgtaccgactgataaatttctcgggtcgcgtgtttctgtcaatatcagtcggaaaattgatcaattgttaaacgttgtcagaatgctgttggggcaaaacaaaatttccgagttgactaaacactttgaggccttcaaaaacacggtttctgaattttgttatttcttcactttattttcaattttagcatttgtctgagcctgacagtgggacaatgcgtgctgagataatacgccatatttgggctcatttaaaacaagaagagcagagcgctgactgttgcgaagctcgtgcttggcttatcggctggcttttgcgctcgtccaag

SEQ ID NO: 83593 - DNA, 870 bp, Heterodera glycines
  Genomic contig location: Contig_ID=SeqID_18889; Location=2115..2984; Strand=+
  SCN-specific regions: Sequence locations=1-9,32-609,631-870
atgaaccgacggtaagcaatttgaaaagtcacaaattcgtcgtttatttgactaaactgttttcccatttcagttggatttgcaacgacgtttggatggacattttcccctgttttgaccatgctcaactcggcctcaaattggcattgctttcgccacgtttcaatgcgttggtggacaaacatttcaatggcaaaagcgaattgacaatttggagatcaatcgaaattcgtcgcaagaacagtgtcacaacagcggcaccagaatcatcggtgtttatcaactttgacaattcagtgccatttccattgcctgactaccgtccgttgcccagcaaaatccgttttaagcgccttcagattgagtaattaaaatcagagctatcgcaataaaagcattcattcattccattatttttgcagttacatcgatcattctgtcatcaattttcttcgtttaaatcgccaaattttcgacaaaagaggcaccaatttacagttgttttggatttcttcaccacacaccacggacggccagctgattttggacatttttgttcgtgaaatatggccaatttttgcgtcaaacattcgccatttgcgttttctcggtggttatcatttggacaatttgcgtcgtctcatttcgccgacatttctcaccgatctcaaccaattgaattcaatcgattccgttgatttgttgcccgatgcaattggtgattttgataggccaaatgcaacaatttctgctggccaagcgttgtccaaatggttgcactctccaagaaaagatggccaaccaaagcaattgcattgcacacttttgaaccaacaagcgtacttcgattgggtcaacaatttcaaggag

SEQ ID NO: 83594 - DNA, 766 bp, Heterodera glycines
  Genomic contig location: Contig_ID=SeqID_18890; Location=1..766; Strand=+
  SCN-specific regions: Sequence locations=1-205,228-385,408-766
cattccaatcactggcactcaattcccaccagcatttcaatctctgggactcaacccaccagcatttcaatcactgggactcaacccaacagcattccaatcactgggactcaattctccagcatttcaatcactgggactcaacccaccagcatttcaatcactgggactcaacccaacagcatttcaatcactgggactcaacccaccagcattccaatcactgggactcaacccaccagcatttcaatcactgggactcaacccaacagcatttcaatcactgggactcaacccaacagcatttcaatcactgggactcaacccaccagcatttcaatcactgggactcaacccaacagcatttcaatcactgggactcaacccaccagcattccaatcactgggactcaacccaccagcatttcaatcactgggactcaacccaccagcatttcaatcactgggactcaacccaacagcatttcaatcactgggactcaacccaacagcatttcaatcactgggactcaacccaccagcatttcaatcactgggactcaacccaccagcatttcaatcactgggactcaacccaccagcatttcaatcactgggactcaacccaacagcatttcaatcactgggactcaacccaccagcatttcaatcactgggactcaacccaacagcatttcaatcactgggactcaacccaccagcatttcaatcactgggactcaacccaacagcatttcaatcactg

SEQ ID NO: 83595 - DNA, 130 bp, Heterodera glycines
  Genomic contig location: Contig_ID=SeqID_18891; Location=1805..1934; Strand=-
  SCN-specific regions: Sequence locations=1-79,102-130
tatggcacggaaagacttccggtttccgacatttttggggtcggaattccgacttccgaaatttttgatgaaaagtcggaatttttttaaattttttttttcaaaaaactagtaagttttgtacaatttc

SEQ ID NO: 83596 - DNA, 743 bp, Heterodera glycines
  Genomic contig location: Contig_ID=SeqID_18893; Location=260..1002; Strand=+
  SCN-specific regions: Sequence locations=1-553,575-743
atgctccattgtcattcagtcgctttgcgtgttggcgaccgaattgtcgcggtgagtctctttgaatttaagcaattatttaatgtttcacaggttgacggcatgtccgtgataggttacgcttgggagcaagtcgttactgagatgatttgtggtggacccgaaaagactgaattggaattaacggtcgaacggacccttccggacggaagtgaccaagcggaggagcaaactttgacagtgacacttgacaagacgcagaatggcgcaatcggtaagtatttgactcatcttcctcgtttaaatttttttaaggactcagtttggccaaacggatgggctccgacggtgttttcgtgaggaatattgcaccggactcaatcgcagcgcgagacggcactttgcgagtgggggacagaatttggcgggtgcagggagagcaaatcgctttgggagaaagtccggcgaatgtcgtcaaacggctcaaagatttatccggggaattcatcatcgaagtgcggcggaaggcgtaatttggattatcagagtcaggaagcgacaccaccacctctacccactaaaactacttaacctttgcttcgttttcactattgtccatctctgccttttcactttacatttttcaatgtgctcatttctcccctcatcagttctaattgtgatataatacttaattccagcgcattaagataactaataatattatctcgttaaattcgtca

SEQ ID NO: 83597 - DNA, 866 bp, Heterodera glycines; identical to SEQ ID NO: 3189
  Genomic contig location: Contig_ID=SeqID_3189; Location=1..866; Strand=+
  SCN-specific regions: Sequence locations=1-4,26-367,395-866

SEQ ID NO: 83598 - DNA, 580 bp, Heterodera glycines
  Genomic contig location: Contig_ID=SeqID_3190; Location=284..863; Strand=+
  SCN-specific regions: Sequence locations=1-281,303-364,407-580
atgcttccttcgcttcgtcaaatgtggtactgtgtgtgcgatgtgcagctgccaatcgcgcagaaaatttgtcggaaagattttttggaaacgctgaaggaatgcgacccggcaaatggatggcttcccgcggtactttcaccaaaccatgtcaatttgggccataactttcagggccgaattgatgccatccgatcggcgatcaaaaaggacgttgagaaaagttcggcaagaatgggcgatgacgaattcgatgaggatgttggcggaccaatgggcgctgggggcggtgctgcggaagacgaaagtgtcgctttgggggacgaggaccgagaggacatgatgctgctggacgagttggccatggaggaggaggaaacggaggaggacgagacggtggacaccggcgaagaggacgaactgatgttatttgaaggggccaagaaataccgataaaactgcactcattttgacttttttttattcaaaaataagtaaaaaataactcaaattattcgttgccgaatttatctcatcattttaatcactcccgattagtgtacatataagtctcaccgga

SEQ ID NO: 83599 - DNA, 404 bp, Heterodera glycines
  Genomic contig location: Contig_ID=SeqID_3190; Location=4463..4866; Strand=+
  SCN-specific regions: Sequence locations=1-3,46-137,159-404
gaaattcaaaacaaaaacaataacatttaaaactctttggtgcctaaatcaccagctctaccaaaatgaccttaacgatggatgaactgagaaacaaagtccaaaatggccaaattagcaccgttgtcgttggttggcccatttcaatttaaaataaaatatttgacactcctttttcactccgaaggctctgtcgatttgcacgggcgactgattgggaagcgattgacggcacggcattttgttgaaatggcgcaaaaaaaggacaaaatgtccatgtgctattatttccttgcgatgacaattgaaggtggcaatgttaaaaattattgtcaattgttccattcattgccaatgttaggccacgtggccgaagggttcgaagtcgcgcggtgggaaaaacg

SEQ ID NO: 83600 - DNA, 1192 bp, Heterodera glycines
  Genomic contig location: Contig_ID=SeqID_3190; Location=2291..3482; Strand=+
  SCN-specific regions: Sequence locations=1-353,377-642,665-1192
atgcattcgttttctgtacgacttcgcaattcgcttttccatgcgctcatttcgctcgtccgtttccttcagcgtcaaatgatcgcgcgatttttcgcttccctcgaaattttttacggtcaccgcggagtacggctcgaacaggccgaggcggcacaccttttctacgcaggccgtgccgaattcatagcggagccaattcgaccgattagcaatcgcatcaaacactttggttgcgcgaaatgtcaaagcgaaacacggaagatgggccaaagcaaaggcaggggaattggcacgaagaaaagtgaacaatctgaaaaaggacaaaagttgagctggccaaatccgacaacaaaagcagcagcatggaggggagaagctgcttttggatgcaaaaacgccacaaattcagacggacaaagggccaaattagaccggaatttggtgtcagtctcccccaatatccgccaacaatttccgcggatcgattgggaagaaattgagagaagccctttcgtattggtcagcttcggaagcattgcgaaggtcccaaaaataaatcccattaaacattgagaaatgccttttaagctcgagtttatgcccgaggaattattccgctcatttctccgcgccttttcaaattttccttccatcatttttctttggcagacaaacagtgagacaaatgccattttagctgacaaaaagtgccaaaatctgcctaaaaatattcggtttgtccggtgggctccaatcaaaattttgctgggtaaaaaggaaatcgcagtttggcttcgattgtcccttatgacgttggcttaagctcatcccaatttgcattatgccattttgcacggcggcgtgaacacagtgaatgaggcgctgatttacggcggcagaccaattatgggccttccgcttcaggtgaatgacttttcttggaaaagacataaaaaaaagccaaaaatactataaaactttgctctttcagggcgaccaaccctcaaatttgcaacgattggtcgacttgggcatggccgttcaattggacattggccaagtgtgggccggacaactcaacgccaaaatggcattaattgagcacaattatgtcgcgttcagcagaagagcacaacaaataagtgccatggtcagaacatatcgcaatggcattggcgctgtacaacag

SEQ ID NO: 83601 - DNA, 595 bp, Heterodera glycines
  Genomic contig location: Contig_ID=SeqID_3191; Location=1..595; Strand=+
  SCN-specific regions: Sequence locations=1-67,90-308,330-595
aattcgtacaagcgactgcagccgaacaggtctaagcggagacggcatttagacgatttacgagatcaaaaagaaaagggaaacattttaagttgggcaccaacaaaaatttgttggactgtcgacaatcggacgagttcgttccgtttgtgcggccaaagttcgtccaacgttcacatcgaatgtcgtattggtggggccgacctcaacccgtacttggcattcgccgcactgatcgcagcgggcattgcgggcattgaagaaggtggggaaaggaaagcattttcggcatcgaacaacgaacactgtcaaaaaagggttggaattgccaaaggccgttgcctgcaatgtctacgcttcggccgatgccattcccgaattgccgaaaagtctgcgaattgcggcggaacttatggccaattcggaaatgttgaaaagagcgttgggttggtggttctttcgtttttattagcacattaaattattttaaggtgaaaatgttttacgacactacaaaaattcggcacgcattgaattggaggactttgaaaaggaagtgaccgattgggagctgagaagggcatttgacagatgt

SEQ ID NO: 83602 - DNA, 2486 bp, Heterodera glycines
  Genomic contig location: Contig_ID=SeqID_3191; Location=1124..3609; Strand=+
  SCN-specific regions: Sequence locations=1-399,421-864,886-2177,2199 -2250,2272-2351,2373-2486
  Gene Ontology: Mol. function=acetylcholine receptor activity; Cellular component=nicotinic acetylcholine-gated receptor-channel complex; Biological process=synaptic transmission
ttgtcccattgctttgcttttcgcttcttttaatgctttatcccttctcggccaagggcaatcgcagaagcgaagaccaactttatgaggatttattgtgggcaaaatgcgaaaaaattaaatagtttttttctcgaaggtatttttacaacaaaaacgtacggcccgtgaaaaatagcacgcaaattttggaagtgaaattcggcgcctctttgatcagaatcatcgacgtggtgaggaggaaaagtgatcagaaaaaagaaaaactaatcaatcgcaggacgaggtcaaccaagtgctcaccacgtcactgtggcttgagatggtcaaaaaggggcaattaccaattcggacattattaatgactaattaggcccataattaatgaccatttattcgcttctctctttcagcaatggttcgactacaaacttgtctggtgagagggaatcaatttttttttcttcttaattcaattgccaggaatccggccaaatttaatggcatcaaaaaattgtacattccctcggaccaaatttggaccccggacattctcctgtacaataagtacagtaattgtctcactaattgaccttacgtggaattccttcctttgaagtgccgacggagagccgcacatttccattgtgtccgatgcgatcgtttattatacgggtctcgtcgtgtggaaaccgccgagcatttacaaatcattttgcgcggtacgtttggttgacatccattggctttttgggctgccaaagggacccaaaaagttttgttcagatagaaattgaatactttccgttcgatacccaagaatgcatgatgaaattcggcggatggacttacaacggatttctgatgaacatctcccaaattccggttacattttcctaaaattcactccgggataagcttttattcccagccgcgcccagaagacgtgatcgagaatcgccattatccggatgggcgggaatacaaatacttggccttgggcatggacctgtccgcctatcacgcgtaccttttggcattcccacgaaaaatcattggacctttgaaaggagtttggagtgggatttgatgtccgtgacgagccgacggcacgagcagctttaccctggctgttgtgggcaggtgaacgaacaacagcaaaatgttgtgacacgaccaccttcgttcatttcaaggacaaatacattgacattactttcgcgttgggccttcgccgtaaaacgcttttctacgccgtcaatttggtcaccccgtgcatgctaatcggtacttaattgctgaccaaaaggccccctgattaatttgctgcccaattaatcccaccaattagccattttgactgttttcgtcttctatatccccgcttgtgagcacaaaatgacttattccagtacgttttggaaaatcaaaaggccattgtatcatttcgcccctaaccgtcgttcagtttccgtgttggtcactctcaccgttttctatttgattctgattgaactgatccctcccacttcgatggttatccctctgatcgggcgctatttgcttttcaccatgttcctcgtctcgttttcaattgcgatttctgtcgttacgctgaacttccatcgaaggtacttcagtgtgtcagtgatcactgatcagtgatcggggttgatcactgatcgtcccactcattaactgccgatctcactttctcaagggatggtactttgcacacaatgccccgatggatttaccgcgtgttcatccgcttccttcccaaacttcttttgatgacccctccggtggatgatgatgcccaatcggataatgacgaaagcaccagcatttcgggtagtttgcaaatgccgctttatttgtccaattcgttagacattcaaccgccctatggcaatgccaactccgacaacaatttcggctgctacgcccattcctaccgaagcagcggccctttcttggcacattcgtgtcgctctcgacgaagcattcccgccgcgggcatccgtctgtcgcaaacagcgcaagtgaaaggaatgagtgcggaagtgctgcgacggatggcggacaatgtttactttgtggccgaatatttccgagcaaagcagcaaagggacaaggcgagtgggacaacacaccaaatagccgtccccatgcccccgggggttctctccctccccctaatgctccatcgtctctccgggaggagcgggggtggatgacatgacgtgctgttacagctgctttctgttttgtcctatgctttctgtgctgtttaggtctctgaaaattggtcctacgtggccatggtgcttgatcgcctccttctgatcgttttctccacctctctcttcatcggcacccttctcattctttccagttcgcctcccgcaaaaagcgaatggggcgaacccctgagcacaatgccaacgacaaaaccactcagtggagacactttcgaattcgaa

SEQ ID NO: 83603 - DNA, 294 bp, Heterodera glycines
  Genomic contig location: Contig_ID=SeqID_3192; Location=193..486; Strand=+
  SCN-specific regions: Sequence locations=1-294
atggactgttttcgacccgagtcgcctaatctgccgaatatttgctccgatgggaatttaatactggatgaccaattgactcaacatcattcgtcgcctttcaaaaccggtcttccgtctcacaaattcgttaacttagctaatttattccgatttcagatgccgtaaatatcattcgagagtcatttgaattggcccaacaaatggacacaccgaatcccattacatttgactgcgtagaaagcgaaacacttgcggaagaaggcatacaacagagaatagctgtgaaagaaa

SEQ ID NO: 83604 - DNA, 740 bp, Heterodera glycines
  Genomic contig location: Contig_ID=SeqID_18896; Location=145..884; Strand=+
  SCN-specific regions: Sequence locations=1-161,184-457,479-740
atgcagcaaaagaatgccaaaacgtgtagagcagcagaagatgaaccaaaaaaagctgctattggaggcactggagatgaactggatttgttgagcttgctgatcaagggtgatcgaagcaaaacaatcggtgaggacgggttcgatttggagctgttcgaccaggacgacaacaacaacaacgacggggaagagcagggcgtgaataagggcaaaacgacgacggcaccgcagaaagccaagcgaacaccgtcccagccgaaggaatcgtcgttgagcaaagcgatgaaagaggtttttacgggcaacttcgagttttttaaaattagtctcgagacaccccgagcctcgaaaaatgagcctaaaaattcgagacttagactattcaaaaaccgagacccaaaaaacccgagactttctcgagtcgagactctcgagcagcactagtaattaggcattttaaaagtgccatgttgttaagatggacttagaccggagcaagcaaacaccatcatcaacagaaaagccgccgtccagaaaaggttcccgtaagggagcacatctgctggagatgatggaccaagaaactgcagccccaaaaacgacccaagcgagaaaggggtccgttaagcggggcaattaacacactaattgcgtcttaatcattggccattgtgaaaaaaaaacaattttagcgaagaaaaaacaacaagattttgaattcaattcggttgtcagta

SEQ ID NO: 83605 - DNA, 406 bp, Heterodera glycines
  Genomic contig location: Contig_ID=SeqID_18897; Location=83..488; Strand=-
  SCN-specific regions: Sequence locations=1-201,279-350,377-406
atggagatcgacaaggaaattgccgaattggaacaggaaatttccaaatgttattgtttgctcttgtaattgtaatattttggtaattccatttgtttcagcaatcaatgaagtggccaaggatttggagctcaaataccgggactttgtgccaagttacatcggtctcgccgattgtcaggataaaatccaaatggcactgcaaaatgggaaagaaaatgtaattaaaatggaagagaaattgacaaatgcggagaaggaaattgtcaaactcaaggtttgctttatcacatggaaaagcatttttgctgccaatttcaggaaaatgcgccacacaaaaagttgggagttgtccaggatttggtggaccgtttggccatcctcgacgaaatggagcagtgtctga

SEQ ID NO: 83606 - DNA, 239 bp, Heterodera glycines
  Genomic contig location: Contig_ID=SeqID_18897; Location=1919..2157; Strand=+
  SCN-specific regions: Sequence locations=1-66,88-239
atgcggtaggtacataaaattcatgtccatctttataaataatgtattaaagcattattatattaaaacaacaaaatgggaaaaatacaattatgaataaatataaagttaacaatatgattaaatggaaaaaagatcatcaaaatttgaacggagaatattaaagagacgtccgtataatttgtgggggcggtttgttcagcttgacaatgctctaaattaattattcaataatataa

SEQ ID NO: 83607 - DNA, 458 bp, Heterodera glycines
  Genomic contig location: Contig_ID=SeqID_18898; Location=520..977; Strand=-
  SCN-specific regions: Sequence locations=1-254,276-458
atggatgatgcaaaaatgaacgaaaaatgtcttaaaacaagagttgagcgggaccgggaccaaaacacggacggacaactgagtaccgaaatcccggttttttcccggttttcccatccaaaaagtcccggtttttcaacccgaaaaggttccggtccagggctgcacgaaatttcgtgtcgttttcgttttcgtatcgaatgccttttttcgtttcgttttcgtatacgaaaatttttttttagagttttcatgcagccctgcacccatgggcatttattgaaacaaatcattttttggctcctaaccgacaattttcgtatttaaacaatggatttttaattttttgtcatttagactgctgctggtagtcatttgccttataatctgaacttgcctgaccaacttttgccgaatttatatggtgcccattttccacgaattaatggtaaaataaa

SEQ ID NO: 83608 - DNA, 377 bp, Heterodera glycines
  Genomic contig location: Contig_ID=SeqID_18899; Location=586..962; Strand=-
  SCN-specific regions: Sequence locations=1-101,158-330,352-377
atgtctctacagatcttgtgagtcatgatttcattaaattaattaaaactttgcacaataaaaacctaaaatagtaaagaaaaaaagttcaaagcgtattgaaaatatttatgtaaaaaaaaataagatataattttaaaaaataaataaaattttagctcaaaaagaatattcgaacaagacaaaaaaattttacaaaatttttttgaaaaatcgggtgttccataatatggcttgaaatcgggaaattttcagattaaaattcctagggggttggaaaaaaattttcgtggaagacgaatacagcggacagaaagagcgcaaatggacattaaatttaaaagttaataattaggtacttaaattacgagaataaa

SEQ ID NO: 83609 - DNA, 279 bp, Heterodera glycines
  Genomic contig location: Contig_ID=SeqID_18900; Location=43..321; Strand=-
  SCN-specific regions: Sequence locations=1-279
atgcttctcatcattagagtcaccactatcatttgttttttaattccgcctaatttgtccattgaaatatgcgtaaggccaaacactgtcttgaattatattggggaactgatgtgcattgataagaatggcatgtcgtactaccttgataaagatacgccaaaacgctcaaataatgacttatattcatgcattcggcttgatatgaacttcacaaaatgtgatcagaatgaccctggtgcaacaatcaaaatcagcgatgctaacacaaaaaaaggg

SEQ ID NO: 83610 - DNA, 281 bp, Heterodera glycines
  Genomic contig location: Contig_ID=SeqID_18900; Location=901..1181; Strand=-
  SCN-specific regions: Sequence locations=1-124,146-249,275-281
atgacttttttggtaagaaaaaataagatatttcttgaagtattgtattaaatctgccaggaaattgtatgtaaagtttgaaatgttgatagttttttctagagagcgatatttggcgaaaatacggatcaggatcaggactacggactaggcatccatacggactacagacttatggactaaaaacccggaaaacccttactccgtataagtccgtatgcaggaaaaatacggacccgtatacggatcagggttttttgaaaagttttttaatcaataaa

SEQ ID NO: 83611 - DNA, 1909 bp, Heterodera glycines
  misc_feature (1790)..(1790): n is a, c, g, or t
  misc_feature (1792)..(1792): n is a, c, g, or t
  misc_feature (1795)..(1795): n is a, c, g, or t
  misc_feature (1805)..(1805): n is a, c, g, or t
  misc_feature (1812)..(1812): n is a, c, g, or t
  misc_feature (1846)..(1847): n is a, c, g, or t
  misc_feature (1851)..(1851): n is a, c, g, or t
  misc_feature (1855)..(1856): n is a, c, g, or t
  misc_feature (1859)..(1859): n is a, c, g, or t
  misc_feature (1863)..(1864): n is a, c, g, or t
  misc_feature (1874)..(1874): n is a, c, g, or t
  misc_feature (1879)..(1879): n is a, c, g, or t
  misc_feature (1881)..(1881): n is a, c, g, or t
  misc_feature (1894)..(1894): n is a, c, g, or t
  Genomic contig location: Contig_ID=SeqID_18903; Location=162..2070; Strand=-
  SCN-specific regions: Sequence locations=1-321,346-716,738-931,954 -1909
atgagcaaagaatgcgaaacggcaaaaaacatcggtgcctttggccttcgtcgtcagtccgaacgaattgaaaaccaatggttctccgctctgctgaccacgcgccagtcgacccgtcgcaccgtaaaatcgctgaatttggatgagaggcgctcacggaagagacactgcacaatcgcaggtgggcagcgaacaaaacaaaacgcactcgcaacagtttcccacttatatttccgatgaactcgaagcatacgtgaggggagaagtcggacaaccacagcagcagcacggcttttgtgcggtatgcaacggaagtgccatggaaaggggggaggaaaaggaaagcgaatgttgcattggaggggcacgagacaagcaaaggcactcgacggacgaggaaggcgaggaactgatcacgggcggggaggagacgggcgaagacgacgcacggacgatggacgaggaggaggggcaaacggaggacgacgaagggacaacggacgcactaaacggacaacagtccctccctctcttggaccttgtcgagctgcgatttgacccgaccgaattttcaagcattcagcaaagagtgtgacactaaatttttattttccaatccattttgttaaaaaaatagcattttgttttttttggtgctggaaaaagtcatttgttcaaaagcgaaatcggtattacatatagctaaaacagaaaagttgtgcttttcataatactctccgttgagcgactcacatacaaaagtgaatttgcatgaataaattaaggaaaaaagccaacgtcacgtgcatttaatcgagcctttttttgtacaattaaagaattcagtgaattaggcagaaaatggatttgtgttaagttgtagccatagcaacggaaatggaatgggcgcgagaagttttctcacacttcgtgatacatacaattaatcttaaagtgccggctgtcaaactcagagtcactcatttgagcacgcagtcacttttcgtgtccctccccccgtcgctttttgtcggaattttgcgcatttaatatttattttagtttttttgtgtgaaatgagtggccaacaaaaagcggaaggattattcccagtggacgaatgcttcgggacgaacatcggtcgcccaatagccgaactggtcgatgagaacggattcggcagggaaagccgagaagaattggtctctttcgaagagttcgtgcggggcggagacaaaaagcgaggcaaaaaggagaaagacgaaggtgaaaaaggaacaatgggagttgaagcggcaaaaagacaattaattgttgaagggttcggtttccgtccgattgacaaccggcgagggggggaggacgacgacagattcttcgacatcgctttgaacagcggtggcacggtgccggaggatccgatgtcatcggcggatagaatgccaaaagggagaggacgaagtgagctgtacgcagtgaagcagcatgaagacgacgacaacggcacgattcatcaatttaatagccaaaatttggcatcattaaaaatggttaagacaaatggggccgtgtggacaatcggcagagcgaaggggacgacgacgcaatgttcgcaagcgcagcgaccacgacgaaactgcgtcattcgctgtgtccgaccgtcggggaaggcggcggatggctaagcgggggacggacgcgaagagagaggtggggacaatgtttgggcagaaactttggtggtcccgaaaactttgttttacgaaacaatttctaggtgtaatctgagncnctnctcgatttcnaaccctnaacctaaattcgaaaattttaaaattttcttttnnattnttannttncaannttcttttctnttttntnacccccccccctnaaattttcaaataaa

SEQ ID NO: 83612 - DNA, 2248 bp, Heterodera glycines
  Genomic contig location: Contig_ID=SeqID_18904; Location=548..2795; Strand=-
  SCN-specific regions: Sequence locations=1-98,122-237,259-954,1025 -1064,1086-1646,1669-2248
atgagtacgaggtaaaatttaattcacataactagggaagcaactaatgatttaactatttttttgttcgattgttttgaagaaaggagctaaaaaacgcatttctgtattaaaaattttcgattctgatgtcattatcggtcactagaaatcgctattttggcgacttcgtcactaaaatagttaaaatcactattttggagttttgtcactatttttttcactattttgacattttttatttatttatttatttatcgaacaaaccacaaggtgctatgcactctaacagtggtgtaaaaagaaaaaagtgagaataaaaataaaacataaatggtagtcaaaaatcacaaaaataagtgtcaaatcacaaaataggtgtcaaattaaacaaacaatagacataaatgaaacaaatcacacctctcaatagggaaaatatgcattattgcttaattattccttctgcaatttctctgaattttttggggtcatttatttccataatatttttcggtaataaattccatgaattaataaccctattaaagaaattattttttgtttttgtaatatatatcctattttgtagtaaaaagggtttgcgaatagcccgtttagcaacagcaaaaaagttagatggtttaagatgtgtatgtttttttattattttaaaagtagttgtaatatcattaattttgcgcctaatttccaatgtcttaattccgcaaaacattaatcttttttcatacggcatagggacaagcccacatttattgaaggcttttcttgtaaagaatttttggactgcttcaattttgtggacattttcttttttcaatggattccaaatttctgtggcgtattctaacactggtctgatatagcttttatatgccaaaattaatgtttcaagcttccgagtttttaacgcccggagaagctgaaaacaagaaaaatatgaattttttaaaattttattaatatggttagaaaaggatagtttttgatcgattaaaatgcccaaatcccttacacattttgtttcgggcaatggttcgccatcaagaaaataaataaattttgtgttattttcaccaaagtaaaggaccattgttttttctattgatatttttattccattattttttgaccatttatttattgcctcaagcgcggaagataaattctctctatttttatcatttttatgctcaatataaattttaatatcatcggcaaacattttaataccaacatttttaggcaaattgttcggggggatcattaataaaaataagaaaaagcaaagggcctaagacactaccttgtggcaccccactataaatgttttttgaatttgaatacgctcagagattttaactctgaatgaacggtcatttaagaaattttcgataaatttatgaatcttaccattaataccgatatttttaagcttttgtagaagtaattcaattggaacactatcaaaagctttagaattatcaatatatgtatatgctctaattatagtccagtctctattaatccccctttattttatttgagactattatggcacatccacccccttttgttggacggtttgcaaaaattgggttatatttccccatatttgagaattcagaaataattgtattttttctttcagccatgtttcggttataaagattagtcccggttcttggtttccattaaataaattatttcctgtaccttattgcttattgaccttgcattaatgagtatacaggagagattttggttttttgccattttcgtattttgtagtggtttgttcgatgacccctatgcattattttctcatgttttgagagggtgtgggtttttcaatgtgataatggaaaggtcaacgacagtatatttgaacagtccttcggacttattcatttcatatgcttgagtcctaagctggtacaaggctcgcagttccgagcgggtcagaccccgccggaccgtgatattttgcggaaaattttggtgttttttaagtgttttgcgaaaattttttatgaaaatatcacggtatttgcgttcagtgaatggaattttgacactgcggcgctttttgttcgattgatcggaacccacaactgtccatggatggcgatggacatccccaggattcaaatgttcagtgattccgcattcgttatggaaaatttttgacagaaattactcacaacttcgttaaaaatgaattaaa

SEQ ID NO: 83613 - DNA, 197 bp, Heterodera glycines
  Genomic contig location: Contig_ID=SeqID_18904; Location=1..197; Strand=-
  SCN-specific regions: Sequence locations=1-197
cggtgcaccccaaaacgtcgtcggccgaaacgtcgtcggaagactttttgaaccataactttgttcactgtcaatcaaattaagaattgttggtgttgttcgatagtctatgtgtttattattaatttgcaaaatctcaaaaattttggttaagtttcaaaaaagttatggccagaaggaactcaaaaacccagtaa

SEQ ID NO: 83614 - DNA, 133 bp, Heterodera glycines
  Genomic contig location: Contig_ID=SeqID_18905; Location=6..138; Strand=-
  SCN-specific regions: Sequence locations=1-133
atgatcaacgaatacgaaatggacgaggacaaaatgtatgaagcatgtgaacagcttggcgaaatgcatgcgaattatgcgcaatatgggcttaagccacattttatggacctttttcagcaacaattattag

SEQ ID NO: 83615 - DNA, 592 bp, Heterodera glycines
  Genomic contig location: Contig_ID=SeqID_18905; Location=197..788; Strand=-
  SCN-specific regions: Sequence locations=1-38,76-310,344-592
atgccgtttttggagaccactttcagtctcggctctccaataattcaatttttgtaattaaaattttatatttttgtgttcttatagtcctaactttgctctatttaatcactatttctctggctctgtatctcttttatttttctttaaatcagccatcaaaaatacctacctctaaaatgaccatttttacttacttaactctaactccctaaatacttttccattggtattgatctcttgccagaataatggcaacatattattgataataatggcgggtattttgaatcatgattgtgttttgttgaaatttaaaaaaaaattttaataaaaaaaatttgggtatcaaaaattatgttccaccctaagtatatgctgaaatatttttaggatttttttatgttggcgtaatgacatagcgacaagccgaagagatttgttccacaagacaatgctgaaatgcattcagtcaagcccgaaaatgaacgaggttatcgcctgcggctattattgctacagagacctgacgaaatggccaaaactaaacagaatatggtcagaaagaaaattaatgggtttaattcgttaa

SEQ ID NO: 83616 - DNA, 237 bp, Heterodera glycines
  Genomic contig location: Contig_ID=SeqID_18906; Location=472..708; Strand=-
  SCN-specific regions: Sequence locations=1-237
gccgggcagccgaaagtcggccatttgcgagagcgaccagctgagcacgggcgcttctgagtcccgtttagaagtagcaaaaaatttcttacgtcgcttttacaaccattcgacgctgagactaacggggcggagacggcggcgcggaaatggcacaaaaaggggcgatgccgacaaagggacagcggagccgccgctgatgtacagctcggcattgggtcctttcttcgagatgag

SEQ ID NO: 83617 - DNA, 1239 bp, Heterodera glycines
  Genomic contig location: Contig_ID=SeqID_3193; Location=2032..3270; Strand=+
  SCN-specific regions: Sequence locations=1-3,25-43,65-199,221-296,318- 363,434-648,670-976,1160-1239
atgattttctgtatctgggaatttttcggtcattcaaaccactgctttttgaagggtaattaaattttttgaaattttataccattacgcttacgaataatatcaatggaaattaggaggatggccggccgagaatcagttgacctcggttttaacttttcactttccatcatcttcatggtgacaccttcacttcctcgtacaataaaaatttacaaaatatttgtattatgtagcatttaaatgatcactgcaaaatgaatacattggattgatcaaaaaagtaatagaattgcaataaaaaaaatatttttataccattgaaaaaaccattaaacacaatcaatctagacagtccttaacaaaaatttatgaaatttatttttaaattgatatttgttatcaaaaataattttgaatatttgaaaaaattgcactttcatggccctgagctgatcattaagagtgtattttttggcctgagacccgtccaaaaatcttcgggtaggatttcgggatccgggacgagaaacacatcgcattcttaggcttaggtctgcttgggcctatgcttagactttatattgtaaaatttttattgtagagttaccattcactttgaaaaagatggcattggagaaggtggtgccaacaccgttaatgttgacggaatttgatctttgcatgcaatttaaaaaagagataagtgctggtcaccatgaagattttgcagtttttttctctgtctccatatttctctcagcataatgggaaaggaatgaatgattctctttttctcattccgcacacactctttcgcctccttccccatctcatacttcttttcctctccgtcacacacactatttcccctctttgcatcaatatctctgctcctccctatgtaccaatatgcaaacccataaattttcttttaattaatttccattttagttgcatattttgctgtctgttcatcgcttctcggccttttggctaagatcaaagtgtagttacagttctttacggcttaatctccgtaacggcccttaccgggtcaaagagattaaccaatttttgggaattggtcgttgcagggggcttgctccctctcggctgtgcgttggcccgttattgcacttgcttacgggaacggcgcgtctcccctgcgggggagaacaaaattattttgtaattcttcaatccaaatttctcttttgaatagctgtgtgatcaaaa

SEQ ID NO: 83618 - DNA, 1610 bp, Heterodera glycines
  Genomic contig location: Contig_ID=SeqID_3194; Location=247..1856; Strand=+
  SCN-specific regions: Sequence locations=1-473,495-1610
atgtggtcggttgctttcaaccgagtcagttcgtcccaaaaaggttttatgcctgtggacggttgtgccgaacacaattttgtactccaatcgatcatccaggacgccaaacgtgccaaaaaacgatgctcaattgcgtggttggatttgaccaatgcatttggttcaattccccaccaaacgattttcacagcactaaaatggtctggactatctgaccaatcgatcagtgttgttcgacagttatatgccacgaattccactcaaattcggcattcaaacggcctcactcccgaaattccaattcgagcgggagtaaagcaaggatgcccgctcagtccaatcatttttaacctcggaatagagcccatcctccgcaccattggccaactcagaactggctataagttgcaagaaaaacgcattgatgtgttggcttatgccgacgatctcgtccttgtagctgagtcgcccgaagaactgcagaaaatgttggacgccacctcaacaatagcaacttgggctggactttccttcaatgcccgaaaatgcgcgacgctggacatcgatgggcgaagaaaaacagcattgaacacaaaattttccattcaaaatgctcacccgcccatcctaacaatttatcaattctatgaccatcttggcgttccaacgggctatggttcagcccaatcagcgaccaaaatcctagaaaaaatgaatgaccatgttcaaaaaatcgatgcgtctcttttaacaccgtggcaaaaatttgacgcaataaatactttcgtccttccgtgcattggtttccatcttaaaaatggtgtggtgcaaaagaacccattaaatgcactggacaagaaaatccgcaattacggcaaaaaatggcttaatttgccacaaagagctagtactgagcccctttatctcagccatgccatgggtgggatggggatgataccactcaatttgcttgccgacataagccaaattgtccacgcttatcgtcttatcacttcacgtgatttgtcctctttgtcaatggatttgatcaaaaccgtggtcaacaaacggattcgacaacagccgactcatcaacaaattgccgaatatctaaacggctcgatgaaaggccttttccggcagtttgagtcgacggacatctcctcaaattggacacgcgtcaggcaggcaaccgcccggctgaactccaaattaaaaattgaatggaaatggtcaacgaatgaagagcgattggcactcgaactcaacaatgacccgctcaatccaaaaaccgcggaatattgtttgagagctgccattcgcgatttcttccgccgtcgtctgctctccaagcccgatcagggcaaagttttttcaatcacaagcgcaacaaccgcttcgaatcactttatgaaggccggcaacttcacgcgattcgccgattggcgatttgttcaccgcgcccgattggactgtgttccgctgaatgcaacgcgtcgattcggccacggagacaaacactgcccgccgctgtcacgatggacaattggaaaccctcccacatgtcctttgccattgttggccacatcttggaaagggaatcacgc

SEQ ID NO: 83619 - DNA, 439 bp, Heterodera glycines
  Genomic contig location: Contig_ID=SeqID_3196; Location=280..718; Strand=-
  SCN-specific regions: Sequence locations=1-13,35-53,75-133,162 -389,411-439
atggttggtggcatcattagcattagaattgtcagcccagcagcaatgccaactgggaaaggaaaaaggttcccatgcttcttcattggaggagaattggtggcaaaaaagggaaggattggagaggaaaaaatatggaatgaatgaatgaaagtgggaaatgtgaattagcacttgccaagacatgccttttatggggcagaaaagtactgatttttaagattttaatcctgaattggataaaggcattcttaaagattattaacatgttctgatttttaagattcgtcctgaattgggaaagcaatccgagggattaaatgtcctgatttttaagattcgtcccaaattggataaagtcaatccgagggatcaagtgtatgccaatttttcattcattaatattttaacgtcataagattaataacaattaaataaa

SEQ ID NO: 83620 - DNA, 1266 bp, Heterodera glycines
  Genomic contig location: Contig_ID=SeqID_3196; Location=1376..2641; Strand=-
  SCN-specific regions: Sequence locations=1-80,102-201,241-297,320 -364,401-434,456-519,541-901,925-1056,1082-1266
atggtcgaaacggtggccaacgaattggcactgtccaccagccaaacgcacgcgctgttgaacaaagcgatcagacggtgggtgagatggcggaggagcagggccaagctggtgaactgtatccccccccccacacccttcaatcgcatttcaatcggttcctccacctcttggccaactttttttcgaaattcattctcgaaattttcaaattatattattctttatttttaattttttctggaaaccccctctaattgtaagaaattttgaaaattcaaaaatttgtaactctacaaaaaagtttgtagaaaaatttgattctgaaatttgggaacaaattttacattgaaaaaaaacttccaatattttttattcaatatattttatttttttaaaagatcatggatttaagcaagttttaagggttcatctatttgcttatttgttatttgggttccaatttttgttttttcagtttgtccgaatatttcgactcaatttgccgtgaggcgcttgaacagcaacaacacaacacaaatgatcgccaacagcacatagcaacagaagcagaaggaaaattgggggcaaaaacgaaaagcgacgaatgcccggcgattaaaaaattaaaaatttcacattttgtcaaatgatacaaattttgtttttttttattcttgttgattttatttgttgaagagagattttcacccctattacagtacttaaactgggtttttttggtctaaaatgaggccttcttcaaccagattgaccaatttcaattttgcgaagccttatgatcggaaaggagcttaattcaaattttaatagttttacatagacagtttttattcaagctacaacaacaacagcgacaaaaatgcataaaataagaacccaaaaatgaaaaggaaacaaactagctaaatggacagtgagtgaactgaaccaatgaaaaaacatactgaaaaccaaaaaaaaattgacagaaaaaaactaatgagtgttaatgactcgtttagcaacgggcgtgaaaggtgttcatcatcctctttcgctgctgctgcttcttctgcctctgttgttcatccacttttgcggagaccaaacaaatttgacaccttcccctttataccacggtttttgctggactgcggccggttatccgtcaggcgaagttccgtgttgttttcaatgccgtaataatgcattgttgctttatcgttattgttatgttcaacggtgaacacaacgatgaataaa

SEQ ID NO: 83621 - DNA, 612 bp, Heterodera glycines
  Genomic contig location: Contig_ID=SeqID_18909; Location=189..800; Strand=-
  SCN-specific regions: Sequence locations=1-235,257-351,404-612
atggccataaaatatggaccaaaaatcgcaaaatatggacataaaatggcaaaaatgtcaaaatatggacataaatttttcaaaattgaatgtaaaatttcttcaaatttattggttgaaattgcatatgagatacatttccagattttttgactcggtaaggcgctttgacaaagacggctttcgttttgcaattagtcggtcaacattcggaaattggtctcgaattttttcggcaattacgtgcaatcattttaaaagaaaaaaaacataaaagccaaaatttattaatttttttagcgcaaaatcaacaacaaaagcgaaattttcgcttttttgcttatttttgacataatttattaatttttaagaaaatttaaatttattcaattgaaaaatttttcgggttttgggctcaaaaaggctaatttagctgctgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccttcctagaagcttcaaaccaagctaa

SEQ ID NO: 83622 - DNA, 154 bp, Heterodera glycines
  Genomic contig location: Contig_ID=SeqID_18909; Location=549..702; Strand=+
  SCN-specific regions: Sequence locations=1-154
tgattgcacgtaattgccgaaaaaattcgagaccaatttccgaatgttgaccgactaattgcaaaacgaaagccgtctttgtcaaagcgccttaccgagtcaaaaaatctggaaatgtatctcatatgcaatttcaaccaataaatttgaagaa

SEQ ID NO: 83623 - DNA, 554 bp, Heterodera glycines
  Genomic contig location: Contig_ID=SeqID_18911; Location=810..1363; Strand=+
  SCN-specific regions: Sequence locations=1-554
atgactccgccctctttttatggatgtgccaataataagaaccctcgaaaagaaggcaaatttgagtccgaaaatcgttgtttctgccccgaggcggagctgtacgccgtcgaatgcaaaaaggtgggaaaagcggtcaggttttgtgctgtttgtgtgaacttaacaagtgcggaccgaccaattccataatgattttgctaagtcaattaaaccaagaaaagggtttggaaacattcggattttgaattatttaatctcaaaattcagtcgatccgcttttgcccatgtcccatatttattaatgggctctctctctttcgtctttttccacttaatgcatttttttcccttttaaggtcgtgtgcaataaaatgaatcggcgcaaccttttaattgagaaatgctggatggcgattggcttcattgtgcgtaaggttttacccacaaatttgctgctgctggtggcaccgctttatccgttctttgcccgtttagtttgtggtcatggtaaactttggccttattggattacaaatttggctttggtataa

SEQ ID NO: 83624 - DNA, 113 bp, Heterodera glycines
  Genomic contig location: Contig_ID=SeqID_18911; Location=1..113; Strand=+
  SCN-specific regions: Sequence locations=1-91
ataaatagggctccaatttttaggcaaaagcctatttttttcctgagctccccgtggcctgaaacgcacgaaaaacatgttttttttgggctgttgttaagctattttttgtg

SEQ ID NO: 83625 - DNA, 1394 bp, Heterodera glycines
  Genomic contig location: Contig_ID=SeqID_18911; Location=1673..3066; Strand=-
  SCN-specific regions: Sequence locations=1-188,210-211,233-442,492 -514,556-649,671-1394
atgacgaaaatatttattgaaaatgccaaaatgacgacgaaaactcaaattgttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagttattttttggaaaaaaattcttcgtaaaaagtgaaataggcacaaaatgccataaaaatgaccaaaataggcttagaatcacatttgaatattttacaaattaatttttgatatatcattttttgaaaaaaaaattcgattttttagggatacattttcaaaaaaattttttaattttttacaaaaaatttctataaattctcaaaaatcctcaaaatatgtaaaaaaatgaaaaatatgtacgaaaaagtccaaaatatgtaaataaaagtcccaacttttgttcgcaaacacaaaaaagaaagtgtttttcctactaattagagcatggagaatccaggaaaaaaaatatgtatttacataaaattagcagccctaaaaatgacagttttaagtgccgcacccttttcgtggcgaaatgcacttttttaatgtaaaaaaatgagacacttctaaccttttcaaacagttaaaccaggaccaattaggtttcattcgaatttttagaatttctgtgcacaataaaactagtgtaagttcctacgcatttattacagacattattttacacgatgatgaacaattggacataataaacaggggttctttttttggtcatttaacaaatattgttgttccatttgtccatcgttcgttcgttcgctatttcccatatgtctcttcaactgatgcgcttcatcaatttgttggtccacactcggctgtcatggaacacatgtacgtagcactggcacatggcgcggaattcttcctcaatgtcgttgtaatcggtcttcttgagcatcacttccggctcgcacaaatttgtgtagcgtccccattcgctgaaagtgtcgctaaagcccctgctgaactcttcttaaacgggaaacaaaacattaaatgatcattttttgcatcttccaccattacccatcatttcgtatgttttgtgcacttcgtggccacactggcgacatttgtacttcacctgcagtgcgctgtgtgtaaaatctgtaaagatttaaaaattaataaa

SEQ ID NO: 83626 - DNA, 147 bp, Heterodera glycines
  Genomic contig location: Contig_ID=SeqID_18911; Location=2563..2709; Strand=+
  SCN-specific regions: Sequence locations=1-13,63-147
ccctaaaaaatcgaatttttttttcaaaaaatgatatatcaaaaattaatttgtaaaatattcaaatgtgattctaagcctattttggtcatttttatggcattttgtgcctatttcactttttacgaagaatttttttccaaaaaa

SEQ ID NO: 83627 - DNA, 1172 bp, Heterodera glycines
  Genomic contig location: Contig_ID=SeqID_18912; Location=10..1181; Strand=+
  SCN-specific regions: Sequence locations=1-73,95-294,319-595,619-1172
catttcaatgtttcggaagccgaaaagcaagaaagttggcgccgatatacgcaacattcggcgtcgcgcggatgactctgaaggagaggagaacaacagtgggccaaggcgatctccctccacctgggctgatgagatggacgattaccaacaacaacaacaacaaccaaacattggcgctgaaagccaacagcacggcgagggtcaaatgacaacgaccgcagcacgtcccgtgggactgagttttgacgagagagagggtgaggagcaaagcgataattattatgctaatggaaatgttaaatgccaataaaagggatatccgtgtaatttttgaaaatacttagttacgtggtttttcaaatttcatatgtgccgcgctcgatggagcgctgcattcattgcttaaggggacgacgtcactcatttcaaactgaagcggcacactgcgagcggtcactcctctgccgccgccgcgcgtaggcgcagcgttgagaaagcggcgagacacaaacagaaaacggtggcggacgaagagcaaacggcgggtacaaacgaagcacagaaacaggttttaaataagccaaatttggatcacttaaataaatatttacaccatttttaacaggtcaaacaagaagtgctgccctctagcgaatgggaaaagccgaagcaagggaaaatggaggattctcagcaacaacaagacggcaaacagcaacccaaattcagagaaccaacgggagaaaaagtgagttagcccccccccccctctccgcaaaaacttgtcgtttggctttgaaaaaattagtacatgcagaccgatgacaatggggcgactgttcgtgccgcatttccggcgacaatgaccgatattcctgacgcaaaagcagtgtatgaagcgcgcaaaaaaagagaaatgatgagacaggttcgaaattggaaggagaaaaagtcattacaaaggtgttatttagggcggattgcccgcctcccaagactacattcctttggatgacaccattagtctgaaaagtggcagacaatctggggaacgggcacgacttgtgcgcgaagacgaaaatgacatgtcggacgaggaggagatgggcaggttgaaaagaaatggaatttggagaatttttctgcttcaccatttctgcattttttga

SEQ ID NO: 83628 - DNA, 658 bp, Heterodera glycines
  Genomic contig location: Contig_ID=SeqID_18912; Location=1275..1932; Strand=+
  SCN-specific regions: Sequence locations=1-149,176-658
atggaacagggtagcagcgaggaggacgaggctatggaagaaggggcgaaaagcaagagtcgaatgggagaaactgtcagagggaggtacaacggaaaggcagcggcagggcggcagcacaagttggtgcagtacaacaacggaaatggagaggacgaagaggaagatgatgacgcattgcaacggtgggaacgcgaacagattcgcaagggggtcagctcgcacaaggttggcacctacgggaaaaacaagaagatttttcattaaaaaaaaaaccgataggtcatgcaaatgcaagagcagttgaacgccacttccctaaattaccggggacgtcccctcaatatgctcgactctggtgaggcggacatggacatcgaagtggacatactggcgatggaccaacagcaaaatgcacgaggcgcaaatgcactaccgccaggtgttaagcagaagcggaaacagaaacaaacaaatcaaatgactctttaagaattgaggaacggccattctgctaaagtcgtatcggtggacgacattctcggcacaattcgccaaagattggccgacaaaaaggagcaacggagtgccaacgacgaaactttgatcaaaattcgcaaccaaatgacggaaaatactgaactcattcataaagtaa

SEQ ID NO: 83629 - DNA, 874 bp, Heterodera glycines
  Genomic contig location: Contig_ID=SeqID_18913; Location=190..1063; Strand=+
  SCN-specific regions: Sequence locations=1-874
cacgccattccctttcatcatttaacctcttcattcgcgacttcgtctcttggcaaccaaaaccaaagatttgccccatcaatttgaatgctgtaaatacgaagagccctcctttggatgtatacacttgtcatctcctcctctatttaatgttcggaaatcattgaccacttcatttctctccggtgagtgagcagaggcggtcgacttacttcatttttctttcaatatagagctccgaacttatgatgtgtggcgctgcgaagacggaaacgaatgtgcaagtggctgttgtgaatgtgaactcgggcgtcattggggccaatgggaacggcgtgttattggcggaaagggaaaccgactcgcgaaatggcgccgaatttacaccaaactttgacaacactcaccaggtggaagattagttcgctggtaaatgggcgggcgagcacaatttttcctaccgatgttacacaccaaagaatgcattcattgttggtgtaaacctaaaaaagggtttgatctctgatcggcgcgtcaaagatcactgagctgtacaaaattaggaaccgaagtgatcggctgctcactcgatcgttttacaacgctgcactcagagatcagattgtcaatttccaaggtcaaacgcaaaaaacacttttccctttccgttggtgtttaattgccgattattaacttccctcccactaatcatttttgtcgtcagtttaattgtttgttcactgttcagggcaatttgttgccctcctcgttttctgcctgcggtgcttccacctcgagcactttgttgtcgatgccattcgagtgcagccatgacttggacacgaattcactgcaggcactgcaccacgacgag

SEQ ID NO: 83630 - DNA, 973 bp, Heterodera glycines
  Genomic contig location: Contig_ID=SeqID_18913; Location=2156..3128; Strand=+
  SCN-specific regions: Sequence locations=1-741,763-930,953-973
atgaacttttcatattggcgagcaaagattctgtccacttcaattgaatgggccaaatcgtttgaagaaatcgaggtggcggctttttcaatcctaataaataaaaaaaattgcgtaatttcagaggatggacgactcggacaaagaggcgatggttgtgaactcggccttttcaattctcgtcttttctgaagcgtttcacacccccgagcggttcaccgatcgcattatgttcccggacggactgtctgggttccgcaatttcagtgccaacattatcaaggagcgcagtggtctgatccccacggttgttgccgttatcaacaacattttggtgtgtgttttgacgggggttgaaaatggtgtctccgtttggtcctcccaaaataggtcccaatccgtcgaatgcaaatgactgaaattgaatatgtgctccttttggccattgtgcttttcgactcaggtccgtccacatgcctccaattgctttttgcgtttccaattttgccccttttgtcaatttttccttcgtttgtctcatttttcagaatgtctttccctcagcaagtcggccgttgccattatcaatgaaaaacgcgccgctcttttggcgagtctaagacgtcacctgaacaggaaattgcgcgacagaatggaggcggcggtgcgaatggcggaacttttgttgaggatttcgaatgtccacgtgagtggccaaatgtgttcttttaaagtgttttcccttcatttcgcattctttcattttccaaatccgtttatttagattttttctcttttagaaagtcgctgcattcaaacgggaaactctctgcaccattgaaactttcaatttgatgtctccccatccgtgggtttatttttgacatggaattttgattatcccattttttgctcccttttcagtctcacgatggagatctctaagaagtacgccgacgtgtcttttttctga

SEQ ID NO: 83631 - DNA, 2047 bp, Heterodera glycines
  Genomic contig location: Contig_ID=SeqID_18914; Location=90..2136; Strand=-
  SCN-specific regions: Sequence locations=1-70,92-379,421-459,481 -548,570-762,786-791,820-1020,1049-1217,1296-1343,1390-1459,1481 -1811,1834-2047
atgcctaaagcagccaaatcaaacgctgtgttaaatcgtcactggatttcaaagttcccggaaggaacttattcaactgatggaaaaattaatccgggactttacaaattgattgatatcgccaaaattttcattggaggtcgggcgaaaattgataaagactgatattaaatatgatttttttttgcgtaaatacacttggtttttccaatttttagcacatatttttgcatttttaacacatatttaggccttttttttggtttttagcacatattttgggtttttttagcacatattttattacatatttcaggatttttagcacataaaaatcccagccctaattataacagatattgtaccaaaaatagtcaattttcatttttgaagcatatttttgaaatatatttcatagaatttcattaaaaatcgaatttaagaataaaaagaattcgccaataattttataaattgtctgtttttgtttgccaaaattgaaaattttaattcctttttcctttttaaaatctttggattaatttaattgatcaatgtctataaatatcattcgcttccgcgcgaaatgtgccaatttttcccccaaaattgcgcgttcgaagcaactgcaaagcgtaactttagtgatcgaagtcacttttgacgatgacgagtgatcgatgggacacggattatttgtcttcaggaaatcgcattttttttggacgaaaattggggctctattttgggaactatcatatttaaaacatgttttttaaaacactattgaaaatccttgtataaaatttaaaaaccaaacgaattattttttttacataaaattgcagaactaataaatgcatattttttatggctttttgattttttgctaagtcctcactaatcaatgcccccactctgttaattggatagattattttcggcatagtttttgtaattaatttttgtaccattaattatggtttacactttgttgtttttttcagtggatcaagcataaagaaagatattttatattttgcatttaatggtttatgttgacacattcattaatacaacaatctctgctgcaaaatgtgctgaaagctttttccgcacatttattttttccatttaatttattcaatttgtcatcatttttccattgaagtccttttcatccatttgatcatttttaatcaaaacatttatttgtgaattattattgataaattaaaataaaaaattgaaattttaaatattcttttgtaaatgaattttttcataatttaattgccttcaatttgatcatctcaaaggcatcgggtgccgccgttgggaagtaattaattagttaattaattaaattaattaattgattgataattattaaaaatattactctaaaatttagccatttgttataattaattaacagtgccggaatcgtcaaaaccaagtctggctcagtatcaggaattgggatctggggcggagataagacgaactgtgccggggtcttgaaaatttagtatgctttcagaacttgggaatcgggcccgggataggattaacagtgccgggatcttgaaccgaagtcgtgatcagtatcactattttggaaccgggccagggaaagattaccggtgccgggattttgaacaccaaatcaggatcaggatttgggaaattttcaaggacgtgttgttttccggaaatcccagttttaccgggaacctgaaaacaattctgggtcagtatcccgggaaaatcgcgacagttaagtgcctgatcctgtcctttctcgaatgaaaattttttatttaaaattttcaatttgtttaggatgtggcattggagctaatgaaattgttgtcattccattgtcatgaattggacgatgtttttacattttttcattttttattccttctttttaacttttatgcatttttgagggcttgaagaaaggggctcaaaaatagcatttctgtattagagatttttagtgcatataaaagcatattttgaggttttcgagaataaa

SEQ ID NO: 83632 - DNA, 1059 bp, Heterodera glycines
  Genomic contig location: Contig_ID=SeqID_18915; Location=255..1313; Strand=+
  SCN-specific regions: Sequence locations=1-337,359-758,781-1059
atggaaaatgctgaaattaaatctcaacgaaaaaataaaaaactcgaacatgaaggctgcctttatgtcttccatttgtttaatgccgatggtgacgtaaaattttggcgctgtgaacatcagcacggcgaattcaaatgccgagggcgagtccacacaacgctaaatgacgtcgtactgaagacagttggtatacacacgtgcaaccgcagcgcggcaaatgtcatcgcacaaaaaaatcaccaccggcattaaacgacgtgccgctgaaacgatggaaacgccagcagcaatcagggcacacacgcttcagcaaattccaacgccactaatggcaaacattccaacaaagaacgcgacaaaaaaaaagtgaaaaatctatttagttttttactttttcacatttttggttttaagcttgtgaagcgagtccgccatgaaattgaattgccgccgccagtgccgttaacgcttcaagaattggaacttcccgagcagtaccgaatctacaaacgcaccgaagaagctcaggagcttttccttctggcggattcaggaacatacaccgaaaatgggcgagacggacaacagcgttgtgtttaagggcaattttcagccattttttaattttataattctcatttttggccgactttctttcggaaattgggcttccgaaatgaagtacatttacgctgacggaacctttgcaagtgcaccaacgctcttttcacaactttacgtcattttggcggggtacttttttgtcaattttgttttacattcgtttttcaccaaatttcagtcgtggaaaatgggtgtttccggttcttcattgtctgcttacgtgcaagtcgcagtccacgtacgaaaagatgtttgacatgatcagaaaccgctggccgacatttgcaccgaaaaacgcatccatggacttcgaacagcgatggtcaacgccctccgcgcaaaacatccacagtctcaatcaacttttgtctcttccacttggtgcgcaacatgaaatctcgcctaacagacgaacaaactcgcgtaagaaaa

SEQ ID NO: 83633 - DNA, 188 bp, Heterodera glycines
  Genomic contig location: Contig_ID=SeqID_18916; Location=440..627; Strand=+
  SCN-specific regions: Sequence locations=1-188
gccgagctgaacattgcgtcgttgaagcgttttgaggacatggaattggagcggcggaagcgccatcagaaaccgacaaagcgactcgcgttggacgggccgcgtgtgcgcgagctgtggacacgggacggaaagcatttcatcacatttgtgcccgaaccaccgccagccgagcaatgctttccaaa

SEQ ID NO: 83634 - DNA, 360 bp, Heterodera glycines
  Genomic contig location: Contig_ID=SeqID_18917; Location=198..557; Strand=-
  SCN-specific regions: Sequence locations=1-360
atgaccaatttaatcatttgccgccgacttcttccgctgatgttcatgcggtctatgctgaatatggtcaaggtatgtctccaagaattgacggtactcctcgcgcaacgcacggaacgcgtacatgtctgcgtacggcaacggagtcagcgggtcaatgaaactgcgcgatatgtgctttgattgcgcactcgcggaactgccttggcatcatcttagggcaccatcatattcaagtcaataaggaatgagtcgtctgtccgccacatcgtcaatccaagaaacgaaaatccggagaagatgaaaaagcaatttttcgaaaatttatcaatttttaggtcaaagcttcataaaaataaa

SEQ ID NO: 83635 - DNA, 1015 bp, Heterodera glycines
  Genomic contig location: Contig_ID=SeqID_18918; Location=7..1021; Strand=-
  SCN-specific regions: Sequence locations=1-41,75-658,680-1015
atggattgctttcaagccgttcttccgcacatcgccggttttatggatgggatttcacagaaaagcaatgctccgttagaaggcatcaaaaaacattcaacggacgaccgattagttcagctcgttgttaggggacttctctatgaatatgcattgactttttgtcaagagcaagcaatggaagggagaaacggtcagaaaacattgggaggcaaattttttaatgtccagcgaaataataaagcacggttactttaaaaaaaaagattgaaagttatttggtctgttattattaagtaaccggcttctttttgatttcattataattaccctatttaagtatttttatgcttatatttgatttttcgaacttaattttttttttttttgtgctgtgcatatttcgtgcttattctggttttttttggtgcaaattaacaatttttggtctttagctgcaacacattgtgagcgacactttaatgatttgctttctcataaagagaaattgtcgtcagcggatttgtcacttatttcgtggcttgaaatgctcgggagtgaacaatttgcccttcccttcaaacaaaaagaattatttcttcgcgtcaacccacacaagtgagtgaaatcactgaaattctcagaaaatttcgcatttttgtcaattacttttattgttttctttctttttttgccattaggaagcctaacttggaagcgcaatggagtgagcaaattctggcgacgccaattaaacccggcggacactttccccatgcgatggtgccttattcaaagcctaaatttacgcagaaactgatggcatattcgatgacaacttctttgtttttagaccaaggttcgcttttcagtattcgttctttaacttggcagtgcaggccgacgccatcccaccgaaacccgtggcagccaaccgatgtctcagagcactgtgccgtccgtcagttccttttccatccataagacatcaggtggatccgacttggacagtgat

SEQ ID NO: 83636 - DNA, 328 bp, Heterodera glycines
  Genomic contig location: Contig_ID=SeqID_18918; Location=1958..2285; Strand=-
  SCN-specific regions: Sequence locations=1-178,200-328
  Gene Ontology: Mol. function=selenium binding
ctgaaatgcatgtttgtgagtgcaatttgcaccgatttccgcaagttgcaggtatttttatagcatttgtcaataatacataaaattattacaagtacattaagcctttgtacgtagtgaaatgaaggaccaatggggagggaagctgaaggtcaagcaggtccgtggagttttgcctacaattttgctgaagagtggcgatgggcaaacgcacaaaactctcagcattgaaaaatgggacacggacacgatgactgagtttctcaacggggctttgtctttgggatgatcttcgatctctcattaactgttattattattttttcta

SEQ ID NO: 83637 - DNA, 806 bp, Heterodera glycines
  Genomic contig location: Contig_ID=SeqID_18919; Location=1..806; Strand=+
  SCN-specific regions: Sequence locations=1-59,98-724,753-753,778-806
acgctgactaattagctaacatttataaagaaagtagaaatttgattaaatgcatatacaatatacaaaatattacttttttaaatttgtataaagttcctattttgtctttgactttgcttttttttccatttatttcaatcggctagtgctttaaggttttgtctttgactttgcttttttttccatttatttcaatcggctagtgctttaaggttttgtctttgactttgcttttttgtccatttatttcaatcggctagtgctttaaggttttgtgttttgactttgctttttcttccatttatttcaatcggctagtgctttaaggttttgtctttgactttgcttttttgcggctagtgctttaaggttttgtctttgactttgcttttttttccatttatttcaatcggctagtgctttaaggttttgtctttgactttgcttcggctagtgctttaaggttttgtctttgactttgctttttttccatttatttcaatcggctagtgctttaaggttttgtctttgactttgcttttttgtccatttatttcaatcggctagtgctttaaggttttgtctttgactttgcttttttttccatttatttcaatcggctagtgctttaaggttttgtgttttgactttgcttttttttccatttattccaatcgaccacgttaattcattctctatacatttagtgtcttatttcatgaaattatattaatttaattttaaataaagaggcaaatttttacagaaaataaatagacgctgactaattagctaacatttat

SEQ ID NO: 83638 - DNA, 1170 bp, Heterodera glycines; identical to SEQ ID NO: 18920
  misc_feature (31)..(31): n is a, c, g, or t
  Genomic contig location: Contig_ID=SeqID_18920; Location=1..1170; Strand=+
  SCN-specific regions: Sequence locations=1-358,389-455,500-629,660 -672,694-743,779-782,808-843,865-875,922-943,968-1170

SEQ ID NO: 83639 - DNA, 528 bp, Heterodera glycines
  Genomic contig location: Contig_ID=SeqID_3197; Location=937..1464; Strand=+
  SCN-specific regions: Sequence locations=1-74,96-111,173-179,201 -256,313-331,359-367,389-392,450-454,476-528
atgcccaaattgattatattggcacaaaatttcaacaactcaacaaaaacccgcggaaacaaatttacatacatttcacatgcgccactgacaccgatcaggtcaaaaaactttaaaaatttcaaatattaaaaaatcaataattatttttaaatatatataaaaaaattttcagatttctatcatttggcataacacaaccgttgtgataattcagaaaacattacaaggatacggaatgttgtgatgataacagaatttttttttatcaataattaaattgtaatttttatatgaaaaaaatattaaaaactaaggcgcaatacagtggtaaaaattcttaatattttcattttaactcataaaacatttgttttcaattttttgggtcctttttaattatcatcatttaaattattcttttcaaaaaaatgattaaaaatttttttgtcggtataatattataatttaaaatgagtaaaaaccttgtttcatacatattttattttgttgtttacaaaatttcca

SEQ ID NO: 83640 - DNA, 2635 bp, Heterodera glycines
  Genomic contig location: Contig_ID=SeqID_3197; Location=2467..5101; Strand=+
  SCN-specific regions: Sequence locations=1-587,612-739,797-838,913 -926,956-1190,1213-1665,1707-1856,1936-2042,2075-2117,2185-2205,2241 -2343,2365-2369,2403-2453,2476-2515,2537-2635
atgagcacagcacgtccattctacaaaattgaagaagaaactggaaagattgttaagggtaagataaaatttaaagaaaatgaaaaaaaatcaatagggtagaaaaatattaaaaaacctgaaaccggatccgaaccccgaaaatatggtaaaatttctattaccatatcagcattattttctgcattccgagactgtcattttttgattttctgaaaattaaaatttcatttcaatttggattatccaatttcagaaattttactataggctatgtaatctttgcaatagaaaaatttcttaaaaaatttgttttgaaacgcaattttaaaattcgaaaaacaccaaaaaagccctagttttctcaactttgtttaaaaacaataatctcaacctgcaatttttttagtttcacacccattgtttccaacttcggcacggcattttccatcattgagatccaaatttttggcacccacaaaaccgcatcaaccgcacaaacaattggcgccgcccgctctgttgcacaatgctttacctgccgacgcaacccatgcactgctaatcccactgattgtgcaagcaccgcaacaacaacaacagcaacaagttgctgcaactgctggcgctgttgagaaagcgtcttttgaaagcagtacaaccaccacaagcagcagtatcatcatgggaagagaacggaatgttgaaaagccgcagcatgaaaggtaatacgatcgtgttaaattaagtttttaaaaattgaaacaacaaaaaataaatttaaaatatttaaaatgaaaagtcttttattagagattgagaaaggaaaattgtaaagtaaaaaataattaatttaaaaccccaaaaaggaatttataatgaaactaatttaataaataaaattaaaaaaaagtttgagaaacaggaaaattttaaagtaaaataaaaaattaatgaaaaatgccaaaatctataatgcgaattttttttttaaagtttttaatcataaatatgtaggtccaaatgtgaatgtgaagaagaatttgtgccgtcgaaaatctccgatgaagaaaaatttggcaaaaattgttgtgagcgtaagcgcgatttatgcgacaaattaaccagaagcatgaatgccaagaacagcatggaggtgacttcttaaagaaaatgttttaactatggcattctcaaaccagtctttggggaggataacaaaattttacgaattttttacaaatttctaaggaccaaagttttgaaaaagttggaatcagggtcaggatttaggaatcctgctaggccatgggttgcacgagtaaaatcccgctttggcccggcttggtaaatatgggattaggattccgggaattttctatagagctactaagatcaatcccatctcggtctttgttaatttgctgaaaatcccctcaaattttcagcatttcttgagaaattttatggccaaacatggaaacccggcgggaagcgatttgatcgatgatcatttggtcaaacacccagcagaccgggacagttttgacaatttgatggatcggttggccgaaatttcggccaaattggacaattggaagcacacaatgcgggccaaattcaattttcatgatgagcctttggtggtctctaaaaatcaaccatcatcaccacaaccattaccactacaacagcagcaacaacaattcccgatggtctcattcagcagctataagaaaaatcaaaatgccaatgcgcgaaacagtggcgccaaatttgaacatgaaatcagtgccaacggcacaatgaacattaacaacagcacattagtggaccaaatcatcccggaaaataatacggcgacaacagtaacgacaacaatcggagcaataattacaacaacagttatggaagaaacaacaacaagcacgacaaagccacaaattgaaaagattatttcaattcaagaaaggttaaagaatgaatttgccactttgttgggcattgttgaagagaacgatcggaaaaatgccaatgtaatgttttaattattaatttgttttaatatttttttgctgttttggcaaaaatttggttaatcaacaaaatttcattagaaatatatatatatatattttgtaaattttaatatcaaagaaaaagttatttttttttgaaaattttgcgttggttttttaaccttgctaattatattagttttttcatttaaaaataattttcatccaaattaaaaaaaatcttggcacttacttaagttgattttaaaaaatgtatgttttagagttatgagaaaaatgccgccaagcaacgagcgctgccaaatgttcagacggaagaatttggagcgttcaaaaatatgaatgattcacaagtttcaaaattgcctgacgaaaagaatgtgttctcacgatggcttaaatgcaaagatcgtagcaaagttcttagcctttgcctgtaaaattagtgatgatctgatcaaaggctcaattttttgtaaaaattttaagcaaaatttttgatcacttttatactttaattgcgaaaaagtatgagcctaaattaaaaaaaaaacttatttttgtaaatcatttagaaataacacttacatacagaa

SEQ ID NO: 83641 - DNA, 1033 bp, Heterodera glycines
  Genomic contig location: Contig_ID=SeqID_3198; Location=420..1452; Strand=+
  SCN-specific regions: Sequence locations=1-43,65-173,249-250,304 -395,427-433,469-492,516-522,553-576,598-943,966-992,1014-1033
  Gene Ontology: Mol. function=structural constituent of cytoskeleton; Cellular component=insoluble fraction; Biological process=signal transduction
tttcaaaaataggcaattgcataaaatatgaaatttatgctccttttgttgctgttggtgttctgtgcccttgcccacatgggtgatgcttttggatttggcggcatgcaaatgtgttgtcccccgccgtgcccgcctccatgcccgccaccatgctgttgtggtgtgtcggcaaatattaaaaaaaaaatataaattccgattaaaatgaatttgtttttaatccattttaaattattaaattaattcaggcggaggaggaggtggtggtggtggcggatgcggtggcgggggaggtggcggcccccctattatcattaactgtggcggcggtggacagtctggcggtggcggttgcggaggtcgtgcatgattcataatttttctggaatcccaatttaatttaaattatatttaaattatttagggggctgtggtggtggtggtggcggttgtggaggtggaggttagcacatttaatttcaaaatgggtaaatatattaaaatattattatgcattttaggtggctgtggtggtggcggtggcggatgtaagtacagtgaaaaaataataatttacaaaccattattttaaaattccgggtcagcaccgggattaggcttactgtcctccaaaaatcctgtctttaatcgggctttacttttgaaacccctggaggactcgggaaaagaattggaggatttgattaccagcaattaaattccttaattacctataatcggcttttgagcattgtatacctgataccaggatcagtaatccttgtaagttttgaacttgcaccattccgtttatccgcatcgatacaggaaccggatcatttctaaataagacttcatgatcagaattttatggaataagtccctcgtttttagacgaaaaattctgacagaaaaagattttctataaaataaattttaaacgtggaggtggaggaggctgcggcggatgtggttaaaactcatgaaacgaaagcctcttcaacatttgtaccagaagaagaatgcacat

SEQ ID NO: 83642 - DNA, 256 bp, Heterodera glycines
  Genomic contig location: Contig_ID=SeqID_3199; Location=470..725; Strand=+
  SCN-specific regions: Sequence locations=1-256
caaaatccgaccaaattttgatgaaatattcggcgaagaatgggacaaaaatgaaaatgaagaaaacgcgatcaaaattgagcaaaaagaggaaaacagtgaagaaaatggaaccgaatcaattaagcaaacatgaaaagtgatcaaaatatgaaagaagaatcaaatgatcaacagaaaagagaaataattcgaaaatttgataaaatttaagaaaatttaagagagaacagaaaatacgtaaacaaagacagca

SEQ ID NO: 83643 - DNA, 598 bp, Heterodera glycines
  Genomic contig location: Contig_ID=SeqID_3199; Location=2139..2736; Strand=+
  SCN-specific regions: Sequence locations=1-111,279-391,413-598
  Gene Ontology: Cellular component=mitochondrial outer membrane; Biological process=sperm motility
atgttcgtccgatcatctgccattctgctgatcgttgctgttgcgctggtgccactttccgatgccattctcttcggcggtggtggcaacaactgttgctgctgttgctcccctccgccctgccctcctccgtgccccgtccagccctgctgctgtgccccgccatgtccgcccccgtgcccttgcccacctccgtgccctcccccgtgccctcctccgtgccctcccccgtgccctcctccgtgccctcccccgtgcccaccaccgtgcccccggccatgctgttgcggtaagttgggcgaaatcgttttaaaaatttacactgaaaaatggatttaaaaatttgggtaacatatagccattcaaattttaaaattcaggaggttgcggcggtggcggctgtggtggcggcccaatcattgtgaactgtgccggcggatgcggcggtggctgtggcggattcggattcggaaaataaatcatttaattcgcttaattttcacgtcaatccacattagattttcatactgtagtgatctttttagtttttttttctttgttattgatatgcaatatttctcgcattgcattaattaga

SEQ ID NO: 83644 - DNA, 601 bp, Heterodera glycines
  Genomic contig location: Contig_ID=SeqID_3199; Location=3139..3739; Strand=+
  SCN-specific regions: Sequence locations=1-236,305-318,351-550,583-601
atgcattcaaattttcgaattggcgaaaaatgggacaaaaatgaaactgaagagaaaaggatagaaattgagaaaaacaatacctcactatcaccagttgatagcggtgaagaaatggggaccgacccaattgatcaaacaagcaaatattctaatcaaaatgttatcaaaagtgatcaaaatacgaaagataaacaaaaatgaaaatgaaaaatatggaagaaagaattggtgccaaaatataataaaagtaaaagaaatattcattttaatattaaattaaaattaatattaatatttttaagcacaaattcaatattccaatgagaataaaataaaaaagatgaaacataagattaatttttatgactcttttatgaaagaattgctaaatatgtttttcagtaattattagtgaccggacttttaggcaccaaaatttttaaaataggcacaaaaggtgagaaaaggcataaaaaatggacaaaaaggacaaaaaaggcacgaaaaattggaaaaaggcagcaaaaagaaactttttttagacaacattaaaaaaaaattttttattaaagatttttagagagcaaaacacgtaaaa

SEQ ID NO: 83645 - DNA, 526 bp, Heterodera glycines
  Genomic contig location: Contig_ID=SeqID_3199; Location=4950..5475; Strand=-
  SCN-specific regions: Sequence locations=1-126,163-340,394-455,477-526
atgttcatagtaccaaatttgtttcatgaggacccaatcaaatgttggacaattacaatgtttgtcgccattttgactgttaatgtcagtgccgcctccaatgggccagttttgtatgtgacgaggtaaaaataaaataattttaaatttaaataattttaagtacggaatatcggaaagcatttgtccatgagtttggcctaattcgccgcttcttttgctttccaaacaatgcttcttcctcggcgaatcaactccaagccaatcatttgccaataaatgttgtaaaagtcacgcctattttgagcccaaaaacaaaagttgtcacgacggcattttgattaatattagaatgtattttttatatattatattgtaataattcatttttttgttgtaatctatgatatttagtgatagatattaactattttaaattgatgaagtggagagctcagaaagtaaattttcaatattcgtgactacatttcatgattttttctgcactaaaaccgaatttaataaa

SEQ ID NO: 83646 - DNA, 734 bp, Heterodera glycines
  Genomic contig location: Contig_ID=SeqID_3199; Location=5741..6474; Strand=+
  SCN-specific regions: Sequence locations=1-695,717-734
atggacatcaaatattggacacaagaatattggaaatttttatccgaccttgaccaactacaaatccccaaagaaattgactccgacaactccattcccgactacgccaagctgcttattaagcagcttcactccctcttaagcaccgcctccgtcctaattcattcacaggctgcggcagtcgacgcggtcgaagaggaacgacgactgagaaccgtcgttgttacaaatgtgcccgaaagcaaatcggacaaagcaacggagagagcccgggaggaccgtgccgttgtggacgaaattttgaatgccacggacgttgatcaggcaccaattgtcttccgtgtcggcaaacgaatagatggtcgaccgcgccccctcaaaatggaattcccgagcaaacatgcagcgcggcacgtcatccgcatgcgcggaaaggtgcaagcattgaatggtctccacaatgtccgcgtccgcgaaagcatgaccaaggaccaactgtccgagaggcggaaactgatcgaagaatgcgggaagaaaaggcaggcggacaacggtgattgggtgatatatgccaatcaggtcgtgctgagacaggacattgaccatattcgaaaaaatttttaaattgtccaaccaaatcactgcaaattacctataattattacccaaaagtacaaaaatttttccggtctgtaaaaaatttctaccaaaaaattactcatccaaacttttta

SEQ ID NO: 83647 - DNA, 1129 bp, Heterodera glycines
  Genomic contig location: Contig_ID=SeqID_18922; Location=1001..2129; Strand=+
  SCN-specific regions: Sequence locations=1-367,390-463,485-542,580 -725,821-1129
  Gene Ontology: Mol. function=structural constituent of cuticle; Cellular component=basement membrane; Biological process =embryogenesis and morphogenesis
atggcactcgaaaaggccgccggcgtggccatagcgatggccgtgtgcactgtgctgctgtgtgtggcgggcattggctttgtgcagcgcgaagtgcagtccatctgggccgagttggacacggagatggaccggttcaagctggacacggacgacctgtggcacgacatgttggccatgggcgccggcacggcggccaaccgccaacgacgaaatgcgtacggcggcgcgtcataccaagcggccggacagcaggcggctgtcggcggttacggtgtcctggtcaagacagtatgcagtaagtgattttgcatactgtagtgtagtgatgggaatgataacattattgaaaatttagttgaaaaataattatgtaaaatttgcttgaacagaatgccaaaaaagaaactcttgcccaccgggtccaccagggcgtcctggcgatgtgggttttgctggcagaccgggcattcccggaagggacggagtgccgggcgtggcagcggacaattggcacaacgcaccgttcaaaggatgcattgtaaaattataaaaacattttaactttttaaattttttgctagaactgtccaatggggatgactggtgccccgggggcagcgggaaagccgggacagcgcggaatgtaagctaaaatttatgaaataaatcttaaataaagaacattcagtatttaatttccaataaaaatttcggcttttttaaaatcaaattaaattaaaaaaataatattaaatgtacatttaaaatttggttaaattttaactttttttaaattttatttgcaattaaatataaaagttcagtcaacgaccagaatttttttcgtaataacacatccatataaaatgtaattcattggaaaaattcaggcgtggtcagcgtggcagcccaggaatgccaggacgtgatggcatcccgggcctacccggcgaacaagggcatccaggcgagaacggcaaggagggcggcacgggagtgaccggcgagaagggcatcgatgcggagaagcgtatcggccgcaagggcttccgcggagtgccgggcgaacatggccccgagggaccattgggagagccgggaaagccgggcccagtggggccaaagg

SEQ ID NO: 83648 - DNA, 1674 bp, Heterodera glycines
  Genomic contig location: Contig_ID=SeqID_18923; Location=1..1674; Strand=-
  SCN-specific regions: Sequence locations=1-60,82-185,207-399,464 -521,543-561,584-587,674-1135,1157-1201,1224-1454,1487-1546,1568-1674
  Gene Ontology: Cellular component=integral to membrane; Biological process=negative regulation of locomotion
cgacatgccgaaattgatgaactgcttgagcaccttgaatcagtaacagtcaaagaattttgttaatcaattaataataaataaacagggtgaagatatcaaggaatctgtcttcatcgtcttctataatggtgaacggttacggcatatcattgataaggtaagaaatattttgctattaatccttttaatttcattttttccttgtcttaaaaataaatgggttaattaccctttaattaatttaataattgctttaattatcctttaattaggtctgtgagggcttcaaagctaagcagttcaatcagtgcccgaagacgagcgcagatcggcaaactgcacttcaacaagtgcacacaaacattcacgacatgcgaatggtctttttacaaatcgattattttttatattaattgcttttttatttttgattatttattaataaatgattatttaattaggtgatgtctcaaacgagggagcatcgcatgagagtgttaaacgaagtggcagcaaatcacagaaaatggttaaaacaagtgagagagttttttcaaaaataaattcaaaaatgaataaacacctaatttagaattaattatttcattaaagagaaataaacaaaaaattaatttaattaataacatctaatttaaattaattaattaaagatgaaatgaacaaaaatgctcgtttaaaaaatgaatacttttttaattaattaggtgcgaattcacaaatccatttaccacacactgaacacattcacttttgatgggattggcaaattttttgtggccgagtgttgggtgccgttgagcgatgttaatgatgttcggatggcgttggaaactggcgtggtaattaggcacggcacaaaattgttggggcggggggtggggggcggaatggcaattaaattacatttatttagaattcatttttatccatgttggacctggacctgaatttcccggaaaaaaatccaggaaaatctttggcttaggaaaacttccggctccttgaggcctggctggatccaggcctgaaccttttttttaatttgtttttaaaagcaagcaaatgtttaaaaaatcaatgaattcttaggaacatctaaaatatatgacaattataatatgatatttttaaatctatatcattttttggtaacttgaaataaaaaaattgtcactcgaaataataagttttaaaatattatcccggaaatccaggttttcatgccgaacctgagcctagacctgaatttttttcacatttgacctggacctagatttcctggccaaaaatccgtgaaaatccaggtccaggaaaaactcaggttgccgaaaaattgcctgggtctggacttggatcaaggaaaaacccaggcctggttccaggtcgaatacgaatatttagatatttattgttatggctaaattctgttcaaaatattcttttttaatttattttattaatacaaacatatgttttgtcttcttcaatttatgacttgtttctattcatggcataattactaggccccgccgcggggacgggatcccgcgcgggattttgcgggatcctagtccgcaatcccgcattttttggaaaatgcgggatttgctggattaatcccgcgggatcccggcccgtgaagaatttttg

SEQ ID NO: 83649 - DNA, 774 bp, Heterodera glycines
  Genomic contig location: Contig_ID=SeqID_18924; Location=29..802; Strand=-
  SCN-specific regions: Sequence locations=1-118,200-308,333-501,544 -666,699-774
atgggttcgctttaccgctcggaggaaatgcgattttgccagctgattgttgaacgggacgcagccttttcatgtgttgctgagcttggcaagcatccattcgtccaattcaaagacgtaataataaaaaacaaattaaatttaaatttaaccaatatatttttaaataaatttcataaaaataattacatttttaaatgtagctgaatgccgaagttaacgtcttccaacgaatgttcacgaaagacattcggcgttttgatgaaatggaacgcaaattgagtaattttttttcgaattttatttccaatttttttaattttattaaatttgaaatccagaactttctaaattgtttaaaattaaaattttctgaaacattaaggatttttggaggtacaaattcgcaaagaaaatcaaccaattgtggacaacacatggggagaagcggttgatgtaatgtcacatggtgagatcaacgaggttgaggtaatataaaggaatttaaattaaaaaatattcaaaaaaatttaaaaatttttacagcaaaaattgattgacaaggaacgcgatatcattagcatgaatgacagtgatcagcagttgaagaaaaattttttggagctcaaggaatggcaatatgtgctcagcaaaacggatgaattttttcagggggtaaaaataaaattttatggaaattttctttattttttttttgattttgagggcattacggatgcggctgttcaagaaatgagggacaaactgtcgtag

SEQ ID NO: 83650 - DNA, 1453 bp, Heterodera glycines
  misc_feature (1255)..(1255): n is a, c, g, or t
  misc_feature (1272)..(1272): n is a, c, g, or t
  Genomic contig location: Contig_ID=SeqID_18925; Location=838..2290; Strand=-
  SCN-specific regions: Sequence locations=1-107,132-155,181-223,314 -439,477-808,832-844,890-1346,1377-1404,1426-1453
  Gene Ontology: Mol. function=ATP binding; Cellular component=integral to membrane; Biological process=glucose transport
gtggaacgccttgggcgccgaactttgcacattactggcctcgttggcctgcttttgtcaagcgcttttatcgcaatttcaatgcttatatcaaaggtggctttttgtttaaaaaataaaatatatttaaacatttgctttccagtcagttcaatggttttcatatttttccattttatttgttctgctttttgtcatttcggcggcaattgggccaggtcatttaattaattaatcattagttaatcaattaaacttaataaattcattagctgatcaattaaacttaattaattatttgttaattaattaaatgtgataccggtttttccagcaaaaaacaatatcaaatagcaaataaattattaattaacaagagaccggatcttattagaatctattaattttgaactaaattgtttttatttcggtaataccgttaaatttaaaatttaaaaaattaaaaaataaataaaccaaaaacagtaatatttatattcaatcataattaaaaaaagctatttaggctcgattccatggttttttgttaatgaaatctttccattgaatgctcgtggcaatgccaattcaattgcggtcctttctaattggggctcaaatgccattgttggcttcttctttccaatgctaaatgtatgtttacgtacattagactaattctattactgtaattccgcatatttaaatacggttttcctatcatgggaaaataatattttcaaaaatcctaggttatcaattgggagcggattcttaagtttttaatttatttttttaggaatccctattttggacttttcacccctaaaagaggcgtccctttttggcatttttgaaaaatttcttaacaaaaatcctataaaaagaacccagatttttgcaaaattttcgctcctattttaccatttttcgcctttattgagcccctctaaattagaatttttcgcgtctaaaaatccgctccctagttatcaattcatggaatttctcttatgtttagaattattttttgactgtgttttttatgggatatatttttcgaaaaatttataaaaaatctaaaaaaatgttttttctagtccgttctggatgagtatgtgttcttcgtgttcaccgcactgtccgttctgttcattgcatttgcggcaaaattcatgccagaaacgaaaaacaaaagcctggaggacattcaggcggaaattgatcgacgacgagggaaaatgccaattagtcnaatgaataatgccaaancgaaacgtgccaagaatgggaaagaaaattgtgaaaaagtctaacaaaattttgcgatgactttaaacacacacaattttatacaaattaattaatttaaatttgcatgacgatcattttacgatttctatctattttttaaaaaatcaattgtctttctgtgcttttatttgaaaataaa

SEQ ID NO: 83651 - DNA, 3585 bp, Heterodera glycines
  Genomic contig location: Contig_ID=SeqID_18926; Location=376..3960; Strand=+
  SCN-specific regions: Sequence locations=1-186,292-370,392-693,715 -797,820-870,892-1035,1063-1228,1250-1298,1341-1664,1686-1985,2017 -3083,3107-3119,3141-3287,3310-3331,3354-3440,3471-3585
  Gene Ontology: Mol. function=chaperone activity; Cellular component =mitochondrion
gtgatggaacaaatggattctggcaaccatggaatgcttcggatgattacagtgaaattaaaaaacgtcttttgcgtcctccgaatgatttctccgagctcaggggtttagttgaagaataagataatcataattaaacacttgcagaaattatacgcaaagacattgaaagaatggcacagataaaggaggaaaacgtaaaaaagaggaagggaacgaccaaagggaagaagcaaatgacggatgagcagaaggaagcacgggaagaagaggggcaggaggaggacgaagtgaactcacaaacatttgaaaatagaaaaactaaacaacaaacactgaaaggaactccattggcattcttaaatacaccccaatttcctttttcccaatttagactcgcaggaacagaatgatcaagcgaatgttcttcgttttttgcctgacctttcctttctttgtgatgttagttggaaattgtttgctctcaattagaaattcatttttcctttagccactattggcttaaccatcgtttcgattcattcctgttgcccatcgatcctaattcttatttatctgtccttatccaagtcccttggagcgattttattgaacgcattgtgcctactggaactgtaaaaattcattgactgtgattttttaatttacgtttgtttatttttcaggtgtcaaatgttcatttgaaagtttctcgtgggcctgaaagaagaatttccaaaaaagcactggtcacagttatgccgggtgcgcggtggccggatggaaaaatggtgagagtttttaaaagcaggtttaaaaaattgttgatatagttaggctgtggctagtgccctccccccatttttttagaaataaagaattctaaaagtattaatggctttccgattttatacccagcggcgcctatcggccacccgccggacccacattttaccttatattttgaaatgttgaccctttttttggcacaaaaacggctataaatccctgctttttgcacttcggcgctgaaaattttctggagaaaaaattttttcagttgccaaggatgttttttgtaaatgtgcccgacattggtcgagtggaacaagaaatcaggaaagcggtacttaaatgcgtaatttagcataaaaataattctaattgtcagtttaggaagtggatgctgggcttgcccctgaacattggagcaacatccaatggatgcaaccggggccaatgtccgttcatatgttttccattttcattccacttttaggtcattgattataccttctctggtcattcttgctttatttgtccttccatttggttttccttggtcgaatgatgactggctcaaaaaatgggcaacttctccgaatcgatcgtaacacatttctcaaagcagtttcaactgctaattttgttcagtcttccatgatggggcatcgtcttcgaatttatgacccggcattaaaggatggtaaattgaagatcaaatttcgtgacgtggcaggccttcacgaagcgaaggtggaaattagcgaatttgtggattatcttcgtcgacccaacaaatacacgcgattgggcgcgagactgccaaaaggtttttctttttgaataaaatagcgtcccaagtctctgttaggtgcccttctgactgggccgccaggctgcggaaagactcttttggccaaagcactcgccgcggaatcgactgtcccattcatcaagtgaataaccaaccacgaaacaatttattttcctaaaattactttttcagcattaacggcactgagtttgtggaaatgattggtggcctcggtgcttcgcgaatccgtcaattgtttaaggcggccaagtcgagggctccatgtataatgtgaatagaccgattagcaaatgtcgcttaatgttagtttatttgattaagttacattgatgaaattgacgccatcggtcgaaaacgtaattctgggtaattaataatataaaaaaattgattatattgaatccgcaaaaattataggcatggaaatgacgagcaggagcacacactaaatcagttgttggtcgagatggacggaatgttagtttgaacatgagaaaaatcacaatatttaacaaattcagggacacggcgaagggaattgttgtcattgggagcacaaatcgccctgatatgctggacaaagttctacatttaagccgtatcactttttattgatctcccattgaaaggctcttcttcgtcctggccgttttgatcgaaatgtcagtgttgacttacctactctgattgaacgtcgtgagttgttcgacttgtacttgcgcaagattaagaaggacaaccgactgacaggaattagccatcggctggctcaattgacccccggatttagcggtactcgctaattcgaaccaaaaccctaaaaaaatccttttcctttcgagctatttcatcttttctgcattaaacactacaaatttacttcgtccaagtttccaggtgctgatatcgcaaatgttatcaatgaagcagctattcatgccgcgacaattcaaaagaaaatggtggacatcgatggttggttttaaggaaaaattataattgttaacccaatgccgtagccagaagtaattttggtcaagtccaacaaaaactttccaattaatagatgtggattacgcactgcagaaaattttggctggaccagaaaaacgtagcaaagtattggtaaaggaggagcgtgaaatagtcgcttatcacgagtctggccatgcattggtcggatggttgctggaacacacagaagctctgctaaaagtacagagacccaacaaatttataaccaaatttatctattattaaggtgacaatcattccaaggacaagtgccgcccttggatttgcccaatactcaccgaaagaccgaaaactgttcactcgtgaggaattaatcgacagaatttgcatgatgttgggcggacgagcggcagaaaatgtgacatttgggcgaattacaacaggtgctcaaaacgacttggaaaaagtaattagaattatgctattgcactaataaataaacataaaatgaatttataggtaactaagcaagcacaagcgatggtcaaaatgtatggaatgagcgatgttttgggacctatcagtttcactcccgaacccggcgttgacccacaaagtgttcaatttcaaccgaagccttacagcaaaaagctaggaaacatcattgatcaggttcgtgcgaggcgtttaatacccaaaaaattgggaaggaaattaaaaaaacaatttgttttttgccttaaaaacattttgtttttctgaaataacgtattctttttctgtctgaattttacggattgaaaaagcgatataaacttattttggacaattgtttaacgaagaaaagaaaaattataatttattttaattttatatagtattcttgaggtaaattttcaacattctattttcaggaagttagccgacttgtatcggatgcttattttgttactgaaaagctccttcgcgaaaatagaaatatgctagaaatg

SEQ ID NO: 83652 - DNA, 629 bp, Heterodera glycines
  Genomic contig location: Contig_ID=SeqID_18929; Location=683..1311; Strand=+
  SCN-specific regions: Sequence locations=1-466,557-629
atgggcattttcaagaaaagtgaaatattttacaacttttttgtgcactatcgtctcctctttgtaattctttattaatgctttagcttttttgatcattttatatgtcattttattaaggtgagtctcgcaaatttatccatcgcactttctcaagttggaaatgatcaaagaaacgatttgcaagtggacaatggcacagtgtgcaatttgcccttcttaaatcatccgtcgatgccaaagtcgcctgaccgatttgtgtcgctggttttaatggtggtgtctgtttttgtttcacataaattgtttgtcgtagcttttttgggattctcgagtgtcggagtaaaatctatgggtggactaaatcattaaatcattgattttgaaaatgaacttttataattcagaagggactgcaggcaaaagtggataacttgcatatttaggggggggggggactttacagaaaaaattatttgttaaaaatttttcaaaaagttactataatttttttttaatctaacaatcaaaaattgaaaatttatttttaaattaaccaaaagcaaattgcatgccaaatttacgctcattacctaaaattaagaccggacgggattctaatgttttta

SEQ ID NO: 83653 - DNA, 899 bp, Heterodera glycines
  Genomic contig location: Contig_ID=SeqID_18930; Location=200..1098; Strand=-
  SCN-specific regions: Sequence locations=1-8,30-533,559-578,600 -800,822-836,859-899
atgattgcggtgtgtctgctgctgctgatcgcgggtgtgacatcatacaatgtgccgcactgatcaaagagagattttcttttagttttttccatatgctttttctattttctatttgggtattagatgagtgatgctatccgtttttcaatagtttatttcatatttcctgttttttttgtaaattctttatgtataaattgttgacaaaaaaagttcagttcaaatttacattcggtgtaaagtttcgcgttggtacataggaaaatgatctttttcaaggtttattctagagaccgagccgggcccggtaccggtttttaccgggcccggcaaaccggcccggtgatttttggaaaaatccggtttgaccggtttttgagaggccaggcccggaaaccggttgcttctgaaaatatcagcccggtccgatccggcatttttggaaatctcggtctctagtttattcattaatttatttgggcaatgtgaaatttttaatacaaggaacaatttttagtttttttttgacgaaaaaattaattaaaataaaataatgtaaagaattttgctgtccctaatttaatttttttttttttgtgctaaaatcagttttctggacttttcgagggtctgatcacgaaactgaaatcggattcgcttaaaaggtaccggggaaattttaaaatttactagtatttagtatgccgaaatgagaggtgcatttttctctgcgctctctatttattgggttcctctcgttttttggggggattttgtatacccataattgaatctgaattttttgaatatgtaaaacacaagcaaataaaataagttttatattgtttatcatattaatatacagacattatcttaaacaaatatctctgaataaa

SEQ ID NO: 83654 - DNA, 1188 bp, Heterodera glycines
  Genomic contig location: Contig_ID=SeqID_18930; Location=1132..2319; Strand=-
  SCN-specific regions: Sequence locations=1-845,882-977,1026-1132,1154- 1188
atgccattggacaaatttaagacggttattcaaggacttggaatgtgtgaaaaggaagtgatttggaaatatgcgaaacaggaggatcatggtcggatgtcactcttgcaaaagcatgctcctaatgtgcatcttgtggagcattacgatcaagccacagttattggtctgtaaattttatgtccatcaaaaaaatgccatggcatggttaggctaatctaggctaatccaccacggccggcgcaaaattcaaaaatttggaatttaaatttactatttttattggcaaatttaatgaaaaatttcaaaaaattttccgatgggcttgggtcaaccgattctttacgttttttcaatttttagccccccccccgtaaaatacagtatggctggcctctgtctacggtatcatattgtaaaagtgtgccaccattttcaggcaataaaaagacggaattggtgatcagcgaatgcgatattcgtatcgtaatggatgcgttaagcagtggaaaagcattgctttgtctgccgatgtttgccgaacagttttatgtgtcggaaaagctgcgacgcatgggcgctgcggttgtgcttgatccgcgcagtggcagtttcaccccggaggggatttccaaaagtatcggcgaagcattgacaaagcggtaatgtgcgcgcaaaatccttataatgatactttataggggagttgctcgagttttcggctctaaagtcgaggaatttctcggctttttagggtcgagagtcgcgactctcggggtcaatcccaagtcttgaaaaattacgactcctcactctcgagcagtcccaataatttgttgtattagattaattataatttatttattttaaaacattttttagttatgacgtttcatttccttcaaacgagtccctgaagcaaacaattttgaatgcattcaaggaacttggtttgttcaaaaattaatcatttttttcataaaaatagggggaaaaaatcatttatctgtttcaaattttctattccattcagcacgcagtccaaatagatgagatttaggggaagataaaaaaacaggcattttagtacgagtaaggcctatatacgaattttagggtgactcaaatatatctggggtggtttgtgccctgagggtttaaaaaatgccgaaatttcgctaaaataaa

SEQ ID NO: 83655 - DNA, 663 bp, Heterodera glycines
  Genomic contig location: Contig_ID=SeqID_18931; Location=1500..2162; Strand=+
  SCN-specific regions: Sequence locations=1-29,89-225,277-283,314 -476,499-522,560-663
  Gene Ontology: Mol. function=protein binding; Cellular component =cytoplasm; Biological process=pole plasm RNA localization
atgccgccaaaaaaggtaagtttgaaaacaatttttaaaaaataaagataaaacaattttttaaaaatgataattttataatttttttcagaaattgtccgaagtcctgccaaagccggtgatggtcacacggagtgcgaccaagcgtgagacggaggtgccaaaaaggcagatggccattcgcggcgctggtccaccaaagcaccgtgggttaaaaatgcgcagaatttaaattaatttaaaatttaaattaataaaagtaaaatttatatttaagcattatttccaccaccagcagcagcagcatcaactttttcaacttttacaccgccgacaccaccaccattttctactccatttcacaagcacgtctcatttttgacaccttcaccaccaccaccagcagatgatttggagtatggacctgcaccaccaccaccaccagcaacagttgatttggatcaaattccgcttccgccaacaccaccaccagcaacattttcagtggaattttggctacaacctgcaccaccaccaccagcagcagcaacagttcatttggatatgaatcccacatcatcttcaaaagcggcagcagcagacgaaattgaacgtgaaaaaaagaggaaaaagcggcgaggcaatcggtggagcaaaacaaag

SEQ ID NO: 83656 - DNA, 1224 bp, Heterodera glycines
  Genomic contig location: Contig_ID=SeqID_18932; Location=824..2047; Strand=+
  SCN-specific regions: Sequence locations=1-60,92-135,198-252,380 -402,434-451,480-607,696-1098,1122-1224
  Gene Ontology: Mol. function=actin binding; Cellular component=actin cytoskeleton; Biological process=G-protein signaling, coupled to cAMP nucleotide second messenger
aaattgtccgaagtcctgccaaagccggtgatggtcacacggagtgcggccaagcgtgcgacggagatgccaaaaaagcagatggccattcgctccggtggtccgccaaagcaccgtagggttaaaaacgcacagaatttaaattaatttcatttttaaattattttcataaagttaaaaataaaatttatatttaagccttatttccaccaccagtagcagcagctgtgcaattggatgttggattggagacaccacctccaccaccaccaccagcagcagcagcagcagcatcaacttttacaccgccgacaccaccaccatttcctactccatttcacaggcacttctcatttttaacaccgtcaccaccaccacctgcaacagttgatttggatcagattccacttccaccaacaccaccagcaacattttcattggatttttggctaccacccgcaccaccaccaccaccaccagcagcaacagttcatttggatatgaatcccacatcatcatcaaaggcggcagcagcagacgaaattgaacgtgaaaaaagaggaaaaagcggcgaggcaatcggtggagcagcacaggtcagatttggaatttatttttaaatttcaattcgattaaatttactttttttatttttaactttgtattacgaattataaatttgtttttttaaaattgtaatgaaattatagaagcgccagactgtgcgcgtaaagaagggtagtgtgccggcaaaggtagtgccgcgccaccctgagccaggctattttggcctcctgcgaggtcaaaagccgagaggtcactagtaaatgctactacatagactgggccggtgagtcttccccccccccactgccctccaactgttttgattaaaaaattttaaagaccagcgtggtcaggagagctggattctgtccacatgcaacgacgcattagaaattaccggcgaacatctcgaggattcggctgtggatgccgcatacgacgcggtgtacggcgagccggtcgctgaccatctagcgagaaaaatcgtaatgagacccaaataccacgatcgtgagttttttttttgtcgacaaatttttaaaataatttaaattgtgaaattcagtccggcgtcgaatggtcggagtcaatgctgcaccgatttgccgtcagcactttgctttccacacttgtgtcacaaaggaccaatttgataag

SEQ ID NO: 83657 - DNA, 414 bp, Heterodera glycines
  Genomic contig location: Contig_ID=SeqID_3200; Location=4670..5083; Strand=+
  SCN-specific regions: Sequence locations=1-58,89-414
atggcaaaattaaccgctgttaactctgcaaaaggaaagttttgtgacgggtattgttatcacaaacacaaaatgacaaaaaataaaacttggtggaagtgtgaactttaccaacaaggatgcaaaggtcggggttttgagagtaatgttgagtttttcggaattcgaatgcataatcatcctccagaccaaattctacttcaaatcgagatagaacagtagatttgaagatgtcaaacatagaaatcagatttcaccttggaatttcaaaaatatcacgtgaactttatttttcctctcagctgcgtgattttgggtaacccaaaagttgaaaaaaaaggtttgatatttcatgactctgagcttttgaatgagcttaatttttgtttaaaccggttcaattttagcgattga

SEQ ID NO: 83658 - DNA, 415 bp, Heterodera glycines
  Genomic contig location: Contig_ID=SeqID_3201; Location=397..811; Strand=-
  SCN-specific regions: Sequence locations=1-415
atgaatgataaaacgactactgggactgaaatcttcggcattccaaacactgggactcaatcctccagcattccagtcacatggactcaaatctccggcattccaaatacagggactcaatcctccagcattctaatcgccgggactcaaccctcaggaattccaatctctgggactcaaccctccagcattttaatcactgggactcaaccctgcggaattacaatcactgggactcaaccctccggcattccaagcactgggactcaacctcagcaaatttcttcagcattttttacatttgagtgctttgcgatattgaaccggtggggagggctcggccgcttcgcggcctcgcttccaaacatttatttttacgctcggtcattcgcggcggttcccgctgatttcgtca

SEQ ID NO: 83659 - DNA, 1401 bp, Heterodera glycines
  Genomic contig location: Contig_ID=SeqID_3201; Location=1828..3228; Strand=-
  SCN-specific regions: Sequence locations=1-73,95-435,458-663,697 -753,776-972,1018-1193,1217-1307,1329-1401
atggatttgtacttcaccaatgtgcaaccattcctcgattttcctgttgttgagcaggaaattgagcgagaacggcaaattaaaaaagaaaatcgtgtcaattttattggaggaatcacaatgccaaagggtgttgtgccaaaattgaatggggtaatattggataacaaatataaaacaccaggcctagattaggcacaaaaaaacctggatttcctggataatattttagaatttgtttgattttttgactctttttaattttattttcctgattttttgtccaagaaatccaggtccaattccaatatgaaaaggcaaattagaaaattgtatcaattttattggcgcaatcacaatgccaaagggtgttgtgccaaaaatggatggggtaatgttggatttttaaaattatttgcaaaaaaaaatgacatgataaataggagggcttaggttggactttgataaaatttagtgaggtcgtttaggaatactcggttctatattataaatttggttacggtattgcgggcctatttacagtaatttagtgagggtcatttaggaagactctgttgtatattataaatatggtttatggtgttatggggtctgtttatagtaatttcgtaaggtcccttaaaagaagatctgttctatatgaatattttaataattaaaaaaaaatttttatttgcaggataccaaacaaatatttaaatctgccaacagtgaaaatgaaaatggtggcgttgtgttgctcagttttggctctgttgtggagatgaatgatggcgaagcacacgcagttgcactcaagaacattgtggtggaagtgttcaagcagtacccgcagatgaacatgatcatcaaatggggcaaaagggcgccaattggcaccggcgaacagtacaaaaagttggcggacaatgtgtatgccaagagttggctggaacagtcggcaattcttggtttaaaaaataaatttgaaattttttaaatttaaatttaaaaaaagacggcggactgaaactgttcatcacccatggcggacagaacagcattaatgaggcagtcaaaagtggcgttccgctgattttgttcccattctttggcgatcagtttaacaatgccgaggcattggcggcgcgaggggtggcaaaagtgattggtaaaatgccaattttgaaatttaatttcttgttttaaatttttcagacattcgctccaaaacattgaaaaatgattttgcggatgcattcaatgaaatgttaacaaattacacggagtataaacaaaaaatggacgaattgagcacaaaaatgaatgcggttgagccggaaaaagaatttattgaaaagtttcgacaactcagaaaaagcatttaatcttttgaataaa

SEQ ID NO: 83660 - DNA, 557 bp, Heterodera glycines
  Genomic contig location: Contig_ID=SeqID_18933; Location=586..1142; Strand=-
  SCN-specific regions: Sequence locations=1-110,132-355,391-557
cgaagctttgatgaagttcaaactcggcactctcccactttttctgctatttagtgaatgtttggcggtgatacctttgagcttatcgaccgaacgatttttggtaagttaatttttaaaaaattctctaaacagcgtcgattgagaaggacaactttgaaaagatggggaaacgaagcgaagtcgaatacggtaattggcaattgcagaacacagtaacaggggggggggtctattcagaccaattcatcaagggaaccggcattccgatgatcggctttggcaagagggacaccgagttcgacccggcgaccattccgatgatggtagctggagaaagaatgctttggaattcaattttgttaagggcttcgggaaaagagggacgggcaggccattccgaaacaatgccatggagacgaagttgcaactttggagaatggggctgctgggataaaatgaaaacactcatcagcccatccaaatgatcgaatgctttgaacataaataaattacaataaagttaaacaaaaaaatgctaataaaaaggaggtcaa

SEQ ID NO: 83661 - DNA, 404 bp, Heterodera glycines
  Genomic contig location: Contig_ID=SeqID_18934; Location=2179..2582; Strand=+
  SCN-specific regions: Sequence locations=1-30,52-404
atgcgtactgtagcaacaaataccgtatagccgcgccgcgccgtcagacactttgatttttctaccataccgtatctttaaacagccaaacttctctcgtctaccgtacctgcctgcgtctaccgtaataaatcgaattttaaaattaattttttgtttttcgacgccagttaacccaccaattctctgctaacactcgctgaacccaggccaaacatggccattgtcgtggccacgcttgacgctctgcgctccgccgcttcggctggcggccgctcgttaggcttgtcattgcccatggcattgctgcttctcacgctccttttttggcattggcaccgcgggcgccgggctcatcggcacacattccctccggggccaacgccactgccgttgatcgggaa

SEQ ID NO: 83662 - DNA, 940 bp, Heterodera glycines
  Genomic contig location: Contig_ID=SeqID_18936; Location=416..1355; Strand=-
  SCN-specific regions: Sequence locations=1-208,230-917
  Gene Ontology: Mol. function=calcium-dependent cell adhesion molecule activity; Cellular component=integral to plasma membrane; Biological process=calcium-dependent cell-cell adhesion
atgcccgggggcgtcgagttcagcatcatcccagcaagcagtgagcagcctcagcagcagcagcagttgccgttctttgtgcgccgtgacaccggtgaactgatcgcatttgcggaaattgatcgggaggagcaggcacaataccaattccgggttatggtaagtgtgtatcgtatacattttggtactaatttgtaagtgactggtttaaatggaaaaagggggtacagtatcccttcccatgattactgtaactgatcaccggggttacaatgactacctatcgttttactgtaggcgttcgaccccacacagaatcggagtaaatgggaaaaaggagtagagtaaacattccatctaactaatcttcgtgggtacgataggacagatcaatactgatcagatagaaagaaaagtacaacagcagatggatgaacagtacgcccaaaaaatagttgaattttcgccccttgcaacatagtatactgtaagtacaattttactgtaggctttcgacccggccaagaatcgaagtgccgagacccatgtgacggtgcacattctggacgtcaacgacaatttcccccaatttgtggagccgttgccacgagtgattgcgctcggccgactcagtccgcccggcacactgttggcccggttcagcgccgtcgacatggacgatggagcgcacggaactgttcgctttcaaatcagttcagttgctgcagcagcaacagatcgggttgatggtgatcagcagcaccagcggcatgatcagcaggagaacaacgagcaggatgatgccggtccgggcgcggacgggcacaggttgttcagcatggagccagacggtcggctgatgttccgtggattgccatcactactggcggccgagcaacaccatcaagatggagcagtacagcagcaacaacagcaacag

SEQ ID NO: 83663 - DNA, 612 bp, Heterodera glycines
  Genomic contig location: Contig_ID=SeqID_18938; Location=88..699; Strand=+
  SCN-specific regions: Sequence locations=1-317,345-439,485-517,540 -565,587-612
atggaccgggacgggacccgggaccgggactcccgttttaaacgggactcccgtcccggtggcttgtccaaaaaaacgggaccgggaccgtgagtcccgttttaaacgggactcccgtcccggtggcttgtccaaaaaaacgggaccgggaccgggactcccgttttaaacgggactcccgtcccggtggcttgtccaaaaaaacgggaccgggaccgggagtcccggcaaaatcccggtgggatcccggtcccgtccgggctctaatgataagtaattgaaagcaaaatattagtgaattttgtgaaaaataatgcttataaaaataaaaatttataaataatggagttaaacaagaaatattttcatacaaatcgtcaaaaagttgtttaaaaactttcagaaataagatttattctccttcatacattgaatcaacaaaaataaatattttatatttaaaaaagaatacaattaaaaaaaacgtgaaaataataaattaatctaaatgctgatattttttattgtagaatcttcattgatgtaaattattaaattaaaagcaatattacaaaacaaataagcaatgaaattaaaaaacctttaatacaa

SEQ ID NO: 83664 - DNA, 706 bp, Heterodera glycines
  Genomic contig location: Contig_ID=SeqID_18939; Location=1170..1875; Strand=+
  SCN-specific regions: Sequence locations=1-21,43-107,152-158,180 -187,250-326,353-488,511-680,703-706
atgcccatttgccgatgccaccattatttgtatgctaagaaacggattagagtgtgctcatcagtggaagaagcggacttgaaaaaacgcgaggcatacatttccggttattattataattatttttgaaattaaaaaaaaaattaaaattgcattgcaaaacaaaagctgtacattttgttttctcttttaaaaaatttaataaaatatttctttattgaaaagttattttaaaaaatttaatttaatccaaatttttgagtaaaaaccaaatttttataaatttaaagcattagaaaatgattaatttccccccttaaatattcaaagaaaaattaattaaaaagttaatctaaaataagagaaacttaaactattttcaggggaacatattgagaagaaaaatgacgtaaaaattttgcaggtgattttatttataaatgaaatgtcaaattcccaaaaaaagaaacaacgataaatgccaaatcttaatttaaatatttaataaaagtgaccctttttcagctgcttctcagttgaatattttatcaaaaaaaaacgttatacaaaaattacatttgtgataaaaatagaaaccttttaaaaaattaaaaaaagatcaaaaaattatccgataaaaatgtttacattaatttcctcaaaacagaaattaaattgtcgaattttttaatgaaaaatataatca

SEQ ID NO: 83665 - DNA, 1150 bp, Heterodera glycines
  Genomic contig location: Contig_ID=SeqID_18940; Location=230..1379; Strand=-
  SCN-specific regions: Sequence locations=1-1150
atgtctgacaaccgaaaagaagcagaggaaaaaatggcaaaatcaatgtaaaattaaaaatgctaattttcaattttcaattttgtttttccattttttcagtttcatctccggcgacggttggctttcggtgttcgatttgcttgagccttctcaacttggccttggaattgcgctgatcagccaccgttttaacttctacgtggatgaacacttgaagacgcgcaaatggacattcggaataattcgaattggaagcaaaatcagggagaatggcaccaacgaaatggaaattgtcaattgctatcgaaatccattgccaattgcgcaaaaaccggtgccaaagaaagtcgtcggatttaaagccatttcaatagagtaaaatggataaattatttattgtcaaatatacataaattagtatcatttctttttcagatacatcgataacaattccatcgcttttctccaccgtttttgtccacttttcgcctcattctgtccaattaatttggccatctgcacgaccaaacaccgaattttggccttcattctgcgcaacatttggccaatgatcgcgaaaaacatttgtgggatgtttttgtttgagaatgttttcagccctttgcataaattcgtcccatcatttctcaacgaatgtccatcacttcgcattgtctctttcatttttgacgacattttcgccgaatttccatttgatgacagtgccatcacatcggatggacaagcggtggttaagtggcttttcactccacttcaaaacgctgtgccaaaggtgttgatctgcacgttggacatggctgacgagaatttggcgtcgaagattgaagccttcaaagcggtgattttcaatgattttttttttttggctttttttcgttgttttttttggctctaacagaattggtcacttcaaccataaaagttgtaaaccttttggtttttcatgtccccctcccaaccgaaaagtgtcattcattttcatatttcttaaccaatttttccacatttttaggcttttgcctcggcttcatctcccgtcaatttcattgtcgtcatttgttttattccttcgtcttttgctgaccctgttgtgccatttgtgttgaccaacggaattgacccgtga

SEQ ID NO: 83666 - DNA, 451 bp, Heterodera glycines
  Genomic contig location: Contig_ID=SeqID_18941; Location=97..547; Strand=+
  SCN-specific regions: Sequence locations=1-18,56-451
atgaaggaattaaatgatgaaattaaagagagagaaaaggaagaaaaagacgacagaaagttggcttacaaattagcaaaggtaaaggaaaaaaataacggacaaaaaaatgtgcaaaaaaagagaaacgaaattttaaacggacgaccaacggacagaaaagtgaataaaaacgacaaaaatcatcaaatcaaaatgcaattgaaattgccaacctttgggaagaatttgaggaaaaaatggaaaaattgtatgaaaaaacgaaagaaaatgccaaggaagaaaaggctcaaaaaacgcatttctgcataaaaaattttcgattcagatgtcactatcggtcactaaaaatcactattttggcgcttcgtcactaaaatagttaaaattcactattttggcattttgtcactattttttcactatttcgacttttttggaaaatttctca

SEQ ID NO: 83667 - DNA, 1083 bp, Heterodera glycines
  misc_feature (1067)..(1067): n is a, c, g, or t
  Genomic contig location: Contig_ID=SeqID_18943; Location=810..1892; Strand=+
  SCN-specific regions: Sequence locations=1-168,190-1083
  Gene Ontology: Mol. function=heat shock protein activity; Cellular component=plasma membrane; Biological process=response to stress
atgcggacttcatcgacaaatttgcatccgttgaggtacgaatcttatgaggtgctcaaaaaacatgctaacgacattgacaaccgattgcattattcacttcaacggctcgacaattttactcggctcaactttttggtggaagtcgaacggaaaggaaaaacgaaaatgcaggaaggaaatgaggaggacgcatacatactttacagcagagccatgaccatttatcttatgatgagtgagtcaattgacgacaaattcaaacgaagctgcggaggtcaacttttttatgaaacttcacagcgtttgtgtgttgcttttgacaaggttgcagtgagtttacaacagcggtttatggagggacaaggcgatgagcctgaattttgtgatccagtggaactgcgttgggtcgaaatagttgaaaaaccgattcccgaaaatttgcactgtagtaaggactccaattcgtcggatgaccaggacaaaattcggtccctttcgccggcaaacgcaacagaacttgtggcaaccgaaaaattttcaaccaaaattaaggcggacaaagaaaaccacattttgcacataaaggacaagacggacaggggcattgggatgattagacatgccgtgaccaataacctggccacagttggacagtcaggcaccagcgagttcatctccaaattgttcgactcgtccatctcatcaaagcagaatcaggatttagttactcaatctctgcacctcaatgaggaagcacgcaactttttggagctggataggctgaaaaagtccgaaaaaatggagaaaccggtaaaagtgagcaaagaaaataagaaaggagaggaaaagtcaaaggaagtgaacaatgaggaaaatgagtacaacgaattctgcaagtcaacgactaaaaacattgacgagccattagtccatgtgcaattttttgctgaatttgagagctccttcaagtccattttttacgtgccggaaacgttgaccacagacgaattccaaaatcaaaatttggcattttcatcagggacgatgaaaaattcgagggaggngaagaaattggcagca

SEQ ID NO: 83668 - DNA, 2129 bp, Heterodera glycines
  misc_feature (1527)..(1528): n is a, c, g, or t
  Genomic contig location: Contig_ID=SeqID_18944; Location=1017..3145; Strand=-
  SCN-specific regions: Sequence locations=1-264,289-1055,1077 -1184,1222-2129
atgcagcaaatgctcggctcgaccaccggcgggggcagtggcggaagcggtggcacaacgactaccgctgcgctcgacctgaacattgcgggcggagctgccggactcatcgacgccacagcaatgcccaccttccatttctcgcacacgcatggacaccaccagcacgtgtcaagtgagtcccagggttttattttgtcgtaacaaatcatggaaatttgttcgtattggttcatacatgatgtacaagggggttctcgaccaccccccccccccccccccgcccccaaaaagttttcaaaaattacgccgcaaaaaaacgtttttttaacaaaaaaagtcgtcgacttgccaaaaaatcgcaaactttgaaagtttttggtgaaaatcttgacaaattggcactcgaattttcaaaaatttccccggcggcgcctatcggcatcgccggcccacctgataccgaaattttttttggaaaaagcgcgccgaaaaaaaggtttttgaaaagcaaaaaaaaagtcggcagaaaaaaatggtctgaatagaaaaaaaaagtcgtcgccggagaaaaatttggaccttcgtatgaaaaatcggtcccgagacatccccctgtcccaaccgtccgtcgtatggcccttgggctgagacaccccttgtacatgtatgtattggttttcgggatctttgacaccaatttcgacactaattcttaacccgaaccctaacaagatgaaattcccgaatttcgataactgatgtcaaattcatggtcagcaacccaaaatccccgaacaatcgagttgatgtcatcatacaaaatgatttttcaaatcgaaagcccgcccccctttaaattttgaaaaattttattctttttctatattttgtaaattatcctttttcctaagtctgtgtccgtatcacattgtttaacttttttccattaaaagacgacccgtgaccaaataatttcttccatttgccattcccatgacccgtttttctgttccccatccccgctaatttgcctatggtcaatttttctgaatcctttttcattgtcaatggaaatttgtcattcgaaagcaactttcccatttatttatccgttacttgcgtcatttttactacttgcactttttgttgtaaatgtagagttgtttcttttgaattgctgattctcctcactttccattttcccttttcagctcctgcaatgctttccatcgtcgaagggctgaagtcgagcaatgaaattcgccaatccgaagcggcttcagagttggctgacattttgctgcttggcaatgaggtgggacagacagacacactaataaaacggaggcagatatttttggcaatcatcaatggtgtctcgacgaaaaaaaatgtttaaaatttgacaggtattttttctggctttaaaaatgcgcttatcatgaatctgaactcttatttttgaaatcattgatttttatctaggatttttcatcaactacttgattttttcaaatttaagannaaatagtctggcataaaattcatacacagatgtgtagagcataaaaagagtttcgaatgagctatttaatgtatggaaaagtcaagttttcaattttttacgactttttgaaaccctagggcttatatgagacaggggtctggggttcgagtccgcctggctgcgatttattttttatgacaattgatgaataatcagaggtaaaattaaggttcaagcataatctgagctcagattcgtgatcagcgcattttctaagtctcaaatttttaacattgttttcgtcgggacaccaattcttgatgattgccgtccttttcataacgttttcgtcgaaaatgtttttgattcgcgggcaaacagtgtaccccactcccacccagcaaatcagtaaaagacccaaactttttttgttgtaggacagtcttcccaatttgccaattgtggaaatagtgcagtcgctgtgcgcactgttgcaaaaggaccaaaattttgaattggtaattgttttttttgtttcatattttttatttgatgcattttttcaacagatgctgacagccgctcgttgcatcaccaacatgcaggaggcggtaataaa

SEQ ID NO: 83669 - DNA, 436 bp, Heterodera glycines
  Genomic contig location: Contig_ID=SeqID_18945; Location=233..668; Strand=+
  SCN-specific regions: Sequence locations=1-179,208-213,235-319,351 -358,380-436
atgagattcttgaacatagctattttcctcccattccgtcactgtggctataaaaggttagttaacttccccacttggacagactcaagaagtggatgactctcggactcgatgactcatggattctcggatctcagaccccttccgcactcatccttttcctacttttaattcccgacttaattttaaataaatattgaataatttgaagtgattttgggattgggtcggaggctgattgggagctcaaaccggagtgattaaaaccccggaaaacttccaaacaatttgagaacggaacagtgcagcagaaagagtgaattaaaaacaaacaaagaaaacccttttaagaagccgcttttcctaggccttttaaaaagcttcggtcgataaaaaagtaaagaaaatattttaaaaagacaaaagttaaatggaa

SEQ ID NO: 83670 - DNA, 1089 bp, Heterodera glycines
  Genomic contig location: Contig_ID=SeqID_18945; Location=1523..2611; Strand=+
  SCN-specific regions: Sequence locations=1-412,434-491,514-871,902 -929,961-973,995-1026,1048-1089
atggtcgtgccgttggcgatggtacacgcggccgtcgctccgacgccacaagacgcggtaggggcacgtgttgccaaagcgggcacagcgcaagtaggagctgctctggcgacgcatggtcagcttcagcgagtgctcacggcacagtgccaaaatggcacgctttccgtacacgccgctggcgagcacacgccattcttcgcggcacgagttgcggacatttacagtggtaggtggttgagataaagcggaggccgaagcggcagagcaaggggaggagagcgtcaagcggaccagctggaaacgggggacctcaaattgtgccaaaaatggagagatttgatcaggatgtatccaggggaaagtgagggcacagaaatgaaaaaaattacaaaaataaacaaaaaattttgccaaatttcttgtttttctcacgcggcacattttttgataaattcactggagtttttttagcctaagcacaaaaaagaaagtctcaaagaaggacactgtattcgtccgtttgtgcctcccctggaatttgtttctgggtatgacgagcctagacttggtcgactagcaggacagggttcgaatttctacccgagctttttcccgggcatttttttttttttgctgaataccaaggtttgtgatcgtgtgaaactggtaaaatccttgtcttgatctcctgcccgagacctaacactcatcagggatgggtttggggtcggcggatcagcaaccaaatcagagcccctcggaaaaggcccaaccaatcactactgattagattatctaccctctgcttcccaggccccgcataattatgatgaatggacggcttcttattcgtccattaattagtgggtaattaattaataattaattaattaattaagaaaagtgcaaaatgctgacagcgcgaggagaaaaagtggcagctgctggcgaggaaggggaaggcggtgaagaaggattattgtccagatcagttggcaacggatggttgtgagcagagcgacagtacaacatgtgtttatttgcgtcgatcattgttctgttgaatttggggccattttttgacaa

SEQ ID NO: 83671 - DNA, 248 bp, Heterodera glycines
  Genomic contig location: Contig_ID=SeqID_3202; Location=2661..2908; Strand=-
  SCN-specific regions: Sequence locations=1-75,111-131,154-248
atgccaaaagttaatgtgaccaattcaaggtgaaaatcgaaacctaagccaggctttaagctgaaaacttagacctaaaaatttatttagatattttattcattatttttcagacacccaaaccacataagaaattgtttttctttgaaaaaagccattatattttgatcttcataaaaaaggacagtccttgaatgacaagaaaagtccttgcaaattaaaaaatccttgaaaattaaaaaaataaa

SEQ ID NO: 83672 - DNA, 588 bp, Heterodera glycines
  Genomic contig location: Contig_ID=SeqID_3203; Location=1148..1735; Strand=-
  SCN-specific regions: Sequence locations=1-282,304-356,378-588
atgtgcactttgcgcgcttacgatgtgagtgccatttaccgaattttacagccattacagtatgccaaatttatcgtgtgcacttttgcgcgcttacggtgtgagtgccactttgacggtgcacagtgtggtcaccactgtgcagaccaggatgacggcccacgcgttcttgacgataaagcatgcccacttggtgtacagggagtggacgaagcggattagcgggggcggctgcttatgcgccgtggccgacgacggcaccgagcgcagcgacagactgccggtggtggagctgctgctggacggatcatctacgacgcaaaaaataattagtagtgaaatgtgcgccaagtcttatgaatagggctaggatttttatgttttaacatattttttttgcggcttagttatggcgagagaagcccaaaaatagcattttctccgaacaatttttggtttagagcgacttataaaaacataaaaacacatattttggcgttttggcacataaaatatgttagcacatattttggggtttggcacatattttgcacatattttggcatttttgagaaaaattgcaataaa

SEQ ID NO: 83673 - DNA, 2985 bp, Heterodera glycines
  Genomic contig location: Contig_ID=SeqID_3203; Location=1425..4409; Strand=+
  SCN-specific regions: Sequence locations=1-8,30-503,527-546,573 -686,708-812,834-1289,1415-1443,1465-1484,1507-1790,2068-2108,2165 -2179,2216-2257,2280-2819,2876-2985
atgatccgtccagcagcagctccaccaccggcagtctgtcgctgcgctcggtgccgtcgtcggccacggcgcataagcagccgcccccgctaatccgcttcgtccactccctgtacaccaagtgggcatgctttatcgtcaagaacgcgtgggccgtcatcctggtctgcacagtggtgaccacactgtgcaccgtcaaagtggcactcacaccgtaagcgcgcaaaagtgcacacgataaatttggcatactgtaatggctgtaaaattcggtaaatggcactcacatcgtaagcgcgcaaagtgcacatgggaatttggcgtactgtaatggctttcaaattcggtccaattaatatggcactcgcaccatattcgtacgctgacccacaaaatgtccagcccacgaaatgtccaagtctcgaatttgagttttttattattcagatgggcctaaggttaggcaaggggtaatatgaaggttatattcgtattcagcgaccccgaaaaccctaaaaatcctaaattagactcattttgtttttataaattttgaaaaattttggacatttcgtgggtttttactcttttggacatttcgtggcttggacactttgtgggggtgcctattcgtacactaaaatttggcgtactgtatcaaaatcaaagtgttaccgtaacactcatttaaaaatagtgaatgttttgtcttttgtttccgcatttttagcagggagttccggggcgaaaaaaaaagtcgggatattttcgggacaaaaaatttatcgggatcgggacctggattcacatccggaaggccaaaatttttcaaatcagacctcacactaaaagacttagtaatgtaccaaaccgtaattagtctcggtaattacaccctaattgaacacaactaattttgcagacagaaaaacgatatcaccggctatacgccgtacggggcacggtcaaggcatgaattggcaattcaggtaaacagaaatattccattcaaattttgatcagtacacaaaactcattaggaatattgctcgtctcgctttctcgcccttttttggcttctcgttctcgcttttctcgcattttatttttttgtccattctgatcaaaataatttccaaaatgaatgagtgttcatgatcaaatttgatcagaaatgttgtgatcaaatatttcatccgaacaaaaaatgaattttctttttgtataaattttgacaaaacattttttcaaaattgtttttcaaaaaacaaaaaacaattcagatactgtttttataataaacaaaattattttaagataaaaacaaattaaaaataataatttttagataaaaaataatttttctttattttataaaaatatttttaaaactattattttttttataaattttgaaaggaaattttttggcattttgcataaaaattcaataaaaaatatgccgaaaaggggacataattgggaacactgacactccgatcaacaacatttggccaattgtaaccaattttgccacttttcaaaggagcattttttcaacgcccaaggccttggccatccgttcggcgtgttcgttttgctgttgccgcgccgtgccgacgacaattttttgcgcccccaaatgctcgcggaagcggcacgcgttgacgagttggtcagcacgcggtttccgctgttcaaccaccggacaaatcggacagaaaattttgcccaattttgccgcgatttttgccaactcaatgaaccaatgcgacgatttgcggtcagagaaattaaaattataaaattaaatttaaaaattaaaatttttttcatttaaatttaaagctaattaggtaatttattttttaaattaaaatccgatgacaattcatgtaaaatttagaaaatttttaaatatatttattcgtttaaaatttaaaatgaatttattgcaattttcaactttttaattataaaataatttaaaaatctatttatagaaattaaacaataatttatagttagtttgataaattaagcatttctattttttaaaatttaattctctgtttaaatttaaaaagaatttattgcaatttatagcgtttaattaaataaaataattaaaaattgataattaatctatttttaatttttattagccaaatattcagtgaaaatttttatacaatatattttttttcattttttaggaagagaaaaaatttttttaagttcaatgatttttgccgacaattaattatttaatttaaaatcattttccacattttaggaaggctttcaattgcaatgggatatgttggttgccaatgagacattgaacgatgccattcatctcaactatccaatcagcagcattttgggccaaaaattcaacatccaagtcggtgacaggcatattggcaccagggatgtttcgggaatgtgtcaaaaatctccacatttttgagtcccgcatcccggacagaaaaatttggaacggcatcccggcctgagtccaaatctcgaatgctgaatcgcgacattttttcgggcccggtatcccggccagaaaatttgggtcatccctataagaatcttggatgccgaatcccgacattttcggataatcttaaatgccgatccgaaaatttttggatttttggaccaccgacacgaatcaccttctcgaacatctcgtattggtctccctctctacctatatacattggcattttgttgccataaaataaaatgtatgccaaatttgcagccaaatttcttcggcatccaatttcgtactgccgccactcccgcaacaacagcaacagcaaattcaacaacaagcagtaccagccacacaacaacagcactcggcagcggcggcggtttgtccatctccaacatgcgccgcgtggaaatggtggtgctcacttataaggcggaacgcatcggcgcgtggacagacgacgaaatcaagga

SEQ ID NO: 83674 - DNA, 599 bp, Heterodera glycines
  Genomic contig location: Contig_ID=SeqID_3203; Location=2873..3471; Strand=-
  SCN-specific regions: Sequence locations=1-24,258-541,564-599
aaatgcttaatttatcaaactaactataaattattgtttaatttctataaatagatttttaaattattttataattaaaaagttgaaaattgcaataaattcattttaaattttaaacgaataaatatatttaaaaattttctaaattttacatgaattgtcatcggattttaatttaaaaaataaattacctaattagctttaaatttaaatgaaaaaaattttaatttttaaatttaattttataattttaatttctctgaccgcaaatcgtcgcattggttcattgagttggcaaaaatcgcggcaaaattgggcaaaattttctgtccgatttgtccggtggttgaacagcggaaaccgcgtgctgaccaactcgtcaacgcgtgccgcttccgcgagcatttgggggcgcaaaaaattgtcgtcggcacggcgcggcaacagcaaaacgaacacgccgaacggatggccaaggccttgggcgttgaaaaaatgctcctttgaaaagtggcaaaattggttacaattggccaaatgttgttgatcggagtgtcagtgttcccaattatgtccccttttcggcatattttttattg

SEQ ID NO: 83675 - DNA, 466 bp, Heterodera glycines
  Genomic contig location: Contig_ID=SeqID_3203; Location=3582..4047; Strand=-
  SCN-specific regions: Sequence locations=1-344,367-408,445-466
atgtcgggattcggcatccaagattcttatagggatgacccaaattttctggccgggataccgggcccgaaaaaatgtcgcgattcagcattcgagatttggactcaggccgggatgccgttccaaatttttctgtccgggatgcgggactcaaaaatgtggagatttttgacacattcccgaaacatccctggtgccaatatgcctgtcaccgacttggatgttgaatttttggcccaaaatgctgctgattggatagttgagatgaatggcatcgttcaatgtctcattggcaaccaacatatcccattgcaattgaaagccttcctaaaatgtggaaaatgattttaaattaaataattaattgtcggcaaaaatcattgaacttaaaaaaattttttctcttcctaaaaaatgaaaaaaaatatattgtataaaaattttcactgaatatttggctaataaa

SEQ ID NO: 83676 - DNA, 509 bp, Heterodera glycines
  misc_feature (12)..(12): n is a, c, g, or t
  Genomic contig location: Contig_ID=SeqID_18946; Location=52..560; Strand=+
  SCN-specific regions: Sequence locations=1-509
atggtcggaaancgaggaccaaattcgaccttctctcggcgtcgcgattcccgtgagaagcagaaatatgccatgtccaacgtatttttggatctaatggatttgtccgcccgtttgttacgtcccggcggtcgtttggccttttggttccccgtttgcagatccgagtaattctcgagtccatttcccacaaatcccatgtgtttttcagatattccgaacgtattttgccccgcatggattgcatgcgattggtgtgcaactgcgaacaaacactcgcgaaggattcgtcccggtgactaaacgccatcgcttaattgctccatttgactgctatgcttttaaggcgccttttggtctatgaaaagcttcgccgtcctctgactgatggccaaaccaaaccaagtgaaagggcattcttcgaattggactgttatgccgagaaaacattccaccagaaagtgttcggaagcatcgaaaagaacgaggccaaggagtgtgctgattaa

SEQ ID NO: 83677 - DNA, 1005 bp, Heterodera glycines
  Genomic contig location: Contig_ID=SeqID_18946; Location=691..1695; Strand=-
  SCN-specific regions: Sequence locations=1-184,220-448,470-516,538 -1005
atgtcgcaaggaagcctttcttcagcaccgtcgtcacaggatcaactgctggtcaagctggggagacatcagttgctccattggatgatttcgaatattcctgatgaatgcgatggagttcagacgggggacgaattgatgccgtatttaccgcccgtccctttttacggcacgtattcatataaattttccattgctcaatttttaataaattgccaattaaggtactgggtaccatcgcttcggttttttgctttttcgacaccgacagcgcatcgattttgccgaattcggcctcgaagggtgccccactaccaaagcacttttatcaaatcaattggtcctttttaagaagcgattcgctggtcgcacgttcattcagcacaaatgctttttacaaacaattcgaggacaaaatgagtccttctgcgcttcggttttgccaaataaaatgggataaaagttgcgaccaaacattgcatcgattgggtgcggtgaattgccaaaccaatgaatttatttattgtacaaattaattccaggtctgaagacaccacgttattggtatgaatggaatgagcaaatgggtccggaacaaaaggaattcccaatgaagccgatgccatttcaccagtgagaggctacaaacggactattcgaactaccccaaacatattgctttctttcagatatttgaacatgttccggaacccggaaacggtcaggcgggaagtgcagcggaaacggctggaaaagttggtgaaactgaagccagacgaaaaactggagccggaatacccggacatcaactaccaggcgaattggcttaagaaaccattgtttgagcaccaaaggctaatgaaggaaaacagtggggagggagtgtgggcggcaatgtattatgactatgagaatccgatggaacagcacgaaatggagaaataccagaggaaaatggacgaaaggagagacgaagagagtgcggaagaagccattggaatttga

SEQ ID NO: 83678 - DNA, 401 bp, Heterodera glycines
  Genomic contig location: Contig_ID=SeqID_18947; Location=110..510; Strand=-
  SCN-specific regions: Sequence locations=1-401
atgacttccgccgatggttccaatatgagcgagggttcgttagtcgtttcgtaaattttaattgtttttactttcagcgattatgcaaatggtccgtcccgccattgaacgcatggacgaacaggtgaagaacaccaggaagagtcagctgttcttggccaatcacatcgaccaaacatcagaaagtgggtgagcaattaatcatatcaagtcaaaagagagtcgtgtaaatgaacatttttaaaacgttatggtgtaattgttgaagcaaaaaatgctgaacatatttagagttaaagaatttggtggatgaacagcttttgccctatgatttggacgcgtacgtgcgaaaattggatgagagtcgaaagcgaatcaacggaatcagccaaaaacttcag

SEQ ID NO: 83679 - DNA, 851 bp, Heterodera glycines
  misc_feature (52)..(52): n is a, c, g, or t
  misc_feature (54)..(54): n is a, c, g, or t
  misc_feature (62)..(62): n is a, c, g, or t
  Genomic contig location: Contig_ID=SeqID_18947; Location=908..1758; Strand=-
  SCN-specific regions: Sequence locations=1-212,234-851
  Gene Ontology: Biological process=chromosome segregation
ttggcatttacttttcctctccgtccctaatttcctcccattttccacaggngnttacattnttttctcctcccttattactccaggtactatctttccgtaacttcagttgggaaggctttttcctttcagaatcgacgacagattccctgccatttgtttgcttgtgaaacattgggcgaaagtcaaagggattagcgatgccagcggtggttacctcaacaggtgactgaatgactaacgcttaattgacagttaattggttgcccttttgctcagttactcgctgattttgatggttctccattttcttcagtgcggcgtcgacccgccggttcttccgaatttgcagcaactttacccggacttgttcagcttaagacgcccattcactgacttggtctatttcgaggatttgcccactcctttgccgggtgaagcaacaaagtgattttcgaagacaataaacctattgtatgtttcagaaatacagcaaaatgacaggactgtgggtgaattgctgatcgctttcttcgactatttcaatcgcttcgatttcaatcgatttgccatttccgtacgaaggggctgtgttttcccaaggtattgtaaaacaagtgtccccaatttatttgaatgcttttcacgaaaggactgaattgccaccaaacactgaacggttccgtctgttcattgaggagccatttgatcaccaaaacacggcccgatgtgtgaccaacgacgatcaatggatgatcattttggacaccattggcaaggcagcgaaggccctttcgccaaactcaaaacaggcaccagatttgctcaaacttggcatccgaatcaaacca

SEQ ID NO: 83680 - DNA, 837 bp, Heterodera glycines
  Genomic contig location: Contig_ID=SeqID_18948; Location=73..909; Strand=+
  SCN-specific regions: Sequence locations=1-561,583-679,701-736,758-837
gccaatacaattattcgtttcctctttggatttccgtgaggctcaattaacaccgaatggtccaatgcgtgtttgtaatgctatcctaatcaacggggagggaaagaccgttgaggtctcagcttggcgcttacaagcggatgtgttagcatcagccatgagaggctatttgtacattttcgtaaactgccgtgccaaaccaccgcgagaacggaccaattgttggttcagactgaacattgatgccatgagttcatacatggtacaggtccaggttcgagcgttgagagtagcaaaaaaatacgagattattttagccacatattgcagtgccacaaaatacaattgctcccgctcaaagccaaccgtccggttcaattatgcctaatgaaccgccggttaaacctttcttcagatttttaaattaaaatctattttcacccccagagatcacaaattgtcaattccggggcaaatttagtggctattcaaagccaacaaaatgaaaattccgtgcctatcacgcaatctgccccggtaaaaagtgttgtatttcagacaatttgatttttgaatttaatttatttcagtctaatcccttagctcatgatcaaaatttggtgcccagtggggcaaactcgcatcacactgatgagatagtggaggtgttttttatacaaataataataataataataatggcttttaagaccattttggattgaaaactttttttaaaaatgtttaaataacaaaatattcttgacttttcatttttttattgaaaatatattcaaaaaaagttattccttatgaagttgttttgaaatatagaaa

SEQ ID NO: 83681 - DNA, 781 bp, Heterodera glycines
  misc_feature (725)..(725): n is a, c, g, or t
  misc_feature (743)..(743): n is a, c, g, or t
  Genomic contig location: Contig_ID=SeqID_18948; Location=2373..3153; Strand=+
  SCN-specific regions: Sequence locations=1-268,290-330,356-781
atgccgcttgaggaagcggaccgtcccgatctcgttcttgaagcgctcatacagcatttgcttgatagagttctaactggccatcctcgtccactaatggtcggattacaacttcatccgccgggattcgacagaccatatattattcgactccgtccaccggaacaaaataatgcagcggcgctcgcagctgctattgaacgactcaatgagcagtctgcggccgggattgatctactttctggcacaatggtcacaaaagtgctcgctgtgtggccactagatcccattcgtgccgatccgcagagaggcggtttttaaacaaattgcattttaaattaataaattataattaggagggtgtgatctaaatgatgaacacaacgtgtcgcataacgtgcaatccatcgtgcgcgtagagaatcctgacgaccgtctatgtttagcacgtgccgtgctaatagggcttagagacagtgagtccaggatgcctaatggaggtggccttgacgcactccgtgcgtacgttggacatcaaaatcaacatggacctgaagcggtttccttgctgaggcgcactgtaaatccacacaacaaggacatgtacacgctacgggacgttgagcaactgcaaagatggttgaacaatgctcatggcattgggcagactcggctcgttgtatttgagaaagagcataataccggatcgtcttcaagggagaggngtgagccttggtttttanaattagaaattttttgcataaagtgcggcacagtttaa

SEQ ID NO: 83682 - DNA, 344 bp, Heterodera glycines
  Genomic contig location: Contig_ID=SeqID_18950; Location=359..702; Strand=-
  SCN-specific regions: Sequence locations=1-344
atgtgtatgggaaggcgtgtggattctcaaaagcaagtacgacagactccgtccgttgtgccaacaatttgtttgacccgttaccatttttggcaatcccagcttcgggggggttggggggtgtggggagaagactgaacttgaagattatgcatctgtttttgaatgcttcagtcagtccatctgacatattattggagttattaatacttttaagattacatttacccatattttaggtctatgctggattgttgtcttatgccgaaactgttaccgattcaggcctaagacatcgctatgaaaaagacggcatttgtcaattggcaaccgatctgaagtga

SEQ ID NO: 83683 - DNA, 517 bp, Heterodera glycines
  misc_feature (463)..(463): n is a, c, g, or t
  misc_feature (481)..(481): n is a, c, g, or t
  misc_feature (491)..(491): n is a, c, g, or t
  Genomic contig location: Contig_ID=SeqID_18953; Location=2180..2696; Strand=+
  SCN-specific regions: Sequence locations=1-91,113-348,398-484
atgaacgattatttgtgtattgcacttaaaaacaaagatcgaaaccagggatttgcaatataccaattaccaagattaaactttaaaattaggtaatttttaatttaccattagcctagctattcaggaaaaaaatatgttatgctgagcacaagtgaaacaaaatgtcaaaatcagcgaggagcaaatgctaagatttcatttctgtttaggggaatgattcatttgaataaaaacggagaatgtaaaagctaattttggagacaaattgtataaagtgaatgaatggttgttcaattaacgggcattttaatttaacaaaaaaaaagaatgtcaaaatttatgtacattatttttttcaataaatttcttattaaaaataagttttaaatataaactttcttttaaagaacaaaaaaacctaccttattacattttgagaatacacaaatttatttattanagctatttgcaaaactanatgataattnttaaaatcaaaaaataaattatttaa

SEQ ID NO: 83684 - DNA, 1918 bp, Heterodera glycines
  Genomic contig location: Contig_ID=SeqID_18954; Location=118..2035; Strand=+
  SCN-specific regions: Sequence locations=1-7,29-50,73-138,160-745,767- 957,981-1027,1050-1145,1170-1260,1282-1394,1416-1585,1608-1616,1643 -1918
atggcaatttacaaaaaatgtgaatttggtgttttgtcaggagaaattggccaaatacacacaaacaaaaaactaatcattgaacaatcgtggtggaaaattgggttccaaaaaaccgagtccgaaaattgttttttgtcaaaaatcagtttgtttggaaccccagggtcagagataatacattcaccagtagatgacacaaagaattgtaagtactcagatggacaatgccagttagaaaatggtgtttatcttttatgggaaattaagaaaaacattaaaaatctttttgatgaaaaaacttgtgtttataaaaaggaaacaaaaatcaatggcacttatgtcccaggtatttggatgtcaaatgataacaatcgggctttggtttttgatcaaaattcaaaaagggtagagtcatgtggtgaaaaattgcgtgttagtgcgcaaggatttgcaataattgaggaacaatttaaggaattgatgaaaaatgagcaaaattcgttagacaaaaacacgagaaacgggataaaaagattcaaacgttggaatactgctttctcaagtgaaatagagaatgctcccttggacggagaagttcgagcaagccaattggcaatgcaattacaagccggtgctttttatcaaaacaaggaaattaagaattcttttcataaattaattgaaatggtttgtaaaacattggatgataatattttcaatgggtattctcatttaaacccttccttgtttataagacaaaaaactggtcaagcttttttagaagggcgttggatttccgatgaaattttagaattttggggttgttctgcaattaatttctcctttgtcccgtcgttagatggaaaatgttatgaatttattccattaaatttttctttagaccataccgaaaaacttttgataggatttttggatccaatgacaatgattgttaaagaaaatagtgaaatccaaacatgcaatgagggacaattcaaaacccttttactgaacaataagctcataaaaataaaccaattaactggcaaatatacttttattggagaaccaactatttataaaatcgatcaaaaaatatggggtgaggaaaatttacctatttttcctttacaaattttcaaacaattaattttaacaaatttaacgaacaaacaaattgacatgctggaaatgcttcatgcattccgtactagccgaattattgacaatagaccaaatgaagaccgaaaaatttttgaattcaaaccaatttcaagcatttacctttcaaaatttaattactgaaattgattggtggaaatatgtaattcgatcagtcgttttagtcattataattaattgggtctacaaaatttataaatggaaacaaaaaatcatgatcagaaaagaaattgaaaagaggaatagtcaaaactttcagcaacaaactggtgccattcaaattccactggccgctctgaaacaacgtttcgttgggggagtgtcggcgcccacgaccgacgcagccgagatgccagagaatgccgagaatgccgaaagaattaaatgccaaaaacagaagagacggaggaaataattttgaacaaatttgcatttaattatttattaatttaaatttcattctccattttattattatcatccatatctttcagcctttgcctttgcgatcactttattcatttatggtaaagtcgttggagacaagaagaaaaagagcgatagggaatttcacagagtttaacaaaaggcggaaaatgtccgtgagcgaaaaaagggggaaagatgaaaaaaaaatccgttattcattcgcttaactttttaaaaaatctgttcaacgttcttgctctccgatttaaaaaatattatttgtcaatttcgtatttacgccgta

SEQ ID NO: 83685 - DNA, 297 bp, Heterodera glycines
  Genomic contig location: Contig_ID=SeqID_18954; Location=2462..2758; Strand=+
  SCN-specific regions: Sequence locations=1-297
atgccaataaatcctactaatgttattcgtttactgcaagagcattatcttaataaagctccaccaccgaccccattgacagccgaggaaaagctattggccgaagattttttgaaaactttggaatttggtgcaaaacaaggggttgaactcgagatttcggatgagcttgtctttgatgagttttcaacagttcatcaaagggaagatttgcacattcagacgaagaatttgacattgaccttgaatgtaaagctgaaagtgatgacagtggcgaacttttctcatcgccagcaa

SEQ ID NO: 83686 - DNA, 853 bp, Heterodera glycines
  Genomic contig location: Contig_ID=SeqID_18956; Location=112..964; Strand=-
  SCN-specific regions: Sequence locations=1-511,533-853
atgagctggcagaccatggagggcaccgagcgacaaattcggggtgagcgagtggggcatttacggaatttgaaactctaaaacgaattcgagacgctacaaattctcaggcaccaatgatattcgttcgaatttaacgaaccaaagccgaacctgaaaaacaaaaatttcaaatcccccgttttcaagaatggcgaaaacccagaaatttttctgcgaaattcaccgcaaaatttcatcgtttttgaaattttgaattaattttcagatttgctgaccacgtgtaccattgtgcatgtgtccgagtttggcattgcggcggacgatgaccggcgccagtgctgtgacagtgcggagaccgagttggccaaggcctacgacgcgtacatgcaggtctgttgtattttacaggtttttttctgattttggcactactcggtttttaataatttggcgccctaaattgtgtcaagaaaagtgtgagaagtcaaaagttatgccaatttttttaaagaaatgtgcaaaaataattattagacgccctaaaatgtatattttggacaaaattctgccaaaatttcttaaaaaattgaaaaaaatccactccctaacagaccttctcctactatttgtacaccgccaatttgatcatgcgtctggaggcccgcgcggatggcattggcaacgcgctgctgaactcctcggcacctgcgccgtcgtcgtcttcctccgctgccgttgatgaccatcatgttcaactacataaccaccagccgcagaattcatcgccgtcacggctcaccgtctgcggcacgtccatttgctcacaatcaatggcaacaggtgcaataaa

SEQ ID NO: 83687 - DNA, 1324 bp, Heterodera glycines
  Genomic contig location: Contig_ID=SeqID_18957; Location=289..1612; Strand=-
  SCN-specific regions: Sequence locations=1-310,332-498,521-532,568 -725,747-1023,1049-1324
acgtgccaattgggccctccattccacgtgccaactgtggcaacagttggtcgacgatgccaaggaggaggcgcgccagcggagcatcggtgccgacgtgtgtgccaattatgtgtgcccggcaattgcgcagcggacaatggcactgcaaaaaattgccaaaaaggtggccaccggaggcggggagggcgagggatgaaaattttgaatactttaatcgatgaaaattagaaaacagtgttggcaaatatttcagtgtcgtgagattggcgtgttggcccaaagtgaggtggtccgtgtgctgcatgagctgcacaccgcgatgaaaacctaccaggtggacgagcaattttcaaaattgcacaaattaatttcaaagcggaccgcaattttgattagtttgcccaaaagtcgccaaaaatatatgttggcatttactcgagactaaatggcataatatttggtcccgctttttcatgtattttttttcaattcctccacaaaaagataaatattgtaaaatcccttaaaattttcatcaaaaatgggaaagaatttagaaaaccatcctctaaaaaattatttgccgtttttttgtagcattgtttttgccaattcaacgcactcggcggacagctgcagcaggcggaggcgcaacggaacaaagtggggccgaacagctcgacgcgcaagcaacgatcggcacaaaaaacatacgacaaagtgagggggcggggaggaaatgggaaaccacgaattttcgttttattttccgtgattatccattatttttataagttttagagttgttttctttgtggtcctgatttttcgggtggtttttttacaaaaaaaaaatttggcgctgaattttagaagcggcaaatgaaaccccgcaatttttatgccgttttgttttgtattctagcaaataaaaccagaaagatttagaatttaggtagaacaatgctgatttaaataaaaagcatgagaaaatagggagtttcggtgtttaaaaattccatttttatataattttttttaaatagaaaagcgagaaatacgcgtcggcacggctcaaatgcacgcgggcgcgcaacgaatatttgctgtgcatcgatgcggcaaatgcttcgttgcacaaattttttgcggacgacatttccgacttaatcgacgtacaatttttttttgggaatttttaaaaattttttctcattttcagtgcactgaccttggcatggactggtggctgagtttgctgttgcagaacatgatcacggcacgcaagtcggcgtgccaagtggagatgaacggtacgatg

SEQ ID NO: 83688 - DNA, 78 bp, Heterodera glycines
  misc_feature (30)..(30): n is a, c, g, or t
  misc_feature (49)..(49): n is a, c, g, or t
  Genomic contig location: Contig_ID=SeqID_18957; Location=1753..1830; Strand=+
  SCN-specific regions: Sequence locations=1-78
atggacgccgtcaaaatttttggcgaattntttcgcgaggacaaatttntctgtcaaagtatatggatatgtgccata

SEQ ID NO: 83689 - DNA, 1992 bp, Heterodera glycines
  Genomic contig location: Contig_ID=SeqID_18959; Location=285..2276; Strand=+
  SCN-specific regions: Sequence locations=1-387,410-717,760-952,976 -1369,1484-1634,1658-1670,1714-1806,1828-1992
atggcaaattggaagggggttctcatcgccgctttttccattcgcattttgctgctgcaaaattttatttgtgatgcagcaacagagaaatgggtggtgaatcacaatgaaaaagggtcggtgcgaggcagaggagagggaggactgaaaataacaatttttgttttttgcatttaaaaaagttcgttttatttagatgttcaaaaatggaaaaaattttttgcgcaatttgcacactttaaaagaacggaatctaacagacaacattttaataaataatacaaatttaagtcaaatggacaaattttgtgttaactgtagcaattaagccagaaatatggaccttttaaattgataaattaatgaaatgccaagaattgtccataaaaattgctaaaattatttttaagcaaatatttgagtccttttgagtagataaaaaatgggatgggataagtgtccaacgaaacgggaaaaatttgttgctgttaaatattgaaaattcgcatttttaaccaattcaataatgaatggctaatttattgttatttcgtcgtggtcatcgccttttttttgtcgaaaaaaataactggggagcagtaaaaggcgatggaaatgaatttttgtggtggttgcgaaggaagaagagacgaaagagggaggggagtgggggacggataactgcattatttttgcttttattaaaatatgttgaacataatttaatgaaaaattaaataaatttttaattattataatggaatttttatgaataactgtttttgtgtgattgtttttgttattaaatatagtgcaaatattattttcttacacgtaaaattaatgaagtctaacatgtaccaaatatagcaaaatgttaaaaagcttttaaatcagttataacgaatgcgttttattagtcttttaaaaggcaatttttaaatgcttacgcaaaattaaaattaaaatttgaaaggtctggtgaattaatctgtgttttgcaaaagattttttttggtactctttgcagtcggagttgaaaggaattggccttgtgttttactgatttcaattcattgagaaaaattttgcatgcaagttttgaagagtttgaataaacaatatgaaaaagttatatggcagaggattattagcataaaaataggtgttaataattaaaaaattgctattttcatcgttaatacaaaaaaaagctgctgggcaaaaatagaaaagaggagtggctcttaagatgtaaaataaatgacattgtatcagagatttgtaaaatttattaaaaatatgagaatattgtatagaccaaaagtgccgattaattcgtatattaatcaaaaaaacttgctttcagaaaatattttaaaagttttaaacaaaaatatttaataaaaagaatatatttttaaatgcaaaaaagtaataataattaatttttatacacaaatataaagttttttttaaatttcttttcaaaatttgttgccaaagaaatttattcaaattcttatatggagtggaataataaaatgtcagctttcactcacggcaacatttgtcattttgctcatcgtatttgccattcgacattgccgcacgcagtcttcctttttgcaaaaattttgaatgtatttgtgatcaaaccaattttttgcaaaataattgaaaattttaattatagattataaaattaaaaatggttttgagtgatttgtcgaatgccgtcaacaatgggggaacactgagtttgcaagaactgcggcggcgccgtaggacggccattgtggttctggcgcccgacttggcggcccgacagcgacagttatggcgagaacgccaccgcagctcgaatgcaatcgaacagcaagatgttattgaattggattagaagatgacggcggaaaaagggcaatttggatgcttttttgttaattttttgttcgaatttctggtaattaatttgcttgaatctttata

SEQ ID NO: 83690 - DNA, 1530 bp, Heterodera glycines
  Genomic contig location: Contig_ID=SeqID_3204; Location=1449..2978; Strand=+
  SCN-specific regions: Sequence locations=1-1,25-156,184-715,737 -1143,1175-1530
atgttttattttatttttacaaggctaattgtgaattgatcgtagaatccttaaatgcctaattggtttcatttttccaagacctaaatttccgacctaaaaatcgaaactataaatattacgaaactaggatttttggcagcatattcacaaaacttaaaaaatataaaaatatttattttagtacaccaacattaattcggaattgattatttagttaaaattcgtttttttttgcctttcaggcgcgcgagtccgaatactcatacaaggttctcaagccgctggataagtttccggtacttatgcgtcgcttttcgagcgaaggccttccgtttactaccattgacccatacaccgcaaatttgtactttaaattggacgaaacttccgagggcccgggatcgccaaatcgtttgctgaaatttcaagtgttggtgctcttggctaagagcagtatccccgataaggcgcgtcacgtaattataattttattcaattcactcctgaaattcgaaaaattggttcttataaaataatatatataagatttcatttaatcaaaatcctaaaaaagattcattttgttaaaaacccactaacaatttttactaaaaaatttaaaatttaccaaaagacaaaattttttcaaaatttcgagttcaaaattcttcaaaatttctttatcaatttatcactatttatttttaatcacgttgttttccctttttagaaagtgcttctctgtcagcggcttaactccaaaggtgccaagtcggtgatgcttgaggactacggcgtcgatcatttcagagccgtttctgatccagcaaatgtgggtggggtttggccaaagcattgcttggttttcatccttttcagagatttaatttttaggttcgacgattccttttctttttgatttaaaattctttttcatatgttcttttttcaggaacatcccaatccttttctttttttttcttaattacttcaattttggatttaatttcgtcaaattggctttactgtttgtatacaatttttctgttgattttagacgaattttttttatcacacaaattcttttttgactacattttgattcaaccctcggtttaactcctgagatggggttttgtctttattttaattattaatattattaatttttgtccttttaggaatatgtgatgatcgaagttggttttgtccgcaattttgccgatccaccgttctatgaactcggagctgtgtgtgcgactatgaagaatctattgggctttttgacttcttacgtggatagcaaatttccctgccctttgaaatagggcaatgaacagacaaaatggcaaaaaaatgtcaattttttatttaattcgacaatttcatttttcaaaatttaaattaccattccagtggttttcaaatttttcattatgagtatcattgcttttgtggagagaaatcatttgttgttttgaataattgaattttgagagacataaataattcgtcgtattttagaaa

SEQ ID NO: 83691 - DNA, 1534 bp, Heterodera glycines
  Genomic contig location: Contig_ID=SeqID_3205; Location=157..1690; Strand=+
  SCN-specific regions: Sequence locations=1-1,25-156,184-720,742 -1147,1179-1534
atgttttattttatttttacaaggctaattgtgaattgatcgtagaatccttaaatgcctaattggtttcatttttccaagacctaaatttccgacctaaaaattgaaactataaatattacgaaacttggatttttggcagcatattcacaaaacttaaaaaatataaaaatatttattttagtacaccttcaccattaattcggaattgattatttagttaaaattcgtttttttttgcctttcaggcgcgcgagtccgaatactcatacaaggttctcaagccgctggataagtttccggtacttatgcgtcgcttttcgagcgaaggccttccgtttactaccattgacccatacattgccaattcttacttcaaattggacgaaacttccgagggcccgggatcgccaaatcgtttgctgaaatttcaagtgttggtgctcttggataagagcagtatccccgataaggcgcgtcacgtaattataattttattcaattcactcctgaaattcgaaaaattggttcttataaaataatatatataagatttcatttaatcaaaatcctaaaaaagattcattttgttaaaaacccactaacaatttttactaaaaaatttaaaatttaccaaaagactcaaaattttttcaaaatttcgagttcaaaattcttcaaaatttctttatcaatttatcactatttatttttaatcacgttgttttccctttttagaaagtgcttctctgtcagcggcttaactccaaaggtgccaagtcggtgatgcttgaggactacggcgtcgatcatttcagagccgtttctgatccagcaaatgtgggtggggtttggccaaagcattgcttggttttcatccttttcagagatttaatttttaggttcgacgattccttttctttttgatttaaaattctttttcatatgttcttttttcaggaacatcccaatccttttcttttttttcttaattacttcaattttggatttaatttcgtcaaattggctttactgtttgtatacaatttttctgttgattttagacgaattttttttatcacacaaattcttttttgactacattttgattcaaccctcggtttaactcctgagatggggttttgtctttattttaattattaatattattaatttttgtccttttaggaatatgtgatgatcgaagttggttttgtccgcaattttgccgatccaccgttctatgaactcggagctgtgtgtgcgactatgaagaatctattgggctttttgacttcttatgtggatagcaaatttccctgccctttgaaatagggcaatgaacagacaaaatggcaaaaaaatgtcaattttttatttaattcgacaatttcatttttcaaaatttaaattaccattccagtggttttcaaatttttcattatgagtatcattgcttttgttgagagaaatcatttgttgttttgaataattgaattttgagagacataaataattcgtcgtattttagaaa

SEQ ID NO: 83692 - DNA, 1515 bp, Heterodera glycines
  Genomic contig location: Contig_ID=SeqID_18960; Location=53..1567; Strand=-
  SCN-specific regions: Sequence locations=1-27,50-273,295-575,598 -827,849-1066,1088-1427,1450-1473,1496-1515
atggtacgtaataaacaaaaatttctttctgacattccttgctcttcttctgctctccaatgtaatgacgggttaaaagctcccgaaaaaagcggaaaagtggtgatagaaccggttcaaagctccggtaatcaaaagcggaatgaaacatttttcaagagaactaaaaaaaatgacagtgatatgttaataaatcttgatgagatagatgattttattgatatttcttataacaccaatattctgagtaaatcttatatggcggaaagaaaattaaaacaaaggaaaatgatgagtattacagaaaacagaattgaagaagaacgagaagcaaatagaaaaagaattagtcaaaaaagagctcaacttactgaagaagaagttgagagcgaaagaaaagcaaatagaattagttatacattaaaaaaaatacatatgattaatgaagagttagaatatgcaagagaatcacatagtcaaaacgttgaaatatcaagaaagcggagtaaaatggattatgatcaattatacggtattgctgcaaagcccaaaaaagcaattttttatgagttaggaccatttaaaatattttgttcaaagtgtagttctttacattttccggaagaatcattaagacaaaatcaaaatgatgaaaatagctttgctaattgttgtaagggcggcaaacttttaaatttagatgaaaaaattgagcaatatcctgaagaattgaaaattcttttcgatactgaacatccttattataaaaattttataacaaacattcgtcgctacaatagtgcttttgcatgtgcttcaataagttgttttaaatttaaatttcctacgcctgggcctccatgttataaaatacaaggccaaatttatcatagatttaattcaaatgcaatccctctcagtgaacacgaaatcccaacaaacgggcagctgtattttattgattctgatgaagcaaccgacattcggtgtggcatgaatgagggatgcaatgtaaatatcatgaagtatattgatgcatttattagaaaaaataacaaatttgcgcaatcatataaattaatgaaaactgtttatgagcaggaaaaagaaaaatgtcaaaatgaaggaaataaaatacctcagataaaattgctttttagtcttaaggaaaattgtgatcaaaggagatacaatttaccgcatattaatgaagtatgtgcaataatggtttgtgatgcgaatgacgatatcccaccagctaaaatagttgtttacccaaagggtgaaaaaaaattaaaggaaatatatcctttggataaatgcgttgaaccaatgtgttatccattactttacccagtttcaaatgaaggatttaattatgaagtaaaggacttaaatggaaaaaaaatttcactttgcgattatacaaaatttttattatttattaaagaaaatggaaaatttatgcctcactttcatgcaaaaaagctttttcaacagtgggtagtagactaa

SEQ ID NO: 83693 - DNA, 897 bp, Heterodera glycines
  Genomic contig location: Contig_ID=SeqID_18961; Location=364..1260; Strand=+
  SCN-specific regions: Sequence locations=1-240,262-510,571-897
atggagtgccaattccgcgcacagtatccaccgtggttggttacggtaatggaggaggagacgccacacagtgaaagggacgacgaaatagcgaaattcgagcaaatgggcggggacgaggcaggcagaagtggacacggcgaaggcaacctttgaaggtgctgagtcgttatataaaaaccatcaaatggaaattttcaaccaaaatctgtccataacttttgtcaaagtcaaccaaattaaaccttcttgatatcattcgatagccctaacatttctctattagctcacctaaatttcaaaaaatttggtcaagtttaagcaaagttatggccaaaagagtctaaggcaccgggttttcaaacttttttggccataacctttttgaaactgagcgaaattttttgaaattttgcaggttaatagaggacaaatagggctatcgaatgatagtaagatcactttattttgttcgttctaagaatgttttgatcagaatttttgataatcaaaataattttatttttaattaaaaaatttatgttagaaattatttttgtttttaattttcttgctattagtcgatagctctatgtgtcctctattagcctgcaaaatttcaaaaaacagttttttgttgaaatttttcatttgatggttttttatataacgcccattttgatgggttttattagagattgacattttgaaaaaaacctggacctggattccatgttggacctggaccttgatttcctggacaaaaatccaggaaaattcaggtccaggaaaaatccaggttgccgaaaagagggcgcagaaaattgatccaaaaaatcgaaaaaagaaaaaattagaaatttaatttattttgtagcgcctgccgaaaattctaaa

SEQ ID NO: 83694 - DNA, 374 bp, Heterodera glycines
  Genomic contig location: Contig_ID=SeqID_18962; Location=353..726; Strand=+
  SCN-specific regions: Sequence locations=33-81,104-122,148-241,263 -280,306-317,339-352
atggccgagtggtctaaggcgctagactcaagcgatgattggcttgcccgctatgctgggtcttctagtgggcgtatgcccgcgtgggttcgaatcccacttcctgcagtaactttttttccaattttaaataaaaatttttttttaggaatttaagagaattattaattattggatacattaattaattgcaatttttccttgcctaattcctcgctttttgccccgaaaatattctcggaacaaacaaaaaatgtaattggcaaaatgtggaaatgccgaagcagcagtaaatgcacaaaagtacaacacttgtggcacatggagcacaggctgaggggaacagttcaacaacaattaaagcattttgccaa

SEQ ID NO: 83695 - DNA, 652 bp, Heterodera glycines
  Genomic contig location: Contig_ID=SeqID_18962; Location=930..1581; Strand=-
  SCN-specific regions: Sequence locations=1-113,135-383,417-652
atggaaaattatgatcagaaaacgtctcaatttggtgatcagcaacattttgatgctgatgcttatgtgtccgcgttggctgtgctcagtttgcccgttctcctggacacttctttattattgtgtgtgttcaaaatgcgtttaatttgatgaattttctgttgggttccaaaaatctcgacactttggtccgtgcaaaatcccgactttctggcaatttcgaacccattgtcttaatttgggcattttcgctccttgttcccaatttgtcgcccattaaagttacaccgatttgttgtctctgactttgttggcattggcactgtccctctccgaccgtccgttcccaatgttttcagtgtttgcattggcactttttgtgcggcaggtggatgaatgaatatttaatttaaattcagttttgattattacctattcttcagacaaacattgtttggctgtttttctccgcttttcccattgtttggcattctttacgctctttcctccaagggcaaatgtcgctttatcaaactgccattttcttggtaaacatacatatccacggatagagagcccggaacccacaaaaaaacatcggaatcccggtctaaaaaaaagtttcctgaatcgaaatcccgatcccaataaa

SEQ ID NO: 83696 - DNA, 1280 bp, Heterodera glycines
  Genomic contig location: Contig_ID=SeqID_18963; Location=45..1324; Strand=+
  SCN-specific regions: Sequence locations=1-114,136-176,198-391,423 -925,947-991,1013-1280
atgaacaacccgccatgcaaggcaattgtactgcttgacccggaaatgatcatgtgctgtcgcatgtgagtcgcgaacggttgacgaagcgatttaaacaaaaaaaaatttttacttaatttacaatagatttatttgaattcgaggttttgagcaggcgtgaaaaattgggagccaataattttagcataatggcagacaaattttcaaaaaatgccatccattgaatgtcttggaaaaagttggatgtgatacccgatcccaatttgtcatccattgacactgattttttttagtaaacttgatcagctacgtgccgtttttgttgctgcaagtcgcaattctgttcgtattttgttacatcagatgatcactgacaaattaatgtgcgttaaattaaattttatttacaattaatttatgactgccaaatttttccatttttatttcaattttcgataatttttggcgaagaatgtcagtaaatttgctgattccttaattattttacaaattgtttgtgttatgttgtcaactttattcttcagtgaagtgggcgtcaaggccaagccgtacatgacactgttggacgaatttgttgccgccggggcggtggagcgcatggagccgcaccagtgtgacaagagtgggctggtgttgcgcgaattgttggcctgctcaattgaaatggcggcacgcgagcggcggaaccatggcaacccgaaactgcgcgttctgttcttgtcaggtccttttttcttcctttatgatgcaattttgctggaaaagtcacgcctctcaccccgaaaatatcaacaaaaaacatagttttaatgggtgggataagttcgtgtttggattagacgtattgaagaccttttttggtaccagtttctttatttatcctattaaacaaatttatcggtctggtgctgcctattgacgctggtgccgaaaattttggacagagcgtttggatggggtgggtaccaatatgaaaaacccctaaatttaccattttttacattaacaattttggtgagaggggcacagacgctcataatggggggggggggggtgaaaaggtgaacccccgattttgttttaattaaaaaaaattccagcaatgattggccccaagtcggacgatgctaccaaattgggcaacagtcaaattgaattggtaaatgctggccaatttgtggagcaattcaaatgaagtgcccgggaaagaattttgaataggaaatagctcggcattacaccaaaaatattttcca

SEQ ID NO: 83697 - DNA, 424 bp, Heterodera glycines
  Genomic contig location: Contig_ID=SeqID_18964; Location=701..1124; Strand=-
  SCN-specific regions: Sequence locations=1-15,37-89,111-134,198-424
atgtccggattccggactttcattttcggcatccggtcaaatccttggcccatacaggtatgtcgtcgttagtctgcactttctcttcattttcattctttattatttgtttctgcattttctatacatatgtgtctccctccaatgggcccctccatttgaagaccccatagaagaggttttaaaaataaaggacccgggccttcaattagaggaaatacggtaactctactacctaactgtttgtttctcgcttttgtaggcatttttgaacgcccattcgcctgtcagttacaccaaaaacggctggacgttgttattggctgttgaagaggggcccatttggtgggacaaaagcaattggacggaaagtgaacgcgcagtaagaggattatcacgcaattatttgaatgaaacaaactga

SEQ ID NO: 83698 - DNA, 683 bp, Heterodera glycines
  Genomic contig location: Contig_ID=SeqID_18964; Location=1477..2159; Strand=-
  SCN-specific regions: Sequence locations=1-212,234-575,597-683
atgccgaaaatcctcttcacaatcatcgctttcgtcaacatctcacaaattttattcgctactgctatgtataatggcgaagatatttgcggtaaaaccaaggaagattgtcaagcggcactgattgcttttatgaacggacgcggaaataaccagaactatcacccgagcggtaacacttaatatttacggaaataatgggcttaataagcattggattgatttctttatttgtgcgattggttgttttttagggcctttttctttggcttaggctccacacaaaacatcatatgagaacaaatgcatatgacaataataatacctaatatatgttttcagaaaacggtccaagaaaggttgataatgagtggtgtatttgggtgcaaagctatgtaacaagtggggccccaagatcaaaatggtgaagccatgaaaattgaaggcggacgaaagaatgatgaatgctaattgaccccatttgcttgttgttgttgttgtttcttttccgtcgggtcaattgtttgtccgcacttttttgggattagatatgtagattaaactttttgctatccattttcataaatattttttcagaaactgctctaaaacgcgccaaattttatttacaagataaataaggctctctgatgcttcttctatcaaaaagggagatgaataaa

SEQ ID NO: 83699 - DNA, 1072 bp, Heterodera glycines
  Genomic contig location: Contig_ID=SeqID_18965; Location=39..1110; Strand=-
  SCN-specific regions: Sequence locations=1-37,60-141,165-227,250 -963,985-1072
atggatgccatggaaatttcgagtcagtcggccgtttcttcgggggaactttccttctcaaatggtctgctgcctccaccgccggcaccacctccaattttggatggcactgattgtgaggcttcttctttcattgttccaccgcctccccctcctcctccgttgcacggtgaattaattatgaaaaaagcaaaacaagttagtaaattccagaagagaatgcatcatttcttctccagtcctcatctctcaatcaaaatcacttcaagtcgtctcctccgtcgcaaattatggccaaagtttcgccaccgaatatccaatcttctccccatccaaatccaattcgttcttctgaaaacctcaacacttatgcattcatcactgatcaagaacactttcctgcagttgttcgacaattcaaaagacactcaagacgttcaaaaataaaccgaggaaaacaatttccattgcgatttccgaagcctacgaaggcatcgtcaaggaagggaaatgtcggagaacgtattggtcctcatcagaaaatggttgcaacaacgtcaacaatggacaccacaagacccgtccccctactttctcttaatttgaccgaaccaactccagagacagctttaagaaagaccgacgaaatgccaaacaacacagtgggcacatccgtgccaaggcaacaacaaacgaactgtgtgaagaaagtgaatgacaacgacagccagcaaccgaaaccatcgcgagaagtcccaattatggtcgatttagaattcatcagaaatacgccgccaccgcccataccggacataatcaagaggaggacaacgagtgataacagggtgaggagaccactcgcttaatacatatttgaaattgtaagcctaatctctaatgattattgtttttgtcttaggtcgctgcgatgagaatgatcccaccacaaattcttatcacgtcgcaaccaccaaaaatccccccacagccattgcttcgtatggaccttccaacaccgccaattttccttaaaggccgtcctccgcccactttcagacaacctaatttttaa

SEQ ID NO: 83700 - DNA, 1101 bp, Heterodera glycines
  Genomic contig location: Contig_ID=SeqID_18966; Location=75..1175; Strand=-
  SCN-specific regions: Sequence locations=1-20,42-106,128-354,395 -835,858-1101
atgataagtcggaaaagcttcacacaaaagcaaattcaagtgacaacccaaaaaacaaaaaaggagacggcagaaacgcaacaacagaacggaaatgaaacagcgagaaaaaagacggacacggaggggcaaaatgacgggaaacgtcaaaaggtttttgtctttttataacctcaaataataacaataaatcaatttcctcagaaaccaacttctcttctaaaacgtaaaacgaatacaaccgatgaactggaacaaacgaatgaacggaagcaaaaactaatgcccaaaggacaaattgaaaaaatggtccaaaaccagtcaaagacagaagaaaagtaacaatttctaccgattttttatttaagtaatttttttattttagaaaatttaacaataagccagcgacaatcgaacaacaaacgattaacggcgtcaatcccttagatacgattttggacgaaatcgaagcttttgatacggcaaacaagaaaaagaaaggtaaattataatgccatggttttaggctttctctactgttttatttctttcctattaagttgagagtgaagaagatgaggccgacaatgcgccgtgttcgagccgacaactgccgccaactccgatgcccggttcctaccgctctttgaacagaatggagctagcgcgacaggaccaagatcacggcatggtccacaccttcttggaaaggaacgatttgatgcagcgaatattggcatataaaatgctcaaaggacgagtggagtcgtattctacaattaggatcaaaattgacctggacaactgtacgattcccgattatgaagtacagaaatttggagtgattttatttttccatttgattttaagctaagcccaactgaatttgacatggattttccggcaatgccttctgctgcgacgattgatgatgttgctgttggcacgaaacctgaagtaaatagttcggaaacgcccgaacaatcagccctaaagcgaggtccaatgactccgcccggctcaccaggaacaaacctatcatcggcgcctgaagcggaagcgaaaccgacaggaagcattctgcccaatcgaaatattgtg

SEQ ID NO: 83701 - DNA, 405 bp, Heterodera glycines
  Genomic contig location: Contig_ID=SeqID_18967; Location=478..882; Strand=+
  SCN-specific regions: Sequence locations=1-281,385-405
atgtccggttacgtcgtctctttcgcttattccgtcgagaattacggccctcgagaattgtgcgaaattttgattgaagacgttgaggggatgaagcacgatttgcgagcaatggtcaattgcagcaaaggtggcggggaacgaattgtggacggaatcgatgccaaattggacagaaaaacagcaatagccgaaggtgaaaagatggcatttatcaccggcatcgatttggccatttgataaccaatattatggcttactttttttctcaattaatcacgatttaatatttttcgaatataaaataattttttaataacagattaagaattaatttaaaaaatattaaatataaatgatttttaaaatttttaaagaaaaaatcaaacaactaagaaattgata

SEQ ID NO: 83702 - DNA, 83 bp, Heterodera glycines
  Genomic contig location: Contig_ID=SeqID_18968; Location=970..1052; Strand=+
  SCN-specific regions: Sequence locations=1-83
atgaacaatgtccgcaccaaaagtttagtggaacacgctgaagcaaaaggaatcgacacaaacacaatcattctggccataaa

SEQ ID NO: 83703 - DNA, 1016 bp, Heterodera glycines
  Genomic contig location: Contig_ID=SeqID_18970; Location=191..1206; Strand=+
  SCN-specific regions: Sequence locations=1-110,132-710,732-758,790 -939,969-1016
atggccgcttccgacgtgttcgaggcaatgttccgttttgactccgcaaatgccacgacttccacttcaaaacgtaataaaactgttggcctaaaaacattccctcaagattttggggaaaagtaaaaatctgagattttttggtattttacagttaattaaatgaaagtttcaattttcagcccctttggatttggccagcagcagcaaccctgtggtggtcagcgacgtcgacgccgatgtgttcagggcgatgttgggctttatttatgcggacgatttgagtgggatgaacggcgacaatttgttcgacgtgctttacgctggtaaaactttaaaattcattattttcttcgtttattttaatcacttttagccaaaaagtacaacatcgccggactggtcaaagcatgcgccgaatttcccatttctgagttgggcaatgtcttccacactttggacgaggcgcgacttttcggagagaaagtaacattttcaaggaatacgaattaaatgggaccgaactgctcgagagtgaatctcggcttcaaatcccggcacaatcctctacatatggaaaaactcgtttttaaaggcattcgccgaacactgcttggaatacattgaccaaaatgcggacactttgctcaaatcggaggaatttctgcgcattgatcagcaaatgttgtgcgacattttgaagagtgatcagctggtgatcagcagagaatttacgctttggaaagctgtaaaattggatttttaaaattgtttaattaattaaaatttgttttttcggcactccgttgggccgattggcaatgtgagcaaaaaggcatcgaatgttcgggagagaatcggcgggaaatgctcggcttggcactgttcgaaattcgcttcccacacatcacaaaggaggacttttcgaagagcattggtaatgccaattttatttattaaattttgtctaatttgggtaaaattaaaaaccaattaattctggcgtcacgcggaaa

SEQ ID NO: 83704 - DNA, 197 bp, Heterodera glycines
  Genomic contig location: Contig_ID=SeqID_18972; Location=379..575; Strand=+
  SCN-specific regions: Sequence locations=1-59,82-197
atggacggcgatgggttcggttcatttcaaaagagagcgttggattcactcgaaggcgacgatttcatggggctgaagaaaaagaaggctttgactacagcggacggggacggcttcactgatttgggcaaaagagcattggatgttcttgacggagatgattttgttggcttcaaaaaacgcagcgaaatgcaaaa

SEQ ID NO: 83705 - DNA, 1765 bp, Heterodera glycines
  Genomic contig location: Contig_ID=SeqID_18973; Location=208..1972; Strand=+
  SCN-specific regions: Sequence locations=1-4,28-207,229-330,352 -374,403-427,520-564,586-661,684-903,925-945,1003-1016,1038-1101,1131- 1161,1214-1598,1620-1765
atgttttatttattttggtgtgagcacgccacgttcgatcaggtcgggaatctcgacagccatccatgggccaaggccaagtgagaaggcatgggcaatgccaaacttcggcacatttctggaagcatatggaacagggctggccgtgatcacggaaatcacggggtttttggggtgccgtgatctcggatcacgggtcacggattttttcaaattttccgtgattttgatccgtgattggcattttatatagggaatttttattgagacgaaaatagtaaagtggtgtgaagaaatttttgagaaaaatagataaattctttcctgcttacaaattagaaagtaaacatatatatgtagtctgttggttaagccttctgtctttcgttgtctgtcccttgcgttcaattccccattgggataggacaatttatatattttgttttgataattttaattgaaatttaattaacaagaaatttcataacattgaaaattatttttctttattttttaaaacgtccatagaccaataaattaaccaatgattggacatattttggacaaaatctgttaacaaattcactcaaaatttttcccggcggcgcctgtcggcaccaccggcagacggacccccattttaccgtatttttgaaattttgaccccaaaatggcagaaaaattaccatttttggcatataaactgctaaaaaccctattttttctctccgtcgcttaaatttaaaacgacaggcctaatcaaaattttcagaaaattttccaaccctctaagaattttttctaaaattttcccgacgttcagtatcttttggggtgttcagatcgtcatgaagaactgagcatgttggtccaaaagattttttcagcatcaaaagttagcttacaaattagaggaaatttttctctacataaatagatttttggttaaatttaagaaaaatttgaaaaatcttaataaattagttaaaaataaaaaattttccttggagatttctacaaaaagctctaattttcctcaaaaaattgccaaaaatcgtaaacttagtcattttttggaaaaggtctccgcaaaaaaagcggtttatatgttttggtttctttaaaacattttttgggaatttttcccgcgattaaattccgttttttaaataaatttaaataaaaaatcattagaaaattttttttttataatcacggatcacggctcacggatcacggaaatcacggggattttggggtgccgtgatcacggttcacgggtcacggatttttttaaaagccccgtgatcacggctcacggatttccgtgattggaaattcaatcacggccagccctgaaactgatgaattttttttgtttttaacacaactttgcggctttcttaggagcttgcaaaagacatatgttttttgctgtcacttggaaccggaagaatgccaccaagaaatgtcgaaaacattgacatagttttgagccaactttttcatcgcttgtgcggtctatcgatgccatgaaaaacctcaaaacgattatggttaatcaggtgcatcttttgagctccagttcgcattttgaacattttgcaattttttcaggtcaccaactctgatggagctcagttgagcttgcccgaacgaaatggtttttttgtcattttatttttttgtatttttgtgattttacaaaacattattaccgagcccggatttatatgcaaatgcatattttttgctatgctctgaa

SEQ ID NO: 83706 - DNA, 147 bp, Heterodera glycines
  Genomic contig location: Contig_ID=SeqID_18973; Location=181..327; Strand=-
  SCN-specific regions: Sequence locations=1-93,117-147
agaaatgtgccgaagtttggcattgcccatgccttctcacttggccttggcccatggatggctgtcgagattcccgacctgatcgaacgtggcgtgctcacaccaaaataaataaaacattgttgctgcaaaagaagagggcaccgg

SEQ ID NO: 83707 - DNA, 463 bp, Heterodera glycines
  Genomic contig location: Contig_ID=SeqID_18974; Location=146..608; Strand=+
  SCN-specific regions: Sequence locations=1-318,346-463
cgtgttatcgcagaggttgacctcactataagcacgggcggcataactttgagcggcccccgtctgtctgttccccgtttcattccttttgaggaaaacgggcgttgccgcgcatgtaaaggaactgaggctgaggtggacacaatggtcaccaaggagggaatcaccttatggtgcacacgaatagaaaaggctcagtttgtcccttttgatgttgtctacgagcttcccggtcattgtttctttcgcgtgaagaataaggcacgtgtgttcagcgttccatatagcgaactgtcgtcctcagacaagtgcgtccagccgctaccaccaccaccaccaccaccaaaacctcaacggacaccggacgacgaggaggagaagaatttgagacgtaaggcaaaggtggcgcttgacttagtggaagccggacttatggcagacgcaatgatgcaggatgggacgc

SEQ ID NO: 83708 - DNA, 336 bp, Heterodera glycines
  Genomic contig location: Contig_ID=SeqID_18975; Location=1872..2207; Strand=+
  SCN-specific regions: Sequence locations=1-17,39-57,81-336
atgaacaaacaaaaaaacgcaggaggatgggtgaagaatgatggtaaattcattgcctattttcctttttcttgaaaatcggtccactttccaaagctttttcaatttttaatggaaaaaacgtctaatttctagagcccggaaatttcaaatttgcggatcccgctgcgggattggtactgaaaattctttgcgggacgggatcccgcgggattaatcccgcaaatcccgcatttaaaatttgcgggatcccgcgcgggattgcgggattttggaaaattcgaaaaaatttcaattaaattcaaaaaatttccaaaaatcaaaaaatgctgaaaa

SEQ ID NO: 83709 - DNA, 460 bp, Heterodera glycines
  Genomic contig location: Contig_ID=SeqID_3206; Location=1890..2349; Strand=+
  SCN-specific regions: Sequence locations=1-239,262-460
atgccaattacgctcaaaaagcggaagaatggcgaagaaaactccttttttgtgagcagtacaaaaatgatgcgcaaatacagcggaattgagacgatttcataaatggaatagccgacaaaggaaagagttgaaatcatttttgggaaaagtcagcttaatacattaattcgtgaaccaattaaatgtggctaatttcttattcaaaagaccttaaaatttatcgataaaatagtgacattatgccataaaatttcaaaattataagtatatttaagaaatcagaataatttctaccccaaaatcagaacattcttataaataagaacaaatggaagccctggtttaaaggccagcttggactctctattattggcgctaacgaaatcagatgattaaagtgaaaaaaggaagatttacgagcatttaaaaagaaaaaatggtttttttttgggttaaa

SEQ ID NO: 83710 - DNA, 912 bp, Heterodera glycines
  Genomic contig location: Contig_ID=SeqID_3206; Location=160..1071; Strand=-
  SCN-specific regions: Sequence locations=1-454,478-668,772-912
  Gene Ontology: Mol. function=transposase activity; Biological process= DNA transposition
ataagaagaattggaacctttgcacataagctattacaccagcaatttaaaaaaggcgaaaaagcggcgcctgcggcgcgaaaagtgaatgaatttctcggcgcggatgtgatctctcctcgtcaagcgcaaaaatggttccaacaattccgggcggggagaaacagcaccaaacgcaacgacacccggaaagttcctgcgcagaattgtcggtgggacattgccataaaacaacaacatggcgctggcttcggaaatctggtcgtcggccgatgaggagcaaatgggtggcacaccgtccgactgatcagcagaaacagcggcggctaaacctgtgtctttcgaacatcgcaaggcaccggagaggttatgtgctgaaccggctggtgacatgcgacgaaagctacatctgttacgatggcacagcacagaaaattgtttggagaaagaaggaggaagacccaattttggtcccccgactcaacctgcaccaaaaaaagcgcatgttgtgtatcttttggtcagtacatggcccactgtactgggaactgctggcacctggcactattttggacagtaatagatacataaaccaactgcgggcggtggatatcgcttaccgcatccggcgccagcagggccaatacccagtacatttcccagacattgaattggaatttgttgccccacccgccttatagccctgacctagccccctcggattaccacctttttctttctctcaaaaactttttacggggtaggcgcttcactgaagacgccgaggtcgaggaggcggtggggcagtacctgacctcaaagatcggcacagattttttccgtcgcggcattaggaaacttccttctcgttggagaaaggttgttagggtccagggaaactattttgttgag

SEQ ID NO: 83711 - DNA, 554 bp, Heterodera glycines
  Genomic contig location: Contig_ID=SeqID_3207; Location=298..851; Strand=+
  SCN-specific regions: Sequence locations=1-111,221-314,338-349,464 -473,504-554
  Gene Ontology: Mol. function=chaperone activity; Cellular component =nucleolus; Biological process=nucleocytoplasmic transport
gcgaaaaacttaccaaaaccaaagacgatgacaattcatggtcatcctcgtcattgtattcttcgtcctcatcaccttcagcctctaaatcaagcagttcagaggcaatggaagagacgaaaaaagaaaaatcgaaaacaaaaaggaaaaagaaaaatgggagaaaaaggaaacataaacagaagaccaaaaaagaaagtgcagtggagaaaaaggaaaaacggggaaataatgatgatgatgatgatggttctgctgccagcagtggttcgtcaagttcaagcagtagttcatctgctgactcggacgaattggatgacaaaaagaaaaacaaacaattggccaaggtgaaagaggagcagaaacaggggtcaaaaggaaaaaacaaagcaaaaaggaagcaaaagaaaggagagaaaaaagggaaaaaggattacgaagataaaggtgaagaggaagaaagccattcatcaagcagtagcagtagcagcagcagtgaagagccaaaaagagaggaaaagaaaaagcgccgaaagagaaagaggagtcattga

SEQ ID NO: 83712 - DNA, 772 bp, Heterodera glycines
  Genomic contig location: Contig_ID=SeqID_3208; Location=169..940; Strand=+
  SCN-specific regions: Sequence locations=1-437,459-480,531-772
atgtcagaattcaaaaagtgcgattgcgaaaatagtaaatttgaggttattggcgcttatcaacatgatctgtctgcaacacttaatcagtttatatttaaatcataattagcagaatgtgaaattctctcatttgttaccaaaagaggatttttttctcttccacaaaaaattagttccttctcatataaaaatggagctgcacctttgcacattaaaattcaaagtccaacagctggagaaaaagtaaaacataaaattagaatttcaataattaggggtaattaaaattgcctaaggtattcgttggctatttcactgcggccgacggagcaattcgttgtgtcgccgtcaaattagtcaacagaacagaagcggcttcatctctttttaagaattcgatcagattgatggataaaatctacgaaaaatttgagaaagagcagaggaaacatttagtcgaaataattgacacgtaagaaaatttaattaattaaaataataatttctttcttaaaattttattttttcagtggctatacaacaccctatatggagggcattgtgataatggaattgggcgacgagtcactccgccaacgattgaaaagcggcagacacccggcactcggcgcaaatgaccgtgacttaatgagtgccgtagaaaaattggctcagccacttgtcgagtttcatgaaagtccggcattaatttgaacatttggttgcccaggactttcccaggggaaatcccggtcctagtttttcaaaa

SEQ ID NO: 83713 - DNA, 1581 bp, Heterodera glycines
  Genomic contig location: Contig_ID=SeqID_3208; Location=1111..2691; Strand=+
  SCN-specific regions: Sequence locations=1-395,418-443,469-829,852 -887,909-1204,1226-1522,1574-1581
atggatgtgaacccgcgaaactatttgtacgtgtcggagaatggaaatttgttactgaaattgatcgattttgagggctctcaattgctccggaataaattggataaaaatgaatgtgttccaatcggtgagcatgctttcaccccagagtacacggggccagaatattacggcgagcatggcagagaggtgggcgcaaggatggggaacgtggtagaaaagtcgggaaaaggttgtgccaatccgagagagggcaaatgccatggccgagtgggaagggccaagggcaaaacatgcaaaaacaaagattatcgttacgactaacggcagctcagcaatactcctctttaatgctgttttaactgtcagatttcgactaaatttgacatttggtcagtgggaataattgtcttcgaaattctgcttggtcatttacgtgccgaacaagggaaggggccgatggaagaggtgaaaatggaaatgatcaagttcacaatttttaagtgaaaatggaaatgatcaagttcacaatttttaagtgaaaatggaaatgatcaagttcacaatttttaaacatatgtaggatgaacaaaaatcaatgctttttgcaattggcaatttattcctcggatttacgcgaaacaatctattcagaagtccgggggaattcaaaaatatgccaattgactattcgaaaagggaatggtttgaacagaacaccaatgcaatggagacggtgctgcaactttggcagaaatttccaaagacggcactgctggttacggtaatggcaagggaaatattgtagtggtgcttttgtgccgaggacaaaacaatgatggcattttcatgaattaaaggcagagcgattatttatagtgaaaacgaaccaatatgtattatatgaaattaattttagaatatgttaaatgtcgacagaaagacgcgtttaacagccaaagggattttaaattatattaaaggatcatgccaaattggagagttcagagaagtcaaaagttccaaagatttgcgaatttttaattcagtgaagttcggcgaatttttaaataaactgcgaattatcaaactaaagaataaagcgaaatgtttgattgaaaagtatagggaattgaatggaacatacaaaaaaataaagataatggtaaagaaagtgatcgaagagcaacaaatggaaatcgaagaaaagaaaaacccggaaaaactcgacgattgcgaaacgaattgatcggcggaaaagcgaagcacccttcaaaatttatctaaaggatttatttgaatgacgtgattacaagccattttagtgtacggaagaaaaaatgttcctttttccctttggtgatatgtcaaaattttctcactgatcccctaaactttttttaaaaaaaatcgtttttttagtaaatcttactctagaacattgtttaagtaattttcttaaaattggtaaattggtgtaaaaaaaatttagaaaaatttttgttcagttgctaggtcgaactttaaaaaatatcaatgataagaatattttaattattatattattttatttgcagaata

SEQ ID NO: 83714 - DNA, 493 bp, Heterodera glycines
  Genomic contig location: Contig_ID=SeqID_3209; Location=514..1006; Strand=-
  SCN-specific regions: Sequence locations=1-305,328-398,420-423,450-493
atggcgagtcattccgatgaatacgaaattgatgaattttggttggataacattgcctatgatgacggcgagccacgtccaaagtcgaaaaaatgcgaaattattgcagggattgatcttcaaagtcccagacaacggcgagagtgggctgaaagtcgaatcttccgtcaatactacgatattattttggatggaaatggaaatttgactaattatgtaatatgcaaatcctgcgtgccacctgcgaaacctgttacatttaattatgccgggtttcataatttgcggtatattaaagactttaatttaaatatttttggatttgaggagacatttggaaaattggcatgggataaaatttggcacaaatgacaaatatgacaaaatggaattagcattggttgaattttgtgttgctgatggacgtcccttttcaattatcaagggcgaaggattcaagcatttcatggatgcttatgccgaattaatgtaa

SEQ ID NO: 83715 - DNA, 735 bp, Heterodera glycines
  Genomic contig location: Contig_ID=SeqID_18977; Location=872..1606; Strand=+
  SCN-specific regions: Sequence locations=1-735
atgcacgtagactttgatccgctcggagtcgactggacccccatgttcacatgcgcccaaaacgacgcaatcgtgcactcgggccccgccgacgcgggccacggactcaacagcatcacgacacctatgggaaccgccgaggccgccgcagcagcacacaactatcttatgattggtggtggccatactacctaccccgtgttctccggcctaccgtaccagcgcggcgccgggcttggctccatgttcagaagcttcctccgcttcctgttgccaattggtcgacaggctggcgccgcaattgggcgccaagggctcgagtccggcgcccgcgttctctccaacgtgctcgacggacagaacttgaaggagtcgctggtcagcgagggacgcaccggcctcaaaaatctgctagacaaagcggcggacaccgtggcaaagagtcggcagaacggtggcggcaacttcgacttcaaacgatacagacagaatgccgccgaactcaaagagggcataaaaagtggaaagaaaggcctcttttccacaatgggtccgccaacggcacctgctaagcaacacaaaaaggagcttcaaactctggaacgcatactccgccgacaacaaccgggctcaacaccccgcaagcgctcccgcaccgtgaaaacgcccgccaacagcgacgacaagaagcgaccgcgacgtgcgccccgctttgacacactcggcgcctactga

SEQ ID NO: 83716 - DNA, 2376 bp, Heterodera glycines
  Genomic contig location: Contig_ID=SeqID_18979; Location=850..3225; Strand=+
  SCN-specific regions: Sequence locations=1-151,173-377,400-1075,1105 -1117,1187-1287,1317-1325,1348-1585,1607-1615,1638-1707,1730 -1790,1829-1883,1905-2024,2093-2158,2184-2376
  Gene Ontology: Mol. function=translation factor activity, nucleic acid binding; Biological process=response to stress
atgcgcgagaaactgaccctccaacagcgagaatatgaggcacaacaacagctccgacagcacatccaggagttcatcgacaaattccgctacaacgccaagcgagcctccatggtgcagtcgcgcatcaaaatgctggaaaaattgtaaacattaatacattaaaaagatttgataaattctaaaactttagataaacaaaaaagtttctaaatttcctttaatttgcttctctatttaaaattatttgcttcgtatcttctatctgtcttttatcatggaaattgattacaaataatagtatgataaaggggacgtgtcaaaatttcaccgccgaaacaagaaaaaaaattattgcaaattttttaataagaaactatccagaaaaataaaatccttcagtttttttgaaattttctgatgaattactaagttttttcaaacgtttttccaataaatcgctaaaaatttttcaaaaaattttttcttagagttttcttataaattttcaaagtttgaaaaaattataattaattttcggtggtgagatttttgggtgcaccctatgataaaatgttatttttcgacatttttttaaaagttttcgcgttattttgcattttttgttgtggtgctcactttgcgttccaatgtttcagaccggtgctgcaacccgtcgagttcgactcggacgtggtgttccacttcaaagactgcgacaagttgggcaacccggtgctgcagctggacgaagtggccttccgctactccaaggaaacgccgtacattttccaggttgcgtaccataatttttttatgggccggggaggttgcaaatcgctgggatagggaagggatgaccgaattttgggatgggtccaagcgcaaatttacatctgtttttgttgggaacagcttatcccccctattttataaaaaaagaaaagtttttgatttttctttgaaataagaaaaggataaagaattttttgaaaaagaaattccaggggggagaaacgcttgcgcccgttttgtgctcttccctgataatttactgcggatgaatacacttttgtaatattttttaaaaaaatttgttaaaaacacaaatgctaattttccattttttggtttgaaagttgaaagttgaaactttttaaaaaatatatatttttattgaaaatttcttgtgaaattgtgaattgattaacaaataaaatgggaaaacaggtgatcattttaaatctttgtttgtttttggcgtttttctttatgattcgcttaatattcccccaaaaaatatattttttctgcttttccgattcctaatttttgtattttgcagaaggtttgcatcggttctcgctccgactcgcgcatttgcattgtgggcgaaaacggggccggcaaaacgacgctgctcaaactgttgctgggcgaccacagccccaccaatggcacacggagtgccaaccgtcggctgaacattggctacttcacgcagcaccacgtggaccaattggacttggacgactcaccgctggaactgctcgcccaacgctttcccggccttggccaggtgggcgccgcaattttttctggcattcagcattttatttcaccgtatttcctaaaatagagcctccgggggctttgtttttcaaccccttaggggggggggcgggtattttaaggggttctaattccaaaattaacaaataattttttacataattacattaattgcactaaaatttccggccacaaaaattcataaatttctcttacagaatttttttttcattattttttgaaaattaaaaattttcgggctcttcatttttctaaattctaattattatttttgagtgtgtattattttattgatgttggttgcgttcataaaaccttgccaatttatttcttttcccaggaggagtaccgtgccgcaatgggccgttttggtctgtccggtgacattgccttccaatccatcgccactctctccggtacttttccgttccaaaaataatgaaaaaattaaatctaaaaaatttaaaaaaaacatatttttctatttgaaaattattttcaggaggacaaaagtctcggcttgccttcacttgtctttctcttcaacagtgagtttttcggagtgttaaaatttataattaaatttaaaacaatccttaaaataattttaccttatttcttggcaggcccaattatttggtaatggacgagcccaccaaccatttggacatcgaaacggtggacgcacttggcaaagcattgaacgattttaaagtgcgttatttcactagtttgaaatttttcaaccaaaatcttacaatttagaaattttttaaattagaa

SEQ ID NO: 83717 - DNA, 709 bp, Heterodera glycines
  Genomic contig location: Contig_ID=SeqID_18980; Location=498..1206; Strand=+
  SCN-specific regions: Sequence locations=1-8,30-158,229-330,549 -622,661-677
atgttcttgaaatttaattccattatttgtgcgtttgcttttattattcgtaattatggctttttcgttcatggcggcagcatgggcttcaactcaatgtgtgaaagcacaatttatagcaaacaatttgaaaatttgaaggctcaaagctatgtatgtaaataattttttaaaaatttcaaaaacaatttagatattaattagaaaattacaataattagatttaatgaggaaatgaataaggaattttcaatggcaaaaattaaaacaagcatcaaaaattttttaatgattaaaaaaagaagtcaatttagttttttgtagaaattgataaattttgtaataaatttaactttttaaaaaaagttaaaaaataaaataaaaatttatttaggaatagataaaaaaaaattatttgatagaaaatatatttttaaaggaaaatgtatgaatattatataaaaaaatttcctattctttttaagaccaccaaaaaaatacaaaaacaaattatttaaatatatttgtaatatttaatatatttttttcacagacattcttcattggtaattatttcaacggcgctttagtgacagccccgaacacaattaatggactctattcgggtgttaacaaaaatggaatttattgcattggaaatgcgtcaagtaaaacggaaaatttattttaaaatttacaataattataa

SEQ ID NO: 83718 - DNA, 985 bp, Heterodera glycines
  Genomic contig location: Contig_ID=SeqID_18982; Location=1..985; Strand=-
  SCN-specific regions: Sequence locations=1-402,431-468,493-985
  Gene Ontology: Mol. function=methionyl aminopeptidase activity; Cellular component=cytosolic ribosome (sensu Eukarya); Biological process=proteolysis and peptidolysis
gaacataagttgtgccataaagacgattcgtccaatatcaacgagtacaacccgtggcctttgtatcaattcagtggaacgcttaggcaatttttttaggaaattcccaaaatttttaatagtttaaaaagcaatattttggctatctttccgttttttaacaacatattcaattttttaggttcaccttgataaaaacttctttttttgaagccttaaattttcctgactttttaaccaattaaaaaaattgcctattttccaggcccgccccacaaagtgcgcgccgcgctgtcccggaacatattccgaggcctgattatgcgttgcatccggaaggcgtttcgttggaggaacgaaacgcacgaaacagtggacaaattcgtgtaggattttagggggtaaattttcaaaaaaaaatttttttttagttttgtattgaagcgaaataaatgggagggtctgatcaaaaaaaaaaaaaaattattttttgaattttcatctgaatttttaaggtgttgaacgaggaggaacagttgggaatgcgtttggccgccaaattgggccgcgaggtgctcgacgaggcggcacgtgccattgagcctggcgtaatgaattttttttttattaaaatcccataaaaatacaaaccggatcaggggattccggaaaatagtttttttcccctaaatcctatccatttcatgtttccaagctgatttttttcaaattggttatggtctttggttgttgttagacatttggttttaaagaaagttgttcaattttttttcatttttcaaaaaattcgaatcaaataaaaacgccaatttttcgtatgattcgatttaaataagtgccattatttgtattaaacatcaggtgaccaccgatgagattgaccgtgttgtgcacgaggcgtgcattgagcgggagtgctatccgaacccactgggctactacaaattcccgaagagttgttgta

SEQ ID NO: 83719 - DNA, 522 bp, Heterodera glycines
  Genomic contig location: Contig_ID=SeqID_18985; Location=271..792; Strand=+
  SCN-specific regions: Sequence locations=1-522
atgccgacggtgccgccgccaacggacactttcaaaaaggagactttcgaggcaattattcccgaaaaatcggttaatgatcggccgcttcagttgtttaaccccggctcggctgctcagctgatcagtgaaatcagtgccttgccatccgaagggcgcccccgggtaaattttaattgctttttccctattaaagtgccgttctcccaagaatttcttccctcagcagcccactccacagccccaaccaaatccgaccttctttcgagctaccgtaagaatgaaattgctgtttttcgaaatcctaaggctttttctcaggaaccgacgccttttgttgttgccacgacgccttccttcttccgacccaatcagcaattccagcgatttggccaaaattctggtggtttgcaaaggatcattgcatttcaccgatcaaaacatgttcagcttgccgtgacgcgacttcgactcgccattgcttacaatgggtccaattttgtccgacaaatccgtggatga

SEQ ID NO: 83720 - DNA, 131 bp, Heterodera glycines
  Genomic contig location: Contig_ID=SeqID_18985; Location=1036..1166; Strand=+
  SCN-specific regions: Sequence locations=1-70
cggaggaactgaaccattttgaacaattagtccagtccttttaaatgaaccgcccattatgggtctctgactctctctctctctctcctccccctacccttcagtctctctttccgttctctctctctctc

SEQ ID NO: 83721 - DNA, 438 bp, Heterodera glycines
  Genomic contig location: Contig_ID=SeqID_18987; Location=2660..3097; Strand=+
  SCN-specific regions: Sequence locations=1-56,83-162,209-209,235 -389,413-438
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagatatatcgattttagtgcgctaggttcgatgaaactttttaaaatataagcctaaacttttttggctgtttaaaaaggaattaaaatttttaaatatttatcatctcccctttgataaaaaagcatc

SEQ ID NO: 83722 - DNA, 5802 bp, Heterodera glycines
  Genomic contig location: Contig_ID=SeqID_27; Location=984..6785; Strand=-
  SCN-specific regions: Sequence locations=1-243,265-919,941-960,982 -1665,1687-1763,1789-2081,2103-3835,3857-5030,5071-5142,5164-5802
  Gene Ontology: Biological process=DNA replication
atgccgtcaaagaagaaaaaagagagagccgctcgacgtggaaggaatgatttcgctgctgaaactactccgatcaatcagatgtctatattagccatatcgactccacaatcatgcttgtcaacattttcgcagttatcatcagcatcaccaatagtgcgcccaagaaaacgtttgtacaatgcaaccgcaacaccttcatcgaactcgactttaattcatacaaattcttgctctgaaacgccaaaaagaaacagaggaagaccaaaaaaacgaacacgaattgcgggcccgggtcgtgggcatcgcagcagctcatcttcgtgtcataatacaccagcacctgtttctaatctacaagctttaccaccaaatgaagagatgcctcacactgagtcgaattctgaaccactaatgatcgaagaaggaccacttatgtcaagtgatggacatgttgcgcaaccagagttatttgcaagccgaaatgagttattaaatttgtggaataatcaaaacgagatgtgcgatgaccgtgtcatttacgcctacatgcgttatctggcaagtattaataatgacaaacgtgttgcagttgttgcgccatcttacaccgacccaaacgtacactacggccctggagcaatccatttggaacttaatgatcactgctacaaccactcagtagactatgatgtcctgctcgtgcctgtcgtttttcctggacattttacgctcatgatatttgaccgctccaacagagaagaattacgttgttggttcattgattcattgccgcctactcgaaacttgaccgctgattttaacaaccgtcttaatgatagcagatttccgggatttgaccaaaaccgaatcattctcctgaaccaaattatttgtcaattgactcaaggtctcgaaccatctgcctttgaaattcaaattcttccgccaaatcaatacacataccagttagatggaattaattgtggtttttttacaattttgtacgctgaatcttatttgatgaacaaccgctgcctttttttgcccaaccttgacatcaatactgagagaaaaagaattatttcacaactcgcaaaattacttctatcagacacagttgaatattttccgaggaatacaaatggacaacaaaatcttggacaaagaaatattttcttacgaggtgcacaaataccacatcaaagatgttctacgcccatcatggaaactcattttaatagccgggagccatcaaccaattccgtttcatcatcccgacgttcttcacgtattgcgagccatcaatcaagccgagaatcttctattgttgacgaatctacaaccatatcaatcaatcaattaactcgccgttgtcatgtaagacacaagggaattccgtgtgccgatattcgagccaaccattatcaaccatattatgactctggaaatattggtgataaaatatgcgctttttgcaaggcgaagctcttcaacagtgaagccacagcaaaacatggcaagacttcttcagcaatttgctgcaattttggaaaaatctgcttgccaaaacttagcgatttgcctgctgaattatatgctctttcaactgaaaactcagcagaagctaaagaatttcggaagaatcaaaatgcctacaattcattgcttgcgtttgcgtctgtttctgttggatacaaagaaaactctgtgggtggcgatgtgtgtttcatgctgaatgggatgtttgtccgccggatcagttcgcttttttctggacaaatggcaccaaatttcgcgcaattatttgtgttagaccctgaacaggcactggagcaccgaaaaaagaacacacgatatggtggcgatcgtgtaaacccaaacactctgaaaaaattggatgcaatactacgtcaacaccatccactggcaaatcaactcatgaattttcatcaacaatatcaatcaaagcttgcagagggtggcccggatgccgtacataacttccgtctcacacttcttgaagcacgaatggcaccaactggaatacgggatccaaatctgcacccacgacagaccaatcttccaactgaaggtacattatttgctgtatggacagaatcggaccgcccaccaatggaaagaggcatttggatcactacagaacaaggccaacttcagcaatttccaccatatcatccgtcaactgacacactgtgttatccattggtttttccaagtggagacgacggatatcacaaaaaactgtataaaagcactttgcatatcgaggaacggcacaacgaacaaagagaaggagaaacaatattggatattgatgttgatgttgaatctaattatgaatcaacaaacgacacagaaagccagtcagaccggaccagcttggcttcgcacgaaagcgatggagaagtaaggcctttcagaaaaatgtctttaagagaatatgttcgatatcgattggcaatcagggttgacgaaacgtatcatcacatttggatcgtcgccggtggactcagccaaaaaattgtgttggattatgctgccagaattgatgcagatgttgccgagtatcttcgtcgtcctgaatttgaccttcgtggcaccatgccagaacacttgcttcgatggttcgcgcgcaatgcaggtctcacctcgccagaagaaattggttcaattgttttgttccgaaaaacacaaccaggcacacttgcctacttccaaaacaaatactatgatgctaccactataatggcacgcatcaggaaacctgatcgagcttgcttcatgctcacgtggacttgtaacccacggtggcctgaaatcaagcggaacttcatgcgtgctgaccaaaaaatggtagaccgctttgacattctgtgccgggtctatgaagacaaacgaaggcatttacaccaccttttggaggataaaaaaatccttggaacacagattggatatggtgaggggcgagaatttcagaaaagaattggaggaccacatttacatcgactttttcaatcggatattttggccatcccggaatgcgtggaaaatttgatttgggctcatattcctgctgaacctaatgcacaagaccaatcttcatgggcgaactttattcgcaaagtgaggaaccttctgccaaagtatcaattccatgattgtggaattcattgccaaaacgctcgtggacgctgctcaaaaggcttcccaaaaccattcagcaaattcacaatcctttttgatgacaagcccgcagtctataaacgactacaaccaacggacggaggcgaaacactgactgtaaagcgggggctttccgaaataacttatgataattcacgagttattccttacaatccattcattttggttctatacgagacacatcacaacttggagttcgcatatggaaaatcaacaaatatgaagtatccacttaaatatccgctcaagggaccatcttattcatatataagaagtgaacataccaacaaaacgaacattgatgagccagcatcctacgcgagagtattgtacagatccccagttgaggctttttcaaggattatgtcatacagatacacattcatgtcacacactgtcatggcactttcaattcatcttcccggacagcaaaaaatgtatttacggccgggacaaaacgcacaggagctcgcacagcaaattctggcaggacaaatggagcttccggtcactcccctctctgcgtattggcaacaatggcgtaatgaccctgcgttgaagaacattttatttgaaaatatgcctgaaaaatattatttcgacaaacagaaaaaagtttggaagccaagaatacgaaatgcccaacgaaaacaaatattgggacggatttatccaattctgccacgttctcatgagaagttcgcattattcattctcaccaagcattttgctggtgaccctgagcatttgaaattggttaatggacatcaatgcgaaagcttcctggaagcagcccgacttcgtggtctcatcaaggattcaaatgtatggatacgaaccctacaggaaggagccaattatctcaatccagcccaaatgcgccagttgttcgccagtattcttctttttggcaacacggaagattgtctcattgatgcattggcactttggaaccaatttttgccgcatatgtacgatatacgttgtagtgatgcagaacgaccaattcgaattgatcaggcactcgcccttcttgaacgacttttggttagacaaggaaaaacttgtgaagattttggacttccggcgcctatgaactcaattgtcaacgacccaacacgtggtgtgaacgatttctttttcccaggccatctggctgatgatgacgttgacgaaacagttgatacacgacagtttgattcggcaagaatgaatcccgagcaggagaaatttttccaaatggtcagaaagatcgcctcaactcgaccaaccactgcagaaaaccgtctattctttttgtctggtgacggaggcaccggaaaaactttccttctcaattatctattgtatcaattgcgcagaattggtaaaaaagtgattgccaccgcctcaacaggcatggcctccacacgcttttacgcaggtggcacaacagtgcattctgcttttcgccttggcattcaggttgaagccggaaaaattccctcaataccaatggaaagctatttcggacgcagaattatcgaagctgaggtcattattattgatgaaatcacgatgttggaaaaaactgtcttggaaaatgtggatttgttgtgcaggcaaatggttcctcgcttcggccaacttccctttgcaggaaaagttgttatactttcgggtgattggaaacagtcgctgccagttgttactgaagcatatggcactgaacctcaagtcgcagcatgtattcaatcttcaccgctctaccagctcttcacaaagataaggctcgtacagaacatgcgtgttaattctcaggacattgaattcattgaatggttgaagaaggttggtacaggtgcattcggtgacacagtgccaattccaaaggagtgggtggtttattcacgcgacgaagtcgtttcttctgtatttgatcaaggctttttacagccagcaaatgaaatgctgaagcgattaatgctggcaacaaccaaccgaattgtggacatgaataatgatgccatattgagaaatatcaattccgattacaccgactacttctctgatgacagaccaattgacgcgaacccaatggcacttaatgctgctgaccaggatgttgcacacctcaatttgctgaaccctgctggcattccggcgcatcatcttcggctaaaagttggctcgataattgtgttgttgataaatttaaacacggccaaatcactgtgcaatggtactcgattgattgtcaaaaaattgaccgattatttgattgttgccgaagcaataactggtgcaacagctcaaagtggaattgaagtagcaataccaaaagttgcagcaacttacaaagacaaacagccaaacggagttaacttcgaaagattccagttccccgttcgggtggctttcacaatgactgtgactaaggcccaaggacaaacatgcgagcggctgggcatcgacttcaccgaagaggcatttgcccacggtcagacatacactgctttttcacgagctacaagctctgattccattcgggtgtatgccccgaataagccagttgatgcagacggaaatgttttg

SEQ ID NO: 83723 - DNA, 1136 bp, Heterodera glycines
  Genomic contig location: Contig_ID=SeqID_27; Location=8610..9745; Strand=-
  SCN-specific regions: Sequence locations=1-234,303-1136
atgatgacaggtcgcgatctgatcaacggtacggtaagggacgagcgcgagagttggacactcagtgacgcataccgtaacgttgtacgcgcacaatccttccgtaaccgactgttttggacgtcgtcaagctgcggtgactcacacccatggggaaagctgcttgttcagcgaggaatttgatcacgctaacaaggctgtacacctcagcaaatagtgcgtaatgagaaaatgataatttttatgttaaaattattaaaaatttaaattttattaattttgttaaatattttcaaatttttgttcgtaccacctgcagatttttgttaactcatagatgaaaatcacttagattggcgcacaaaaatacaccatgcattaacacgctcaagagacccttctctccgatcttgatcaattgaattcaatcgattctggttatctattccccgatgaaaatgctccgaattcaactgctggtcaagcgttggccaaatggttacgaactccgacaaaaaatggtcaaccgaaggaattgcgttgctcgcattttgcttttatgaaaataaacaattggttccacaatcacaagcaggtggtcgacacattttctctcacaatttgtgcttttatcgacaaggatttcgagactaaacactttgtttttgttttaccaatttttgtgtttaggcatttctccgtgccaccacttcggtcagttacaatatgcgaattactttttataagaaaacaaggccaattccatttgaattggtgaacgaacggacgaatgagaagctgacactgacgaaggagaaagagtgcggtgatgaaatctgtgattttctgatgaaacggtgtccaataattgaggagacggcggcgcttcaatgggaaaacgacgaaaatttggatcatttgaacggagtcttcttccgtcatactatcattcggtgagcagcaaaggccttacttttgtataaagtacggacatgacgatagtatctacatactttcccagcaattttggcaggaccagcaagagcatacatgaaaagggggcgggtgggtaaactgaaatttttgcgaaggggtgtccgtccatgaaaagaattttaatgaattttcttaataaa

SEQ ID NO: 83724 - DNA, 1557 bp, Heterodera glycines
  Genomic contig location: Contig_ID=SeqID_28; Location=16..1572; Strand=+
  SCN-specific regions: Sequence locations=1-64,239-264,439-464,616 -676,700-722,797-922,1216-1281,1356-1381,1556-1557
atggcacttcacttcactcaatggcactcaattacagcgaatggcacttcatttctgtcaatggcacttcacttcactcaatggcactcaattttagcgagtggcactttacttcactcaatagcacttcatttctgtcaatggcacttcacttcactcaatggcactcaatttcagcgagtggcactttacttcactcaatggcacttcatttctgtcaatggcacttcatttcactcaatggcactcaattacagcgaatggcacttcacttcactcaatgacacttcatttcagtcagtggcacttcacttcactcaatggcacttcatttcactcaatggcacttcatttctgtcaatggtacttcacttcactcaatggcacttcacttcactcaatggcacttcatttctgtcaatggcacttcacttcactcaatggcactcaatgtcagcgagtggcactttacttcactcaatggcacttcatttctgtcaatggcacttcacttcatggaatggcacttcacttcactcaatggcacttcatttctgtcaatggcacttcacttcactcaatggcacttcacttcactcaatggcacttcatttctgtcaatggcacttcttcactcaatggcactcaatttcagcgagtggcactttacttcactcaatgacacttcatttctgtcaatggcacttcacttcatggaatggcacttcacttcactcaatggcacttcacttcactaaatggcacttcatttcactcaatggcacttcatttcactcaatggcactcaattacagcgaatggcacttcatttcactcaatggcactcaattacagcgaatggcacttcacttcactcaatggcactcaattacagcgaatggcacttcatttctgtcaatggcacttcacttcactcaatggcactcaattttagcgagtggcactttacttcactcaatagcacttcatttctgtcaatggcacttcacttcactcaatggcactcaatttcagcgagtggcactttacttcactcaatggcacttcatttctgtcaatggcacttcacttcatggaatggcacttcacttcactcaattgcacttcatttctgtcaatggcacttcacttcactcaatggcacttcacttcactcaatggcacttcatttctgtcaatgcacttcacttcactcaatggcacttcatttctgtcaatggcacttcatttcactcaatggcactcaattacagcgaatggcacttcacttcgctcaatggcacttcatttcagtcaatggcacttcacttcactcaatgtcacttcatttcactcaatggcacttcatctctgtcaatggcacttcacttcactcaatggcactcaatttcagcgagtggcactttacttcactcaatggcacttcatttctgtcaatggcacttcacttcactcaatgacacttcatttctgtcaatggcacttcacttcatggaatggcacttcacttcactcaatgtcacttcacttcactaa

SEQ ID NO: 83725 - DNA, 1524 bp, Heterodera glycines
  Genomic contig location: Contig_ID=SeqID_28; Location=3003..4526; Strand=+
  SCN-specific regions: Sequence locations=1-154,176-448,484-561,583 -612,634-663,685-794,816-844,868-896,920-948,972-1000,1024-1049,1071 -1103,1127-1281,1389-1434,1456-1524
atgaagggccaccgtccacaccagaccgactatctggctggtccttcagatcgctgtgacacccggcgggctcaggaaggaacttggttccatccgtccaggccgcagccctggataccagcgcaaaaggaccagtggaaagcgaacgcccacgcccacccaactgggaagaaaacccagtaccaggcaggactccacggttttcatggatggcccccagggtattcgaaaaagcgtatcaaacatcctataggggtttactaccgcgtcaaccaaatatgcaaatgtttcggcccttcaaagccgtagacacggtttgaatttcaaaaaaatacgagcgggcctcgtcagtacggcactcgtattttattttttttgttgctaagctcaccagtcagcctttggcgtcaccccggattgttgctccctaatggtcaaaatgtttttgaaaaaaaaaaaaaaaatttaaatgtttaaatatttgttcattaaaaaggaaaaaaacaattttagggagtaaaaacatttttgttcggaaatgaaatgaaaaagagatgtttggggggacaaaaatatttgttgttcggaaattaaatgaaaaagtgatgtttggggggacaaaaatatttgttgttcggaaattaaatgaaaaagtgatgtttggggggacaaaaatatttgttgttcggaatgcggaaagaacaaatgaataatatgtgcaaaaacatttaattatataggcataaacaggaaaaaacggcccacgtaatgtctgaacatttgtttttgcaaggaaacaaatggaaaaacacaaatgcgcatgtttaaacatttgtttatgcaaagaaacaaatggaaaaacacaaatgcgtatgtttaaacatttgtttatgcaaagaaacaaatggaaaaacacaaatgcgcatgtttaaacatttgtttatgcaaagaaacaaatggaaaaacacaaatgcgcatgtttaaacatttgtttatgcaaagaaacaaatggaaaaacacaaatgcgcatgtttaaacatttgtttatgcaaagaaacaaatggaaaacacaaatgcgcatgtttaaacatttgtttatgcaaagaaacaaatggaaaaacacaaatgcgcatgtttaaacatttgtttatgcaaagaaacaaatggagaaacacaatgcgcatatgtgttcacagtttgaatagataacgatacatagttggctgttttttttggtttggtaaaaccaaacattgttttgataattttagtaaaaaccaatttgttttttattgtatgttcaatttaaatattaattttttttattgttttttatatatttttatttgttttgttattttaaaaaatttatttaatatattattattctttctgagtgaatctttgcaattaatttggttctggtaattaaacaaatattttcattaaatggttaaaaatttacaaatttttttttggtaaaattcaattggattttatgacaagaaatttcgatttttgtta

SEQ ID NO: 83726 - DNA, 267 bp, Heterodera glycines
  Genomic contig location: Contig_ID=SeqID_29; Location=2980..3246; Strand=-
  SCN-specific regions: Sequence locations=1-267
tacaaaaataaaagtgattttgagattcgggaccaaaggggtgaccatgatttttgagtggaaaaattttttcacccaaaatcctccaaaaacatgtcattagggctattttatgacgctgatcacgaatacgtgatcagattttacttttaacatcgataagacctcagaatccctgtgtgattggggattctgaggcatcattttgaggggggagggggcaggttcggatccggacggtgtaacattatttttctgtgcatttta

SEQ ID NO: 83727 - DNA, 8565 bp, Heterodera glycines
  Genomic contig location: Contig_ID=SeqID_349; Location=173..8737; Strand=-
  SCN-specific regions: Sequence locations=1-148,170-777,799-847,869 -2708,2730-2949,2971-3074,3096-3442,3465-4929,4951-5206,5228 -5537,5559-5571,5594-5686,5708-6667,6691-6982,7005-7332,7354-8565
atgagtgagctcttgcgcatctccattgcaccaatggtggtgcgtctcaagatgtatattgagacagcccaagaaaacttgggcaaagagctggcggaccaaagtgtccgtgcagatctgatcgcagagagacaaaatctctgcaaaacaatttctcttttggagaaatacaatggaaaatgggaagccattttcctgagagtgaagggacaagctcttcaagatgaagagcaaaattacagagacttcaaaccagaaggcaaggccttcatgcattgggtcgaccaagcccgagggcttgtcgacaccattgaaggggctttaggcctctcggagctgggggatgcaattccccagccaaatcagccagcacaagttgtgcagcaggcaccagtggtgcatcagcgtcatgatgtgacgcttccgccgataacattgcccaaattctcgggggaaccccgagaatggcctttgttttggaagctctttgagacttccgttgaaagtcttcaaattgaagacttcaagaagcacatttatttgctgggatgcctcccagagaagtcagttgctaggagagcaattgacttatacccaccgtcagatgaaaactacccaagggtagttgagattctgaaaaagcggtttggggatgaaaagacaatggtggagtccctccaagcggagttgctccaccttgccaaaccagctgaatccgttcagtctctgagacaattctcagagtccattgaacggatttgccatcagttattggactatggagaaaatgaacaaaacaagttcatggcctccacaattaagtccaaactgccctatcaccttctcacccaagtggtggagaaggaaatgagggcaggaggagccttcaactgcacagagctccgaagagctatcacctcaatcgttgaagtgaaagaggaagtacagagatgtactcaggttttccgtggagaggaaaaacctcgcaattttccccctcatccaaatgggggaagagccaaccaagggagaggaacaccgttccgtttctcccagccgttcagacaagaacggcagtggaggccaatggaacgaaacgaaccggtgaggaggatgtctcctcaaccgaatcgttccttctcggccatcaacaaaccacagacccctatctcagatagggggtcaaaacgcttatgttccctttgtgaaacaaaggggcatgcaccgagcaggtgcacaaaatacaccactccgggggcgcgaaggaagcgccttacggatcaagacaggtgtattaattgcctgatgatggggcataacaccaagaactgcacctcaccccgcaggtgcagtcattgtggtgaaagacaccactttatggtgtgttttggagaaaagtctcgagagggaacctctcggggccaaccaaataatcagatgaaaagagaagcgagaaaatcctctcaaagtcatctgactatgagcaagcatgctcataaaagcgtgcccagttcggaatgctcacccatcactacaaatgtgatgacaagcgtgatggcgaaaaagcctcacgcatttctaatgaccagaaaaatactggtcagatccaaaaataatcgaagagtttggatggaagttccattcctcttcgacccaggaagtcaaacttcctacgcctccgaccctctcatcgagaggctcaagccaccgaaagtgacttccgaagaaatggaagtctatggctttggaggagaaaggaatggaccaatgaggttccattctcccgtgtattccatccaaatcagaagaacggatggaaagtgggaagaaatcctcctaaataggacggagagaatttccacgccattcaaaatggcagaatggaattctgaggaattcccactcaaaggaatggacatggccgacgctatgagtttttctcgggaagagcccgaaatactcataggtgctagacatttctggcaattcttccaagggaaggaagaagtttctccagggttgtttgtaattcaaacaaccttgggccctttggttaacggagagtccgactttgggccggaacttccgaacccaggactatcaatgatggccattgatgagtccaatcaagggcaaatgccaacagttaaagaaattgaatatttctttaatttggagtcattggggatcaaagacgatccaaatgaaaatgacgaccaaacagcaatgagcctgtttaacaagtccatccgtcgagaaaaagacggaaggtactctgttaagtggccatggaaggaggaggtgcctgacctcccttccaattaccgcatggccttttcaaggctaatgtctacttttggtaagcttcgtaattctccagacttaatggagcaatacgatgctaccattagagaccaattggaaaaagggataatcgaagaggccaggaaagcccctggcactcttgagcattatatccctcatcagggagtccttgccaaaggcaagaaattgcgcgtcgtttacgacgccagtgctcacaccagaggaacaaacagtctcaatgcctgtttgtatagaggcccggtaatactgccggatctcatcggaatgcttatgcgattccgatgtccaagattccctctcctctccgacatacaagcagcatttttgcaaattgctttggaaccggaggatagggaagtcaccaaattcctctgggtgaaggatgtcagtaaaccactgacaccagcaaatctgatcacttaccgattttgccgagtggcattcggagtgatcagttctcccttcattttggctgcgactttgcagcaccatttgaagggataccattctccagtggccaacgaattggcccaatcattgtatgtggataacactcttcttgagtgtgaatccgcagaagaggctttgcataaatatgcagagtctaaagccatccttaaagaaggacttttcaatttgagggaatttgttacaaattccccagaggtaatgaaggcgattcctgaggaggatcgcctgaacaagcccaaggtaaaagtcctagggctcatttgggacacagacaaagacgaaattgtctttgagttcccaactcatggcttagaaaagctggcaacacgccgtcttgttctaagcttcctcgcctcattatttgaccctcttggtctaatggggccgtgcattcagcccttaaagcttttcttccaaactctttgggaagaaaagaaaggctgggatgatgttctttctgagaaagaacaaattcaatgggcctccttccaagaaaattggaaggatcagaccctcaaaatcccacgcagagcaatgctacaagggaatccatcccttgaattgcatgcttttgtggatgcttccatacacacatttgcagctgctatttatctaagagcagtaaaagataaccaaatatcagtttggcttatcttctccaaaaataggctcaagcctaaaaatgcttcaaaagcattaacaatccctagaatggaactcatggccattctaatagggattcgcggtcttaaatttgtcgccgatcaaattcggcgacccatttctgaactccatctttggggcgattcacaaatcgctctaagttggattgcttcaaaggaagcacagccaaaattcattgagagacgagttaaggaaattcgtactctcaatgaatgcgcctttcactttgtccgaacagccgaaaatccggcggacattgcaaccagaggcgcaaaaccaggagaacttaaggataagtctctctggtggaatggtccttcctggcttaaggaagaccatgaccaatggcctaaagaaatggaatttcaaataaaagatcctccagaaaatctggaggaagggtctctggataacgaagagaaagttttcttcgttaataccagaacagaggaactgattgatagtcctctgattgaccccaaaagattcagctcttggacaaagattgtccaagtgactctttttgtgttaagatttctccgtctgaaattaattcagaggggaaatcctcatcaacttttcgagagtcatcgaaaagaaatcgccaaagtgtccgaaaaaggaccattttcagcagaagatgttctcctagcagagaaccttctgatccgcatggatcagatgaaaaaggctgaagattccctcagctatccttctcttaaggatagcgaggggattttgaggcttaaaaccaggttgggacggtgtgaccaaccttttggttttagccatccaatcattctcggaggacaatcctccatccgagacttgatcatcttaaaatgccaccagaaaaggcatcattttggggtggaaggcaccctcactgagttcttactcgagtattggacacctcgagcaagaactaaagtgaaaaaagcactgaaaggatgccttcggtgcaaaaggatgcaggcataccagtttgcattgccaaaaatgcctcctttacctgacgagcgagtatgccgtcaggctcctttcaaagcaatcggcattgactttctcggtccaaccgaaacacggttggccggagagaaagtcaaggcatggatacttcttatgacttgcctcgtaacacgagcagttcatttggaggccatgcttgacacaactgccgagtcattcctcaatgttctccgacgtttcataagtcggagagggaagcccgatttaatttggagtgacaatgccacttcatttaaattggctcaaaaaaccattgagcatttgaccactccaggagtggatcaaaacacgcaggaatttttcgcacttaataaaattaagtggcgattcattccacaaatcagcccttgggcaggtggcgtttatgaacgccttgtccaattgtgcaaaaattgcttcaaaaggactttggggagaaaagtcctcagttatgatcaactcataacttttgtggctgaagttgaagccacattaaaccatcgccctattacttctgtgtcagaagggatggatgaaatcctgccccttcgtccagtggacttccttcaaccggaagtccaaattcactgggacacgaatggtgaagaattcgatccatcggatcgaaatctttcatcccaccaaaaattagttgccctttttcaggcaactaaagaatcccatgaatttttctgggaaatgtggcaaaaagaatacctcctccttctgcgggagagaggtaaatgggaccacaagagtccccgtcttcaggacaaaacagaaccaaaggagggaatgatcgtcctcattcatgaggagttcactccccgaaaccaatggtctttgggaaagatcattgagcttaatggccgaccaggggccattagaagcgttcagttggaactcccaattcatgggataaaatcaaagaggtatggaaccatgcctcggaaaatcattatcacccgtccggtgaataagattttcccattggaagtaggattagataatcatacagaaaatgaagaaaaatttgaagaaagttcaaatggaactcctcaaataacaaatgagaaagaaatatctcatttggaagctccaatggatgaaaaggagactgaaactcttcaattggttgatcaaccaattgaccaaaaccggcatggcatgatcactcgcagcaaagcaaagatggggacagttttgaactgtctttccatcctttttgctatgtttgcgttggttggagcttatccaaccaatcattgcaatgaatgcaaacttctttgctttaacaaaggcgttaaagcaaagattccaaaagaaatcaataaagttgagctctgctgtgcagagaactgttacattcatgagaatgtaaagaagctcacttacgagctgcccaaggagatcctcctaaatgacttcaaatgcgaaggtcatttctggatggattcgaaacacatgttcaaaaaagacattttatgtccagcagttgatgagtgtgaactcatcgaatgctatttttgcattgaacagttagcgaatccaacctgttatccattgatttcatcaatgctagcagggggactttgcttatcattcataagcataagctttgtggctttttccatattaaaagtcctgttttcaggactttatatggtcatttggctgataattcaatttatcaggccaataatttatttagctggcccaaatcggcctccgaaagataggaggccaagggcaacagcttctcaaaattggacatcacgccgtgtttacagaacaatggcgtttgttgtccttatggctaactctctccagaatttgactggagcagagaccatagcagtcatggccaaatcggaaaaatgcattaaaaatgcgacaagcatgaaatgcattgtcgaaagttcagcaactttgacgttgctaccagttggccaaacaaacactcttcttctgaaaacagaagaaggtgttctccttggttcaataaacgttgtgcttaaggctttagctttggagtgccaaagctttactaaagcctggcaacgttcatatgcaattaatgttttggccggcaaaaggtgccctaaaatgggctcctgcgaaggaaagtattgtggagaagttcgccacaatacttccattcctgagctaaaagatgccaacgaatttccaggcaattcattttgcctggacagcacagccttttggggcaataaatgcctcttaggcggcagtgcatgccttttttatcgttggtatgctcaggaaaagtccaagacagtctatgaaatcatgggctgcaattcttgggaatttattgtttatgcaataattcgcctggaaaccttgggtgaaaaacccaagtcaactcaagtgttcctctatccaggaagaacactgaaatggaacaacatcagccttactccgatcggagtaacttttccgcccgctcccgtcttaaactcagattttgttttcgacgggaacaacatggctctaaccagagagccattaacaattgactttaactgtaaaagtcggcaagaagcaattgatttcaattgcagtcttggtgttcaggcatgcactgattgcatacctgaccattcatcaggtttagtgaactgcaattgtcgttcacataaccttgaaaaattaatggaaagtccagagaggagacttccattaaacataaaaaattaccaactcagaaatactgggagaaaggtaattgctttgacaggatttagtcctgtccaattaaaccttcaaatcgaaggtctccaaatggctttggaacttcaccaaagcctttgcacaattttgccgttgaacatatctgggtgttacagatgttcaacgggagcacaattccgttatgtgtgctcgacaaattttggcaattctcttgccgaaattaattgcgccgatggaacacatttttcgacaaaatgtgattccaatgcatcaatttaccaaacaattttggcttttgataaagccagaattgacacaaagtgccaaacaaagtgtttggctggaagcacttcttttgttctaagcgggacattacactatgtccagcctgaacaaatagaagattacagcccaaatcactcgggaaaagtgatggatagccaatccagttggcataactggaattttgattggaaggcgaccctttggtctttgattggcctccaatcatcacttgccttcataatgattatttgtgtaggcattgtttgcctaacaattttcattaaaatttctcctttctatagactttggaaatttatttcctggtctttaatgagaaaaagatacggtaacgtgtctacagtattggcaatactgtacttggccgggggaggatccttcgtatgtggaggtgactcacggcctaatgactcactgcctatccctcaaaaaatttctataaatatagaccaactctcatttcacttaccattcatcccacaatttaaactttcacccacgaccaaaatatccatgccttttgagaggaccccttttagcgatatcacaaatcgctcctcaaggaatgaacacgggggagaacctcgtcgtctcgctccctcgggtcgagaaaatatcgacccggaggattttctcttcactgaagaggtggatcctcttaccacagaggaagaaattcctctggaacatccatggaattgggaacaagtgtcagagcttggctctgaccctcccggttccgattcttctcttgaaagagaggtttccccaatttcggccgattcagattggtcgtggactccacccagatcaatctggccacaaggaaatcgcgagcgattgagttcgtggtttccacgaatcttgggaaaccattggtaccaaagagggaggagatcggcagaagcacttctaagagactttcttagaagtggagcctttcttcggaccaatcacctctccaccaatcgcgaactaaccattgatgggttaactcgcggtggagctgagcggaccttaatttaccccggaatgtcg

SEQ ID NO: 83728 - DNA, 633 bp, Heterodera glycines
  Genomic contig location: Contig_ID=SeqID_349; Location=1361..1993; Strand=+
  SCN-specific regions: Sequence locations=1-24,46-373,396-633
gtaacacccagatatgttcaacggcaaaattgtgcaaaggctttggtgaagttccaaagccatttggagaccttcgatttgaaggtttaattggacaggactaaatcctgtcaaagcaattacctttctcccagtatttctgagttggtaattttttatgtttaatggaagtctcctctctggactttccattaatttttcaaggttatgtgaacgacaattgcagttcactaaacctgatgaatggtcaggtatgcaatcagtgcatgcctgaacaccaagactgcaattgaaatcaattgcttcttgccgacttttacagttaaagtcaattgttaatggctctctggttagagccatgttgttcccgtcgaaaacaaaatctgagtttaagacgggagcgggcggaaaagttactccgatcggagtaaggctgatgttgttccatttcagtgttcttcctggatagaggaacacttgagttgacttgggtttttcacccaaggtttccaggcgaattattgcataaacaataaattcccaagaattgcagcccatgatttcatagactgtcttggacttttcctgagcataccaacgataaaaaaggcatgcactgccgcctaagaggca

SEQ ID NO: 83729 - DNA, 586 bp, Heterodera glycines
  Genomic contig location: Contig_ID=SeqID_349; Location=11632..12217; Strand=+
  SCN-specific regions: Sequence locations=1-536,558-586
tcgatgtaaatgaagacaaaatcgttaagaattccatcaaacagccgagtcatgaatcgctggaacgtggctactgcattcgacataccaaatggcatgaccaaatattcgtaaagcccaaactctgtggtgaacgcggatttgctgactgagtcagggtgcatttttatttgccaatatccactcatgaaatccatcgtactgaatacttttttattgcccaacatcatcaaagtgttgtcaatatttggcaaaggaaatgcgtcttttactgtaattgcgtttaggcctcggtaatcgacgcagaaacggattgttccgtcttttttcgggactaaaacgatagggcttgcgtaaggtgaccaggaaggccgtatgaggcctctgtccaaatagtcttgtagcatcgttgccactttttctcggaatgcataaaggacgggccttacacgcattctcaaaggaggagctgtcccagtttcgacgtgatgcattacgaggtcagtttgtgtcaattcctggtcctcaaatgcaaatatttcctcaaaatcacaaatcagttgacaaactggccgttgttctactt

SEQ ID NO: 83730 - DNA, 621 bp, Heterodera glycines
  Genomic contig location: Contig_ID=SeqID_3210; Location=1892..2512; Strand=+
  SCN-specific regions: Sequence locations=1-261,300-331,387-586,613-621
atggccatgctgatgaagcagtttaaaaaaggacaaagtgccaaaaggtaattaacggagccacgaaattccctaataattataattaaagggggggggggggggcctattttaaaaaatactttgtcctaattgttacgtaaatgatacaaaaattgaaaatgattccaaatgtggcgatggttgcccataaaagtacacagccaattagagaacagctgggatttatgtctttgaatgtcaaatgaaactaaaaattgctaatttgaaaattgtttattttaattgaaatttttaccgaattgttattaatgccgtccataattttggcaaaattagaaaaaataattttgttaaaaactgaaatatttaaaaaattaattatactgtaagtggccactaaattttcatgataataaaacaatctaaaagctatcgtatgataccccaagattattttttaggttatgtttaagaaaagatatgacggatttttcacgaaaattctgtaaattggcagttttacgaaacgccaatgttggcagtttttacggaacgacccagcacgaatccatattatggagggtttaggaaattttaaaaaatacacctcaaacaata

SEQ ID NO: 83731 - DNA, 145 bp, Heterodera glycines
  Genomic contig location: Contig_ID=SeqID_3210; Location=27..171; Strand=-
  SCN-specific regions: Sequence locations=1-145
atgcattcctttcttgtactgaccattctttttgccaatttggcatcaaatgcttttgggcaacaatggccaaaagcgactagtgaagaaactgatgaggcaacaattaaagtgtcgggaggcgtcaaagacttaaagtcaagcg

SEQ ID NO: 83732 - DNA, 104 bp, Heterodera glycines
  Genomic contig location: Contig_ID=SeqID_3211; Location=2536..2639; Strand=-
  SCN-specific regions: Sequence locations=1-104
caaaaaattgatagcggcgagttggccaagccggaacagacgcagttggacaaattggcacgacggggcgagttggagcgtgacattgagcagctgaacgaaca

SEQ ID NO: 83733 - DNA, 1055 bp, Heterodera glycines
  Genomic contig location: Contig_ID=SeqID_3212; Location=54..1108; Strand=-
  SCN-specific regions: Sequence locations=1-177,206-296,318-513,536 -563,596-628,650-803,826-1024,1046-1055
atgtcgaaaacttcccaaccccaacaacagcggaggttgtcccacggtggtgacggcaccgagaccaccccaaatgggggcgatgtgcgcgtgaaaactgtttcgggtaggcatcgaaatgtacgaaaacaaaaaatggttggctattatttgcgcgtttcctctttatgggcacccaaattttaaaaaattatcaaaaataaatgcatggatttattaatgtggcatttacgcctttttgagccaatttcattttcatacacgcgacaattgtggattttttgaaaaatttagcgaaatttttggaaaatttgggtgaggctaactaagtctgggggggggggtagtagtaaatttttcaaattttaggacagtggttttttggctgtaaaaatttgtattttggtttttcaggtgaaactttcattgccgccacacaacgggctgatggtaaatttccaaattgttttgcttttttctaattttagaattgtaagtagcgagaaaccctccacatttggggaaaaatggagaattctttcgtcgggtcaaagccgtcggacgcataatttcaccttaatttttagaaaatttgtcaacttacagaaaactcaaatccaaaaaaatttgaaaaatcattttttataatctttcccctctggctaacgaattttgccaaattttttatagatgtagtgttttccagggactttccgagttttcgtgcatggggagaggcatagtgccacaaccacaccaggatggggctgtcgtgtcgatgaattttcggaattaaaaaaaagttttttaaattccatcaaatttgaggcagttggcgcaaaccgcgccgggtgaaggccggctacgtgccgcaggacgagcagccgcgcttcgagtgccgggcgcaggcggagctgcgccagcgcagcggcggcgccgaggacagtggcgccaaagtgccgttgggctgggacccggtggcaatggtcaaaggcacgccgacaaagcaagagcaaatgccatcgaaacagcaacagaaacaaccgcagcaaagg

SEQ ID NO: 83734 - DNA, 1270 bp, Heterodera glycines
  Genomic contig location: Contig_ID=SeqID_3214; Location=1017..2286; Strand=+
  SCN-specific regions: Sequence locations=1-14,36-160,182-536,558 -603,625-650,674-1082,1104-1227,1249-1270
atgttcatgtatttttggggtaattaaaattttaattggccaaaaaaatgcgatgatacaaattgcaacagtgcgatttgagttttgtattcatcactgagaataaacatgaatatataaatgaagattaaaaagaacaccacggttaatttttgtgctaattttttcaaaattttccttattttaggctaaattacctatttctaaatggcaccgcccgtcaaaaaaaagaaaaaacattcccccgtcgctttgaggaaaatgtgagccgaattctttttttttgtcaattgctcaattaattttcccgcatttcagcttttgaccatgcccaacttggcctcaaattggcactgatttcgccacgtttcaatgcgctggtggacaaacatttcgatggcaaaagcgaattggcactttcgagtcactttacaattggcaggatgagaacgagagcaaaattgtttgttaagaagagcaatgccacaactgaaactgtgccatttcttttgcacgaccgtctccgatgcacaacaaaattcgctttaaggaccttcggattgagtaaatcaaacaatcaaagaattatcaatgggttccctttcaggcacattgatcattccgtcagcacatttcttcgttccaaccagcaaatttttgacaaaggcaccaatttggatttgcatgtgtctttatccaaagatgtccagctaatttggaatgcttttgcccgtgaaatttggcccatttttgcgccaaacattcgccatttgaattttatgtatggtcatgatcttcaaaatttgtgtcgccacactacgccgacaattctctccgagctcgacatcatttcgatccattcccatgatttgttgcccggtttgatcgctgatgatgggccaaatgcaactgcggcccaagcattgtccaaatggttgcatattccaacaaaagatggacggctcaaacaattgatttgcagtggtgctacgtcaaaactcaatgcattggtcaacaatttcaaggaggtgtgaccatattttcgtaaaatatttggattgattgccattggcttttcgtttccattgtttaggcatttccccgtgccaccacttcttcggccagctacaaaattcgacttgaaacttttgaatcaacggaaattggcccatttgaattgttgaacgaacggaccaacgaaaagctggtattggagaaagaagaaacaaattataaatattataatatcatcgatttgctgttgaagtga

SEQ ID NO: 83735 - DNA, 725 bp, Heterodera glycines
  Genomic contig location: Contig_ID=SeqID_3214; Location=2506..3230; Strand=-
  SCN-specific regions: Sequence locations=1-625,647-725
atggtcggtaaatgtcggtccacaattttctgctaaccaaattaaaagcatataagaacagggagggcttccatcgaaaaataatcagaacatcaagtccaacaaatcaattttggggtcgaaaatcatgatttccatatttggccatattttggcgttatgtccatatttttgcatttttccataaaaactctattagaacggcccccagcagttaaagtagcttttttgaccggaaaaatttccgaaagaatcatttgcaaattgaatccgcgaccgcgggattttctgtccgcgtcccaaccctgctggttggcaatggctctattgcagtttacacgaccataaaataagacttcaaaaaattttcgttatgttttgaaaaattatgtcaaaatccattgtttatcctctggggatggaaagggacacgccggcacattttttttactcattttttctaacccaactcccaatcacttctgatgtgtaaaagtcccaaaaatccaaacaattaaaatatattcaaacaaaaaagcaacaaataaatgtgaggtatgcaattttcagatcaatttccattcataatgatcgatttatctttcatttcccaataattcgttcattttttcttctgctgtccaccaggcccgggattcattttcatacgaccaccttttgccttcattttgtccgtctttggtggagagaatcgcctaaataaa

SEQ ID NO: 83736 - DNA, 737 bp, Heterodera glycines
  Genomic contig location: Contig_ID=SeqID_18991; Location=235..971; Strand=-
  SCN-specific regions: Sequence locations=1-216,238-603,647-737
atggccatggttggtggcactgtttgcccgcgaggccggcatttgtggcggtggtggcaacaaattctgttgtacggcatcaatcattgggccgcagcatgtgctgaccgcggcacactgcttcatgtctttcaaaggcgaacagcgagaaaatatgcacgaaaaggttaatgaaaatcgaagggaaaatatttttatattccttattaggcccactaattaattaattttatctatgatttgccgaattgaacacataaattgtagggctattgaatattgtgcatgagtagtctatataaattctcttggagtagggttgtcgctgggacgatagtcaaaatctatcaaattggcgatagtcataaaaaatgtcaactagataatctgtgacagagaattgttcataacttctcccattttcatcagaagcttttcagcatatcgtagattaagattttagtccggctcattatactaattatatttaaaatgtcaaaaaaatgaagggcgggggggggggtggccgaaggcccccctcgaggcctcgaagcggccgagtgagtaccatgggcgcaggaaaattattaaggaggagggttcattatttatttatttttgcaaaattaattcataaattttttttcagaaactgctctgaaacgcgatccaaaatttatttacaagttgaataaggcactctgactcttatattatcaaaaaaggagatgaataaa

SEQ ID NO: 83737 - DNA, 118 bp, Heterodera glycines
  Genomic contig location: Contig_ID=SeqID_18995; Location=857..974; Strand=-
  SCN-specific regions: Sequence locations=1-118
cgggcgcgaagcgcccgtctgagcttaacaaatttaaaaaacgggcgcgaagcgcccgttagagcaaaacaacatttgaaaaacgggcgcgaagcgcccgtactatgccgcgaagcgg

SEQ ID NO: 83738 - DNA, 615 bp, Heterodera glycines
  Genomic contig location: Contig_ID=SeqID_19000; Location=130..744; Strand=-
  SCN-specific regions: Sequence locations=1-417,600-615
atgagcctagctcaagacctattgagcccagcttccatgtcgtactcaaatgttgaacaattttccgtgcccctctcagatgagtgcgtccgatcggacatcggtgccgtcaattcagccatttcggcactgaacccatggaaaagcccggccgaaattatggcacaaatttcttcacagttaagcattgcccaagcagcactattggtcaaaatgaattgggaatgtttggagaccaaccaaaataggatggaagcaacggcaccggaacagttcgacttggcacttttcgtggaagcattggaagccacagtggaaatggacgacgtggggaaggaagtgaagttgaggagggacaaactgaacgaatgggctaccaaaacgggcggaaaagccgacaaggagggagataaagtggaacaagaggaagataacgccgaaaagggagataaagtggaagaaatgagagataaagccgaaaaggaaggagataaggccgaaaaagcgcgcaacaaagcggaaaaggaagcacaaaaggatggaaaagaaacagagacatttagaaaagcggaagatcatggagacaaggaagagaagaaggaccccggaggggaa

SEQ ID NO: 83739 - DNA, 612 bp, Heterodera glycines
  Genomic contig location: Contig_ID=SeqID_19001; Location=296..907; Strand=-
  SCN-specific regions: Sequence locations=1-395,417-612
atgtcgcccgaaatgttgaccaacaacaatgatgtattttttctgatcaagaccatccattacgatcaatatttgccatttccaaggtctgtccttttttgttgtccttttttgatttttcaaagactctatgccctttctgttactgttcttgaaacataaatctcgtcttacccttggcatttagcagggatttagggatttgttggccgtcttaagataataggccttgtcctagagcttagccaaacagcagaaggagaatgactattttgagaacaactcaaaatccctaaaaatcccaactattaatttttggaaattttagagaaagagaaagtgcaaagggcaacagaaaattcgccatccttaatcatatgacatgtgtaaatgttaatgccatggaaatgtgtgcttatggagaagaaatcatgggataatttggcatgccgtcgctattcattcattcatggcatggcattaccctcttccccccccccccccaattgtacaatagttgtaatagaatcaggcatgaatttcatggcattgtatggtatgtgccaatgcattcacggcaccctcagcaaattggaggggagggcaaataaa

SEQ ID NO: 83740 - DNA, 657 bp, Heterodera glycines
  Genomic contig location: Contig_ID=SeqID_19002; Location=511..1167; Strand=-
  SCN-specific regions: Sequence locations=1-174,197-522,545-554,585-657
ccccacgacaaccgcactttcgaggaatggtatgaacggttcggcccatttgtggaacaggagggtaagccgatgtcagagcagagcaaagtccgactcattgtaagtaaattggggacggatgtgtacaagcgttacactgagagcattcaaccacaaacaccagatgtgaacgcaatggcagaaaaagcgaaattggatcttaccaaggatcaaattaagagtctaattttcatcaccggtttaggcgaacacaatgccgaattgcgacatcgttgtctcaaactgttggacggcaacgcaaagacgcacagtgttcagatcaaagggacggagtgcacgccgacacaactcaaagaagagttacaggctcagtttccaaatgtaatgattgagttgggagttctgcaaaaagtcgactacagcaaatgggcagcaccaatcgtcgcggtcagaaaagccaatggcaaagtccggctgtgcttcgacttcagcaccggattaaacaacgcattggaaccgcaccaccacccacttccacgtcccgatgaactttttgccaaactcagtggtgccaaattcttctcacaaattgattttaaggatgcttatcttcaaatttgtgttgatgagcaatcacgcagcttttgggcgtga

SEQ ID NO: 83741 - DNA, 364 bp, Heterodera glycines
  Genomic contig location: Contig_ID=SeqID_19003; Location=212..575; Strand=+
  SCN-specific regions: Sequence locations=1-364
atggatatgatggacagactgggattgtcggacaccatcaggaatgatctgaaagataacttccagactgagactgccaaattgaacggagcgagcccgaagaaagataagaaattcttcagaaaagacggccgtggtaagaagcagaacttcttcgccgttggagcaaatgtgatcgccagcttgggagatgaaccatggcgtgccggacgtgtgatcagccagaaaagaggcctttacaacgttcagttttcggacggcacgaccggagaattcccggcaaagagtgtacagccgtacatgccggacgaagacgaaaatttgaattttcttgacggatttggactgaagagatcctcatccg

SEQ ID NO: 83742 - DNA, 971 bp, Heterodera glycines
  Genomic contig location: Contig_ID=SeqID_3217; Location=1059..2029; Strand=+
  SCN-specific regions: Sequence locations=1-400,443-489,524-757,779-971
atgttccaaaaccttggtggtatggccggccttttcgggggcatggctaacgctgcgagtcaggcacagcctccgacttccgccggtgcgactgaggcgggcccacagccgaggtagtctttttcaatttccaatactaacacttccatttccttctcaatccctttcatttcagtgcccctcctggtcaaaacattccgagtggttttgcggaattgcttggttctctgatgaatttaagcaccacagtgaatgtgaatgatttgtcttctaattgttttctaattgtgcttaattattttcagagcagtcagcccccggaggagagattccgtgcccaattggagcaactcactgcgatgggattcactgatcagcaggcgaatattcagggtaggatttgttgcaactttcaactgcttgtttattgaaataaaaattcggcattggttgtaaatttattgaaacaacgctagttaacagattattattgaaatttattttaaaaaacccaaaggggaatttagtttgcagaaaatgttttgtcttaaaaatcgaaaaaaaacatggaccccgtggaactttggcactacacaattctttattctttacattttcagctttgttggccagttttggcgacctttcgggtgccattgagcggctgctgggcggtggcgggcaagggaatgccgataccttttgagagtgacgaagtgctttgaatccattcctgaaagagagctcctccgacgtatttctcccgctgttttgttgtggtgtgataaatttgatcgttccttataattgccccccccccaaaataatggctaaatttcactgacaatgagtgtgtttttatctgcccacaactcgtcatatgttaatcgctttatacacaatgtatcggcttaggacgcgccgtcattaattccattgtttcggttgaaatgtcaattaaactattatta

SEQ ID NO: 83743 - DNA, 794 bp, Heterodera glycines
  Genomic contig location: Contig_ID=SeqID_19005; Location=616..1409; Strand=+
  SCN-specific regions: Sequence locations=1-47,73-127,150-475,505 -672,694-794
atggtgttgttgctgggattggttttggtgttgtgccattggttgtgggtgctgctgctgctggtgatgatagaatggtggcatcggaagcgcacccgaagcaatcggatggtcattaccaccaactgttaaaaaatggcttttttaaatggtgccacaattcgtgaccggaaaatgggtaattgtaaaacagaaagggacaactgggcgatggccaactgggtcacgggaatcttcggtcttgagtgccatacaataatttaggcaccagggatgtgtcggaatgccgatttccggcatttttgtgtcattagaattccgattgccgaatttatttggccgttggaattccgatttctgaaatttttgagagcgtttgcacaaatccttgttaggcatccccgaactaattggtcgcacttcattagcaattaatgataatcgatttaaatttagcaccacggtgaaatctgttgtgatgaggaagatgatgatgatgttgatcatcaccaacagcaatattattgggcggaggtggaggataactcgtcgcaacatgttgcggatggttgtgatgcgggagttggacgttgccatatgagtacagttgctgctgctgttgctggtggtggtggttgaacattggcatttgctgctgctgctggcttcccacatttgcacctgctgctctcattaacattgtgccatcaccgccggcatggacaccaaaagggtggtgaagttggtggtgtacacgctcgtcctgtaaaagaggaacaaaaaatcaaacacga

SEQ ID NO: 83744 - DNA, 3264 bp, Heterodera glycines
  Genomic contig location: Contig_ID=SeqID_19006; Location=1..3264; Strand=-
  SCN-specific regions: Sequence locations=1-82,112-345,370-521,548 -708,750-908,934-934,956-1214,1267-1376,1398-1684,1706-3144,3166-3264
  Gene Ontology: Mol. function=DNA-directed RNA polymerase activity; Cellular component=DNA-directed RNA polymerase III complex; Biological process=growth
tcagtcttggccaaatgcaccaatttttggacatttgtgcactgggaaaaagccgagcaactgcggagccgagtaaacaatgtttttaaataattttatttaatataaattgaaacagtttttgattcatttaatcatatcaattgttgtttatttttcctaggcactgctgtcgtcggtgcaattgcagccacatcaattggtaattacttaaaaaattctttttgtttcacaaacttatggcaaaaatactcagaaaaatccgaacttttaaagaaaaaaattttcatagatttttttaatttaacaaaaaatgatctccctccaccttaagcctcgccattaattaaaaaagaaaattctttcaaaatctgcgatattaagcatggtttaaaaatttttttttcaaaaaatctaattcttttttttcttctaaaaaattcggtaaattaaaaaaatttcatgatcgggaacgatctgctccgctccactgggggataaaaaattttaacagaaaagctcaacattttttctattaaaaatttacctcgcataatttttttatccgataatttttgcagttgtctcattaaataattatatactttaaggtgaaccctccactcagatgacactgaaaacctttcactttgctggcgttgcgtccatgaacatcacccaaggcgtgcccaggataaaagagtaagcaaaaaataaaaatatttttttggcatttttaaaaaaatttacaaatttgtatagaatcatcaacgcggtccgctccatttcaacgccgatcatcaccgtggcattggccgatgagcgggacgaaaagttggcacgacgggtgaaggcacggattgagaagaccacattgggtagcaaagcatttttaaatgaaatcccccattttaaattaaaatattttttattgtctaaatttttcccaaaaatgtatgattttaggagcatttgcgccttgaaaaatttaaaataaatcgtgattttttttttaatattgagattttttttaggatgcattactctccccctgtgttaaattacttttttattttacttcaatttttttaagaaaaaaattgcatattcttcaggcgatatcattgattatgtggagcaggtgtttttgccggatggcctttacgtactcgtcaaattgaacacccggcggatcagagaaatggaactggaggttttttattaaaaaaataaattcatttttgaacttattaatataaatattttgtttctaactaaattccggggcacgggaagcgacccgacgatctgtaggcttcgccggaccaaaagtttgcctataaagctacctcttttagtccaaattttgctatattttttggtcctcccctcctccccaaattttttttatttgatgagggaagcgggggaaggtgaccaatggcgtatctagggggggggcgttatgtcgggggtacgaaattgatgttaaggtgatcctttcctaccaagaagcgaaggatcaggacgcgcaggaggaattcgatcagatgcgctgcggcgaactcgacggatgcgttgaactcatcccgcagacgtcagtcagggcactgcaggaacggatgttcactttgcggtccaatgactgctcgaaagtggcaacggacgaaggaaaggtgggccgaatcatgtcaattttattgggccgaccggtaaaaccggaaagcccaaaggccaataacccattaatgacttttgggactctttcaaaattgaaagagggacaggttgacaccgcgctgtgcatgctcgacgaggtgccgcgcctggtctcccaacaggccgggcccggcaccggcaagacgttcagcgcggcatcgatcgtggccacggtcctggccacggatcccacggcacgtgtgttggcgctggccccgccgaacgtcgccgtcgttaagctggtgctggagatgcaggacgcactggccgccggaaaccacgtggagccgatgcttgccttgttctccggcacaggtaagttgagatatgccaaggaagttgagcggatttccccccacctgctcgccaccgcggtggaggcacaggactttcaggaactcctacagaaggacaaagaccgcgtcaaggtggagcggtacctggacgcctgcgagcggaactcacgcctggcccaggaaatggcagttgccaaaattgtgcaggagcacaaaaaccgccgcctgtgcttcgccaccttgtccttctgtgagcaattgccggcactgtttggggaaacgacgcatttgatcatcgacgaggccggacgaggcgccatacgtccaaatcctcaacttagtaagccaactcccctgcctaaccgaggtgctgatcaccggtgatcgccgccgagcttcgcgtccacttgccctccctgccgatcgccgtccgtgaggacttcggcatggacacggtcatccaaaacatggatgttgcacaagggacggacgtcacaacattatcggtcagttttcgctcacattctgctctcgtccgcggtacggaggccggattttacaaaccgcacgccgagtagttgacaccaggacgcgacgactctgagcgggcactcatgaccgaccaaacggccttcaaattgccgaaaaagggagtccctctaattttggtccaccagagcacacctgcgcaacgcgacgaagtgtccacctcttcgcccaatcctggacaaaccgacacagcgatgagagccctctggcgcttggcgcgggccttccccggcacactcatccgctgcatttgcttctacgccgcccaagccctggagatcgaacggttggtggcccaacaagaaatcccggacattttagtgaccacggcggacgcgacacagggccacgagtcgtcacttgccgtcgtcgtcacaacatgctccgtcttcgacagtggagccgactctcagcctttctgggctgatgccgcacgggtggacgtcgccatctcccgcgccagccatggaatgatcatcatcggcgatttgctgctgctcaaccggacggagacgtggcggcgctacctggaccaagcgacgactgagacaacagtggtcggtccggagtacttcgacttcgagcagttcaacaaccccgacaactattacgacagagacggtcagctgatctcggccaacggcggtgcggtacggtcagagcatttctacagcaagtacggtaaaaatgtgtggtacaa

SEQ ID NO: 83745 - DNA, 2577 bp, Heterodera glycines; identical to SEQ ID NO: 19008
  misc_feature (1255)..(1255): n is a, c, g, or t
  Genomic contig location: Contig_ID=SeqID_19008; Location=1..2577; Strand=+
  SCN-specific regions: Sequence locations=1-449,471-583,620-670,692 -926,962-1130,1152-1267,1303-1388,1424-2057,2080-2362,2389-2577
  Gene Ontology: Mol. function=protein kinase activity; Biological process=actin polymerization and/or depolymerization

SEQ ID NO: 83746 - DNA, 447 bp, Heterodera glycines
  Genomic contig location: Contig_ID=SeqID_19009; Location=1342..1788; Strand=-
  SCN-specific regions: Sequence locations=1-225,248-447
atgccaacgtttggtaacaatgcgcagcatcggccttccaccgttggggcggcgatggcgctggacaaattgccgccgtctccgtccgcccgaattgcgtcatcaccgccatgtaataaaatgaaaatgcaaccaattgattgtgaattcgggttttaaatggtttcattactggtcgaatttcatgccattccagctcgtaatgtaatagcgttgttttgccacaaaatttgaaatggaattccgaattcggaccggattttttggtcgtaattcgttttttcgcttcggaacaaaaaatgtcaccaaacattttgccaagagccaaaccaaacaaaacaaaaaaaaaccaaaatatatttttaaaggcaagccaaaagcgattgatcatcagctgaagcagcaacgccaacatcagatcagtgccattgacgatttgctggggaa

SEQ ID NO: 83747 - DNA, 173 bp, Heterodera glycines
  Genomic contig location: Contig_ID=SeqID_19009; Location=1..173; Strand=-
  SCN-specific regions: Sequence locations=1-51,73-173
tgtttgccttaattttaacttattacatagagaaaacggcaattttaataaatttcacctctacatttgaaactttttcccccctattttcgcccctatttcgcgaattttttgcccctatttaggtccctaaattggaatttttcgcccctaaaaatccccaccctagtgat

SEQ ID NO: 83748 - DNA, 701 bp, Heterodera glycines
  Genomic contig location: Contig_ID=SeqID_19009; Location=602..1302; Strand=+
  SCN-specific regions: Sequence locations=1-28,56-88,112-231,253 -443,499-618,643-701
accctacttatcacattcatcacacattttctctaaaataaaaagcaaataagcagggttcgcagatgcgagactttgaggcctacataagccgaaaatgaaaagcggacatttgcgctccgtttcttgcggaccatttttacccaatccatttgccatgccatttaatacactgcgtttttttgcccgggaaatcaaatggacggcacaacaccagcaaagtaaatgttcaaaattttcattgtaatcaaacaaaaatcatttctggccatcatagaaatggggacacaatgagtgattatacaaaattggcggctggcataactgaaaatgatgagagattatggaaaattaatgacaaaaaaaacgaaggaacaattcaaaaacattttgtgttgtgtgtgggctatgggattttactaattatgattcgatgtaagcacagaagaagaaaaaagaaaatcaaaaatgagaggcaaaaggaggagaagaaggagattttgtagtggctggctggcaaatgtaattagcgattcattggcgataatgagggtaatttgtggcggttttttcgttgtataggcaaaaacaattagcgctgtgtttaaacattaaggcaaaaaaagaaaagaaaagaaaagatgccacacaaaatcattttctttttttggacacttttttccgtcttttattgtttttgg

SEQ ID NO: 83749 - DNA, 293 bp, Heterodera glycines
  Genomic contig location: Contig_ID=SeqID_19013; Location=2908..3200; Strand=+
  SCN-specific regions: Sequence locations=1-163,205-293
atgtacgaggccgaatttgaaacggtgaggagcaattgtaggcaattaattaaatggctaattgggttaattggttaattgattgtcagatggacaccgccgattcaccgattgtcagcaaaacgatgcttatcccaccaatggaatacagctgttgtgggctgaatgaggaggagatggagatgaaatggggaaggcatttgacacgcgtgtacagagacggagaagtgccaataacggcggagagggcgaaaatgatttgtgtgatgaagggggcggaccagcgcaaaaag

SEQ ID NO: 83750 - DNA, 954 bp, Heterodera glycines
  Genomic contig location: Contig_ID=SeqID_19016; Location=422..1375; Strand=-
  SCN-specific regions: Sequence locations=1-244,266-716,738-954
atgaaggttttgtgtgaaattgttgcggttatgctgagcaaaagtttcctggacgaactgtttgaaccccgtgaaatgtacacgagacaaggacttcgccaacactttgagcaaattgcgcattcttcggtgatgcgcctcaacgaggccaggtagataagcacataatgaggcacttagattaagccgggtaatgggatttattagcagcaaattccggataaaatagtaaaaaactcggaacagaaccaaagttcaaatcagcaagggtggaggtgcggacaaaaaaatcccgcgggtatcgatcggatcggcggaatcatggcggattgaaaatgacaaatcgcttttgatcaaggaaaaaaacgccgcggatcgcgatcgcgctccaccctctgattccaaacaagaaacagaaatttaaatcttggggattttgagatttccgttacggtaccgcagaattttaaagaaaaaccatcacactactgtatgaatggtcaaaatttgatcaaaaacacattaagcatggttaaactgtttgatctgatgacaatggcagtcaaataccaatttttgctgtgcaaagagccgtcagaaattgtactggtgacaatgaaccatttggacgggatgaagacaattttcaaggaccaccaggacatcattgagcgcattgatcatgcaagcaatttggtcagatgttttagctaataatctaataattagaaaaattactcaatttaagcttatggaccatttcggagacactcctttatgggtaatttcaaaaaaagtatacaaatatcaatatagaagttactgtaattaagcaaatgtccgcaataaggtgcgaattgcttaattttttgagtggaactcgtgtcaaagtttcgctgatgttacgagaacatcgccaacttgacggtaattaattaaaatgtgtctaataaa

SEQ ID NO: 83751 - DNA, 954 bp, Heterodera glycines
  Genomic contig location: Contig_ID=SeqID_19016; Location=1885..2838; Strand=+
  SCN-specific regions: Sequence locations=1-19,126-149,179-207,228 -343,365-748,771-851,873-896,918-954
atggcaaatgtgggattggatataaatgattaattaaatagtataaataaatttacttataaatattgggttttttatttggtaatttttatttatttaaaaaaaataaaattgaaatataaattctgattaagtaatttaaggtctttaacttttgttcttttttaaaattaatttccaactgtaataaatctccgaaataaattttatatatatatatatatataaaatacctaattagttaagggatgataaaaataaataatttggcaacaatatgtaatttacgtgattttaggtctccgctattaaggatgggctttgttctggtccaacaaacagttcgccatcatcttcatcatcagctgatgatggcatgcattattcgctggagggcagttggtccgacttattcaaattggacgaatttggcggaatgttatgcatcaaaaaaggattgcatttggagcaacacgggcaaaaaatccaattgaaagcgatagccaaacataacggtgataacaacattcggagtttcaacaccacattttttgcctatggcaaaaaaattcttttgagaaaaatttttaaaaatactagtgatttcgttggatcataaaatttcaagtttttcttgacgagttcgagatcacgaaaatttaaaataatttaagcaattaattttttccaaaatatctcatgaaaaattgctggaaattcttttcttttttttgttgttaatttataagcggaagaataattttgaaactcaattttaagtatttttagttaaaagataccctgttttgaacagcttttttaaccttttcgactaatttagcatatattttaaaaaattttgtgggtttttagcagttattttgatggtaaatcccaccacagttcacaaatgaaaaattttactattcccccatttatttacaaataatttaa

SEQ ID NO: 83752 - DNA, 317 bp, Heterodera glycines
  Genomic contig location: Contig_ID=SeqID_3219; Location=209..525; Strand=-
  SCN-specific regions: Sequence locations=1-244,266-317
atggctctcatccttggctccgtggtcacttccccgttgccaataatgtgccaaattctccttactgtacagctcaaactcaacaaactgcgatttttggtgctcgacgaggcggacaagctgatctttgactcgatcttctttaagtctgtgctgaaaatcaaagatttgatgctcacccatcacaaaatgcagcgcgaatttgacaaggtgtgccatgcaatttggccctgtaaatcatggctatttttgcttttcagagtgccgtttctctcccccctcgaactctgatgctcagtgccacttacggagattcg

SEQ ID NO: 83753 - DNA, 503 bp, Heterodera glycines
  Genomic contig location: Contig_ID=SeqID_3221; Location=838..1340; Strand=+
  SCN-specific regions: Sequence locations=1-58,80-466,489-503
atgcatctgacccaaaaattgcaaaaaatagccaaaccacttcagcctcgaaaggtgcaaaatagcaaatacctatatgatattgtattaattaacaattttcagtatccatttgtcgaacttgttcctttgatgggtaaaaatcatcttgacactgtctcagagagagttcgcggtatctctaataattcttttttacatacatataattttcaaaattcaggaatccatccatgtgttgaagaaagacataatttgtttgcatgtttgaaaaaatgggactacgacgacatgaaatgcacaaaattctccgattcattattcgtctgtttagctaattttgagagcatttaaaccattttacaagcttgattttggaatgtcataagtagggaacggatttttaagggcgaaaaattccaaaataaggccgtaaataagggcaaaaataaggtcgaaaaaattcaaaatttaggggtataatttttaaataacttttttta

SEQ ID NO: 83754 - DNA, 778 bp, Heterodera glycines
  Genomic contig location: Contig_ID=SeqID_3221; Location=1861..2638; Strand=-
  SCN-specific regions: Sequence locations=1-778
atgcccgagggcacacatttgctggcaactgtctcttgcgcgaaaggtattatgactgacaagatgaagattgactgattctttttttttttacttttgtgattttgtatcaattttatgccatttgaaaagcttcagctgaaatccaactaaggttttacaaaacaattgagtctttttcttaggcgcgccatcccttcatgttcttccggtggaagtagtccacgtagtacggcatgtgtccgcggcgcttcataactttggtttggatctaaactattcgagttatgggactcaaattgtgagaaaagacaagcaaaggactcgccgtgccaagttcgggctgtttccatttgcggaaaagccggtcaatgtctgcttggagtatgttggacgcctccgctttcacactgctacccttagattcagggaatgaattagttcaagaaattatacagaaattaaggaccacataaacgatagtgccaactttcataaatcgaggtcccaacaatttaactgttaaactgtcaatccttaaaatctatacaatataaatacggatttactgtcgcattaatttaattccagagttcaacagatgcgagtattcgactaacttcatcgacgatgtgcaagggctgctctcccttaattctttgctcattgtgtgcagcgacaatttttttgtttgattccatacaactctaaattgtaaaagattagtagtctttttcaaatttttggttcaaaaccggctctaatacccggaaataaa

SEQ ID NO: 83755 - DNA, 536 bp, Heterodera glycines
  Genomic contig location: Contig_ID=SeqID_3221; Location=3626..4161; Strand=+
  SCN-specific regions: Sequence locations=1-536
atggcatcggtgcaaagtttgggagcggaggccgaggatttgggcggagatttggtcgcaaatggcgcaagaatggaagggacggacgcctcgaaacgattcgcgaagggacgtacggaagagacacggcaatcgaacagaacggtgagagggcgggacacgggacggtgcagagaggcggcagaagacgaggagtgaccgtcagaagaaatgagatgcagcggcaggagcaatcgatcggccagagcgacttccatcttaaagcgatcagcggacaatgcgacttccaatggcaaccgatcggatgggacgacgtctttcagcgagaaatcgccagaggcaactcttttgtgacgtcatttggaagaattgacgaagaacgtgcagaaaaaccgcagcagtcggtccgtggaaggggaggaggacgcggacggagtgcaaacggcggacgggggagacgcggaaacggcgccgggcgcggatggtctcgcggagcatcgcgaaactttgaccaaggtggacggactgatcactaa

SEQ ID NO: 83756 - DNA, 172 bp, Heterodera glycines
  Genomic contig location: Contig_ID=SeqID_3222; Location=1135..1306; Strand=-
  SCN-specific regions: Sequence locations=1-172
atgcgtcgtataaagatcactgttttctcggaccgggactttgaaaagaccaccagttacggaccggaaggcatttttcgggttgatgtgccgggaacggagcgattggccaaagagtcattcgaattttgggcgaaaaccgaaaaggacgagttggcccacaaaactggcg

SEQ ID NO: 83757 - DNA, 669 bp, Heterodera glycines
  Genomic contig location: Contig_ID=SeqID_19019; Location=234..902; Strand=+
  SCN-specific regions: Sequence locations=1-579,601-669
atgggaaagcgcgcgttcgatcgcctggacgcgtcatcgcttggcttaagcggctataacgcctattggccggaggaggagccgctgaatcggctggcatttggccaacgacaatttgcggatgccgaaacggagcaggaaaagccgactggcagcaaaaagcatcgccgatggtcgcgcccactcgcgggcacaaagcgccgagtgaatggcttcggactgtttggccaattgcgattatagcgcgccagtctctgatcgatcctcaatttcttttttttgtatcgggccgcttttgtcggatcactgtcctgaactgaactagtccaataatattattgatcaacatttctgatcagaaaatcacattggattgaaccggaattatcccttatataagctttggattttgatctgattaaattacttttctgatcaaaaaattaagaactgctagttttaaggtgttatgtatgagttgacatgatcagctttaaagaaccgtgtttgatcagtattttggcttgttttttttgatcacttgtatttggttacggttcttttgtctgatcgatcataaatgtgttatttctaaaattggttaatcaatgaaattttaaaaaaacgaagataatttttcaaacccagtaaatttatctcatcgtaata

SEQ ID NO: 83758 - DNA, 258 bp, Heterodera glycines
  Genomic contig location: Contig_ID=SeqID_19020; Location=1295..1552; Strand=+
  SCN-specific regions: Sequence locations=1-64,116-224,253-258
atgcccatcatgttcacatttatcattataactcagctgctatttgtgcaacagtttttcgtggtaaaattgaaatttttaaattaattttaaataaataaattttgttttttttgcaggttgttgccaggaatgttaatgggcattatcctgaaacatattcttcacaaaatttgctgtttgacgacggcgattcaatgccaaccgaaattaaaacgtaaaagttttttagaatttataaaattataatatgatgca

SEQ ID NO: 83759 - DNA, 650 bp, Heterodera glycines
  Genomic contig location: Contig_ID=SeqID_19023; Location=1642..2291; Strand=+
  SCN-specific regions: Sequence locations=1-38,180-268,377-391,428 -478,560-614,637-650
atgacaataactttatatggtaagtttattttgcgatgtattatatttaacaaaaaataaaaatgttttgaaaaatcaatgatatatgagaaaataaaaaaacattttttttaattttgaaagatattagataacatttttactatttaatcttaattatttatataaaatgattaatacaaaaaagaaagcttgcaggctaatttaaaatttatggaatgaaagaactcttattcgttattattttttttcaattaacagtataagctttttttaaataattaattaaaataatttagtttaatattataatagcatttaaaaattaaataaattaaatgatttttaatcaatgttaaaaaataattttttataagcctgaacaattgcgttaatattaaattattattattatttaactaatattcaggtcatattcatcaaagcatcaaacgagacacaccaaagaaatgataagtttaaatattgaattttatattaactttgtatttaatttttatgtcttaaaattatttaaattttagtttaaatataaatactcaactaactatagtgacggaacaattaattggaggaaaaaaaagtcggcaatattttaatatttgaattttttaatcatcctcaaaaaa

SEQ ID NO: 83760 - DNA, 1119 bp, Heterodera glycines
  Genomic contig location: Contig_ID=SeqID_19028; Location=1337..2455; Strand=+
  SCN-specific regions: Sequence locations=1-252,302-429,451-636,659 -1119
atgccgtcattttttgccattttttcattttcgttgctgttcattttgtgccatcattgttcatttgccgcttttttgatcaccaattatccaaatccgttaaacaacgcttcgctgtggaaatgcggcatttcctcgccgggccctttgtgcgacccggactcgctgctcaacgaaacggcacggcacgaggcattggagcttttgaagcagttccaggaccaaacggacattgatgtgggagaaacaatgaaaaaaaacaaaaaaaaaacatttaaaataatgatatttaaatttaatagagcggatttctcggttttattgtattttaaaaatccaaacacattatttaaggaaatcagaaaaattaaattaaaattccgattattatcatttgtcacaccaaagaaatttaaatgttgaaaaaacataaattattataattttattgaaggacaatggcgatggcagctgcaaaggcaaaggagtgattgttgggttggcgctaacgaaacagccaatcattgcgagggtattaatttttaatttaatgaccaaattaccatggaagtcgatactcattcagtcttcggacttatttggcccattccgttttatcactcctttacactgccgaacaaaatcaaaaagcatattttaaaaaattgagggatcacggctaaaaatgccaaaaccgaccattactgcctaaagatccttcacgccattttaccaccacagaatgcgcggatcaatgtgacggacgatctgatgaagaacatttggcagttggacaatcggtgcaacaaggcgctgatgctgacgctgtccgtacagccaacccccgtggtgcgcttcactcggtacatgaccacgccggtgtttgacgacgagttgcaccacctgatctggactgaggtgtcgaccgaccgggaattaggcactcaccaattttcaatcaatttattttccaattagatactttaattttgtttgaaaatgatcgtagtcgtgtgagcttttctccgccattggatgttttacagcaataagttaccgtatgccaaattcgtttggattttcagctgactcttaataatcttttgattttaatgaaaa

SEQ ID NO: 83761 - DNA, 265 bp, Heterodera glycines
  Genomic contig location: Contig_ID=SeqID_19029; Location=1332..1596; Strand=-
  SCN-specific regions: Sequence locations=1-111,146-182,204-207,244-265
atgaaacccaaaccgatttatgacagattaattgaattgttatttattttgaaggtaaatgctataaattcttcatccaactcgtgctccgcttgttgaggatcaaaaagcaatattttaaaattctataaaattatttttttaagcacatttttatgttgatatcacgtgtaattttttatcttcatgtgttagatctcagatttgtataaaatgaaattattttatgttttatttttattacaaaatctttaacacaaataaa

SEQ ID NO: 83762 - DNA, 398 bp, Heterodera glycines
  Genomic contig location: Contig_ID=SeqID_19032; Location=202..599; Strand=+
  SCN-specific regions: Sequence locations=1-398
atgggagtacgtaacatttttcaatgataaatcaaattattatccattacagttccagacggcatgaggcaattgttcaacccggctcccaccccgccagtgctttatgtgttcagaggaccggcccgaaatggagttgcgatttttaacccaacaattccaccgccacctccggtccttcgcgccccgggaacttagtgccgatcaaacaattggacgattttaggaatgatttttggataattgttaaccgatccctaaactgttgatctctcataaaagctgtcttccttttaggggcatatctttcattttaagggaaaagctaaagaaaatagtgtggtgtgacgggtgaagatgctatgaaagtggtgaaaataagtgataggcaattggaa

SEQ ID NO: 83763 - DNA, 741 bp, Heterodera glycines
  Genomic contig location: Contig_ID=SeqID_19032; Location=1790..2530; Strand=+
  SCN-specific regions: Sequence locations=1-312,334-613,641-741
atgtcagtgaatttatattgtaaaggaattacagaccctgtagtaatacctatcagaccgaaggagcaaatatctgcggatacgattcttaatgagtttattaaattacaacaatcgtattcggaaatcaatttactcgatcaagaaatatcagtaattttcaccacttattcaacacctgcaggaagcggtaaaaaatataattaattcatatgctcatcatttttaggcagaaaatcaaataaattaatggaaaaaaatgatcttagtcgtattcgtatttctaacgctgacaatttctgtaaggggttaatcaaaaaagagaatttaaattgtttttcaggtttattttatgccttagagctcacccgtcattaccagctcattaacaatgggataacatataaaaaatatttatgtgttataaataatcaaaaaaaacaaaaaacgattgtgcgagatttgatgaatgaggcggacattaatcaaaaagaaaaatcctacgggctcgatcatatcaaaataattcaaaatttttgggatcaaaaatattcgaaattatatagaattgtagcctttgattatgtaagaacattctcgaaaaaactttctttatttgtgttttagaaatgtggtttgaagcctatatttaaagcagaaggtgggaggcggtttgaagttgctgttttattgcaaaatggacattggtgtggactgaaaagaatcagacgttttttcaat

SEQ ID NO: 83764 - DNA, 533 bp, Heterodera glycines
  Genomic contig location: Contig_ID=SeqID_3223; Location=135..667; Strand=-
  SCN-specific regions: Sequence locations=1-98,120-346,368-533
atgccaatccgattcccaaaaggatttcgttcattggccaaatggacttccgaaaggttttttaggttggtcgatgaactttcgaaaaaagatattaataaacaatttaaaaatgatttaaaaggtcattaaagtacagaaattgagttcttctccgttaatgaggccattaactgaagtttgttgtatcgatatgtaccaagaagtgtgcttaatccacgaatgagaaaaattaaagaagcaactaagggaaatgatcagttgtttggactcacaaaaaagggtagaagtgcaaaatgaaagggattaagccgaaaaaaattcgggaattgaatttttccatttcaaaataataaattattttattgttacatggattattataattatttagcaaaatccgtccttcgctttctccacttcctttttcccaccagacattcgttcttccgcccaattttgacggaaatttattatacaatatttttgtgtggcattctttggaaatgttcaaaaagaaaaagccgttttaa

SEQ ID NO: 83765 - DNA, 478 bp, Heterodera glycines
  Genomic contig location: Contig_ID=SeqID_3224; Location=96..573; Strand=+
  SCN-specific regions: Sequence locations=1-478
ctaaatcccggctttgacaagcgatctttcgattccttcactggccccggcttcactgggctggacaagcgggccgctttcgacaccggcttcaccaattacgacaaacgcgcgttcgactcgttcactgggcctggcttcaccggacttgacaagcgatttgaaccgtttgatggtaaaaaggacaaccctttgattatatttgatttatgttttcttttttcaggctatggcttcaacggatttgagaagcgatcgttcgattcgttcatggggcccggcttcaccgggatggacaagaaaaagagggcgttcgattctttcacggggcccggctttacgggaatggacagaaaatgaacacaaaatggacggatggccaaattcaatcaaatcgttaaaatttgaaatttctatgtgaccccagctgttttctttgctgaattgcaccagttcgatattctcaatttatgcgcca

SEQ ID NO: 83766 - DNA, 978 bp, Heterodera glycines
  Genomic contig location: Contig_ID=SeqID_3224; Location=881..1858; Strand=-
  SCN-specific regions: Sequence locations=1-9,52-526,548-978
acccacaggaaaatatcattttattattttaaaaaccaaaattttattttagaaaaccaaaaaatgggaagtgcccattttcttggcccaattttactggtcgcttttgcggcgcttatccttggccaacgttcgtctccaaatcactcttcgggatcgccttcacagcgtgagaaatcacatggactgtctcaacagggaaaaggccatggagcaaaagaggcaccggggcaacagatcaaaaacaaagacaattcgatgccaacaattaaaaaaggaacgtcgacgaaaagccaaaaaaagggaaaaggacggcacgcaaaaaacaacgacggaattggcactttgggaaaaagcaaacgacagaagcgattcctcacagaaatattcggcaattcattggacaaatcgaaaaataatgcggaagagagtgaacgcaaaagagaagggtttggcattgtgccagaaaaagtgaagggaaaagcggaaaaaacaaacgaaagagcggcagaaaaagcaggtgaaaagaatggaaacggaggccgccaaaagcgcttcgatgaaagaatcctcggcaacaactcatttgaaccgcccgttctgaatcttggcccaaattggccaccccctcaataccggcacatttctttttccgatgcctccaacaaaagaggacagcaaaaagatgaagcggaaaagcgcaacaaacgaagcacaagccaagaaaatgaagcggaaaagcgcaaaaaacggagcataagccaagaaaatgaagcggaaaagcgcaaaaaacggagcataagccaagaagatgaagcggaaaagcgcaaaaaacggagcataagccaagaagatgaagcggaaaagcgcaaaaaacagagcataagccaagaagatgaagcggaaaagcgcaaaaaaagaaacattgcggcaactgggaaaagcggacgccctcgcggaccgattttgcccgaatga

SEQ ID NO: 83767 - DNA, 1708 bp, Heterodera glycines
  Genomic contig location: Contig_ID=SeqID_3225; Location=467..2174; Strand=+
  SCN-specific regions: Sequence locations=1-10,32-254,276-637,690 -812,844-1117,1183-1198,1220-1387,1422-1629,1651-1708
atggctcgacttctgttgcggctttttggcttggccttcgttttcgccgttttggcctttggcactgcgcagcccccgccgcccttccaagggagcggttcgttcagagaaggtgaagccatcaatttaaatatttaatttgttatttttggcattttaaggccaattcggcgcccctccgtttggtggctctccgccgtttggtggcaattcggcggacgtttcagtctcggcgagtgattcgtcggaatgcagcggaggaggaggaaatggagtgcaaggaggtgaaacaaatgcgcatttctactctataattcattaattcaggtgggcattacggtaatggcaatggttacggtaatggcaatggttatggcaatggcggctttggcggaggcggtgccgaaggtggccaagggatggacatcgatgtggatgttcagcagtcatccgaggaggggaaacgacgccgtaaaagacatagcggattcggacaattgatcgacaaaatcaaaaactttgttggcggcaaagaatcgatggagaggggtaagccaaattagcaaaggaacaattagtgaacgattaattgacccgggattattatacaatttgcaaaattgtaaggttagttaagtattttttaaaacttttattttttaaacatttttcatttttttcaaaataaagtcatttttgccccttattttttaagaaaatgataaaaatgggttccgtccaaaacgcaactataaccctttgatgatgggagcaatgggagcatcgcaatatggtcaaattgatcatcaattaattaacaaaaatacaaacatttgttcccaatttgcaggttcgatgtacggctcgccttatcagtcgaactcggcttatgggaataatcaacagtttggatatccgaacaatcagcaaaatcaatttgggtactctaatgaccagcaaaactcaaattatcaaatgcgctaccaacagcagcagggatttaacccccaattgttgcaacaaaattcgaatgatcccaacgatttttatcagcagcagcaacaatataattcgaatcagcaatatggtgcgaatttggcacaacagtacgacccgaatcagcagcagcaacaacagcggatgatgatggcaatgatgggacagcagcagcaacaacagccatttcagcaaatgatggcaccacagcaacagcagcaaaactatggaatgtattgaaacgaaagattgagaaaagaatgaatgagtcatcgaaatggaaaaaaggagaagcgattgaaattccttatttaaaagtgaatcattcactgatcggtagtacattaattaaacaagaggaatgttttatttgctgctaaaaaggcgcgatgagaagagcgaagagagaaaggaacgggggaaggcatgacatttgtgtcaccgtaattttctctgctaaaattggggaattcttgggcgggggagtctgtaagtctgtaattacgggtttagtcttttttttttaaagtagcaatttggggcgctcacacaacaaagtcaaatccgattgcgcggcacgcgccgcaatgattcctttcctcaaagagtttttgcgcttttccactcatttgtcagcccactttttgttttgaaaatgtatcatttgtaaagcaaaattaaaacccttatcagaaatttcgaaaatattaaa

SEQ ID NO: 83768 - DNA, 863 bp, Heterodera glycines
  Genomic contig location: Contig_ID=SeqID_3225; Location=2471..3333; Strand=+
  SCN-specific regions: Sequence locations=1-153,175-785,813-863
atgatcaaaaaaagtgccgtcattccttcccttttgctatgcgccattttggtcgcccaatttattgagcaggtcaaaatcaaacgaataattaagagctaaatatccattaatcgattgcttccgtcgttgtcccctttaaggccaatgcttactgttgtaaagtgtccgattggccaattggccatccgccgaactgcaacatttttggctgcaactgcgactgtctccattgtgtgaacggttcgccaaatttggactgatcatgtccaaaatttgaatcgatgttattcagtgattgagaagggttgttgcattgcgcaaaagacggggctgaccgttggctgctcagaaacgcgcctcaaacgccacgcgctgccgcaacagccgaagcgggcggaggccaaagaggtgtttcagcaagcggacactgacggagacggggcactgagcatggacgaagcggtgggacgaaaatgaaaagcgatgattaggaaaaagaataattaagaaaaacggaaaatgattgggaaaaaggataattaagaaaaaggagatgatgggaaaaaaagaaacacagattattgactaaaagaaattaaaaaaatagatttatgtttttctaaaccacagcattttgattgttttcaggtcaactttttggtgtctaaatggaacatgacggaaggtgagctgaccaaccccgacaaacgccattggttcaccgaaattgacgtgaaccgaaacgaaaaattggagcccgaagagatagacgaagcaatgacaaagtgagagaaagaaggagaagaaaagcggacaaatgaaagaccaacggaataacaaaattagcaaacatttaaata

SEQ ID NO: 83769 - DNA, 865 bp, Heterodera glycines
  Genomic contig location: Contig_ID=SeqID_3226; Location=81..945; Strand=-
  SCN-specific regions: Sequence locations=1-170,242-865
atgggcaatgtccaaagttattcgacggccgaatgcaatttcaattgtgaccccgaagctgcgcacattgtgctcaaggagatgcaatgtccggtcacaattgtcccttgggagacatttatggccaaaagcgatcgaaaagttggtcgattagcaaagacataagctcaatttttaaattgggaagaatgaaaaatgaattttcaatgaaagtattttttaatcaatttttttttaatttccacaggtcaatccgtcctgctgtaaatgcttttccctctcactttaagcatggcattgactttcacgcgcatttgtccctcgacgttccgttggcaaaattcttcgccacagtgaccaatttgggaagggcgcggatggaagcgaacaatcgccaatttgcgtattgcgacgaaatcgccgtgggaattgccatcgccgaggggaaaataattcgggaggcgaaaatgttaagggcgtcggtggaattgcacggggaattgacgaggtaagcagcggaaaaacggaggcaaaatgatggacaattcccaaacagaggtcaaattgcggtcgattggacaagcgttctttacggaatggacaacggattaatcggtaattaatcattcaaaaataaattaacaggagattaaatgcatttgtaaaaagtaattatgccaaggcgaacacccaaagttgtgcaagcggagacagcaaatcgaattcgtgttggattacgatgttcaccgattggaccgaatggtcactgaagcgattgaaaattcggcaaggaatatagacaaaagcctcacaattgatagcgaattatcacttgctgaacgcgaaaataacaacgaagaataaa

SEQ ID NO: 83770 - DNA, 901 bp, Heterodera glycines
  Genomic contig location: Contig_ID=SeqID_19035; Location=883..1783; Strand=+
  SCN-specific regions: Sequence locations=1-327,360-618,654-667,689-876
atgtccgttttcactttcttcccgtcagatccctcactcgaaaaattgtaccaacaattggtggtggaccaagacttggacggttggcagaatgtccgtggaccgagggacgaagaggacaatgccgagtttgaggtggtcaaagcgcgccgaaaggcggaaatggacgctaaacgggaacaggtgggcaaattaattacgattgaaaagccattgatgccattcgttcagtaaatttttattccttttaattcatggaattttcggcggcaaagtggcgctctttaataataattataaacccgactggctattgacccttatttgttaagtttgtaaaaatatttttcagaatatttctagtcgtgaatgggagttcccgggtttaggaaaaatggaaatttgactaatttcttaactaatttcattcaaaaaaaaacaaaaaattcctttagtgttatcgccttatatgagtaaaatcgcggtgcaccccaaaactccgccgcccaaacttcgccgagacataagtccgccgaggcaaaaaattttcaaatttagaaatttttcaagaaaaaaattctagaaaaatcaaaaaattttcctaagatttttttcttgaaaaatttcttaattttgaaaatttttttaaatttcttcttggcggaatcgtatggcctttggcctgagaatcacttgcgctttccgttttcattttggttttgcaatggtttcaccccccccccctccctccaactaggacaaaatagtcaaaaactaggtttttttcctttttttaaatgtttgccaatttttagtttcgtggcaaacgcgaacagctcataaagaggctggagaagcagcaatgaaaagatctcaccattttatttttgttttgtttaga

SEQ ID NO: 83771 - DNA, 1482 bp, Heterodera glycines
  Genomic contig location: Contig_ID=SeqID_19036; Location=1195..2676; Strand=-
  SCN-specific regions: Sequence locations=1-89,111-119,141-337,359 -524,546-1079,1101-1186,1208-1482
tcgctgttctcttccctctcccttttccgtctcttttattttaatgccaaagtccatttgcggtccatcgccaattgggcatccgctgtggccatttggttggtccctcctcctccaatttcctattaaatgcacattttgaggtgtgtgatcgccgtgtgtactgatcggctaatcggaattcgcaacccgttgtttgcccgggggcacgtcccccggcgaaagatggcactgctaatgggcttcattttggcggtgcctgcgttgctcaccgcacaccagcacttctcccacaaatgtctgatccgcgccttttgcaacggcacgcaaatccattccatctgtctgccggtcactcaggagtttgtggcacttttaaatgcttgcgacaatttccgtttgcagagaatggcccaaaaaggccaatccgtactccgtcgcttttcgcagatttatcgtaagtcccccgagggagagaacttggcaaataaatatgcctttagtcaatcagcacgttgataaacacggtgatcaggtgaatggcaaatgccaacgaaagttttccctcgtccacacattcactccccccccctctccccactttcagtgtcattttccccatcattttgctgaccgtcctcaacgttttgttgctttgcgccctccggcgtcgccagagggaactggccatcattggcaccaccaaacagatcaagtatttattggcgaatgatcaacccactttttgacaataatttttccctctttgaccccttgggctttcttttgctctttctccccaccgttccgtccgttttaggccctcaaagtccacttcttccgagggtctctcccagcaaatggttcactccaaaactgaacagcgagtgacgtggaccgtcactttgtgagttccatttcaattcagatgaaaggcgtttcgcttctcattttgcctttgtccaaagaatcgtttcgatgttcactttcactaatggcccttccgccgttattaatttgatcgaaggctttggcattaagccgccgatggacagcaaacaatggtacaattggacattaatcgcaaggtgaaaatgggagagggggggggggtaattagctaataaattaccaccacaaattggcatacctattacagtacattggttatccttggcaaagtgtccaatttcattttgttttgtttgtcttcaaaacactttcgtcggcgtctttttgcacttgcccaaaaacgagcgaacgggcgactcggtgagtcccccgcgggaattccttcattaaattcgccctcctcggcttgttcagcttcgtttcccaatcgacaccgatcctcttacacggcaatggacaatacaacgcggaggggtacgccgaagtaaatgttcaatgagcgtctgagaggaagagcctaccgattcgaaaatgcctgtgccaacggtacactgcgaaaaaggtgacgtt

SEQ ID NO: 83772 - DNA, 383 bp, Heterodera glycines
  misc_feature (371)..(371): n is a, c, g, or t
  Genomic contig location: Contig_ID=SeqID_19037; Location=500..882; Strand=+
  SCN-specific regions: Sequence locations=1-127,149-302,324-383
atggaacggatggtcacattcccgagcacatgcgtagcaacttatcggcttgaagaaaggccaatgcgtttggtgcgcaattgcaatttggtggaccagaaaatacgattataccgcgatcaggtcgaaaaagaaattaattttatttggtatatatttaatagtattatcttgaaattatgaaaattaataagtttccagcttttcggcaaatagtgaaaaatggtaatctctttaaatactattaaaaatatagaaaaaattcaatttctcgttttctgttattgaatggttcgtacaaaaatttttgtaacccaagaaaaccgaggatggcttcctctaaaataataggagtatttatatttcattanaataataacata

SEQ ID NO: 83773 - DNA, 104 bp, Heterodera glycines
  Genomic contig location: Contig_ID=SeqID_19039; Location=71..174; Strand=+
  SCN-specific regions: Sequence locations=1-104
tgtccgttgtggtgctcactcaatcatggggagcgataatccatcgcagaattaaagtacagactatagggaagctattccggaaggattcggtctctccataa

SEQ ID NO: 83774 - DNA, 418 bp, Heterodera glycines
  Genomic contig location: Contig_ID=SeqID_19040; Location=765..1182; Strand=+
  SCN-specific regions: Sequence locations=1-9,31-217,239-418
atggtggaccaatttttggaggaaatttaccaggaaatttgtcaggaaaatgagcagaaaaagtgccaagaaagtgagcagaatggtaaaccataaacaaaatgaataaaaataaacctgaaaaaataacttgggttctgttttatttttttaattgcaataatttgagttagggggcgattggttgggtcttagattcttgaattgtttgtttcggatgtcttaaaatatatttgatttgacaagatgtctaatcataataaaagtttaaccattcataattaattgtgcatttttaaagttaacggaaccgacaattggccaactcaagaggacaatccgccgacagaggacagtgtgccgcatgtgccaaagcttatccacggtagtgccataccaaaaccgatggattgaacca

SEQ ID NO: 83775 - DNA, 950 bp, Heterodera glycines
  misc_feature (1)..(1): n is a, c, g, or t
  misc_feature (78)..(78): n is a, c, g, or t
  Genomic contig location: Contig_ID=SeqID_19040; Location=1644..2593; Strand=-
  SCN-specific regions: Sequence locations=1-950
nccatgcccaaaaccatcctgcaccgtgcaaagagtccacatcgactaatgccggaccatttttcggcaaggaatatntaatcattgtcgatgctttttcgaaatacccggaggtattcgaaatggccaccaaatcgacagcggcaacaatcgaaaaacttcgatatttgttcagccgacacggcattccggaaattttggtgtctgacaatggcacccaatttacgagcaacgaatttgctaaatttatggccatcaacggtgtcaaccacctgttttcagcgccgtataatccaatgtccaacggccaagccgaacggttcgtggacacgtttaagagaacgtttcgaaaattgaaaggggagggagccccaagcaaggaaatcatcgaaactttcctggtaagttaccggactacgccaaatgattcgttgccgaacagcaaaacacctgctgaaatgtttctgggaagaaaaccccgcacaactttggatttgttgcggccgccaccagcacaaccgatcgaaagagacgtagaaatggcgagacgcttcaataagcgatttggaaccaaattaagggagttttcgatcggaaacaaagtctttgcccgccacagaatttcccaaaattggcaacagggcaagatttcaaagcgaactggtgtgatttacgacgtgacattcgccgatggtaagtcagggcgataccacgccaaccagcttcgtcctcgcaacacatctgactccgacgaacagctctcggtgatgctcgaagtcttcgacatcccaagaccggttgctgttgaggagcaaagggcaatcccagtggaaatgccattggaggacccgcttggcgaacaggaaaatttgggaggtcaaattgaccagggacagcaacgacggtaccctcagcgaaatcgccgtccgccgcagcgcttctcaccgtaa

SEQ ID NO: 83776 - DNA, 1122 bp, Heterodera glycines
  Genomic contig location: Contig_ID=SeqID_19043; Location=268..1389; Strand=+
  SCN-specific regions: Sequence locations=1-205,227-288,310-687,710 -814,837-974,999-1122
atgtcaagctggtatcccatattgaaaatcaaggacattggcaatgcttcttccaagccgaatgtgccggtgattccattggcacaaattgtccgttgggattgggacacaaatggggcacaacagatcagtgaagtattaaagaaatgatcaagcttataatttaattacctaacaaatattattttagacccttacactcaacaagggcagtgaagttaatttcaacatccgagccaatgtttctccttcatttattattcgaattcttaaaaaacggtagaaaaagtaaatattataaattacccacattttacacttttttttttaattttggcccaaaaatggcatttttttatgctctccgcgctcaaatttttaaaataacactggcgaaaatggtcttcggattccccccccccccataagtccttttaaagaaccagaaaaataagtactgatcccgattggagttgcgagagttgagagtgatcctcctccgatcatttaacatttattgtttcccgccgattaagtgcgttcccggcgccttccatcaactcaactgatcacgacgatttgacggtgaaaattggtgacaaacaggtgaaaatcagaaagaaagagagtaatggaatttatcttagcccaaatttatttgaattctaataagtttagcagaccattgataattttaaaaagagattatcatcgattccctaattcttttttgatcagatcagtgaaattttgatcaggtcttgcttaagctttataagatatatcactgacaaacgattttgatcagatctatcttgaaaatagataaaatcattgataaatttgatagatcactgatagtcttgatactgataaatcttgatcaaatcgttaattaattttgttgatcagatcgctgtgtccgcccattggctgtcgtccgtttccccggtgatcagtcgcatgctcagcgtggagatgaaggagaagcagcagcgaatgatcactttggacgaattgggcgtggacatggaccaattcatggagtttttggaggccatcaattatctgttaatgagcggaacttttctgccaaaccgtaattcattgatactgtatcta

SEQ ID NO: 83777 - DNA, 522 bp, Heterodera glycines
  Genomic contig location: Contig_ID=SeqID_19043; Location=2369..2890; Strand=-
  SCN-specific regions: Sequence locations=1-522
atgacggcaagacaaaaatggatggcaaatgcaacagagacagagaggggaatggaagagaatgtcacgaaaatagtggaaaatgagaaggattggcattattggcttgggattgggggccgaatgcccctcatacgaggtcgcgaagcggccgagtgagtacattaagcacgggaaaattggtaaatgggggagaggagggtccactgcgtttcggcgctggtgtttcggcgccagcatgtttttggctataacttttttctttgtaaaccaaatccaacattgttggtgtcattgaaagcttaatctatttagaagctttttctaagctattgcttcgcgattagacaattaccaaaaaagttatacatgaaaattgcgaaaagtcgaaatttttgaagttttttcttcataaaatttttccaaaaaatcttttggttttttgttaggctaatagagcatgttaagagctttcgaatgataccaagattattggtttggatgccaaagaaaaaagcttaa

SEQ ID NO: 83778 - DNA, 1080 bp, Heterodera glycines
  Genomic contig location: Contig_ID=SeqID_19044; Location=1..1080; Strand=+
  SCN-specific regions: Sequence locations=1-1080
  Gene Ontology: Mol. function=calcium sensitive guanylate cyclase activator activity; Cellular component=synaptic vesicle; Biological process=synaptic vesicle fusion
tgtgctgaacaatgccttttcagggcttccaaaagatttacaagcagttattccctcagggcgaccccattgatttttccaatgtcgtcttcaaaacttacgacgacgatcaggtgaattaccaattcaacacctatggacgtaatgtaacgcgttacggtaacacagtcaccgccctcccccaccccgtccattagaaaaacacgaaaatgttttggtgatttgaactcattcaaacgaaagtggaaatggcattttctgatgtttttaggacggagcaattgaatttgatcagtttgtgcacggtttgttaatcaccggacgtggcactttagagcaaaagttggcatgggtctttcggttgtacgaccaggacaaggacggagcaatcacccgacaggagacgggtggagatgataaaatgggaggggggggggcaataaaagacgaaacatttgaaagggagacggtaaatgaactgaagagagacggtagccaaaaaaagtaccgaaaattatggaaatttttaaagacaacgagcaacagctgatcagatgatcagaaataaatacttcaaaatttatgcataaccaactaatttttcaagttttttgcagtaactttttgtgtctattgaaatcctttgaccttttgtgggcaaaaaaaacatttaaaattctcaaaataagcataaatggcgaaaaatgtcatttaatgcaaaaacaaaaaaggggaaatattaaatattttctgaaaacaaagccaaaaaaaaccctcgcctacttttttcgcttattttcgtgcttttccacagaatgcctaattaggcacatttacaaattgtccggcgatgattcagagacagcggacacaaaaatggtgccgaacagagtggcgatgatttggacgaaactgaacaaggcaaggccatttcggctccgccacagaacagaggccaacggacaaagccatcctttttaggaaagcgatgccaaaataaactcggcggaatttgtggaaaatgtgaagacggacaaagcgatagtcaacgttcttagcctatacgaaggattgggcaaa

SEQ ID NO: 83779 - DNA, 1182 bp, Heterodera glycines
  Genomic contig location: Contig_ID=SeqID_19044; Location=1907..3088; Strand=-
  SCN-specific regions: Sequence locations=1-124,185-192,214-363,390 -417,442-493,533-1182
  Gene Ontology: Mol. function=sodium channel regulator activity; Biological process=protein amino acid phosphorylation
aaaataaaaattgcgaattcaatcaacttttattgttccagttttccgtttgtactttttcctgtctctcctctcttttcctttctttctggctttgcttcttttccctctcatccttttcgtttctgtccctctctttctctctctccctccctttctctcccctttctctctctctctctcttttaactgctttttcaccttctaaaagagcgatcctttgccgaagcccgcgcccgattttacaccaccgaagtcacaagagctctcgcatatttgaacgcgaaggatatcatttacaggcactcttttccttttcgttcgttcgctcttcgaaaagcgctcattttcggctaattgtttagggatttgaagcctgagaatttgctgctggacagaaatgggcacgtcgttctgacggacttcggcctgtgcaaagagcacgtcaaaatgcggcagaccaccagcactttctgcggcacccccgaatatttgggtgggcctttccccccgtgcctttctcagcccttccgccgtttgctttaagcgcccgaagtgattcagaaaaagccgtacgatcggacggtcgattggtggtgtttgggctgcgttctgttcgaaatgctcttcggattggtccttttttgcctttcccaccctaccgtacctcccgaacactttcagccacctttctacagtaagaatcagaatgaaatgtaccacaagacgctcacccaaccgttgtgcgttccctcgtccgcttcgactttagtgcgcaaattactcgtcgaaatactgcacaaagaccgttcggaacgattgggcgcaaaatccgattttgaggcaaattaactaattaatgattagtgattttggatgaaccgaacggtcatttgctaatgcgcaggaaatacgaagccatccctttttcgcaccaatcgattgggaaaaactgctaaacaaagaagtgaaggcgccgtttgtgccgaaagtgcgtgccgaaacggacactttgaacatcgcgcgcgaattcactgacattgagccgaaccctggtgatttgagtcaccgcatcatttgtaatgacaaatctcagcttctttggtgcctttgcaaacattcgtcaacagagaaacggaattcgccggattcacttacaatcagaagccgaatttgcacatt

SEQ ID NO: 83780 - DNA, 1362 bp, Heterodera glycines
  misc_feature (478)..(478): n is a, c, g, or t
  Genomic contig location: Contig_ID=SeqID_3227; Location=682..2043; Strand=-
  SCN-specific regions: Sequence locations=1-277,299-613,679-918,942 -1362
atgtcatattcatggtcagcgacccttaaaacccccgaaacatgtttcaaggtacttaataaaaaaaaaattcgtcaaaaaaactaagttcagaagaaagttagaaattcgaattttaaatttcctaaatttgagtcttaaacttacaaaaatcatttgaaatgacctaaaaagtgtataaaatgggtgccctttttaaagtttaaacagtgtaacagatccaccgaactcattttttgaatttacctttgaatttcaaaatttctgccaacaaattccaatatttgggatggcatggtttttctgaacgagagacaacaaaaaattttaaggtagagagcctaaatatttgagaattttggtggcttttgggcaaaaccctctaaatttggcattattttcggtttctttttcttttgttttaaaacattcttttcatcctttccctttcgtcagaattgccacgcatttgtgacgngggagcattcactggacgacttggcactgcactacaccctttccccagttgagctgcagcgacttttagctgagaatggcaatttccgattcatcgcccgctgacttttttacccattttcgttgattttgacacatatttatttatttaatttatttcctctcctccctctctgccttcttttctgttactttctttgagtgacgatatacgggaaaattcgacaaaaatctcgtgttgccatctgccgatgctactgcttgttttttaaccacctattttggtcttttcaagaaattccataaaaattgtaataagaacgaaaaatacacccctaaaatcgatcctaaaaatttcagaaaaagacaaccttaaaaattgaccagaaattcagaaaatataccctctaagaaattaaaaattttcgcaaaaatgtgtctccaaaatttattatttattttcttgacaaagttgcggttgtgcgggagaaattgataaaatttttttgtcacttttgggattttttttttgcataaagacattagagtttccaatttttagcacctattttgcacttttttggcttaagaaagtatgaaaatttggcttctcttcagtttctttatcttctttccaatctttttcttgttgttggcctccataacaaggcgatgattttatgttttaaaaattcttaaagaaattgaatatttatgtctcgaacggacagaaatatttattttgttttaaattttagttcacaattttatgcaaaatctcacatgctaattattttgtatttgtttttttgttacattttgcattaacttttattgtggtaaacaaaaatagagataagtaatttaaatcaaaacaataataaa

SEQ ID NO: 83781 - DNA, 526 bp, Heterodera glycines
  Genomic contig location: Contig_ID=SeqID_3227; Location=2642..3167; Strand=+
  SCN-specific regions: Sequence locations=1-526
atgggcagtgactctccagcagcgcgcaactacgcctatacatatgtaagtgcataattgtttataaaatcccacaaattaatttatttttaatagattatcaaccaacgacttaaactacccaaaattgaggtaatccctttaccaccagctgatcaaatccaccctgccgacctcaacgcaatgaatgtcctcctccaaaatctttacatcgaggtgaaaactgaattggggaaatgcagaatgctgtggaaagggatgagggtatgaaaaaacttaattaaaattgattaatccatatttttagctcaaaaatagactcataattaaaaaaacaatgtcgggaacagaagttacggcgtaagtcctttgaaaaattaaactaaaaatgattttttttctaaaatcagaaaaaatcatttaatttttagtgtaattggaaatattcgccgccctaagggatgataatttaagaacattttatgttctggaatggaagcttgttcaattgcaaaattcttaaata

SEQ ID NO: 83782 - DNA, 317 bp, Heterodera glycines
  Genomic contig location: Contig_ID=SeqID_3227; Location=3473..3789; Strand=-
  SCN-specific regions: Sequence locations=1-66,105-317
atgtttttaagttggtttacagtttacccacccctttactgtgttttagtcaattttgaaatttggaaaaatatttttctaactttaaatttttttaaaattttgttttcagtaaaaacggatgtcatattcatggtcagcgacccttaaaacccccggaaacatgtttcaaggtacttaattaaaaaaattcgtcaaaaaaactaggttcagaagaaagttagaaattcgaattttaaaatttcctaaatgtgtgtcttaaacttacaaaaatcatttgaaatgacctaaaaagtgtatttctgaatccaaataaa

SEQ ID NO: 83783 - DNA, 1189 bp, Heterodera glycines
  Genomic contig location: Contig_ID=SeqID_3228; Location=281..1469; Strand=+
  SCN-specific regions: Sequence locations=1-447,484-600,634-788,838 -976,998-1189
atgggcagtgactctccagcagcgcgcaactacgcctatacatatgtaagtgcataattgtttataaaatcccacaaattaatttatttttaatagattatcaaccaacgacttaagctacccaaaattgaggtaatccctttaccaccagctgatcaaatccaccctgccgacctcaacgcaatgaatgtcctcctccaaaatctttacatcgaggtgaaaactgaattggggaaatgcagaatactgtggaaagggatgagggtatgaaaaaacttaattaaaattgattaatccatatttttagctcaaaaatagactcataattaaaaaaacaatgtcgggaacagaacaacgaacagttacttacaatggtcagagtaaaattcggtatgtaacatttgattatgatagaattattattttttcaatcccccaaaagaagggttatttatgtaaaaagaaattttattataaaataatcgagcatttcttttgaaaattttctttgacagcatctatcgaattgtaaattttcttaattaagaatgttttcagaaaatttgctattgaactgttcctccattccaaatatgtgtgaaattttatatttaaaatatttaagtttaaaaactttgatggaagatttatttaaacatgataagttaaaatatttatcattcgatagaaggaggcgcacgaggagaaatagtttatgtcatagtaagaggaacgggacatgagtcggccttagcacgcaactacgcttatacatacgtaagtgcatgaatttatataaatcattaaaattaaattattttttaaaattaataaaatccttattttaactcagaaaacacttgtaaaaagaacactgctgggagagaagtaaagcgtaatgttccactgtcagaagttctttctcttggcattgttcgacaagccccactcccaaatttgcggcatcctcagttgtgtttgaaatttctgaaaaatggcgcttcatccggcttttttgtagactttctagcgtattacggaacatttagtcggtcatcaataaaaaactctgaagtcaaaaaagcacatattttaagcgaattttgagcctttttcttcttcaggtgggtttaaggttgggaaatgggcaaaaggtcgtattcggattctgaggccccgaaaactctaa

SEQ ID NO: 83784 - DNA, 1663 bp, Heterodera glycines
  Genomic contig location: Contig_ID=SeqID_3228; Location=2456..4118; Strand=+
  SCN-specific regions: Sequence locations=1-261,283-300,322-484,513 -580,605-680,706-709,731-753,777-794,817-998,1026-1029,1051-1134,1183- 1459,1491-1577,1599-1663
atgatgaaaattaattttgtgattattgtcttcttttttttaatcatactaattgatgcagttaacgaagctttatttgatgatttgtgggataatctaaagccaccgacctcaaaaaactttaaaaaacaaaaatttggagaaaatattgctataaatgaagaaattgttgacaaaaatgaaaattatgagcaacaaaatgccaataaaaaaatgataaagtatgaaaattgcaatgagaaagaaatggaagacacaaagccaaaaatattacaaaaaacattggaggaacaaaatgataatttaatgtcaaaaataaaagtgccaaaaattgaatttgacaaattgagcgaagactcatttgaaaataaatttaacaagctgaccacttctaatgattcggattacaataatatggtaatgtataataaaaaaatgaacaaaacaggaaaatcttaaaatagaatgggttcttaaatacttcaattatttataatttttaaatatttattctggaggcagaaagaagaaacgaaatggaaaccttgaatagatttaacatgatgaagaaggaattacgaaaagaaaatttttataaaaatttgacaaattttctttttgaatgcgaaattgcaaaaaagttgggaacaaatcgtaccaaaatttgtaaattaaagcgaaaattaaagcaagaaagaaagagagctgaggaaagtgaagaaataaaaatggaattgatcagaaaatttgatcaaatgagaaaagaaaaaatttatgggtttaactacgccgagaagaaaagatcaaaaatagaaattgcaattggcaatgaattgggaattagtcgtaacaaaatttacaaatggaagagggaatttagtaagagatcaatggcctaattgaattttactcattattgtcaatttaaggtatcaaaaagaaattttcaacgaaagaaaaaattgaaaaaattaaacaatttgaaaaagtgagagaggaatttttaaaaaaatttaatttaaaaacgaattggaaatttaaagaaaaaatagcggaaaaaataggtgctagattgagcacaatttgtgattggaagagaaaattggactttagacctcgtaagattccttatacttttatttaattataactaatgaaattcaatttaaaaatttaatttttgttaaggaaaaatcagaaattacacgaatgctgagaaattggaatatgtgaaaacaagtgaagagatgagaaaaagaaactcaatgatgagtgaggcaaaaattgccgaaaaattaggcattccaattacgaacttaagacgatggacgaaagaattgggcaccaaattaaacagttaaccttcgaaaattttaaatgctattgcaattttaagaaattatatcctatgatgacagttgagtcaacttaattatgcagagaaaagcctagtgtagtatctctttgtttcttttttctttgtaatttctcggggccaggacgttttcgcgtggggacgttttcgcgtgagtgcctgtttaccagggatggcacggaattccgagttccgacttccgaaatttttgatgaaaagttggatttttcggaatttttttgagttttttgttcaaaaaaattagcaatttttgtacaatttatgtta

SEQ ID NO: 83785 - DNA, 514 bp, Heterodera glycines
  Genomic contig location: Contig_ID=SeqID_19045; Location=276..789; Strand=-
  SCN-specific regions: Sequence locations=1-11,94-131,200-200,497-514
atggacgaaaatcggataacaactacatctggaaaatcagtcaataaacaacagaagttaattcgacagggaatgggttttttgttgcaacaggtttattaattttgcaaaatgaaatcaattagtaataaagattagagcagacaacgcaccctccgatgtgtcaacgagtcaaagggaaagttcaattaccaaaaaagtaatttggttttaattttcaattaaaattttactctaaccctgtcagaacaccgcctctgaggaaattacttcgaaggaacaaatcgtctctctcccgaacaaaaatttaattcattcggctgttgtcgagaaacgtgaaaataaagaattaccaaatgattcttcgttttttgctaatctgaagcctgcacaagtcatttccaattgttttaacgagggaacgactcccgacttcggcttacacattcacagatttattggagaaaacaattacgtccggtcttgcagatggtccgatttacttaaaggataa

SEQ ID NO: 83786 - DNA, 911 bp, Heterodera glycines
  Genomic contig location: Contig_ID=SeqID_19045; Location=2066..2976; Strand=+
  SCN-specific regions: Sequence locations=1-18,40-91,189-243,265 -430,452-660,685-712,735-911
atgtcaaagaaaaaagctatcgtggaaaaagagctggcgccgaaacgcgagcgccgaaacgcgtgggtcccgtttgtacatttagtctttctaaaatattttatgaattttaaaaaaatactatttttttcagaaaatttttgtgttttaaaagtatttaaaataacaaataaatattataaaattatccataaaaagcgacgaagaaattgatgcagaagtttcctaatatttttttgttaatgttttattaaaacaaattgttcaatagtttttgcacgtttctgacttcaaaagttttgaaaaaaaattttttttgaggggggcttatattcgaagggggcttctactcgagggggggcttctatttttcaacccccctacaaggggggcttatattcgagggggggcttccattcgagggggggcgtataatcgaggaaatacggtaaatatttaaattattcgttacgcagaaaaagaaccttaattttacctttggtttgcttttttctactgaaaaattaataaaaaatcttatttacctatttcgagatttttgtgcctatttaataacaattttgagctttttttgtacctattttgtggtttttttgtacctaatttttaccgacctaataattattaataaaattgaattgttttattcctttatttatttttcagttttatcctcttcggattcgccgtcaaacaacagacacaattaaatggcacatttcaatatgaaaatggcacttttgcatatgaaggcgatggcgaactttggaccgacggaaaacaaaaaggagcaaatgcccaacattcctacggtaatggcgataccgtaggaattggcgttaattcggccactcgacagatcattttcacaaagaatggacttcgtttgg

SEQ ID NO: 83787 - DNA, 1767 bp, Heterodera glycines
  Genomic contig location: Contig_ID=SeqID_19046; Location=41..1807; Strand=-
  SCN-specific regions: Sequence locations=1-63,93-229,254-899,921 -1432,1454-1473,1495-1680,1703-1767
atgcaggaacaaaatccggaaaatgataccgaaataattaaccaactacttacagaaagtgaagagattaatgaaaatgaagaaaatgaagagagtacagaggattttgaagaaagtgagaattcggcagatttttttgaggcagatagaaaaaaacgaactactgtaacgactcccgatgcacggtggcttaagaaaatcgggaaaagcaaatcaaggaaagggggacaagagaataaaaatttgaatacaagggtcaactatgccttatacaaattaaatgaggaaaggaaaaggcagtatgaccacattttcactcaggcatgtctaaactcaaattttcaactccaattagcaaaagcgattttgcaaattaacccaaatgagggggtacggaaaatttttaacagggacgatttggtggctcgttggaatggagaagaaatggaagttggtttttgcgtaccaattattccagaaaaagtgatttgggataaaaggataggagaagaatgttatgaatggacaccgatttttgccgaaaataccacatttttcataaaacccggcacaagagaattgagtattctgggtaaaaccattgagtgtgaaagtttgcaaaacgaaaacatttttaacgcaacacaaaaagaaattatagataagctcacaaaaaacttagaaaatttgcgtcctaaatatagaaatatgcagaatcctctcattttaaaagcaggcacacttttcgaatcagataatgttagaattgaagatgctatgttagaataccgaaaaaaaataaataatttgccttcttcaactttacgtatcgtacataagacaaatgtctcagaagtcattagactaattaaagaagaagcaaatgagacattgagcgcaattttgggaaaaacagggaattggattgacataatgaaaaatattccaaaaaaggcacaagaagcagtgaattacttaaaagggctatcaattttattaataattattccactaatcttattaatagccataataatttttatcttgacaaaatattggacaattatttcgggcggatttcgagcagggacactggccgctcgagtcgtcaggagaataattggaatgaaaaaaaggggtaccagggtcgctgcggtgccaacagcaccggaacgggagtcaattgaccaagaagcatatttattggaatatttaccgcctagacgggtggcaataattacaaatgatcccaggcgattaccatcaattcgtgttcatattaatgggcttcatacttccgcattggtggattcctgtgccagtgtttcatactgtcgggaaacaacagcaaaaaaagcagggttacaaatccaagaattggacgggggaaatccaaatttgactgcggcaaacgattcttttattcaaattttgggaaaggcacagggaaaaattcgcatttacgacaattcaactggaaaatttggagaatggtcagtgactttacttgtctctccagacaaacattgtccgggtcctttgctgttagggttaccaattttgacagagttaaagggaataattgcctttggagaaaaaaaagtgcgtcttgatgagatttggacaaacattatatcagtaattgaagttgaaatgcctaaatcaactaaagtaataatgggaaaaacagagataatcgaaccaagaacggaaaatattatttcagcacatgtaaaggagcattttccaaaggaacaaaatttcttg

SEQ ID NO: 83788 - DNA, 1711 bp, Heterodera glycines
  Genomic contig location: Contig_ID=SeqID_19049; Location=1..1711; Strand=-
  SCN-specific regions: Sequence locations=1-149,171-364,389-439,461 -480,502-565,643-732,767-862,884-910,952-1116,1198-1284,1459 -1473,1495-1552,1632-1711
  Gene Ontology: Mol. function=Rab GTPase activator activity; Cellular component=soluble fraction; Biological process=cell cycle
ttctttttttttgtcaggaatgtcctcaagatgcggtcattctccgtgacattcaccgcacattccccgcccatgagtactacaaggagtccaacgaagttggccaaaagtcgttgtaccggatcagtaaagcggtaggatactgtaatataataattgtaatacagtaattagcgcaaagacatagctaaatttttggcatcgcggtgggggtctaactaacgcccacttccttccgacgacccttttttgctcttcggcctcttaattttttcgagcgcttttcaaaaaattaagggatagggttcggcctttgtcgagaggtgtagtcgggaattggaatttttgctcgatgctttttaacagattaaaatttttaaaaattcactgctcgtgccgataggttcgcggcagccagtaaattttgagcattttcacgaaattaatttgtcaagaaaaacggtattttttgcacaataattttcccattttttcattaaaagtgcctagacctgggcggcttaagtccagaaaaaaaaactcatgacacctcgacccagtgccctaataattaattattgaaatttaataataataataattatatatatatatatatatatatatatatatattatatattttttccatttaagtattccttgtacgacgaagaagtgggctattgccagggcctttcatttcttgccgcttcacttctgttgcatgtgcttttataatttaattaattaattaatttatttttcattgtgtttatctgtcttctttatttttggtgacaaactcatgtataatttggattttcaaaatagtcaaaaaattaatggcaattaaaaaaaaatttccttttttattatggattgagaatggtcgggctggatcttgaccctaaaattattattttttaaaatttttatttattttatttttccatttttcccctaaagatgccagaggagagagccttttgtgtgctggtccgtatcatgtttgattatgggctgcgcgagctgttcaagaccggcttcgatgcactccatttgcgcttccatcagttgcaacggcttgtggaagtcggcaaaatgaattgaaatgaattttaaattaacaataattaatccattttatatttttaattatttttatagaattatttctaattatttatttttatttcaggattatgttcacgatttgttttcacatttttatcaaatgggtattgaaacgcatatgtaagtgctgaaaattatttaaattatttttaattataaatttttattttttaaatttcatttgtttaattgatttaaaacttaatcttaaatatttaaaattaattcatttactaatttactttattctcaattataattaataattttacattaattttttattaaacgaatattaaatttaatttaaattttcaatttatttaggtatgcttctcaatggtttttaacgttgttcactgccaaatttccacttcaaatggtgtttttcattgtggacctttttctaactgaagtaaaaaataaatttaaaaataaatattttaattaaaaatattattaaatttttaagaaatttaattaattctttaattacatggatgtttttaagggaattaacaccatttttcacatatcgctggcgctgctgcaagactcaaaaaaagtaataataa

SEQ ID NO: 83789 - DNA, 85 bp, Heterodera glycines
  Genomic contig location: Contig_ID=SeqID_19050; Location=1945..2029; Strand=+
  SCN-specific regions: Sequence locations=1-85
gttcctgaacttttcctcctcgccactgatcaacatgtgcagttcattcagttcctttgtcacttcgtccgagtccatcccaacc

SEQ ID NO: 83790 - DNA, 2330 bp, Heterodera glycines
  Genomic contig location: Contig_ID=SeqID_19052; Location=599..2928; Strand=-
  SCN-specific regions: Sequence locations=1-978,1053-1058,1081 -1295,1338-1341,1373-1733,1756-1909,1932-2251,2273-2330
atgccaaaggcattgcgaatggacacccacaaaacgcaattccaatttcggaccaactcggagaatgccattgccgaactgaggcggataattttcagaaaattgttggccgacccaaagttagcggaggatgagcaagacatagggcaaagtgcacagaacggatcagaaattgggcagcacattataaacaaagcgaaagtggtgaaaatggaagcgttggaaagtgatcggatcggaacggccggaggcatttgtatggtgagcaaattggccacatttctgagagagccgaacaaagtggtgagcccgaagaaaggcaagcaatgcaaaatgagcaaattaattaaagcattaatgagttttaatggctcatttcctttcgcttccttttttcaggggtttccattctgaaaagcatcgacaaatggtggcccagcgaatgtgagcagcgcgaggaggcccaatcagtggtcgagactcagcggatatatatgacaaaaggcaatcgagaattgtattccgattttatgatagtttggggtcaattggccactctccgcggtggtccgacgcggttgcacaaatttttgtgtatgaatgaagccgaaatagaatttgaaattgccaacaatgaacggtacacggaccctggaggtaaaaaaataaggcccgatttttggattttcccaattttttacaaatgcaaatttgtttgggctttaactcaattaaaaagcaattttttcagcttggttcaatgcttctatgcatgctttccatagtcaaatacatatttggacattttcactgaaaaacttaaaaaatggaataaaatcaaaaataaaaatgtattttgacagagagattattaagaaaattagaaaactttcatacctcgctatctgacatgtttggtcaactaattaaaacgttctgagacgaagtacgaaaagtgcaaaagatcaaattaaaaggaaattatttaattttaaaaattaaaagcaaattattatgtttattaacaatatacatatattatttaaaatattcgcgacataaagcaaatattttttcacattgcgttaattttaattccaaaaattgaaaaacgatgatttccataaatctcgatgtagcattaaaggagagcaaaattaatttcgaaaaagaaagagaaaaactactgatcgagatccgcttttgtagccaaagttaatgaatgcttctttaaatttcggctcaacacgtattatgattaatataaattttaaatgtagcgaatattttaaacaatatatatatatatatataatatatatatacgtatattatatcaagtttaatttaaataatatttttcttttaatttgatcacttgcacttttcgtatttcatcatagcaccaattaaaaaagcctaaaacaaatatgaaaattctatgttatttttcttactaaaagctttcggctccaacgcattaaaatttctttagatttttaaaatacagtccaattaagcctggaaacaaattaaccataccaaaatgaccaaaaatcaatttgcaaatttccattttaagtttttcgaagtgccgatttgctacaaaagcattacctggatgctttcacaacaatttccccagaacctcgtcaggcactaaaattggctactgacattttctgttgggtgctttggctggaaaacgatgttttgaaattatgggatgacaagaaaaaggaaaagggtaaagtgatgccaagatttaccatggcatggaagcagaaccggtggtactacgaaatggtttatgaccaaatgttcgacattgaggaggcgaatggaaaagtggaagtgccgaagaaaaagcgccaaattggcattctgttgcaaatgtccaaacatttggtggaacagaagctgaaaatgccggacgaaaagctgagggtcgagctgcgcaacaaaaagctggaacggctgaagaagggccgacagtacggcacggcatcgccgccgccgaacggaacggtggacagagaatggcacgaaattcggcgaaagtcggaggagggaaaagaggacgaaaagcagagcagcgcaattgaggaatggcttaagcaacgccatttcgccacaatcaaaggctttttgtgcaacagcgaaaagttcaacagggaatttgagcaaagtgcgcttttaataatgccattcattgcctcattttgtcataaatatggctattaatggaaatgccacttttgcgccaaaatttaattctgtttagcactcagccccacacaaattacaagcttgtttattttattattaaa

SEQ ID NO: 83791 - DNA, 845 bp, Heterodera glycines
  Genomic contig location: Contig_ID=SeqID_19053; Location=164..1008; Strand=+
  SCN-specific regions: Sequence locations=1-13,56-351,373-376,408 -500,522-554,576-585,609-657,712-817,839-845
atgaatttgtggcatttattatttattatatttttctttatttttttaattaaatccggcaaaatccaaccaaattttgaagaaatatttggccaaagatgggacaaaaatgaaagtgaagaaattgtgataataaaaattgaacaaaacgaccaaaacgagcaaaatgaaactacgggcattgatcaaattggtggagaaaatggaacggacccaaatgatcaacaaaaaagacaaataattttgaaatttgaagcaattaaagaaaagttaaaggaaaaaataatatacaaaaggaaagattatggcaaaattgagagaaaaattgcaaaattattaggagcaaatcggcaattaatacaaaaatggaaaaatgaattaaatttaaataaaaacaaaattaaaaaggaatttatgaggagaaaaagcgcaaattcattgaacgatttgatgaatttaaagaattatatggccaaggcaaacagaaagaatttgcgaaggaattgggcatttgtgaaagaaacatttcgaaaatggaaaaaagaattgttgccaaaatacaataaaagtaagcgaatttctaactttttaaaattatttattattttcagcgctaattaaaccttcaaattatgacaaattaaaaaaagatgaagcaatattttgaaataaaagaaaatttgaattttatttgtttaattaattaaaaaagcaatttacaaaatttgttggatatgaagccaattatggtcaattaattattttttttgaattatgtgcccaaaaaaaaaaaatcattttgagtaaattgctacactttccttttaatttattttttccataaa

SEQ ID NO: 83792 - DNA, 489 bp, Heterodera glycines
  Genomic contig location: Contig_ID=SeqID_19053; Location=1458..1946; Strand=+
  SCN-specific regions: Sequence locations=1-489
atgaggagaaaaagcgctaaattcattgaacaatttgatgaatttaaagaattatatggccaaggcaaacagaaagaatttgcgaaggaattgggcatttctgaaaggacattttggaaatggaaaaaagaattggtgccaaaataccataaaagtcaaagtaagaatatatttttagtgaaattaaatctaatttttatttaagagcaatatacaaatgaagctaaattaagaaaaatgagaaaatattacgaaataaaagaaaaaaatcagaaattgagcgatgtattaattgccaggaaattggaaattggatcgtcaactctgaaaaatctgaaaaccaatttactacaacactaattgatcagttatgattgaacatgatggatgataatatgatcacatcgggcctctccccccgggcagtatctgttcccgagacctatcgggtagagaaagcctaagaattgtgtgattttctttcccgga

SEQ ID NO: 83793 - DNA, 932 bp, Heterodera glycines
  Genomic contig location: Contig_ID=SeqID_19054; Location=16..947; Strand=-
  SCN-specific regions: Sequence locations=1-280,302-704,726-784,855-932
  Gene Ontology: Biological process=embryogenesis and morphogenesis
atgcacaaaaagtttgacacttttgaggaggcgaagcattatttggagaagtattatgagggaaaaggttcgccatttattgaaacaatagcaaatttattttatttttgtagcggatgaaaaaaagtcgccaagaaagtcgcgaacttcgacggatgcaaaaatgaaggaagagaagtcgaaacagacaacggatgaagagacggacgaggcaacggcggaaaaggaaagagacgagcagacgaaaggggaggacgagacgggcgcaaagccagtcggtaagagcatttcaaaaaccaaataatcggagttccctaaaaacgaattctaatttttgaggccccaaaatattttatctttcgcataggtccgtaaaattaaaaattcacaatgtaaatcgactgctttatccaataccaatgtatatgttttttttccgactgacagctcgcgaggtttctttgttttagtacgttctctgtgtatctccagtcagattgtttatgtccagtttgcacgaattgcatatttattttgtagctcgtaagcgcacttatggcaccaaactgaacgacgaacacgatggcgacgaagagacaaagttgggctcatccgaaggacacaaagcactcagagaagaggacattcctcgcggagaggaaaacgccgatgccgaaatgcgcgaaggggacgaggcgaataggacggaaggacagcccaaaaaggaaggcgattcgatggagagcgaagcgactgctgacaacgacgacgagcagcaaattgcgaaggaggcagccaaggcagaagagaagatggagcagggaggggaggaggaggcgcagaaaaaggcggagacaaccgaagacgaaggcgtggccaagaaggcgaaactcgacgactccgactcaacagagaaaagctcgcaaaaatag

SEQ ID NO: 83794 - DNA, 81 bp, Heterodera glycines
  Genomic contig location: Contig_ID=SeqID_19054; Location=1040..1120; Strand=+
  SCN-specific regions: Sequence locations=1-51,78-81
atgccaacaacacgaccacgagcgacagcaaaaaattttgtgaaggaatcgtccacagacactgaaaatgaagtttcggag

SEQ ID NO: 83795 - DNA, 167 bp, Heterodera glycines
  Genomic contig location: Contig_ID=SeqID_19055; Location=1..167; Strand=+
  SCN-specific regions: Sequence locations=1-167
catagtcggactcggaaagcctttcgtcgctgcttgggcctcttggtaactgccgaacactccacgctgatgaccccaagcaaccgcataaaaaacggacggagtggaaggcgctttcggttgatgatcagacattttcagtgataaaataaatgggtacttttaat

SEQ ID NO: 83796 - DNA, 477 bp, Heterodera glycines
  Genomic contig location: Contig_ID=SeqID_19056; Location=391..867; Strand=+
  SCN-specific regions: Sequence locations=1-477
atggacaaattgaatttggaagagagtgttcaggaaatcgggcgaaggactgagctggcaaaagtgccgaattggcggtgcctaatccgtccaaagttcgcttccgttgcgttcgcttctccgtcactttaccctttggacgagtgccctcaaactttgcagcgccccgtggcaaacgctcggcaaaaagtaaccgccctcgagcagaaggcaaagagggacgccctgctgtgccaaaaggcccgtcatatagccgaagccggcgggggacacttccatttgcccttgggggtcgccgattcctgcgtcgaagccgcaggacacgaggacaagtccgggacgccactggtggatgattggaaggacaatgcagtggaagaaagcggcgtattcggcgtccccacaaccgacggaattcaatggcacatttatggtgttaggatctttcggaagaacatcgctgttggtctgacatga

SEQ ID NO: 83797 - DNA, 1306 bp, Heterodera glycines
  Genomic contig location: Contig_ID=SeqID_19056; Location=1..1306; Strand=-
  SCN-specific regions: Sequence locations=1-1130,1158-1201
  Gene Ontology: Mol. function=protein binding; Cellular component =cytoplasm; Biological process=microtubule stabilization
aaaggagcaaagtgcagctatcctttcccatccattctcttcagtgaagccccaaatgcctttgtggccattcgaccgccgggccatcacgtaaaagggcaaatgcgcgggggggggggggaaatgcccaattcaacgacaaaaggaaatcaaatgccattggtcggattttctcatttttaaaggcctcgcagaacgacccttgcggcttctgtctgctgaataatgttgcgatctgtgctcgcaaagctcgctcattgggcgttgaaagggttctgatcgtcgattgggatgtgcacgcggcaccaggggacgcaatattgtgtggagggggacccggagggcattcttttgctgtccattcaccgctttgaacgcggcactttttggcccgagctccccgaaagtgccatagttcaccaatgtaagcaaaacgtgttcatgtcagaccaacagcgatgttcttccgaaagatcctaacaccataaatgtgccattgaattccgtcggttgtggggacgccgaatacgccgctttcttccactgcattgtccttccaatcatccaccagtggcgtcccggacttgtcctcgtgtcctgcggcttcgacgcaggaatcggcgacccccaagggcaaatggaagtgtcccccgccggcttcggctatatgacgggccttttggcacagcagggcgtccctctttgccttctgctcgagggcggttactttttgccgagcgtttgccacggggcgctgcaaagtttgagggcactcgtccaaagggtaaagtgacggagaagcgaacgcaacggaagcgaactttggacggattaggcaccgccaattcggcacttttgccagctcagtccttcgcccgatttcctgaacactctcttccaaattcaatttgtccatcgtcacaaatggccattcttcgcgcgttggcttcaaattctgaacgctttgagggcaaaaagaaagttgcggccaatcgaagtacagaaaaagggcgaacagtacgaaagcaaaggctttcacctgactgaaactgatcaggtccctcagtcggaatattttgggcagcgacagaaaccattggcagtgccacagccgacgagaggacaataccctcccagggagaaggaggaggaacggaagttcgaactgcgcatccaaacgatgctcaacaaatatgaaaacagagagagtgaagaggcaagaaaaaggggaggaagagagaggagaattgagagggtgccagacagtgagagagagatggaggaaaatagaggggaggggagggag

SEQ ID NO: 83798 - DNA, 296 bp, Heterodera glycines
  Genomic contig location: Contig_ID=SeqID_19057; Location=1842..2137; Strand=+
  SCN-specific regions: Sequence locations=1-171,193-296
atgggtcaaaaccttgaaaaatcaaatctctatcaaatggtcaaaatcggaaaggacctttatgagggatttgcaaagcttggggaaatgaaggaacaagtcgacgagatcagtgaccacgcgaagggtcgacagcaaaacttggacagaatcgacttccatgagaaactgaaaatggggggaaagggggagagattcaaagaagaaacccgggaaagttcgaagatgggtcttacaatttgcactgccgacagaaaagactttgtcaatgcgccgtatttgtgccaatgtttaaa

SEQ ID NO: 83799 - DNA, 740 bp, Heterodera glycines
  Genomic contig location: Contig_ID=SeqID_19058; Location=645..1384; Strand=-
  SCN-specific regions: Sequence locations=1-404,429-740
atgaagccaagtggaaggaagttcgccccctgccctagcgagattagtgtaagctttttggaggtggcaccggcactctgtgcgggattattgccataaagcgcgaggcatggagcgcatggaccacagacggacggacacaccggcacggcatacaacaacaaaaaaaagtgccatagtcggaaaagggcggcactatgagctatacacacacaaaaccgcaccaacttttttggcatttgtgccatttgatccgcacatggccggccacctaatttgatgcccacaaaaaaccattagcctaattgggaaaacatcattaagccttcggcggtgtggggagagggatttggcaaaattttaattgcctaaaagcatatggggttaatgtcaattagaatatgcaattttttggggaattttttgattaaatttcttgttccatgtacaatattaatggacacttttttgatcaatgggttttcgaagatattcactttttggatcatcgttgaccacaatatatgaatgagtcgccctgatcactttggatttttgatggttttaccatttttttgagtggatttttgatggattccaagttttttttcccatcacttttgtgtcagtttatgggttgatcccatctgctgatcacttggcacttgagagagcgtgccatttggaccagcaggaaggcatctcaaaatagaacatcagtgatcagggcatcaaataaa

SEQ ID NO: 83800 - DNA, 936 bp, Heterodera glycines
  Genomic contig location: Contig_ID=SeqID_19059; Location=85..1020; Strand=-
  SCN-specific regions: Sequence locations=1-8,30-154,176-215,244 -451,489-504,526-647,669-725,747-852,875-882,918-936
atgggcgagaagttcagcgaggaggaagtggacgaaatcatcaaagagtttgacaaggacggagatgaacaggtagaatttttcatggattttttattaaagatttatcttttttaaaattagtgcagttttgatcggttttaagactgctgttgatgatatattttttaaataagcaagcttctttaaaatgagtttatttaaaaaaatcggagaaaaaaaaattaaaaattatgaaaaataggaactaaaagctcaccttttgagggggcatgtaaaacagagccccccgttggctctgttttaggaaatacggtaatttagaaaaaaaaaaaattaaaatgggaacctattttaggaatagctataaaatccttgtctttttagtagccctgcaaacttaaagtgcatttttggtcattttaagaatggaataattccttaaacttgctaaaaaataataagtctaaaatatttaattttttaaacagtgggaaaaatcattatgtttaatttgaattttgaaagattgattatgaggaatttgtgaacgcggttgccccaattgtgaacgatggagcaaaagaagacgcgccatgggtccaagaagcgtcgtccaccgctttgccaacagttaatggaaacggcacaaaaaagcaataaaagcagataattaattaatcagtcaatcagtcactaatcaattctgatcactgttgatctgatctctctctatccaacaaaacaattttgatcagtttttgtaccataattattaaataccttaagcatatattgatgatctttgattttttcattcgttatgtgttctagcttattttatcatatgtacggtttgtttgtttttcttttatctcattgatattattattattatgttttattaattaaaatttcaggtgttaaaaaaataaa

SEQ ID NO: 83801 - DNA, 47 bp, Heterodera glycines
  Genomic contig location: Contig_ID=SeqID_3230; Location=517..563; Strand=-
  SCN-specific regions: Sequence locations=1-47
atgccaaagaaatcatggcaaaaagagtgtggtgcactgaccagatt

SEQ ID NO: 83802 - DNA, 225 bp, Heterodera glycines
  Genomic contig location: Contig_ID=SeqID_3230; Location=6341..6565; Strand=-
  SCN-specific regions: Sequence locations=1-95,131-225
atgttatcgccaatcagagtgccattttcggtgagttttttggcattggcactgatcagacaaaaacagaaaattgagcaaaatccattgacgcgtttttggccggttgaaatttaaatttccaagttccaggaacaccatagcacaaattgcaaagttggtcaaccatgtggtggcaaaatgccaatgcttttcggagggaaacaaaatgccaatgccgaatag

SEQ ID NO: 83803 - DNA, 1346 bp, Heterodera glycines
  Genomic contig location: Contig_ID=SeqID_3230; Location=7088..8433; Strand=+
  SCN-specific regions: Sequence locations=1-345,368-637,683-702,781 -976,999-1112,1134-1216,1256-1346
atggaaatcgaaaaaaaaacaggcgaaaaagcaccgaaatttatccagtcgagagccaatccgagaattgtgcccacgagagtgttcgagaatgtaaaaaaaaatccgggaatttttcaccctgagaattgattggtggtggtggtggtgaacagctgattgttggcgtgccgaatttacaacaaacaaaattttaagtttggcgattcgtccgaaaatcgtcccggcgttggccccgcgccgacacattgcaccgaggcgtggcagttcccctgtgacgatggcatccattgcattgcgcgttacgacgaatgcgacggcatcgaacagtgcccggacgcgtaaattttaaattttaaatgtttttggaattttaggaatattgtttacaaaatataatagcgtataataacgaaagaatacagaaatttttagttaataggagaacagattaaggataagacagacaaagccaattaattagtgatactcgagaccgcaaactaacgaagactcgagaccaaaattctcgagcatcttttttagatcggatgaaaagcattgtcaagcaaatgagcgagcttcaatgtcacaagaacgcggaaggtagatcaaaaaaaatatttggattttttggaattaaataaattaatttagtattttataactttttttaaaatttccatttacagacattacactcaacaacagcagcatggacgagaagataatcagcagcacaagcagcaacaggcacagaagcaacaacaacagcaacagacaaaaagtgccgtgccaaaagtgagtcaaaatgccaaaagaaaaaattggaaaaatagcgcccaaattagatacgctttttgattttctgccgaagaatggcaggctttattcccccaaatttgcgagtcaatccgagcctatgtctctgggaaagtgtcctgaaaagtgccacagtctcaaatgaacagctgggactcttcaaaagcattgcttgatgtattcacgggcacaaaatttgaatattttagatttttggaataccgtactcactattaatgcattggttacggtattaccgttcttttcaagaccgacatttttttaaagacaaacgccgcgggcggggacaagcgcgtgccgctggaactgttgctggcgggtgctgctgccttcgtgctcgtctcggcgctcgtgcacgcggtgatgaaggcgacgcggcggcgccggttggcgcggcggcgcggccgcccgctggcgccaaccgacgcggcgccggcttccgcaagggtgaaagtctggtggacgaggaggacgacctgctgatcgcgcaaatgtacggctga

SEQ ID NO: 83804 - DNA, 591 bp, Heterodera glycines
  Genomic contig location: Contig_ID=SeqID_3231; Location=237..827; Strand=-
  SCN-specific regions: Sequence locations=1-151,173-381,410-414,436-591
ctcttctttttaatattgatcactgacttatgcatttaattcgtttatcattgaagcatttggtttaattgattagattttctaatccaaaaaacccctcaattctgaatcttcatgatcagcccaattattcaagtaaaacatttttgcccaacttttttggcatttttggatttacggatgggactgattgctggatgatggcggctttaaatatgtttacttctgagtttccggtcactgttgtgatgtacaccttcaggtcctggtgatgctcgttcagctccgacgagccgctgggcgagaacatcgctcgctttgagaaggaatgaacggaaatggaaaaggaggcggaaaatggcacaagaaaaacgaaaaagctaaaattaaatataaaaaaagataattacccaattaaaattccattttttcaaattgaaaagccattgaaaaggcggcggataaacaattggtgcagccggttgggtgttttgttaatggatgatcgacgaagtgagaaagggacggatcagagcggaaggaacactttctttcccgcttttccttgctaaattggtttgtcttggggcg

SEQ ID NO: 83805 - DNA, 1007 bp, Heterodera glycines
  Genomic contig location: Contig_ID=SeqID_19060; Location=380..1386; Strand=+
  SCN-specific regions: Sequence locations=1-174,196-233,306-968,990 -1007
atgcctcacaagggaaccacccgaactgtaagtcggaaaatccatatgtattatatctcattggatagagtagggtcgacttctattgtgaaattttaatattacgcccatatagcaagaaaacacaaagatatgaggcctcaaaaaacgaaattttgtctgtgttttcaccaaaaattggtggctcagttggttaatttgcatttttgaagttcgtgttcaaatccaacatgaaaataaatattttttaattaatgtaaatattacaaaacaatttaaaaaagtattttttaaacttaaaaattgtaagatagtttttctttaacaaaaatatgcaaaaaataacaataaatgtaaagtttggaattaataaaagtgataaaaactggaaatggtcccttaggcgttgattttgttttttgaggcttcataactttttggtttcttgctatgggaacgtaatattaaagtttcagttatagcctttttgaaaattatacaaaatttgtccatttttgtgaaatttttaatttcggggggatggaaaggcacctgccctccacttccccttggatacggacgggcctatccccgaaaccattccatttaattgtcattcacctttcccatttgctgcagacgacagtcccccacaatgccttttatgcgaaaaccacggcccgacttcgccgaagtgccttaacagtaataaccagtaaatcaaaagcgaaaaatagttcaatttagattatgctttaaacaacagaaattttgcgggggagggggaggctaaggaaaaaatttgcttgtaaaaaccaagggtctggggctacgcccttgcataagctggggatttcagaaaaaaggcaaaaaaaaaaaaaaacatttgttacaagggaaccaatcaaaatgcatttgaaaatttgtaaacgtaaatttcaatttttcagatctgtgcgtattttctttgtcttaagaatttcaaaaaatttacagttattccttaa

SEQ ID NO: 83806 - DNA, 1089 bp, Heterodera glycines
  Genomic contig location: Contig_ID=SeqID_19062; Location=49..1137; Strand=+
  SCN-specific regions: Sequence locations=1-284,306-544,601-869,892 -954,976-1089
atgttgggaaatatagccctgtccttatttgtaaaaaccgtttttgtaattagttattttaaccgtacttgtattcaaggaccattccagccacattttgacttgcttgtgatgggacaaaaatttttggattcggtgacgcaaattatggtcaatggaatacaaagaggaaattttgacgaagaattaacaactaaatttgataatgaaagctttttgggcattttgtgctttaacgccaattttgaatgtgaaatgaacgacaattttggaaaatttctgagcaatttttgccatgaatttaaaactggaaaaaatctggaagaagcaattgaaactgtgaagaattctttgataatactagcaagaagcatcacaattgagcaaattatcactaaggaaagtatatttcaaaaaattgccaaaaacgaattttttggtgccaaaaatgcggaaaatattgcaaaattttttgaacatgccaattctgcgtttcgcctaaatttatcggcacagttggtaagaataaaaatttaaacgcaagtttttaatttattaaaaaaaattctatctttttttagtttgtaatattttaaaaatgttttagcatcattttaacaatttaatgagtgcatccgaaaatgtgccatcgacaaagaaacgaattcgtcgtatgatacgccgaggttttagcagagcaatggaccaatttcaaaatagcctggacaactcacgatatcgccttcgaaatgatcggaaaaaatgtgctttctttttggcacttagtgtcgttttgctggttggcattgttttcacgatggccaatttggccaaaatcagtgccaatgccagccatggtcaatgggcatttttcatcctgtttttcaccatcattgtcacttatttcattatgcatactgtctcatttgtacttttgtgtgttcaaaatccacatcatcaacaagaagaacaaccggaacagcagggccaagaattaggcgaaataggcaattagagaacggagaagcgagtacgagaagtgcaagactgaaatggatggcactaattggaaaatgatgatatttttaa

SEQ ID NO: 83807 - DNA, 294 bp, Heterodera glycines
  Genomic contig location: Contig_ID=SeqID_19062; Location=2167..2460; Strand=+
  SCN-specific regions: Sequence locations=1-134,208-228,250-294
atggcacaatatgtggtgatgcctgttgatggaaaacaatggaacggtttggctgaccatggaacgataattttcaaagatggcgaaggaaaggtaaaaaatatcaaaattccgttgataaatcaaaaaccaagaatttttaaatattttttaaatttttaacatttaaatccaacaaactttaaaattttataataataaaaattacatgttgtgcccataattcatttttgtatacaaactttttgtcaacaaattaacaaatgttaaatatcataaaataaattttagtag

SEQ ID NO: 83808 - DNA, 527 bp, Heterodera glycines
  Genomic contig location: Contig_ID=SeqID_19063; Location=235..761; Strand=+
  SCN-specific regions: Sequence locations=1-36,58-181,203-527
atggacattgtccatccatatcaggcatgtaagcagaaaaaattgagaatccaaagaaaatttttttgctgttcggtcaaaaaaaaattttcggtaaattttgtctatggcggtttaaatagcgccgcaggggaaatttttttgcaaatttatctttttcatgaaaaaaaaaaaatttttcatttctagggggtgagagaggcacctctctcctctggttacgggctggggctgctggtcctcaaacatacagaacccacaaaactgatcatccgttccgatcgatcaaatttcaaccgtacaccaaccgaccaactgatcagtctaccgtatgccaataccatcattccaacacttcctatcacaaatcttccttctccgtctgccaataacgctgtaggttgttcatgaagcccgttttctgctgcaggcgttgcagctcgggcgaacgcttgtttttctccatctcagctcgaacttcggcttcaacttctttgggcggattctaaagaaaatttaaaaaaaaa

SEQ ID NO: 83809 - DNA, 1018 bp, Heterodera glycines
  Genomic contig location: Contig_ID=SeqID_19064; Location=123..1140; Strand=-
  SCN-specific regions: Sequence locations=1-71,153-678,709-730,784 -816,845-862,918-992,1015-1018
atgattgacaaatatgaaaaactcatggagaagttgattgatcaaatctatgataactatgaaaaagtttgatttattttaaatttgattaaaatatatttttcataaaaattaaatattaaattaattattttactaaaatttcaaaaaatgctttagttgaatgtgcccgtttactcgctgcacacggaagtgacgtcatttaaaccagttgctaaaccaatcgctggcaatgaactgttcaaatacgtgccttacaaagacgcttcccgcgtggaacacgtgggctaccgcgtgaaccatgtgttgctctactattacccggatgttgtgcacttcgtgttgcatgcaatgatggacgtggcgggtataagcagcgcggtgaggctgcaacgaagctttgcgtacttttatcgccgcgtgcttgataacaccaagttgcgcgacaaacgtgagcagttggtgcacgcgatgaagcagacggctggcgggccgaaaatgtctgcagagaagcgtgagcgcgttgcggatgcattggtcctgtttgctgcagcgttcatttgcgctggcaaaatcgaagcagatcaatgtgaagttgttcatcgtaacgaggcaggaaacaagttgaaggcaattatcggcgagtcgtaagttcaaaaccaaaatgattggcacatgaatttaaaaaaaaaatttatattttaatttcgtaggcttttactgtctttcctaaaaattatatatatattttagaaatttcattattttaaatttaaaatatttcaattcccttattttttgaaagtttgccacatgttttttaataatgtttaaaattttatttcgtaaggatttattgtcctttttttaatttttaaaaatttaatatttttatttatttattttaaaaaaattttcccaattttttcttagcgagtccattgaattggagaagcatgtgaaggtttttgtgcatcaatttattgtcagttacaatgagttgattgctgaggaggag

SEQ ID NO: 83810 - DNA, 435 bp, Heterodera glycines
  Genomic contig location: Contig_ID=SeqID_19065; Location=63..497; Strand=-
  SCN-specific regions: Sequence locations=1-81,128-156,178-211,233 -270,294-435
atgctaatatttgcaggtatacggtaagtaatttaataccgtatttttacaaagaatacggtaaagagcggagcgatgaactcaaatttgaattttaaaaaacccttttaaaattaatttcagtttttccgttaaacaaactgcaagtcagtggacaatgcaaaatgaaaatggaaaagcgttgttgtttttctatgtgtgcctttgtcgaaaattggttggctttttggggatgccgtacgcagaaaatgccaaatttggaaaggtgtgaaaatttaattaatttaataattcattgaattgtttgttgtttaaaaaaaggaaattaatgaattgagtagttttatcaacaattttccatttgtaatcatgcaagaattgaaaaagaaaattggaaaaattgagaatgctgagaaggatgaattcgagagaaag

SEQ ID NO: 83811 - DNA, 593 bp, Heterodera glycines
  Genomic contig location: Contig_ID=SeqID_19066; Location=186..778; Strand=-
  SCN-specific regions: Sequence locations=1-474,496-539,561-593
atggcaaggattattgggaggacaaacagacggagggctttcattgtgagtgtggaagcagcatttgctttgaaaaggtaatgaaaagtgccaattgtggcaaaacaattaaaatgcgaaaggcgaaatgtcccaaaaggcgaaaaagcgaaaggcgaatgtcccttgaccttctactgggaaagaaaaaatcggggacgggcggggggcaggaattcgtttccgaaattgtgggattgcgggcgtaatcccacgggatcccgtcccgcaattaataaaaaatttttagctcgtattatgaaataacaattattttctgttttcttactcctaacgaatttatgaaacgcccatggtgctggtatatatcagggatgggaaacgtacaaaaaaaaaaaattcggaaacaggaaattggcagccgttatggcactcagacggctgaaaaattttttggaattgccaatcggaattccaatgggccaaaaattttggcaatcggaaatcggcggaattccgagctcagaaatgtcgaaaaccggcattttctcccatcattgtatatttggcacaacaaaattacgtatctttaa

SEQ ID NO: 83812 - DNA, 806 bp, Heterodera glycines
  Genomic contig location: Contig_ID=SeqID_19067; Location=328..1133; Strand=-
  SCN-specific regions: Sequence locations=1-752,774-806
atggaatcgttttgctgcgtttgtaaagcaatttatggaggaagtcacagctgttatgtctgcaaattgccgtgccacacattctgtggcgattctggcggagttgaaaacgaacgcttcggcggaaaggtcgtgtgcaacttcgcaaacgaggaaggcaatgcaccgatagcagaaggctcagaaaatgatgactacgaaccgcaaaacaaagagaatgaaggcacgccggcaaaagagaagaggcgccacaggaacaacgatgcggcgaaaaaactggaggctgtcgagtgggcgcgaaagaactccataaatgcagcagcaaagaagttcaaaatgtacaggaaaacgatcagagactgtatcgcgcatgaagataagctgagaaaacaaatgtacttaacaatttttttttgtgatcaaaaattttagcatgtcaccaaatggggggaaacgaatgagactcgacggagcaggtcgcccagttcaccgtccggacatcgacactgaactggccgaatgggtcaccaaaaaacgaaaaaataaacagcctgtgtcaaggaatatcattcgacagagggcggctgcgctgttcacggacactgacaccaaagtgagaaaactgctagtatgctacaaaaataaaattttttgttcaggcatcacttggatggctgcaaaaatttctgaggaggcacaatttcgtgctgcgcaaaaagacatccgtttgtcagaaacccccgtccaactatgctgaagcggtggccaagttcatcagttttgttgccaaaggcgcaaggcgatga

SEQ ID NO: 83813 - DNA, 2018 bp, Heterodera glycines
  Genomic contig location: Contig_ID=SeqID_19069; Location=1596..3613; Strand=+
  SCN-specific regions: Sequence locations=1-701,745-1091,1129 -1711,1740-2018
atgtatgaaatgaagatccgagcgcaaaagaagagaaacccgaacatcatttttcgagactcattcaatctgatgccctgcgctcttggtcaacttgtccctgcctatggattggatgttgaggagaagcctttcttcccgcacatggcaaatcgtccagacaactatggacgagagatcttcccgacccccgacgactatctcgcccaaggaatgatgcctgaaaagcgacgccaatttgacgactggtaccaacaacaccgagaagagccttttgtgttggatgaggcattggctagctattgttccaatgacgtggagatcttaatggctgcgttggttgcttttcgtcgagaattcatcgagatttcaaggcggcaagagtacgtcgatggggtcgacgaccgggagaaccacgacggaattgatgtcttacgggagtgcatgaccatcgcaagtgcgtgcatgaaacacttccgcaccaatcacctcccggctgagcacctcgccattgtacctgagcgaggatatgacaacgctcaaaatcagtccctccttgcgattcgcttcttcaaaaggtatgaagaacgccatggcgtccaactccaagctgcgcattctgccggtggagagaggaaagttggcaattactctctcgatgcttgggttgaagctgaacaaagggccattgaagtgaacggtaattttacttttaaacattttaaaatattgtttttaaaaataggttgtgtgtggcacgggtgccaaaagtgctttccggatgataatatgctgttgccaaatggaaagtcggccggagaagtgagggagcgggacgcaaagagattggaatttctgcgcaatcaaattggccgtgtggacgtttattgggagtgcgagattgagcgaatgcttgctggtgaccgagaaatgcggcaaatgttcaaaaaatatgttgattatggtccactcgaaatccgagccgcctttatgggaggacgcacgggaccattgaagctcttccggaaagctcgggatggagaaaagatttcatactacgacttcacttctctctacccattcataaagtgaaaataatttttataattttttaattataaaaatttagctttacgacgcgctatcccatcgggcacccaagagtccatgtgctgaacgaagaggtggaatggacaacatcggccgacaacccctacgatctctcacttctgaaagtttgggtcattcccccgcgaaactgtgatgtgccggttctcccagtgagagtgggtgaacggctttgctttccgctttgcatgaagtgcgccagcgatcacccgacaggcggagttaatgaaaattaccactgcacacataacgattcacaacgtggttgggtcagcacttgcacatctttggaactgaatgctgccctggacgagggttatcgggtcaccaaacttttccgcgtattggaataccaaagcagcgatgatcaattgttcaaatcgtacattgcggaatttatggcgctcaaaatccaagcatccggctttgacaccagtatcaaaggcaatcctgagcttgaggaagcgtttgtgagggagtgttatgagaagtttggcattacaattgatccaacaaagatggagccgaacaaagggaaacgatcgatagcaaagctctgcttgaataacttatgtatgttgtctttaaatatattatttttaaataaatttctagggggccgattctctcttcgcaactttgggctgtcgcaaacactcatcacagatgaccctgtggttctcgctgaatatttggacaaccggtcgctcgaggtcacagcgatcgacgaatttgacgctgaacacatactgatcagttatgagaaaaagaaagagtgggtcgaggaacatgcatggtccaatattggtataataatttatgaacacaaatacaagaataatttagtaatatctctttggacaacttcgggggctcggctggattactaa

SEQ ID NO: 83814 - DNA, 296 bp, Heterodera glycines
  Genomic contig location: Contig_ID=SeqID_19070; Location=936..1231; Strand=+
  SCN-specific regions: Sequence locations=1-269,294-296
atgcctggaaaattaattgtaagtgattaagccaatttatattgttaattgggcagatataaaacaacaaattagcatttgaataatttcttttttcaaaggttggggatggggacgccgataaaccaacgggaaaatggcgaagatttggaggccgcggcaacggattttcaatgggattggcgacgaaagatgaacatgatcaatcagaaaaaccttctcaaaacattttttgtaattatacaccgctggacacattacaaatcgtattgtaatcagaagcaaaaatatttcca

SEQ ID NO: 83815 - DNA, 134 bp, Heterodera glycines
  Genomic contig location: Contig_ID=SeqID_19072; Location=1999..2132; Strand=+
  SCN-specific regions: Sequence locations=1-134
atgtgcccgaatcaaatgagtgtgccgtcccaaaattcatttaaaacgttttcgcgcaagcaaaatggcatgatccaaactgatcaggcttctggaccatttttgattatccaaaatggccttatttgccacca

SEQ ID NO: 83816 - DNA, 678 bp, Heterodera glycines
  Genomic contig location: Contig_ID=SeqID_3233; Location=1342..2019; Strand=-
  SCN-specific regions: Sequence locations=1-678
atgtcgaaacaaccgaccaaaacattccattacccggaatgggttctgacgaagtcgcttcttcgtccaacaagtcgtgcagcaacagctcgagaatgtgcccgaagtaaggcagggaccgacacgcggtggccaaatcaaatgcaaaggcgccgaggttgcgtttcaaaagttgcttgagaagtttgtggataaacacctgggaaatacaaatggtaaatgaaagcaacagagagaaagagaaaagacacctcactgactctgaccaaagtgtggacggaaagtcgcgacaaaaagtcaacatttttgacgactccaacgaaggaactcagcgaggaagaaccgtcatcagtgacgagggaaatgttgtcggacaatttggcggacgaggatttcggtagagaagaaacgcaactcgcaccacacgccaaataatcatcgttaacacctgaaagttaaatcaaaccgagtgatggcaaaaccattagtaatacaaagcggataaatgccaaggtcaattggcaacataatgcgacgggaaatgaacgagcgagagctttgacgactgagcctccggatttgatctgggtctgtcgatgtgcacaagttttgatctgtggacaaaggaagccaaacctaaaaacacggaaaattaattgtcaaaaatgcaaaaataaa

SEQ ID NO: 83817 - DNA, 3312 bp, Heterodera glycines
  Genomic contig location: Contig_ID=SeqID_3233; Location=127..3438; Strand=+
  SCN-specific regions: Sequence locations=1-487,511-771,795-903,928 -972,994-1198,1225-1895,1918-2234,2271-3312
  Gene Ontology: Cellular component=exocyst; Biological process =synaptic vesicle docking
gaacaatctctgctgttgaacggcggactcgcaatttacgaaaattatataatttgttcggcctcaaacagcgaatttccggacggtgaaaaggagcgtatttacgtattccatgccgaaaaacaattggatttgtacgaagcaaattccatccaaacaaatcgaattttgcaaatggccctcaagtaaatggaatactaaacagaagttgaatccgtacaccttactcccgaaaatttgagtcgctctcatttgctcactttcgacgtgaattcgctgatcgccatttattctctgtcgctttccctcgaaaatgatcaaagcgcagattcgctctctttggaatgccttgccgaaattcgtattgctgaattcctgccccatccgaactgtctcgtctcaatggacctcacgaggctcaatttctattcgggttaagtttccacaatgctgttagaacatcgttttgtatagtaataacaaagtctaatatttatttatattttaattccattgtgtttctcatcctcctttaaacaaatgaattcttttatttgatataattgcttttttagatgctgttcccttttgtgatgatttggactcacttttggtgaatatttctgggcatttgctgttgctgagcccaatgcaatcccaacaacccaacgaagacggacattccgggaaaacgcagggggaaaacagtgaaaacagcgcggaatttcaagtgaatttgtcatttctcccctaattgaaaactgctaaaaaggggttaacaaaaaaggttttctactcaatttttcaaagaattttgctagagagaaaaaaatattttcacggcatttgccatactatcaaattaaaaacttttttcaaaatttattaagaccaatcgggtgtatttattttttgtcaaacatttaatactgcttgtgtgttcacccacccttcactaattcatttttcattctctcccctcttttaataaatctttaaacacaaaaattaatcactcttaaattgtttgctttgttcaagcttcatcccccaacattaatcgcttcttttgtggagcatttttgggccgcgttgccttccgatcagcacaaaaacactaaaaatgatggaagaattgcctttctcgaagacgctttatggattaatgctggttgtaaaaatagcaaggcaatccttcattattattattatttatttatttttgcatttttgacaattaattttccgtgtttttaggtttggcttcctttgtccacagatcaaaacttgtgcacatcgacagacccagatcaaatccggaggctcagtcgtcaaagctctcgctcgttcatttcccgtcgcattatgttgccaattgaccttggcatttatccgctttgtattactaatggttttgccatcactcggtttgatttaactttcaggtgttaacgatgattatttggcgtgtggtgcgagttgcgtttcttctctaccgaaatcctcgtccgccaaattgtccgacaacatttccctcgtcactgatgacggttcttcctcgctgagttccttcgttggagtcgtcaaaaatgttgactttttgtcgcgactttccgtccacactttggtcagagtcagtgaggtgtcttttctctttctctctgttgctttcatttaccatttgtatttcccaggtgtttatccacaaacttctcaagcaacttttgaaacgcaacctcggcgcctttgcatttgatttggccaccgcgtgtcggtccctgccttacttcgggcacattctcgagctgttgctgcacgacttgttggacgaagaagcgacttcgtcagaacccattccgggtaatggaatgttttggtcggttgtttcgacatttctcttcagaccctcttctcccaaccgccgtcgcatttcttcgcgagttccctgctgaatacctccgcaccattgtcttttgtgctcgcaaaacagaacccgctttctggagtctgttgttctccgtgagtcaccatcctcgccaattgttccaaatgtgtctcaaagaaggccaattggacacggccaccagttgtttgatgattttgcacagcatggaaaattttaaggagagctctaaggttttactttagctcgtgttcaaaatgtcagcatttttagttgtcattccgtttgttagaagaggcgttgacaaagagtaaatggaccgtagcccaagtaataaattaaattaattcctttttttaataaaattcgaggacatcatctgtttcatgcacaagatttcccatgcggttgatcaggaaattggcgtcagcagtgaggactctttgttggaaggagggggccaaaaagatcactgtatttattgtcggacattttcagtgcatttgattttcagttttcagattctcgatcaaaagttgagaaactcatcgacgaggctttccgggagaaaatccaagtatttctggacaattgtaagttcacgtttgccggaacatgcaaattccgattcttttagcacattatgattgggagttagagcagtcgagtggagtcgcaagtgaatatatgtgagtgatgtcttacgatttgttttcggaaactctcatttcctgtctttgttttagcactgatctgatcacttttctgaacaccactttcgtttcctttgccaaccttccgcccgttcttgccaggcatgtccgtatgcaggtcggaaactcaccaggcccttaaccagccgaaggcgggaaggggcaggaggagcttacctcaaaatgaaaaaaaattgaggaaaaatatacatttttttgaaaattaatatcatttttcttaatattcgcaaaaatttgttttctccgacaacatcgacaaaaagtcttcgggttcctccaccgatattcttttctgattaatgtggcctataaacgcacttaaaccctatttcatatgttttttagacgtgtaaattccttgccgatcgcatgagttcgatgttactttcgtcggagcatcgttcggtcagtatcggtgcacttgaacagttttcgcttgatgtgatgcaatgcgaacttttcactgcccaacgccccgtgcccggtttcgaagataatgctctcgccattactttcgcacatttgcgtcaattgttggatttggtgatggggcccgactggacaactttctttgccgaaagggatgaaggaaattcgcatcgcaagggcggaagcagcggcaccaaatacgcccgagtaaaggcgtcgagtgccgcggcacttatggaaaagtaa

SEQ ID NO: 83818 - DNA, 143 bp, Heterodera glycines
  Genomic contig location: Contig_ID=SeqID_3234; Location=1446..1588; Strand=+
  SCN-specific regions: Sequence locations=1-84,106-143
gactcgggggcacaattagtgagttaaacattgaatttgccgggggttggccctcgcacacaaaatgccccaaaaatgccggcactttgggcattttccaaagtcactgattgatttgccattcctttctccaaattatccca

SEQ ID NO: 83819 - DNA, 111 bp, Heterodera glycines
  Genomic contig location: Contig_ID=SeqID_3234; Location=1777..1887; Strand=+
  SCN-specific regions: Sequence locations=1-58,80-111
atggaccgttgtttatggggacgattgcatttggcagcagcagcacgactatttgtgtgctcggcccaacctgacgcagaatcgggtaacacaaatcaggaagagggaccg

SEQ ID NO: 83820 - DNA, 1015 bp, Heterodera glycines
  Genomic contig location: Contig_ID=SeqID_3235; Location=441..1455; Strand=+
  SCN-specific regions: Sequence locations=1-580,602-605,638-1015
ccttccataagggtgaccctctgatccgtgagattccgttgcggcatgacgcgggatgcaaagtgtggcaaaagatgggtggtgagcatggcattgagtggtcaaattttgttgtagggaaggccttggtcggacacaatgccaacgaatgtggaggattacctttgtgcgaaggcattaaatccgaaggattatcatgcggccaggacatgccatgtgaggggagaaaatccgatttaagtgaccgaaatgctcagggggacagcgggtcgggcatggaatggaaacggaggcgcaccgttggcattggcacggcaccgccgcggcaaaacgccacccgacaaagggcaaaaattgagccgcaacttcccccagctgctgctttgtcttccgccccattttcgcgttccgcgtctgatcagctgaccaacgtccatttggtgggcaacggatcaaaagccaacggaagtctaacacaacgaattgttacgatgccaataacagaaaaaagagtgccgttgaggatgaaacgccgaaaatcgaaaagtaaattcggacggatggaaaagcaattatcaaaaagttaaaaaattatcctttttgttagacttttcccattgaaaatgcaatgaattattgaagtctttacagtacattctcgaaatgtgctccgaacgccgctgataattcccgaattggaactgatgaaaaagtggcgaaacagtcgaagaaatgacgaaaagccaagcagagaattaccaagccaaggggaagatgaagcagtaaaattattgctgctgaatgatattgggcaaagtgcggaagagcgacgggaagaagtgatcggaagaacggaccgatcggaagtgatcacggaactgatcggggtcacctcgtatgggtctcgtcagtgcggttctgacgaggtattagttcaggagagagaaagtcgttgatgattcccctcatttgtcagttggcccgattcactcggattgcgcattatgtgaagaaa

SEQ ID NO: 83821 - DNA, 281 bp, Heterodera glycines
  Genomic contig location: Contig_ID=SeqID_19075; Location=967..1247; Strand=-
  SCN-specific regions: Sequence locations=1-203,236-281
caccggcgattgggggtaatccccgcatcccacggcccccacccgtccgaggcggaagaggggaaaacggacggaacgccgtgtcggggagcaacagaagcggcggaagattgggggcgagcaaaaaacaccgtcgccgtgggccggacggaagaacggaagaaaactgtgtgatgatgggagatgatgagagagggggattggatgatgatgatgatgatgatgatgatgatgaggaaaagttgcgtttatcgctgccgtcaaatctcatctccgtttag

SEQ ID NO: 83822 - DNA, 1138 bp, Heterodera glycines
  Genomic contig location: Contig_ID=SeqID_19077; Location=154..1291; Strand=+
  SCN-specific regions: Sequence locations=1-5,27-570,592-1138
atgccggtgaagcttgagtcgctgaaagcgacatttaatttggactgtgaggacaagccctttttcccctattattacaacaagaaagaaaattatggaatacgattggaacatctgccaccgatggaggactattcgccgggatctatgaacaaggataaatttataaaattcgaaaaatggtaagaaaagaaggacaaaattaacaataaaaaattttttttcaggtacaacgaaaacaagggggcgcccttttatttggatgatgaattgaaaaattattgccgaaacgacacggagattttattgctgtcaattattgagtttaggaggatattgattaacgatattacgaaaggatttgacccactaccgaggagttgtacgaatgcgggggttgcgatgaatatttttaaggcaatgtttttgttgacggagcagttatcgattgtgccggagaagggatatgagcggtgtgatcgcgccagtgtgatggcaataaagtatttggagtggcggagccagcgggatggaattgagatacggcacgcggggaacggacgagaggtcaaagttggaaaatataaattggatggatttattgcgaataacggagctagggacaaatgcatcgaggttatgggatgttacatacatggatgtttgaattgttatgacccggcggcggaactgattggaggaaggacggcccaggaattgaacgatgagactcaggagagattggcggagctacagaagactttggatgtcgaagaagtttgggtatgtttatttgacatttgaatttataaattctactttttaggggtgtcaaattgagaaggaattgaaaaaggatgaggaaatgaggggcttcttcgacgacagaggaaatgagaaggggccgattgatccgaggatggcatatgcgggagggaggaccggaccgatgaaattgtttgcgaaatcggatgagaagaaaaagattagtgtttacgatattgtgagtctgtatccgtcagtgaattacggtacagcttacccgattggtttgccggagattattataccgaagagtgatgagattaatgtaaattggacaagaccggaggatttgaagtttaatggattgtataaa

SEQ ID NO: 83823 - DNA, 1201 bp, Heterodera glycines
  Genomic contig location: Contig_ID=SeqID_19080; Location=1369..2569; Strand=-
  SCN-specific regions: Sequence locations=1-223,245-308,332-758,780 -920,943-1172
atggtgggtgaaaacattttattttttgggtcattggatacccatttcgccatgatgaagtttgcccgtgtatgcataaaatttttttattactctcaccgactgtaccggagttataattatggcattgacttttttttgtgagacagtttagtcatcacaaattattgaatatttatttttcagaattttggctctagggcaatctgtcaagttatggaagagaaataaaatttgaaataattattattcttttggtcagtttaccctaatctcaaattttgaatgatacaaatccttaatgatatgacaaacaaaaaacagaaatcaagccttaattcactaatcacaaagggctctttacaaattcaaaaagcggaaggattttgcgaattcctcattaagctcacatgaaaggagaattttgaaatttttgataggctcctaacatggatttgtttttttaatccttttggctttcttaaacctgatcaattttataccaagtctattttcagactgagaagcttggagatctcttagcttccaatgatggaccatttccgaatttttaaggggtactgtaactgtattggcaaaccaaaaaagacaagtgagaataatctaaaggttcagaaaacactgggtttaccatgcgaatttggctccttaggtacccgataaatcactgattttttaatggaagaaatcatcatggatagagataggtttattagcaaaaaacgaaatgaaactttcagtacaaatgactcacaacagcttattaacaaggagacctcacaggggaagctgaaggatttaatatttgaattattgaccgctcatccgagccatttccaatctgagtttttatgatcaaagccctcgggcaactctgtcaagaatgaagggacaggagctattaaaaaaaattatttaattgcagtcgaaagtgttaaaaaaaagtaaatgtataatcttgtcagtaatgatccaatacctcaaaaaattgatttaacaaccagccagatttctatcagttcgattatactcaagtgaacagtgagaacctttaatctttaaaacgaaccttgtcgtcaagcaaagctaaggttgagagccaagaggtgccaactatcattatttaacctatcattggtcatgtggattggataaaaatttatataaatttataaataaa

SEQ ID NO: 83824 - DNA, 290 bp, Heterodera glycines
  Genomic contig location: Contig_ID=SeqID_19080; Location=764..1053; Strand=-
  SCN-specific regions: Sequence locations=1-290
tcgaaagctcttcacaggctctattagcctactaaaaattacagaaaatttcgaactataaaaaaaagatagaaataaaaaacttcgaaaattctgccttttttgcggttttcaactgacaacttttttgagagctgattaatcactgagaaatagcttataaatatcttctaaacatctagggctttcgagtgataccatgattgtgaagtttggccaacaaagaaaaaagttatagctttttgaacattgctgagatggagttggccagacggagttgacctctaccg

SEQ ID NO: 83825 - DNA, 1359 bp, Heterodera glycines
  Genomic contig location: Contig_ID=SeqID_19081; Location=303..1661; Strand=-
  SCN-specific regions: Sequence locations=1-202,226-320,367-532,556 -1168,1190-1275,1298-1359
  Gene Ontology: Mol. function=ubiquitin-specific protease activity; Cellular component=nucleus; Biological process=pathogenesis
atggaccttaacaatggtttttacgacagggaagaagacaaagtgaaattgaccatcgatctcacaactgttgatgaaccaaaagtggacaaattcaatttggatcaaagcaattcgaaaggcacactctttatggaaattgaaaaagtgtcggaatttgcgcgagaaatctttaagagtgaacgtaaaagtgaaactgtgcacatcaaaggattgccatggaaaatatgggcacaaattgaaaagaaagatgaaagcactgacaaaaatgagaaatggttcgccattttccttttgtgtgatgctccaaaagaaggtgcaaaattactaataattaatatatatattaacaacaattaattaattgatattgagcagaaacttggagttgcaaatgttcggcaaactttcgaattgtctctctaaagagcggcgttgcggatttcagaagaaaactcgatgaccatgtttttgacaacaaagagaacaacaggggatacaattacatttcatttgctgtgagtgccaattcaaataaatagtgcccaattaaattttaacataattaaggaactgatgaacccaagcaaaggcttttacgaccaaagcgaggacaaagtgacattggccattgatgtcagtgtgaaagaagcgaatattgaggatttcataaatacccaatatgatctggcaaaaatctcatcattgaattatcatcctatggacctgctgtttttagcttctttcttattgtttatcttttgggttttacaatattgatttatgatttattaaagcggcttttttctttttttttcagtatcgggttattaaaaaaaatttcggtaatggttacttttacttgtccctaaaaaaagaaaaaaaaggcgtttttttatgatattttgttctactcgggggctatcggggacgctgatcacgaatatgacatcagatttgtcatatgacatcatctaatatatgatttttttcaaatctttgatttttcatcaagtaatttttttcaattttttttttgatccaaaaacggaattatgtttaaagatctttttatgcatctaaagttgcacagatcaggcattgacaacttaaaactgagcaatttgatcaaatatgttttcaaatgctgcaagtgtctttttgccatgaaattggcgccgcaggagggttgctcggatacgatcagcaacccattgaatgactccaatatgagcatggacatcgtaaagcccaaagacccattgttggcggacgacccgtccttggtggttttttcgacgtgcaacaagactttcgtctatttgtacgacatgtccaacccctcccaagctaaataaa

SEQ ID NO: 83826 - DNA, 1361 bp, Heterodera glycines
  Genomic contig location: Contig_ID=SeqID_19083; Location=126..1486; Strand=+
  SCN-specific regions: Sequence locations=1-238,260-871,920-1126,1191 -1249,1273-1361
atggcaaccatcgatgcgcgagactacgaagtctttctcgacccagaattgagaattctgtcgacaacggcgcagacagcaaactgcgaaggattccgataccactactttgcgatgaatgaggaggcgaaagagtgggtgaaaatcgacagccgaacgggaacaatcggacgaatggaacggacatccatccatgaatggaaagacggaaccctaggaaaagaggggccagcggaaatgccaattggattccacaattggatcctacggaacgattcgaggagcagttcgtccatttcgccgagagagagagatattcgagagttggcagcagcgagacgccgaatacgcgatgaaaagagcgacggcgcttggagcactacccggaggactcgagggagtggccaaaacatggctcaaagggctgtgggaacaagtcgtggaggcctggatgaaagcagcctgcctttatgcgacattcctgctaatccgtgatgtgctgatcccattggcactggcctatctctcagcccgatccgctcgagtcttcgcgtattgatcggaacacggcgcagacgaccacaagcaagagacaatctcgaggatacccggacggcggaagaaacgccgatggtcgatctgacccgaggatcgatacgggggagcacgaagagaaggcccatcacgttgggcctgaagcaacaaatcgtcgctttccgcacggaaaacccaacttgttctcccgcccggaatgttgcgactgcccccggaagggcagaagaaattgcgaaatgagggaagggggcgcaacgggggaaaacgaaagtgattgaacgaatgaatgatcggctgggcgtcaatgatcaacatgatcaacaagaaagaagaaaaaggggaaaacaaggggaggaagaatttgccctgaggggaaaacgagatgtgcatgtgaaagggggggataaaattgacaataataaattttgttagtgtacaatcccccctaaaagttgttattggccaaaatgccattcgaccccgcccctccctcacatattgtattacccctatgatcacccccaattcatttgtgatttacccgccaaaccgccaaccccccttttttttgtccctcctcccctcccattttattttcatattttaattgtatttttatccaaaatgctgacaatttaacagccgaagtgagtgattaaaaataaaaatttttagggcaccctttgaaaatttgatgatattttattagttttattcattccaacagtcctaatgcgcaaacttttacagggaatgatgcaaagaatgcgcaaatttgcaagagagccgcacagaaagtacgaaag

SEQ ID NO: 83827 - DNA, 663 bp, Heterodera glycines
  Genomic contig location: Contig_ID=SeqID_19084; Location=161..823; Strand=+
  SCN-specific regions: Sequence locations=1-83,105-663
  Gene Ontology: Mol. function=helicase activity; Cellular component =basement membrane; Biological process=protein folding
atgaaaatatcaatcatcgacctagtattctttggaatgctttttgcatttcttggaaatggtgcatctacttttcccctgaattcggctgtgatggaggtcgagaaggacgaagcggacaattcgactacggtggaggccgaagacaattcgactacggtggacgctgagacggaagaagcggacaattcgacaacagtggaggatgtgacagaagacgctgacaattcgactacagtggaggatgtaacaaatgatgcggactcgactacggttgaggctgaaacggaagaagcggacaattcgactacggtggaggctgtgacagaggatgcggacaattcgactacggtggaggctgtgacagaagatgcggacaattcgactacggcggatgatgtgacagaagaagcggacagttcgactactttggaggatgtgacagaagacgcggacaattcgactacggtggaggttgtgacagaagatgcggacaattcgactacggcggaggatgtgacagaggactcggacaattcgactacggtggaggctgtgacagaagatgcggacaattcgactacggcggatgatgtgacagaagaagcggacagttcgactactttggaggatgtgacagaggatgcggacaattcgactacg

SEQ ID NO: 83828 - DNA, 607 bp, Heterodera glycines
  Genomic contig location: Contig_ID=SeqID_19084; Location=255..861; Strand=-
  SCN-specific regions: Sequence locations=1-607
  Gene Ontology: Cellular component=extracellular; Biological process =cell organization and biogenesis
gtagtcgaattgtccgcatcttctgtcacagcctccaccgtagtcgaattgtccgcatcctctgtcacatcctccaaagtagtcgaactgtccgcttcttctgtcacatcatccgccgtagtcgaattgtccgcatcttctgtcacagcctccaccgtagtcgaattgtccgagtcctctgtcacatcctccgccgtagtcgaattgtccgcatcttctgtcacaacctccaccgtagtcgaattgtccgcgtcttctgtcacatcctccaaagtagtcgaactgtccgcttcttctgtcacatcatccgccgtagtcgaattgtccgcatcttctgtcacagcctccaccgtagtcgaattgtccgcatcctctgtcacagcctccaccgtagtcgaattgtccgcttcttccgtttcagcctcaaccgtagtcgagtccgcatcatttgttacatcctccactgtagtcgaattgtcagcgtcttctgtcacatcctccactgttgtcgaattgtccgcttcttccgtctcagcgtccaccgtagtcgaattgtcttcggcctccaccgtagtcgaattgtccgcttcgtccttctcgacctcca

SEQ ID NO: 83829 - DNA, 402 bp, Heterodera glycines
  Genomic contig location: Contig_ID=SeqID_19085; Location=610..1011; Strand=+
  SCN-specific regions: Sequence locations=1-14,36-127,206-209,370-402
atgaacaaaaagctcaaaaatggaccaaaatatggactaaaaactgtcaaaatatatgtaagaaacaaagactctcgaccatctctaatgatcaaggcccagatttataaatgctgaatatagatagataaaaattgaattcaaaaattttattcaaattaaattatttaatttacattttggttaaaattaaacaataaaaattctcaaaattaggtacaaactaaattatttctttaataaaatttgattcaaattaaattaggtaattaaattaacaaataaaattaattaattaaaacacaaatttggttaaaattaaattcattaatttgaattattgaacagattacaattcagtcaaatgaacaaggaaaagcttcggaccgcaaaaaaggatga

SEQ ID NO: 83830 - DNA, 531 bp, Heterodera glycines
  Genomic contig location: Contig_ID=SeqID_19087; Location=118..648; Strand=+
  SCN-specific regions: Sequence locations=1-531
atgggctcagatgcttgtgagacgcttagagacgcacttcatcggtttacaattgaaggaattccaaaagaatctgttgacaacgaattggacttgaccgaaggtaaacattttagagtaattgataacacattttttttgcagatggagaaatgatttgttctgcacggacgggaagcgatgatttattgtcagcactcgaggaaaacattcagcaattgaagccaattgaaatgcccgtaagggtgacgagaaaagacattccgggcgtcagaatgcaattgcagagagaatttaaccgaatgaatttcacgattggcaattgttaatattttgagaaagtaacaatacactgactaaatttcctaatgctaattacccaagaaaacattcgaaaatgcttcagggaggagcgaagtgtttcattgtcaagcggacaaacttcagactgtggtttagattatcataatacaaaactcaaaaagtataacttgaatttttggcaaaagtaaatcttaaaaatatcctata

SEQ ID NO: 83831 - DNA, 1095 bp, Heterodera glycines
  Genomic contig location: Contig_ID=SeqID_19087; Location=732..1826; Strand=-
  SCN-specific regions: Sequence locations=1-287,309-502,524-662,685 -801,823-892,928-955,985-1095
atgcaaatgaaatttgagatgatcgatttgccactttctcgcaaaaaatttcacatgagacaaaaattgcgtcgggcagtgaaaagtgctcattttttacattcgcttattgatgacaatccgctggtattcactgttggattgttattgatgcttatcttcttcgtttttcaggtccatgaggtcactcgtgttgaaactgtttcttacgtgtctttcatcttcggcagtttggaactcgaactgaaaaattggaaacgagccatcgaaacttttgacagagcaaggtttgtctgcttttgtttgttagttgatttgagttgctttcagaatcggttactccgaactgcttgaacaagtccgaaacagcgatctcagcgaaacttatgctacaaagttcgccaaatatgttgtaataattaaagagcaattaaaaggtgtcgcgaggtcgaaaatctgctcattttgtgccgggctcagacaggagatgcgaatgttctgctttcaactgtcagttcagtaaatctcaatgcttctgaagatgaccggaagccttcgcccgagcaattggtagttatttagttgttaggattacgaattattataggtcgttattcaaaaaatggcttacagactgggacagacatttgcggaattttcggaaataaaataaatatttctttagaacgtttgagaaaaatttttctatggaacctcttcagtgtagctcttcgtaatttcaaatataaagaagaatttcgagttcaattaatttaactagtcaatctcttagaatttaaagttccaatctgtgttattttactttaaattctccgcaaatttcccagggcgcgaaaagttctcaacaaaatttttgaaaattgttgtatagttatttttatgaatatttgttaaatataaattttagatagggaaggcaatcactgaaagcaccaaacagcagaagaaaaaagccaggatgatgaaagagccaaagccaatcaaacctttcttcttcgatttggcagccaatttcaccgaagtatgttgaaagcacacgcattgatgaaaagggactcatttatgttgaataaa

SEQ ID NO: 83832 - DNA, 3024 bp, Heterodera glycines
  Genomic contig location: Contig_ID=SeqID_3237; Location=199..3222; Strand=+
  SCN-specific regions: Sequence locations=1-429,452-662,710-927,950 -1029,1053-1232,1254-1435,1457-1627,1649-1728,1784-2512,2551 -2734,2756-3024
tgatcacgagctgatcgtctgttacaaaaccaaaaaagtgaagcacgtggtcaacaatgaaattgccgaagtttgccaaaaacatcttggaaatgttgggcaacagcaggcgcacggatttcgcatccgcttttgtgccaagcgtaacgcgacggagcagctgatcagtgtggaatccattctggatttctcattctcggacaaaatgtaattattgacataaaaagtgattgtttttccaggacaaaggtccttttttgaaaaggatttccaaggactgtccttggcgattcgagccatattttttgaggatttttgccatttattttttttgtaacctatttttttaaaaattttcacgataatagagcaaaccttaaaagctaccctaaggtacaaaaatttttatcgttacagtatattttcgtcttataaaaataaataaattaaactgtatcatcattgtcaattaattatgattctcattaataaattttgcgttttttatagatacaaaagagagcacagttactcatacaaaccgggtggacacatcgcaatgaaggagaagatgccgttttttttcattgagttcggcaatgcgaagcagcacagtatgcttcgtggcacgggagacagtagcgaactgtcagcagaattggtaatttatttatttattataattaattaatcagctaattgataaattgcgttttgtgaggggaaagaacttttggcacaattaataatttatgaaggtttcgcctacccactcctaagaattgaacctaaaaatttaagcttcaatattcgggagggggaatcgggaatcaataaaaaaatgcaataatatgaaaaaatgcccccccccttccctattaaccaaaacccggaaaaattggaaaattttctcagaaattcatcccctaaaatttatttttttttttttgcttttttaacacttatttgagtttttgtgcctttttgagcgtctaacaattggcacaattttgccatcaattgcctcggaaccatcatcatcatcaccaaacaatgatggaggagcacagcaccgcacaaaactgctccattttgttccgccagctaatgaagaattgaaaattttcttccaaacccgattgcccttctcgcgattgatcactcgcaaaacggatttgctgccttatgaaaacaatcccaatatcgtaagcgataaaattaattactgcatttaacgaaatgaaatttaaaaagtttaatggcacacccattacgcttttatttagccgactaattaatgtaaaccccgacgagtgtcttaattttatggtttttcttaatttggaaaggagatctttaaacatcgagtttttttttttggaaaaaacgcagcaaaaataattaggcttactaatgaagggctaaaaatacgaaaaattatttaattaatgaaaaactaatgatccattaaacttaaatttttaataaaaatccgtgccttacttattattagggatgcgatttttaagcacaaaaaaccgcgaaataggcacctaaaaaggcattaaaaatcgcaaaataggcattaaataggcacaaaaatcatcaaataggcactaaaataagcaaaaaaaaaatttttattaatgctttttaggtagcaaaactctaaaaattaatcaaaaaccctattttgcttatatttcaattgttttaaagttgttttcgataaaaataattttttaacacaaaaatttttatgaagaaaaaataattaatttttggggacgaatttttgtgaaaattttttttcaattcttaggggggtgtattttctgaatttttttcagggcgtttcttaagggtgtattttctgaatttttttttcatttttattaaggatttttccgaaaatcctgaaaaattcgtcaaaaatggcgaaataggcacaaaagcgtttttcgtgcttatccaagcgtattagtgcgcaaaaattttaggtatttgcctaaaaatcggatccctacttattatcatttaattattttttgcttttgcgtagctctacccggacaaatgcgaacagttgggcgatgactgtgagccgactcgggaacttttactgaaaattcaagatgtgctgcagtgctgttcgccagccaacccgtggaataaatgcctttgtgatgggtcgaacagtgtggataaagtactgaaattcaaggaccccatatgggaagtctatatcgtgctcgtgccaaaacgaaattgcggactgggatcccgcaaaatcccgcgcgggatcccgtcccgcgccggtctctagtcctccatatggacaaaaaaaaaacactattttgaaaccattatggaaattttcacgacaatcaatccgtaattatgctgtagttgtagagctaaaagttataaaaccttttttttgtaggctaatagaaaacacttagggctatctaatgatatcaagaactaaaaatttagatgctttaagcaaatttatctgaaaaaatattttcgtttgatcgttttttgactaacgcccattatggtggtttttgactaacgccatagcacattccgaggcctcaaaaattttcgaaatcggaattccgacccaaacgatgtcggaaatcgtaattccgtgccatctctggtgcaaatcggtgaggaaaccgggtcaacattttcaggtttaccccgtctgatgtcccctgcgatccaccaaaatttataaaatagcgcagaaaaacaattgggagcttggttaacaaatttcaaaaagtaaaaaacaatattaaaatccggggccgaccaatcccgaaggttttggaaaaacgatcgggagcaatcccgaatcaggatctcaatgaaatcccgttcccaacactttcccgaaaatattggaaaatttatccctgttttgtctcaatatttttgtatttcatgtcattatttcgctattttgcatcaagatttttcgaaccctactaattgcaatactcttaa

SEQ ID NO: 83833 - DNA, 1122 bp, Heterodera glycines
  Genomic contig location: Contig_ID=SeqID_3237; Location=3618..4739; Strand=-
  SCN-specific regions: Sequence locations=1-889,926-961,983-1122
atgtgctgcagtgctgttcgcctgaaaacccgtggaataaatgcctttgtgatggatcgaacagtgtggataaagtactgaaattcaaggaccccatatgggaagtctatatcgtgctcgtgccaaaacgaaattgcggactgggatcccgcaaaatcccgcgcggggtcccgtcccgcgccggtctctagtcctccatatggacaaaaaaaaacactattttgaaaccattatggaaattttcacgacaatcaatccgtaattatgctgtagttgtagagctaaaagttataaaacctttttgtagaaaaaaatggccaaatttgcgctgctttaagaattccaaattttttcctagtcctgtctttacaattatttgaaaatccccaaattttttggaatttatagggacaattagagggatgtacgtacatacaataatttttgtcaatttttcagactgaattcgccgcaccgcccgggaaaaaagattcctcgccggacactacgccaaacaacagcagcagccgatggggccatttgggtgatccgctgaatgcagacgacattttttacgacagagagatggcgcagcgaagatacgacgatattatggagggtaaaggaaaattttttttgttttgtaaaattattgtataaaaaaaatgattgaatattatgtccaaaggtttatccctttcactttctatacagacatctcttgatggactattgtactcaaaaaaacaaacaaaaactttactagataagctgctgaaattgcgtgggaaatttctcaacttcaaccaaattaatttttattggaatcattcaatagatttagttgttctctataagaatattaatttggattgaattttagccaagctattaatttataattttttttaaaaacaaaaatttactgtcgaaatcaatcaatcactgttggaaaactaacagcaccaccatatatttacagccatttttgcctttttaatgtctatttttaaaatgcaattaggtgatttaattaagattgtgcccaatgtgtacaacagacaacgcctgctgaaaagtcgacaaaaaatcggaggaaacgacaggctaatgcacatttga

SEQ ID NO: 83834 - DNA, 1834 bp, Heterodera glycines
  Genomic contig location: Contig_ID=SeqID_3238; Location=584..2417; Strand=+
  SCN-specific regions: Sequence locations=1-120,144-217,239-254,276 -859,901-1003,1025-1053,1082-1111,1133-1156,1178-1286,1309-1513,1542 -1687,1713-1834
  Gene Ontology: Biological process=body morphogenesis (sensu Nematoda)
atgatttcaagcccgtttgtgctgaatttgaaaaaaaacaacttggcaaccctggcttattattggatggtgcttgtgcgtttcttaaatccaccaatgggttcgaaagcaaaaaatgggtaatatatatatataaattaatagcttgactccaattctacttaattaatatttcatggtagcattaaatagatttagttgttttctttcaaaatataattttccaaaattttttcccataagtttaaaaaaaagttataaaacattgaacattctaggttttttgcaatggtcatgcatatataattattagcatttacaatttttaagtctttaaaatgcaattgagccaaaattaatttatatatttgatagccctaggaattctcaatttgtctttaaattttcataaaattgcattgattttcaaaaaagttatggacaagaaatgctgacttaagactttttgaaatattatgacaataacttttttttatacttaagtaaaaaaaaattaggaaaatcatattctgatagagaacaattaaagctattttgaatgataccatgaaatattaatttggttgaatttgtgccaagatatgaatttatatacatattacccatttttttgtattcaaaccgattggcggaatttaagaaatacgccaacacgttattggatgcacgattaaattaattggtttatttgcagacaagctccattgcccacgaaattttgcatacactcgctctttaccacgaaatgcatcgtgacgacgcattttacttcctcaaactcaatccatttgatagaaacacggtaggtatatgaaacacatacacgcataattgtggcattaatttatttatttttactttaatttttcattttttatagttttgggtgaacaattatgtaccgctgaagaagaccaacaattttggctttacatacgactttgcatctctgttgcaatatccagctagtataaaaaatgggtaatttaacaacttttttattttcaactattctgatgctttgcccaaattattaacaaaaacaataaaaatgaaaaattcacacctattaatcgattctaaaataattttgcatttacacccctaaatgttaaagcttttgacaactattttcccatttttagagattctattttgggtttttttagaacctagaaatagttattttggcaatttttagcaactataaattgcatccctaatcttcagcatagaaaaattcaatgggtcgcgctaaattcgggatttttatttttatttaacatactaaacctaataaaatttagggtcgggatcagtttggcgccgaccgtttcggcgccgccaactttcaaatgccaaacttttttatttgtcaattaacgttagcaaatctggcatcatttgaatgcagtgttattaattaatagttcatgtaaaaatagaaatacacatcatataagggtaaaaaagtaatgacatgtggcgcacgccaaaaaagccaagaaaaagtaaatttttgaggattgatttttcagctactttaacatgatcacaatgagccgcttttatcagcgaacaattggacatggtggaatcctttcattcaaagactcggcaataatcaaccacatttactgtcgaggtgcggttactgtaaaacaggaatttttatttttgttatttgttataggttactgtaaagaaaagaaaaacgagtgccaaaacggaggctatccaaacccaaaacaatgcaatgaatgcttttgtccaggaggttatggcggtgcacattgtgacgatgtggaacaga

SEQ ID NO: 83835 - DNA, 415 bp, Heterodera glycines
  Genomic contig location: Contig_ID=SeqID_19088; Location=201..615; Strand=+
  SCN-specific regions: Sequence locations=1-88,120-288,317-415
caacaattcaccgcccttatgcagtcacaaccccaacaaccgcccgctgcccacgcgcacgcggcacaccaaacagcgcagcaaaatgtccaccaacaccaccagcagcagcaggcatcgcagttgtcttccgcttttctgccccatcagcagcatttgctggaagggaccgcgcaaagttccaacgcctccggcgtgcccagcggtgcccccgcgggcgctttgccatccgcctcgacgcaattgtctgccgcaacggtcggcttttaccagcagctgctcgcacttcaacaagcccagcagcagcaccagcacggcggaggtgcaggcggtgccagcggaagcgcaagtgcagccgcaacaccggcagtggccacgctgccgcaacaattcaacacagcacttcacttggcaa

SEQ ID NO: 83836 - DNA, 1064 bp, Heterodera glycines
  Genomic contig location: Contig_ID=SeqID_19089; Location=334..1397; Strand=+
  SCN-specific regions: Sequence locations=1-369,392-477,631-781,928 -1064
  Gene Ontology: Mol. function=transcription factor activity; Cellular component=nucleus; Biological process=regulation of protein activity, epigenetic
atgctgaacccggcaaccgccactttgtacgcctaccaaagctatttgcagcaacaccagcagcaaccgcaaacacccgcaccagcggcagcgtcggttggacaggcaaagaaagggggaaaagctaaaggggcggagggttggcaaaatgtacaattgaactcgatcagttgactaatgccctaacattgtacagctccaacttctcgcccaattgctcgccggcggaggcgtttccaccggcaccgccggaaactgcggtgtttctgcagttggcagcggtctccaatcggtgctgagcgctttccccggcggaggacagcaacagaatttgttggccgccttggcagtgcaacaggcggcgcaaccgcaacaacagcagcaacagccaacgcaacaagaagaaacacgcattttattggagcagcttatcagacaacagcaacagggcagagaccaacaacaacagcagcaggtagagaagcagaggggggaaaagagtgtgggagaggggaagaaacaaagaaggaaagacttacatgataaagagagagaaagggatagaaaaagtgtgtggactatgggggaaataatgaggaaagaaaaagagatgtgagaaatagagggagaacggtgatttcggctttttagagagaacgtgagcagcagctgaagcagcaacaaatgctgcagcagcagttgggcaggttcaacgccgctgcggtcggtgccatctcttcggagccgcaagcgccgcagctcgaacagtcgccgacgatgacggcaacagcggtggcggcatttgcatcggcgcaggaacaaatgcaacaacagcagcaacaaacggcgacggcaattgccgtggagcaacagcagcagcagcaacaaaatgagcaattccatcaacaacaacagcaatcacaacagacgaacggcaacgccctcagggagcaacaacagacgacgggaaacgccgcgggggcacagccgcaacagcaacaacggcaggcgacgcccaacgaacggctgctcacatccgaggcgttgcaggacagaatatcgcg

SEQ ID NO: 83837 - DNA, 503 bp, Heterodera glycines
  Genomic contig location: Contig_ID=SeqID_19090; Location=116..618; Strand=+
  SCN-specific regions: Sequence locations=1-503
atggcaaaggcgacgaaagcccgatgggccaagaaaagtgagttttttcactaattttaattcaagatcattttttttaaatttcagccgctccacagctgaatcccaatgccaaaattccaccgcaggacgaagcagggccgaggatcggggcccgaagggaacaatttcgaaaaagggatttgaccggcaactcaataagaaaaattttggttcgcgctacagaaatggacgaacttttcacaatggaatggcccaaagctatttgtaggacactcgaacacctcggcaaaattcaaattttttcaaaagtgttttgtccgattttattaagataaaatcataaattttaggcacaaattttgtccccaaatgacctggacggacttgagcgatcaattgacgatttcaaagtgtttttggcagagcaggaccggatgagtgcctttctctcaaagaaacccaaggcccatcttctactcttccacttagtattgaaatga

SEQ ID NO: 83838 - DNA, 696 bp, Heterodera glycines
  Genomic contig location: Contig_ID=SeqID_19094; Location=857..1552; Strand=-
  SCN-specific regions: Sequence locations=1-371,393-696
atgtcgaatgggaccgctgaacggtttgtcggcatttttaaaaggtcaatgaaaaagtgccgtcaagaaggcaaagattggcttcaaaaagtgcttttggcgtatcgcacgacaccaaacacggcactcaacggtcattcgccagacgaacttttccttggccgacgcatgcgcacaagaatgacacttgtccatcccgaaaaacaaaaactccagccaacaaatttggaaaattttcaacaattccaagggcaatacatcaaaaagatggaaaatcaattcaacacaaaacatggagccaaatcaaccattttccaaaatgaggaaccaatttatttttggaatttgaaaaacaataaagccatttggctcccgggaaaaattatagagaaattcggcacatctccgacgtatcgcatcttggaaccgacgcttggccgagccattcatcgtcatgcaaaccaaatcaggcgacgtttcccaattgaattggaggacaatgatcaagttgtagaaaatgatcaaacccaggcacaaaatccgcaacaatcgccgatcgcgcacaaaccgcagacaaatcgtcagcaatcgcctgctcaaccagttcttttgcgccgatcaggaagagccaaacaagcacctcaacgactggtcctggatccgacaaagccaaaatatggcttaatccgatcttaa

SEQ ID NO: 83839 - DNA, 196 bp, Heterodera glycines
  Genomic contig location: Contig_ID=SeqID_19095; Location=1136..1331; Strand=+
  SCN-specific regions: Sequence locations=1-91,115-173
atgggaggagtttatcggagtagtaaatgtgcgtgggaaaataaaatgccatttccggtccaggccttacattgttataataccatcaatatttttaacaaaattttttaatttcagacgctaaaataaaaaaagaccaagaataaaactaaataggaatttatatgcaaaacaaaaataattttaaaaaattaaa

SEQ ID NO: 83840 - DNA, 327 bp, Heterodera glycines
  Genomic contig location: Contig_ID=SeqID_19097; Location=108..434; Strand=-
  SCN-specific regions: Sequence locations=1-283,305-327
atggatcaaatattatcaaaagtttatttcaatctaaaatccccagctagctatgcgggaattttgaaggttttagaagaagcaagaaaagtagacaaaaatataacattagaggacgttaatacgtttcttgaaaaacaaagaacctatacgattcataaaccaatcaagaaaatatttccaagactcaagacgatacccagcgggcttcatacagattggcaatgtgatttgtgcattttcgatcagttgaaaaaggataacgacggatacaaatatttgcttgtctgcattgatgtgctgagtcggatgatcttcagtgcaccg

SEQ ID NO: 83841 - DNA, 816 bp, Heterodera glycines
  Genomic contig location: Contig_ID=SeqID_19098; Location=1398..2213; Strand=+
  SCN-specific regions: Sequence locations=1-104,126-265,287-316,341-816
atgggctgtccttatgctttttcctgtaaatttctgctcatcattttcacattatgccaattcgttgcgccaaactttagcttttttggcacttttggcgattgttttgatttgtttaacattttccacaacaattggtgcaaggagaaggttgcagtggagagcagaagcttggaccaaatgtacacttccgcgttgactgaaggcgggaaattggtggtgtacgctgggggcacaatgaggggccaacaagtaatgaaacgccgaaattgcctaattaaaaaattaaacggtacagaaaatttacaaaaaatcgatattaaaattataaataaaataagattcttttgatttttatgcaatattaaagggacccacgcgtttcggcgctggcgtttcgacgccgatgtttcggcgctggcgtttcggcgccagctcgtttttccacttaagcttttttctttggcatccaaatccaacaatcttggtatcattcgaaagctcttatcatgctctattagccttacaaaaagcggatagattttcaagcctgtaaaaaattttattaagaaaaaacttcaaaaatttcgacttttcgaaattttcatgtataacttttttggtaattgtctaatcgcgaagcaatcgcttagaaaaagcttctaaacatgttaagctttcgaattatatcaacaatgttggatttggattagatagaaaaaagttatagccaaaaacatgctggcgccgaaacgccagcgccgaaacgccggcgccgaaacgcagtggacccattgttactgcataaatcgttaa

SEQ ID NO: 83842 - DNA, 723 bp, Heterodera glycines
  Genomic contig location: Contig_ID=SeqID_19101; Location=859..1581; Strand=+
  SCN-specific regions: Sequence locations=1-61,83-162,184-439,461 -542,568-723
gctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaattgttgtttttcaaaaaggatactaaaactgggataaccccattcagagactagtcaaaaaaaataataataggcttggactaccatactaattagaaattttagaatgtgtctgttaaatgcaaaactgttgtgaaaaattgttataactccattcagagaagagatagaaaaaaaataaaaataggtttagagagcccgtgaacagctgcatcggatgcaagtgccgccgttgctgtacgcctaacagttggtgagcaatgacggaaaattgcttaaaaaagaaaccaaacaaactcatcaattgttagctcccgttgacaaaccgaagggtacattggggcaatggatgttgggctaccgtatcagttattaaaatttttgtttttcaaaaaggatactaaaactgggataaccccattcagagacaagtcaaaaaaaaaaataataggcttggactaccatactaattagaaattttagaatgtgtctgttaaatgcaaaactgttgtgaaaaattgttataactccattcagagaagagatagaaaa

SEQ ID NO: 83843 - DNA, 1265 bp, Heterodera glycines
  Genomic contig location: Contig_ID=SeqID_3239; Location=1970..3234; Strand=+
  SCN-specific regions: Sequence locations=1-17,39-97,119-190,240 -334,356-378,401-434,458-582,604-920,944-1265
atgaccagcagaaaggaaaagaaaaataatttgaagaatgaaaataatttgccaaataatgacaaaatgcaaaatgacggcacagaattacttgaggaattcaaaggtatttttgatagaatttttttttttgtaatttaaattttcagcaatactgaagagtgacacatatatgacaaaaggagccaagtaaatttaataaatattcaaaataaatgtcaaataatttaaatttattagggtagggctccgatcatttggggtgagaaaagtcggagttcgtcggtgacatttaggcgagatcgggtggaccaaaagggtctgggtttttcaatttttgccataaattaaaaacaaatgcagccagaaaatttaggaattcttaatgaaattatatatgttttagacttttggacaaaaatcaaaaatttgacaaatatattttaaataaaattttgaattttgccattttaatttttttggcaaacggaatggaaccccaacaagaattaattaaatagtgtaatgcaatactaacaataagcacaatattatcgaaacaatactcggcgaaacaaaattatattttgattcaaaaactttcggccaaagataattaaaagcgaaaaattgaacaaactttttttcttttctctccgtcgttttcgaattccctaattgccttaatctcgggggcaggggtcctatccaaatattaaacaaagctcacttttgaatttaagcgttttggaaacgaaaatgttccaaatgccacccaatacatggcaaatgatttcaaagcatttctggacgaaatgccagaaacagagggcaaaagtgcaatcattgcacttttggcatcaaacccttcgtcacccattttgccaagcgatttgattgagcggctgctgatcaccaagccaacaacaaattcaaaaaatttggaaacaccaattgttcatagacgtcatgctcgtaacggtttcaaaatcagcgcgagtgacatggaaaaaattattaaaacaataattgaaatccgcgtaattctcacactgctgacactttatttctggtattgtgaaaacaattttattttggtaataattatattgatcttcatttggtttgtggtagatttgagagacgacttagagcagggagggagtgatctgaaaattttcaaaaaaatcagaacattttgcaaaattgctccatcaaatcaggacatttgtaataaatcaggacagatcacatccctgacttag

SEQ ID NO: 83844 - DNA, 1294 bp, Heterodera glycines
  Genomic contig location: Contig_ID=SeqID_3239; Location=5575..6868; Strand=+
  SCN-specific regions: Sequence locations=1-170,193-244,270-301,347 -465,487-575,598-703,725-1009,1044-1044,1080-1188,1233-1294
atgctatcaactttttctattgcaacaattatcttaataaatgttgtccatttcaatgcttttattataaatgaggcaccaacaaatttagcaaacgaacacaaaaagccaattaacgaaacaccatttcttaccgaacttaaaggtgattttgatgaaaattgttaattaaaatacaaatttaatttaggaattatcaaaagtgacaaattcaagacgaaaggcaataagtaaatttaaagcgataattataattaaattaaaaaaaagagttatttcataatttgaccttttcaatctcaaaaaataattaattaaaatacataatttgtaatataaaatttttccactaatttttaaggccattagttgaatgggcgttagaaattggttgcaaaattattattaaaaatttgaacgaaaatgccaaaatatgtgaacaaaatgaagagaaatgtccagcgcaaataacaaatttttacaaaataatgaccaaaatttgcatcaaaaatggtgacaaaaacttaattcttgatgaacatcgagaacaactgacacagctcaaggacattcttggcacacaaactttggcacaaatgaaaaaatatgagcaaaactttcaacaaaatggtccaaatgccaaacaatactcggcattgctccagtttggcgatgatttgaaagcatttctgaatgaaatgcctgaaatggagggcaaaagtgctatcatagcacttttgtcatcaaatccttcctcacacattttgccaagcgatttgattcaactgatgctgatcacgaacaaaatcaatccaaaaaatttgatcaccacaaatcgacgaggtcgccgagacatgcgcgattcattcgctatagcattcattatttggttcattatttatttatggtggtttgggtactcctttttggctggtttggtcaccggttttttgctcgctgtttggcttggtaggaaattttgatttttttagtgatgtaattttagagcttttgttatgctaaatttttggaaaataatttctgtattattttttttttaaatttatttatgtaattttcttttttcatccgcagcaacttttttttttgctattttctgtttttccttaactttcttttaggtatttgcacaaattattttctttttttttacacattgataaattgtagtttgaatttttaaagattcattaaccaactaataatttacatagttttatgcttacaattaactgaacaaaaaaaaacatgattaacttcaaacaaaaaaaaa

SEQ ID NO: 83845 - DNA, 1782 bp, Heterodera glycines
  Genomic contig location: Contig_ID=SeqID_3240; Location=279..2060; Strand=-
  SCN-specific regions: Sequence locations=1-74,99-328,350-360,384 -514,554-682,704-709,739-822,845-850,875-875,898-997,1019-1031,1069 -1154,1176-1222,1246-1323,1352-1478,1500-1720,1742-1782
  Gene Ontology: Mol. function=glutathione peroxidase activity; Biological process=glutathione conjugation reaction
gcctacacagcaaacaaccgcagcaaatttggagtcggcactattcaagagctttacttccctgcggttagatcaaataaacaaacaaaatgtttgatcttctaacaatttgtcaatcttgggtgccatacttggttcagatcggtttaatgagaaaatttggaaaaaattagcctatttttaagagtaaagcaattaaactaataccataaatttttttggttttagaccgatttaatgagaaattttgaaaaaaatgagcctatgtttaataataaagcaatttgcctaattatcataaattttttgacactcaatagtggcacataattagattttaaaactataaaattacgtatgaaaattataaaaaaaaaaattaaggattcctcattaaacgacagcagcaaagttggagatggcattttgcgagagaatggagccaatttgttcgacccaaatgttcaaattggcacccaaattagcaaaatcactttgacaaaaagggtatgacatattaaataaaaatattttcaataatttgaaaaatttaggaagcaaatccgattgaacagattgacaaaatgatcatggttgatgaaggtgaaggagttcgaaaggagcgaaaagcttcggccaaaacggcgccaaaaaagaacaaagaaggtaattatgaaaagtgaatttttaataattttaattaggaaaagatacaattttacagcaaaaaatcaaaccgataccgaataacaatttttaaggaaatttgaaatatttttagaatttcccattcccaaaaatgctaaatagaaaaaaatgaaatttattttttaagtaagatttttaaaacatacagcttaatgcaccaagaaaagatataatttaaaataattaatagatgcaaaaaagcaaaaatccgatgccaaagccaccagcactgcggcacccccaacttcaacaacaacagttgcatcagcagctgcagcaaagccaaaagaagatggaaaagagggacaagcaggaggaacatgtaaaaaattatttaaaaaataaaattgatttttatttcttttagcaaactccgaagcaaaatctcaagtaaaaactattccgcaaggccctccaatgccaccaccaaaatctgctccgccggcgccaccgcagccaccagcttcaccatctgctcccccagcatcaccgcctccacaacagcctgtgattgtaatattaaaaaaaaaaaataaacaaaatgcctaaagtaaaaataggagaattaaatgtgtgccattaaattacagggaaattttgtgtaaaaattataggaaaataataaatttatttcaaaaaatatcactaatttgccttgaaaatttcataaaattcgttatgtttcggaaatattatgccagaaaaattaaggaaaccatattttgtcattctagaaatgattttaattttaatgtcatgatgggtaattaaaatatttaatttcataggtaccaccaaagttggtcaaccaatcgtcagcaggtatggcattgccgatgccaattggtgttggtggaaaattgcccaacttcaaactgatctacttcgatgcgcgtggcatctgtgagccgatccgactgatatttcactattccaaagtgccatttgacgatgtgcgaatttcgcgaaaacaatggttggcattgtgagttttgaattgtttttttttgtgtaattttaatttatttttttagaaaggacaacacagtttacggcaaagtgccaattttggag

SEQ ID NO: 83846 - DNA, 107 bp, Heterodera glycines
  Genomic contig location: Contig_ID=SeqID_19105; Location=353..459; Strand=+
  SCN-specific regions: Sequence locations=1-107
atggagacgaacaccgtccggctgaaggagtatatggaatgcgacaatggcaccactgaaaggccattggatgtgttggtgttgcagagggatgccggtggaggacg

SEQ ID NO: 83847 - DNA, 972 bp, Heterodera glycines
  Genomic contig location: Contig_ID=SeqID_19106; Location=154..1125; Strand=+
  SCN-specific regions: Sequence locations=1-190,212-215,240-289,312-972
atgctcaagctgtactacagctttggcttttcaaactccatcgaacaaaacgtgcaaacaattggtggtgatccaagtgaatggagccgaacggcgaacacagcgacgaaacgacggactgtcgcttttgtcagtgcgtggcaaatggcaattggtcatcgctttttcctcgactccgtggccaatgcttttgtggtatttaaaaacaaaatgtttaaaattgaattcatttttaatttaattcaggaagaacttttcagcagtttgttggaagacgtgagaacagccgaagagacaacagaagcgatggaatttgaggaaatgatgcgccaaatggaaacactgatggaattccgagagggattcatgcgaaagtgctaactaaaatttgacaaagtatgctacgaaattttgtgcagattaagccgacacccacgcgttgtcctggacaaaggaaaatacggcgacggggcatcggcacccgacccaattttgccaagagatctctgtaagccgcaataggcttattgttagctcagcaattcgctttttttgccaaggcattcaacccattcatttgatgaatgcgtccgatcactccaaacggtcgatcactttacaattgcgaatggacaaaagtgcggcagaaattgcacaaatggcggcgaacgccttccaaacgcggcattttgttcacttatcaccgcacattaacggcgatgctcatttgcaaaaaggggaacaattggtggcaggaaatgagcaagaaaagggggaggaaggggtcgctggggaggacgacgaatttgtgttggtggaaatgcgcccggggggaggggaagcggcgacccgccaattcgagccaagggaatgttcggtgccgacaatgctcagcccaacggaagcggaccaactgttcgtggcacgcagaaaagaactgcataaactggcaagtgaagcatgcgactgaca

SEQ ID NO: 83848 - DNA, 418 bp, Heterodera glycines
  Genomic contig location: Contig_ID=SeqID_19109; Location=2029..2446; Strand=+
  SCN-specific regions: Sequence locations=1-54,76-77,99-418
atgtcgcactacggtacaagtgcacgtaagagtcaaatcattttagacgcataattgaagtaaattataatttcacttttcttggtgcataaaaacatcaaagacatagtaatttcacgttttattggtgtacacataaataattaaatcgcaatttcacgttttattggtggacacataaataattaaatcgcagtttcaccgtttattggtgtacacataaataattaaatcacaatttcacgttttgttggtgtacacttaaataattaaatcgcagtacgtcttattggtatacacataaataactacatccctacaaaacaaattctcaggtgaaacattagtatttgctgtaagaattggcatggaaagggacatttggtgattctttggaattcatcttttggtttaaaaa

SEQ ID NO: 83849 - DNA, 173 bp, Heterodera glycines
  Genomic contig location: Contig_ID=SeqID_19111; Location=265..437; Strand=-
  SCN-specific regions: Sequence locations=1-173
atgccgacggtgccgctggcgttgttgctcacgagtgccgtttgtttggcgactgtgctgctgccgccaacgccactgtcgccgctgctgctcacactgctcgccgcactacgcgtcgccggtgcgccagcgtacgccgcacgctcagcgagttcagtcgccatgggcaattg

SEQ ID NO: 83850 - DNA, 96 bp, Heterodera glycines
  Genomic contig location: Contig_ID=SeqID_19113; Location=613..708; Strand=-
  SCN-specific regions: Sequence locations=1-96
gggaccgggaattttgggcaaaaccgggaccgggacttgccgggacctgagaagtcgggaccgggacctcgatttttgttcgggaaccgggaccaa

SEQ ID NO: 83851 - DNA, 58 bp, Heterodera glycines
  Genomic contig location: Contig_ID=SeqID_19113; Location=901..958; Strand=-
  SCN-specific regions: Sequence locations=1-58
aatgagcagcaaaacgaatgggactaaagtgtgttctgcggttgcggactcaaaattt

SEQ ID NO: 83852 - DNA, 2093 bp, Heterodera glycines
  misc_feature (1040)..(1040): n is a, c, g, or t
  Genomic contig location: Contig_ID=SeqID_19114; Location=271..2363; Strand=-
  SCN-specific regions: Sequence locations=1-164,212-404,427-476,498 -978,1004-1200,1229-1294,1333-1363,1385-1802,1824-1892,1931-2093
  Gene Ontology: Mol. function=mRNA 3' UTR binding; Cellular component =mitochondrion; Biological process=mRNA catabolism
ccgtcaaattcgctgttcacgtgcatttcaccattcactcactttacagtccaaaaatacgcccagcaaattgcagcagcagaaaagaggcggagcatgtcgttgacaccaatatttatgatgatgaagaggggcaaatcgccgcttttgctgcttcatcaccagtctttgtcgttgtcgtcttcttcgtcatcatcattgtcgagtcgtctcctcccgccgctgttcttcatccatcgtcgcgatcactttaataatctccgtcgtcacattttcaccgccgagccgtcccaaaatcggctgatcacatcgatccgccaccgccagatcaccacaatcagcggctatcattctgctgctccgatcactctcttcaacggcagcggcaattttcgtcagcacaaaacagcaaccagcaacaacaaaatgggttcaatcacgcagctgagcagtgtggagcagcacaagtgcgcactgctgcacaccaacggcggtccggcggttgcgcccgcggcaccgttgacgctggagccgttggccggccctgacacgggcatcctggtggcacggattagtgtgccgtccacgcgcaacgcgttctcccgcgcacttgcacaagcggttggtgccatttttgggattaaattgcaaaaaacaaaacaaaaaaatttttttttgcgagtcttttactaggtcgttgcataaaaaagggcgctttttgaaggaaaaaaatttatgaacaaaaaatgaaaaataacaatcataacaaagccgatcaaaaagctacttaacaaagtaattgccctgactgtctacaaccttttgccgccgagatgggagtttaacaatgccctttttgtaaaattctgtgccattctttgaacctaggtaattttcactggatccacgaccttgccatattctttaaagagcctaccctataaggaattttcgaagagtataaagctactagaccaaaaaatgaatttaaattggtttaaaactcacgaaaatggcattttttttatacccaccccccnccccccccttcgaaaaaaataataattttttctttcaattttcagttccgtgacatggtcgaccaattgcgctacggcctcgaaacgcgtgcgttgattttgaccagttctgtgccacaagcattctgttccggtaagccattgtcattttacaacccccaaaaaaataaaaaaattataaatttttaggcgtcgatttgaaggaaagacgcaaaatgacgtccaacgaagtgaccacttttgtggatggttcgtttttatttcttttaaagttttatatatatttttttttgccattttattcgttcaaattttatcggtcataaaaatttcagaaaattttaggccttcgtcgaaccattaacgacctgtccgagttgccttttccggtcattgcatgcattgacggctgcgcattgggcggcggtttggaattggcgttggcctgcgacatgcgcattgcgagtgagcctttcttggaattttcctggcccttttctcaatagtttggcgattttatttgattgtactatagtacaaagtttaaatctgttccgctaaagtgaccaggttgaacaaaaacagaaaatattcggcagcattcttccgaaaattcggggattttaattttttttttcttcgtcctcctaagaattgtccctacatttgcgaccgctgatccacaaaatcgtgccaattttagcattttttcaacgacactttcataaattccaaaactgtaatattgaacccctatttggattttaaaaaatagtttgattgaccctaaacaccatttgaagttacagagagtttggtactcaattttccgtaaacgaatttttctctcagattttaaactttaaaaaacaattgttttttctgcttgcagcaccccgttccgagttgggcctgcccgagactcggctggccatcatccccggctgtggcggcacccagcggttgccccgggtggtcggcgttgcaaaagccaaggagctgattttgaccggacgcaaagttcggggggacgaagcggcacaaattggactg

SEQ ID NO: 83853 - DNA, 205 bp, Heterodera glycines
  Genomic contig location: Contig_ID=SeqID_19114; Location=530..734; Strand=+
  SCN-specific regions: Sequence locations=1-11,33-205
gtgtttagggtcaatcaaactattttttaaaatccaaataggggttcaatattacagttttggaatttatgaaagtgtcgttgaaaaaatgctaaaattggcacgattttgtggatcagcggtcgcaaatgtagggacaattcttaggaggacgaagaaaaaaaaaattaaaatccccgaattttcggaagaatgctgccgaata

SEQ ID NO: 83854 - DNA, 2329 bp, Heterodera glycines
  Genomic contig location: Contig_ID=SeqID_19115; Location=729..3057; Strand=-
  SCN-specific regions: Sequence locations=1-124,172-273,306-336,415 -533,555-587,625-832,855-897,920-970,1042-1096,1118-1127,1149 -1299,1321-1365,1397-1539,1574-1676,1700-1903,1925-1935,1957 -2205,2228-2329
  Gene Ontology: Mol. function=microtubule binding; Cellular component =spectrosome; Biological process=body morphogenesis (sensu Nematoda)
atgggaacagctggtaaagacgacgacggagaaaagccatcggttgaaggaggcaaacaagcagaagacgttcatggcagcggtgaaggacctcgagttttggctgggagaggtgaatttcatcaaaaaaatgttaaaacaattaaaatatttttaaataaatgatttttactgacagcaatatcaaattagtttttgccgcaaataaatcaattaaatttaagaatttaaggattttgaatatttttttaaactgaattccgagatttagtgatattttattgactatttaaaaacattaatttgaatgatgcgatttttttaaaatcatctttgataaaaatgataaaaacttttttattttattttttaattagttaattttttttacttttttattactaatttttttatctcttaaattgttttttgatattaccaatgtattaaacattttttatacaattttcattttttcaggtcgaaacactgctcgcctctgaagactacggtcgggacttggccagcattgagaatttgttgaaaaagcatcaactattggaggtaaaatgcatttctaaaatctcaaaaaatgttatatttttaaaattatttattttttaaggccgacatcgtcgcacatgccgaccgagtggaggaaatgaaccgtcaggcggatgccctgctcgagtcggagcagttcgaccaggcgcaaattgacggacgccggcgcaacatcaacgagagatatgagcaagtgaaagtgggtgaaaagaatcaattgtattttaatgttaaatttatctatttaacattcgtgaaaaggaaatccgaaatttaaaaattaattttggaaaaaccgacgcaatcctttctgtttaaattataagtggatttatcttttaatttattttgtaagcatattttattaattaatggaaaaaaaccaattttaaatgaattgcatttctataatttaatttaatttttgttttaattcaaataaaaaatggattttttataaaatatttattattttatcatattgttgattaaaaaaacatctcgccaattcactttttttgcaaatttaatatttcaaaaatattttgcaatttcgaaaaattatttttgtgcttcttaaccctctttagttgttgcttctttcaggactcgactgatgtgcgtcgcgaaaaactgaacaaagccatcactgttcaccaatttctgcgcgacattgacgaggaggagtcgtggataaaggagaagaaagtgagtgaatttgttttaatcggatggatttattttttaaatatatttcaacttattatttgaaattttcatgaaaaccccagtttaaaaacgtaattttttttcttaaaaaattatttaaattcgttgttttttttttcaaatttaccacaaaataataaactaactttctagtgtaaattttttttaaatggcgctgaaattttaaaatttctcatggcgacgcctgccgacacagcctggaccttcattttacaaatacataagttttaaattatttttaattaatttttgttttttagctgttggtgagcagcgacgactatggccgtgatttggccggcgttcaaaatttgcgccgtaaacaccgtcgttttggcaggtgagctcattaataaaattccaaaaatatttatttgccagaaataaatgcaatattttgtcttttactgatgagaagcaaaaattccgtgcgccaacccacatttaagccaatttaggccgcctaacttttccaattattgtccaattattttttttatgttagaattcacgaaaatttagaaaaatgcaaaaaagtaagaatttaaaaaggtgtccaatgttaggactgagaacaggaaaaaccgaattttttcttggcgttgactcaagaccgggtacaaaaaatgtacccccaaaaattgcgtcattttcttacactttttttttcaaaaacagtgagttggacacccatcagccccaagtggaagtggtgcgctccaagggcaaggaattggccaagtccagcgaaattggcgggccggagattgagcgccgtatcaaagcattggaccaaagttggacacaaatggtcgaattggcagacgaccggcaaaaaaagctgcaggagaggtgggaaaagggagaaaaagcattgaaaatttcaaaactatatgagtgaatttattttccccaatttttctaatattttttgaaaaagttattgaaatagctcttcaaaatctacacaaagcgatattttcaaattttatttgaaattctcggtccaaataaa

SEQ ID NO: 83855 - DNA, 51 bp, Heterodera glycines
  Genomic contig location: Contig_ID=SeqID_19116; Location=740..790; Strand=+
  SCN-specific regions: Sequence locations=1-51
cttttcttcacagcgaatgcatatgacttaatattcaagaatatttccgtg

SEQ ID NO: 83856 - DNA, 711 bp, Heterodera glycines
  Genomic contig location: Contig_ID=SeqID_19117; Location=33..743; Strand=+
  SCN-specific regions: Sequence locations=1-96,118-435,457-659,692-711
atgggggatccaattcagctcaatcctccactgaactactttttcgaagagagaacggtggaaatgcgcggatggacttttggcaacgaaacggacattggccaattccccgttttagcgacactttcttgtgcggtcgaaatctgtgcggatccgtgtgaacagagctgtttggacaaaattgtgagcacattttgttgtgctttgggtttgacaaatcttggaaaaacaaaaattttaaaatcgaaaaattcaaacaatgggtttacctgtcaaaaaatactcaaattttgcatccttttgggatgcggcaaaaaagggtattaggtaattttaaaaaaatcatttagttctaagaatcaccaattttgattaaatggatttttttttgttaatttatgttgtttttgttactatttgtccccttccgaatgccctccaattaaacaataaatggcactaatttatatataatttcctcattttttctttacagtctcttgacaagtgcagcctcaatgattttatcggtgacaaaaatgccacggatatttgccacgaaggaaatgccgccgctgttcagggcacaatcagtttttgtttgatgacgcttctgatgttcctctgttcttccactgttttgatgtttcagtgataccaaaaaataattttattttgttttttaataattctaattcgttaaagaatcaa

SEQ ID NO: 83857 - DNA, 50 bp, Heterodera glycines
  Genomic contig location: Contig_ID=SeqID_19117; Location=1610..1659; Strand=+
  SCN-specific regions: Sequence locations=1-50
atggccgaaggaaaaaaggacgaaatatggatttaccaacgcagaaattg

SEQ ID NO: 83858 - DNA, 2114 bp, Heterodera glycines
  Genomic contig location: Contig_ID=SeqID_19118; Location=758..2871; Strand=-
  SCN-specific regions: Sequence locations=1-215,237-987,1012-1468,1490- 2084,2107-2114
atgattaaaactgctcttttcgatctcctcgacggacacacagcacaaaaccttccctttctgcgtgaaaatggtcgaattgctgtccctaaaatgcttttttgcttttatcggaatccgttgagaatcgatctaagcaattctaaaaaggtaacaaatgcctttctgctaaatcccattctcatcatcaaatacatttattgtagaaggaactcttggaaaaaatggagaaatgtattgagtcgcaagtttcacattttatgaggcaacacggaatcatcgacaatcgcttgtgggtttgtcttccaattcgctttttgtttgattggttccgtgtaaataaactcccacaatttttagtcccgaaaatgctcttggccaaattacaatttcttccggggcgcctttcgtttacatttttaaccacgacgaacttcccaaagatgcaaacaatgaatttgtgctttccctttaccctgaagagtcatgcgaagatttctctgctgaacgcattcagaaattaattgaaactgtgttggaattgcatccaaaaaacaaaaagtgtacgtacgtcttttgctaaattttaattctcattaaaaaattagtgttaagtcgttccgattacaatttcgactatttcctacacacagcaattttaaatattcggaataaaattgtggaagatattggcacaacacttagtctgaatgactttgtgcaagcggcaaaattcctcaagcgaatgtttgtggacggggcggcggacggatattcaatggcattttcgcgccattccctgcaggaagtcgacacgcttaacaggtgcttaattagataattgttatcaagtctttaaatgccaaactgttttagcataatcgattcttccgtcggattcggcatgaatctttataagagtcagctcaaccagcagccgaatgtgacgggaggtggtgacatcgccttctctcaactcgagcatgattttacggttaaaaaatacataattatggaattacatttctttactcttaaaatttggtgctttagttgaacatggtaagtgaccaattggtgcgtcgttcgccgagggctttgggcaaagcaaagcaaaatacgatggtcgagcgaatccgaacggactgcacggcactttggatggatgggcaccaaagatgtgaaacactttctctcacgggtgcacttttgctatttgtaatcgaagcaatcacttaattgttgtggtgataattcaggacaattgtgccattttacagtgagtttcccttttgttttgcctattccctttccttttgttttattgttagctccatgacttgccaaatgaaacttcggtcggggggagtcgttctcgagatgaaaagcgccctcggaaggagcactgttcgggtgtaaaaacctactcaatgtaattaattgtctgctcatttcccatcatctgtccttccctctgttcatttctttaggtgtaattgcggtctgtcgcgtcaaattcgaagcgaccctttttctctgaaggtgagtttcttttattaacaagagaatgattcattgtaaacagcaaatttcaggaagcaaacttcactttttaccaaaaatcggacctcacatttgccagttgttgtgctgatttggatcgttacgactttcatttgttcaatgttcacgacgcagcaacaaatagggcctctaaaagtgacgaggaccttgacacgacaatggtctttgatgatcagaacccaaaagggccaagtccaagtgggacgaagagagaaaacgaagcccattttgaagtggacgatgaagaaaacgttgtcatcgatccccatgagtacaatattcggtttttcgatgatgatgatgacggcgcggcccaaattccttcagacgaaggcgaaggattagaaatgtcggaccaaccgaaaggcaatgaagctcccattgaaccgatgacgcaagatgatgtgccaatgagcaaagcatttagtggcgatgacattgaggaagacgaggaggtcgaagaacagcggaggaaagagcgaatcgaatcgacggaagaagacgaggaattggatgaggaagcggaagag

SEQ ID NO: 83859 - DNA, 605 bp, Heterodera glycines
  Genomic contig location: Contig_ID=SeqID_19118; Location=886..1490; Strand=+
  SCN-specific regions: Sequence locations=1-497,519-605
catcttgcgtcatcggttcaatgggagcttcattgcctttcggttggtccgacatttctaatccttcgccttcgtctgaaggaatttgggccgcgccgtcatcatcatcatcgaaaaaccgaatattgtactcatggggatcgatgacaacgttttcttcatcgtccacttcaaaatgggcttcgttttctctcttcgtcccacttggacttggcccttttgggttctgatcatcaaagaccattgtcgtgtcaaggtcctcgtcacttttagaggccctatttgttgctgcgtcgtgaacattgaacaaatgaaagtcgtaacgatccaaatcagcacaacaactggcaaatgtgaggtccgatttttggtaaaaagtgaagtttgcttcctgaaatttgctgtttacaatgaatcattctcttgttaataaaagaaactcaccttcagagaaaaagggtcgcttcgaatttgacgcgacagaccgcaattacacctaaagaaatgaacagagggaaggacagatgatgggaaatgagcagacaattaattacattgagtaggtttttacacccgaacagtgctccttccgagggcgcttttca

SEQ ID NO: 83860 - DNA, 3650 bp, Heterodera glycines
  Genomic contig location: Contig_ID=SeqID_3242; Location=592..4241; Strand=+
  SCN-specific regions: Sequence locations=1-106,136-182,204-353,375 -395,421-569,603-744,767-1014,1037-1384,1439-1587,1610-1966,2005 -2205,2227-2625,2647-2663,2685-2722,2748-2990,3014-3323,3345 -3374,3497-3537,3563-3590,3622-3650
  Gene Ontology: Mol. function=signal transducer activity; Cellular component=cytoplasm; Biological process=cell-matrix adhesion
atgctcgaacaacgcgacaaaatgcaggaacaattggtaaggcaattatttattactttttattggccaagggacgacggatgggccaaggccaagctgatttttcaaaatttaaaatttaattaatcattttttgattaggtgcgaatgcaaaagtgcgtcgaagaaacggaagagaaatgccgggaaacggagagagagcgagatgtactgagacggcaaattcaccagcagaccaaagacatgccattggtcggcgagcggggggggggctaagcttggcaccaattagttgggaaagtatggcaaaatttgacctggggaattagaaaggctcgcaaatgtttgaactgtttaaggagattccaaagactgggcccgggtgaaaaagtttgataattttttaaattaattttaataggtagctttaattatacattaaatttttttgctgattgttaaattttagaaaaaaggaattccgaactaggccggatttgttaaattattttggtagatgaaattaatttgaattaatttgccaaactgccattggacaccattttctgaaatgcatctcttttttaaaaattcaaaagaaattttcgctataagatgcaaacaaatgaggcattatattataaataaaccattttttggcaatttaggaagtgcaaaatttgacccacgaattggtccaatgccgggagcaattgtacgagaaggaggaggaaattgtggagatgaaggcggaacggaacaacaccagactgttgctgtcagtgaatttgttaaacacacttttaatattgttccccgctttagggaacacttggaatgtcttggtaagttgggcatatgccgaaaaattcaaggaggacgggttaatggcattttttgattttctatcggttttcgtttggcatttgactttgttttctaagacggaaccggtgccagttcgcgcctttacttagaaaggaccaacttcgtttctcgatgggtgttcgaattcgccaccctttcccgggttttcggggctctttttaaagcttgggttttttactaccaatgaaaaatggtagaaaagtcgtacataggacccgagactcctcttttagacttaaattggccctgggcttattaatccctttctgttctttggttttttcttaattggtaatgatacttttacaatattccccccccccccctccggcacagtgtccaaacatgaaaagtctctgcgaatgactgttgtgaagcgccacgcgcagtccaaccgcgacaacagcgtttcctccgaggtcgaagtgctcaaggcgctcaagtcgctgtttgagcatcacaaagcgttggacgaaaaagtgaactccgtaaaatgaataaaataattaattttcaatttaaatgtcatttttttaaatttaaaaattaactgcacattttccataggtcagagaacggctgagagtgtccattgaacgagtgcacaatttggagatgacactcagcgcaacgatggaggacaacgcggcactgaaagcgcagctggaactcagccaagaacagcagcagtcggcagcactgcaacaccaggcagaacaatgcccggggaggggataattaattgattagcccatgttattggacaccttttatgggaatgattagcccactttatggggtcccaattttattggccttgaaattacattaataaattcggctttattttaaatatgggcaaaaggggaagccgaatatagagccaataattgggctatttgaatgttgccatttatttttcagcgtgtgccaaacggcgatttgaaaaattctgtcgatttctgcgccaacggaggcgctcaatccgccgctgttgttgagctgcaaaaacaattggacaggctcagccaggagtatagcaccagcatcaaacagaccaacgaactcagctcgaggcaaaaattgttttaaaataataaattattacaattttatggccggggtaaaaaaagcgagtggaaaacaaaaattcaactcccgttttaatagtgattttaatgactaaattcaccaaaaaaagagatttaggttcgacaatgccgataagcaccgcaaaattggaattttaattgatttttttaaaggcatttaatttttttgaaaattccattttctttccctatttttactagctaaacaacaaacattaccaaattaatcctatatacccaattaatcctataagtcatccaaattatttttaggaattccgaattgcaaacggagctttcaaatgccgaaaaggaggcgcggcaagccaaagagaagatgcatagcattgagcagcaaatccaagaggtgggacataaatggaggaagaaagtatgaatatgcattccctggatcatcaaactcatgtcccaaccggtctttggcaaaaaaaaaactcgagaaaagccaaagccactaaataatgttgtgttgcagttacaagcccagcgggacgagcaggacacgcgcgtgtccgtgctggaaggacggatgatgggcgcgcagcgggagacggcgtgcatccgcgacctgaatgacaagctgatattccaggcaaaacggggaattttgaatttatttaaattacaatcaaaatgaattaaatccgagcatttatcttctctttaagattgccaacaaagacgcggccattcgcatcagtgaggagaaagtgcagcagctgaaggaacgcctcgaacttgcggaggcgcaattggcccaaagtttgaagaaggccgagtcactgccgtcggttgaggcaaatgtgtttttttgaattggcacaatggcttcatcctgccaaagcctctgagattgcttttaaatttgggagatttaccgctttttattctctgttttaggccgaactgttccaacggatggaggcattgtcagcagcggaaaaggtggacaaaacgccaacaaatgagaattaataattattaattttaaagaagcaattgtcagcggaggaacgcattcaccgaatggaaacgcttttggaggagaaaaatgccgaattggagcggacattgcaacgcgaacggattaatgagggacacaatgtgaagaaggggggggggggggaagacgatttgccaaaaattagtgggggaagacgatttgccaaaaattagtcataactagggctactatttatagctctaaaaactagagtgccacgggaccgggaatttttgccaaaaccgggaccgggacttgccgggacctgagaagccgggaccgggacctcgattttttttcgggaccgggaccgggaccgcaagaaaaaccgggaaccgggaccaaccgggaaattttaaaaattcaaaaaaattttaaaaatttaaaaaattcaaattttaatttatatcaagtgaaaataatacaaaattatttggttttttatttaataaattaaattaatgaaaattttcaaacaaattttcttcaattatttcaaacaattattcatcgaatattaatagaaattcagatttgattttcacatcactttttttcggacgttttttcaaaaaacttttgggaaagaaaggggtccggcgttgccaataggcgccgtcgggggg

SEQ ID NO: 83861 - DNA, 1770 bp, Heterodera glycines
  misc_feature (62)..(62): n is a, c, g, or t
  Genomic contig location: Contig_ID=SeqID_3243; Location=1..1770; Strand=+
  SCN-specific regions: Sequence locations=1-26,52-294,318-559,616 -806,846-968,1000-1509,1536-1597,1626-1770
  Gene Ontology: Mol. function=signal transducer activity; Cellular component=cytoplasm; Biological process=cell-matrix adhesion
acaaagacgcggccattcgcatcagtgaggagaaagtgcagcagctgaaggacgccctcgancttgcggaggcgcaattggcccaaagtttgaagaaggctgagtcactgccgtcggttgaggcaaatgtgtttttttgaattggcacaatggcttcatcctgccaaagcctctgagattgcttttaaatttgggagatttaccgctttttattctctgttttaggccgaactgttccaacggatggaggcattgtcagcagcggaaaaggtggacaaaacgccaacaaatgagaattaataattattaattttaaagaagcaattgtcagcggaggaacgcattcaccgaatggaaacgcttttggaggagaaaaatgccgaattggagcggacattgcaacgcgaacggattaatgagggacacaatgtgaagaaggggggggggggaagacgatttgccaaattttgcaataaatatcatccctagtcatagctcgtgccagattttaaaataaatgcaaagtctaaccctaccgattggtgggtgcctccctgggaaattattacaaaaaaaattatttattttttaataaattctaataatataattaatgtaaacctaaatttgctcagaatcgcctctccgccaccgtcgacaaattgttgagcgaatcgaatgaacgcctccaaatccatctgaaggagcgaatgcaggcgcaaattgacaagaacaaactgatgcagcagcttgaccaggccaagaaaatgtttgaccaggtggccatttgacacgaaaatccggccaattaattatatttaatgactaattaattattaattaatgccccttgacagacggaacggttcaaagagcggctgctgcgtgagaatgacgaccttcacaaggagatggacatgctgcgcaattccctctacacgcagcggacagcccaattttattcccggtaattttaatttatttatacattaattttatgattactatattacaatttgcctttgcttagtctcaacaatggcgcggttggcgccggcatttgcgcttttcccccaccgtccgctgtgtccgtcggtgccgctgtcggggtgccgcatcatccgctttatcagcaggcgccaatgccgccgtcctatcccacgcaaagtgtttgcgccatggacagcgaggacagcggagcgcccgcgtttaagcgacgcatgcagaagggacgcgtcacggcgctgcaggacgatccgggcaaagtgcaaacgctgggcgagcaggagtgggaccgcattcagcaggcgaacgtgttggccaacatccaacaggtggggactccaacagcaacaaggaacaacaatcagcagttggaaaattagccctcaaatggacccacaaattttattgaattttcaaaaaaaaaattccccgcagggcttttccatgttcgatttgcgacgtttcactattcagtcagtcacccataaataggattttttcaaaatttaattcaaaatccttttaatatttatgaaattggggtacatttcattcctccacaccttcatcattcggcactcccctttctccgttattttaatttatttaaaacatttttaggctttttccacctcttcttcaatgctcaatgtgaacgcggcaccgccgcctgcgctggaccaatcgacgactgatccccacacattggcctatttcattcaggaccgactggacgcaataaacaacgaaattcggctgatccaa

SEQ ID NO: 83862 - DNA, 142 bp, Heterodera glycines
  Genomic contig location: Contig_ID=SeqID_3244; Location=1139..1280; Strand=+
  SCN-specific regions: Sequence locations=1-142
aatgctaagcaatttgacatctcagaaaaaagttatgagagtcaaatttttatcaggttataactcaactccaaaactgctgttttctaccaaaatgcgaaaaactaatcattttttattgattctaaatgtccaaagtaga

SEQ ID NO: 83863 - DNA, 75 bp, Heterodera glycines; identical to SEQ ID NO: 54636
  Genomic contig location: Contig_ID=SeqID_3244; Location=1977..2051; Strand=-
  SCN-specific regions: Sequence locations=1-75

SEQ ID NO: 83864 - DNA, 491 bp, Heterodera glycines
  Genomic contig location: Contig_ID=SeqID_19120; Location=90..580; Strand=+
  SCN-specific regions: Sequence locations=1-208,236-468,490-491
atgcacaaattggacaatgttttggcgaaaaatgctagtgtccacccgtccaatcactgtgaggtcagttccgtcccgtcaactccatcccagcccagttaaaaagccataagttttttctttaaaaagtttgctaaaaaaagttggctttctcaaaccatcaaaaaaaaaaaatccgttttattttcaaatggaggcattttggcgtaatggtggtgatggtggacacagagcaattggtggaaagcacgaagcgggcggagatgaatgtgtgaaacaaaaggaggggacggtcgattcgatgaagcggtggtgaaaagcatacaaaatgcgccgcaaattgggattgatcaaaatggggacgggacgtgcgggggaagaggtcgcgcgtcgccggcgatcggatttgtattgattgatgatcggtttaagaaattgtgggataagaagacagtagagataagctgattagaaaatttaaataacattta

SEQ ID NO: 83865 - DNA, 226 bp, Heterodera glycines
  Genomic contig location: Contig_ID=SeqID_19121; Location=528..753; Strand=-
  SCN-specific regions: Sequence locations=1-138,160-226
atggaccttaaaatgtcggagaggaaaaatgatggagaaaaagtgttcaccggtgagtgaaatgattgaaaactactcacataagcggatgcattgaacaaatattaggtgattgtgcatgtccaaaaactgaacaagttgaaatggacagaggctggtcgaaatgttgagcagaagcacggagtcggagcagagcagcatttaacagattaatgttgaaattaaa

SEQ ID NO: 83866 - DNA, 432 bp, Heterodera glycines
  Genomic contig location: Contig_ID=SeqID_19122; Location=327..758; Strand=+
  SCN-specific regions: Sequence locations=1-26,48-118,185-432
atgtcacttccaggaaagccatttaactgttggaattcttctgcttgtcacagtgacctcgaaatcactgatgataagtgtttggcagtgcattataaggaaaacgaatacggtatagtttataatttacaataaaatttcgaatatattttttcaaaattttttattaaacaaataatttattccaaggggggcatatattcgagagtggggttttattcaagggtggggttcgattgttcaacccccctttttttttacaaattcctatgattttacgcatgaaatttttattaatttttgaaatatctaggtcaacttttttggctttttacacaatgatacaattaaatcttaacctgaaattttgaattgaaaatttttcaattttgacccttgaaaatataagcgaatatttgaaatagaatttta

SEQ ID NO: 83867 - DNA, 634 bp, Heterodera glycines
  Genomic contig location: Contig_ID=SeqID_19123; Location=679..1312; Strand=+
  SCN-specific regions: Sequence locations=1-474,616-634
atgatggagaaaaagagcaaaggccaattttatactgaatcagtcgcctatggaacggcccgtcccaggggcagtactcaaaatgcgactgccgggtcgtttcgtaaaactgtcaattgccaagagcatttcctaaaaactgccttggtcgggagggagcagatatattcgggtagagtgtaatttgtgagccagggcgtgacagccggctgagttaaattaggtgggggattgagttgatataaacctaaagttggttaaaatgattaaacaaaactttttagaatgatatcacaaaaataaaaagtaaaagtgaaaatgtgtgtaaatgttgaagaaaatggccactttgattagaagaggtgtcgatttgggacgcgaacgtacagctgagttggaagaaacgcacgcaatgctgaatgttggccaagcagcaactgcaaatcaacagagaaaggaaagagtgcttggcagagagaaataaaaagaaaagagtgtaagcagagagaaaacgaaggaaaagaatgtaagcagagagaaaacgaaaagaaagagtgtgtggtagagaaaatgaaaagaaaagaatgtatggcatagagaaaatgaaaggaaagagtgtctttggcagagagga

SEQ ID NO: 83868 - DNA, 808 bp, Heterodera glycines
  Genomic contig location: Contig_ID=SeqID_19125; Location=209..1016; Strand=+
  SCN-specific regions: Sequence locations=1-252,297-808
atgcgtcgtcctgctgagtcagtgctgcatcggtggtcgatcgaaggaaaatgaggcaagttctgagcccacccccccccccccccccataatcaaaactcaatttttaatattcacttttttcagccggagcaaagcatcacttacgtcgacttgaacagcgcgattctcggaggaacggcaccaccggtgaagccgatcgtgggcactggaacgaaagacgacactggaaagaagggcgagcgaacgcaatttttgaattggttaataatttttctttgtttttcaggttcggcgcattccgaagccaagaagcaaccgacaaagccaaaagcagcggacaaagggaaaaaagtgccatgtaggtgttcattttttaatttgaatttatactgattgtcctcccattttagcaaacgagcctgcctgtgcagagaaagggaaggaagtgccggcacaaaagggtgaaaaggagcaccaggcgaaaggtgggcaaaccattttatttaatggcatttaatccatccctccccattttcagatgccaacaaaccgcaattggacacgagcattgctgtgaagaaatagtgccgtcaacagatgagcctaatgaattcgtgcgattatgaggaaattgatgatctccaaatgttacaatgctctaattgtcatgttatttggcctgttttgtcatatacatattcactgttgtacataatttgtatgtgtatatcgtattgcttgttatgtctccaccggaaaaaaagcacataaatcaccttttatgttatttaaagcaattctgaca

SEQ ID NO: 83869 - DNA, 1441 bp, Heterodera glycines
  Genomic contig location: Contig_ID=SeqID_19126; Location=240..1680; Strand=-
  SCN-specific regions: Sequence locations=1-19,41-41,64-121,143 -165,188-347,369-1323,1351-1441
atgacgacggacactgctgcaaatcgacagcgacgcggccgaggcgagagacgcacacgagtggtaagacagttggatggagaacacgattctgacatccatttcgagcccctgacccggattcgaaccaaaactcgaaaattcaatttccgacaaaattcaaattatgcaacaaaatgcacgagctataacggagaacgtagtatttcggttacaattgaactgttttgatgcataacttgaattttgccgaaaattgaatttcgagtttgtttgaatccgagttcggggttcgaaatggatttcatacagcgcctccgaaaagcccctaaaacatcacaaagccgctcattccttttttcctcttttatgggaccacaaactgattttgacattaattttagtcaattttcagcagctgcgcgacagtgccaagaaaatcaccaaagcgtccattcttcgtctggcccgacgcgccggtgtcgcccgaatcaacgcaagagtctacgacgaggtccgtgccgcgctgcgctcgtacttggaaaccatcattcgagacgcggtaagttttcaaaaaatgattaatcccgatatatcacatcacccaatgctttcaggccatctactgtcagcacgagaggcgcaagaccatgaagagccgggatgtggtacacgcactgaagcgccagggcaatttgatgtacggcttcgaacaataagcgcaaggaggaggaggatggatatatttggaaccggcaccatatgatatcttcatggataatattattgtacatgtgtgtatatgcatatattgtattgtatattgttatgtcgatgctattgtacaccatttatcagtgtaattgtgagccgttattattattgtctttgtgtgttgatattgtgtatttggtacgataaaggctgatatgactttttggcgcggtgcggatcgaaaattagatacgaattgttgaacattttgccgatttagtgacgcttttatccaaccccctcctaatttttgtacaaatcattgtttctaagagcaatttgagtctaaaaaaaacaatatttcgaagttttttcatcataaattttttccagggttgaatttttttttgctttttgtaaggctaatagagtatgtaaaggagcttttaaggtactctttcggtttgggtccgccttttgggtcaaattttttttttcttttttattgtcagaattgctttaaataacataaaaggtgatttatgtgctttttttccggtggagacataacaagcaatacgatatacacatacaaattatgtacaacagtgaatatgtatatatgtatatgacaaaacaggccaaataacatagcaatgctcgtgtccaattgcggtttgttggcatctgaaaatggggagggatggattaaatgccactaaataaa

SEQ ID NO: 83870 - DNA, 698 bp, Heterodera glycines
  Genomic contig location: Contig_ID=SeqID_19128; Location=153..850; Strand=+
  SCN-specific regions: Sequence locations=1-40,62-102,136-178,298 -394,418-543,565-698
atgaatatcgcctccggaaattcagcgcgccacgaaggtatttaaatgagttttatttacaccgttccaagttcaccgagggaatcggtgtcgccgtcgggcaaaatttaaaaatagaaatttttttttaaatttgaaactttcatgacatttgtccaacacatcgaaaatagaaatgttattaaaaatgaaaatagttaaatctttttattatatatatatatattatgatttaaataaaactatgcaaaaatttttatttcaagaaaatttgtaaataaatttatgatttaatttctaccctcctgcttggctgaccattgattttccaggacattcaaattagcttgtcaaaatttttcgatgcaattcaaaattgactcgaatcgaaaattgtttttgcatcattaaattttcatatccaaaattggtctataatttatatttccatgcattttaaagatgcaagtggaagcggaacggaaaaagcgtgccgcaattttggagtcggagggcatttgcgaggcggaaaagaaccgagcggagggcgagaagcaggcgcgaattctgcgctccgaagcacaaatgcaagagcaggtgtttcaataaaagatttaattccaaaacttgaagagcagaaatgaaaaaaaaccggaatttaaaggatttaaatgatttttgaattaaatttgaggaga

SEQ ID NO: 83871 - DNA, 757 bp, Heterodera glycines
  Genomic contig location: Contig_ID=SeqID_19129; Location=69..825; Strand=+
  SCN-specific regions: Sequence locations=1-116,138-240,277-563,601-757
  Gene Ontology: Mol. function=receptor binding; Cellular component =mitochondrion; Biological process=proteolysis and peptidolysis
atggccattggacttgccaagtcggccgaaagtgaaaaagagtcgcgcgtcatattagcggaagcggaggagcaggagcaagtgattgtcagccgtgggttggcgtgtgccatcgaaacggaggccgaagctcgcgcaaaagcgttggaacgaatggcgcaaggaattgagaaaatgggcggcactaatgcggctgcctttgtgacagccgacaattacgtgaaggtgagtggggacgcgaaatttaaaaagaaaaatttaatttgaattaaaattgattatgaatcgaaaagactaccgtattcctacagttcctccaacccttacagtggtaggagaacatcggtcctaatttgtaagtacagaaaagtgtttgaaatacttacttaaaaatagtataaaaatggcaaatcgtgtgttaagagatcagtgaaccaaaccaagtaaaaaaaaagttgttgggttgggaaaaaaaccaatttatccggcatcccaaaacattccgggttagttaatcggagtcgggtaaggcacaaaaatttttgctagcgatggcaaagtacaatttttaaaattatttcatataattattttaatttaccgccttaggcctttgccaacttggccaagtcgtctaacacggtaatcatcccgtcaaacagcatggacatcagcggaatggtcacacaagcgatgggcatctacggcacaattgccaatgcaaacacagccaacaaacactgaccatttttattga

SEQ ID NO: 83872 - DNA, 307 bp, Heterodera glycines
  Genomic contig location: Contig_ID=SeqID_19130; Location=762..1068; Strand=+
  SCN-specific regions: Sequence locations=1-83,105-307
atgatttgtctggcacttcattctccaaacaacaaaatgagtgcgacactcaaaatcagcaaatcaaaatggaaaacaagagcaattctaacatttcaaaaaagttacaaacgaaaataatcagcaattaattaattaatcaaatttttttggtaattgcctgaacgctgcgattttatatattttagcttcgttagactgtgtgctttcgaatgatatcaaaaagataggatttgttcgaacatggaaaaagttattgtatgaaaacccgggattgtcaattgattggactcataaagtgcattag

SEQ ID NO: 83873 - DNA, 1523 bp, Heterodera glycines
  Genomic contig location: Contig_ID=SeqID_19130; Location=1357..2879; Strand=-
  SCN-specific regions: Sequence locations=1-12,35-369,392-454,477 -578,607-814,836-1523
atgaacgagtcgcagctacaaaatgtttctcttaccggggaaatgtcgcaagaattggcgttggaattgttcgaaaacggcggtgtgttggtcagtccattttcatttctcaattactagacagtaaatatcaaaaatattgtatttaagatcttcaaggacttccctaagggttgtgagttcggcatggattatcgctcgtggattgtcggcccaaatttcctcgggatgaaagttggccaacaaacagcgcttttcatttttatcccttttaatttcctttttgcagatgatacctcctggcattcatttcatttactttaggtgccgtctttggtactttttcactttacgccacataaatttcttttttctgaagttttcgggggctcacgaataaaatggctatgaatctctattttttttattatattcccgtctatttgaatcggttttggacaataaatgtgaattttggtgaaaaattaatttacgtctttttttccaattcgggtccggcattttaaatgaatggaaatgattgtcatattcgtgatcagcgcccccgaagacccaagaaaaatacaaataaataaaaaaaattatgtggcgaaaagtgaaaagttaccccgtcttttccttctttatttcctttttattcattctttttttagtgtaccgggtgcgcctcgcattgctttctttcacaattttcggcaaaaggaagtgattttgaggaggtgggacacgaaaaaggaagacttggtgactgacgaaaagtcggacgaagttgaagtgcgtttttcgaattaggcaaattgtctgtcttttcttcattttgtttagttggatcgacttcgcgagaatctcagaaacattgatcgctttttgggagtttatccattcgcaggtacattaaaaaatgatgatcttttaaggtcactggggaaaacttaagaaaattttggcatgctttattaacatttctctaagactatcgcaattggctttccctttcgtcgtacattacgccaaactccgtccgtcgtctttccccctcaaattcactcggacgcatttcgtcccaaaatgaaatggtcacgcaggaggcgaaattggagaagaaattggtgagaatgcaaacaaaggcaacgcatttttccattttcccgcctttttcagggtgatccctttggtctttcgattgtggacagagaacaccgcgggcgcattcgcttcacggacgaaggcggacttccgctgatgagcgaaggggaggaagcgaagctgaacttcactcggatatcgcagatcacagtgaggaggagaacaaaatgggagaaaaaaatatgcggaattaaaaataacaaatagtttgtttttagttggctgacacaaatttaaggagggcgggcattgacagttccgacagacttttccaatgtttcgaagcaatgggcggtgattatcgcgaagtccttgcagaattccaatttgcttttgtcgtttttctcgtggggcag

SEQ ID NO: 83874 - DNA, 853 bp, Heterodera glycines
  Genomic contig location: Contig_ID=SeqID_19131; Location=171..1023; Strand=-
  SCN-specific regions: Sequence locations=24-365,392-752,775-853
atgccaacttacccaaggcgaaacaactcatttgcggctaatgctgtcgcaaatgatcgacgcaacaatgtgcttgtatatcttgggaaattaggcgagaagggcgccatggaaatgggcgaggaagtgactgtactgacatctgcggagaggagggaggaaaacggtggcgacccatttgcgatgcggcgaaaaattgggcgccatcacaaaaatccatcggggacgacagtagcacagcgggattctgtatacatgtcgaagggtacggtaaccttggcgaaggcaaaaaattgtagtggacttttagaggggaatgaacataaaaaggagaaataccagtggaagttgatgaatgatgctaatggagaagggaaggaggaggaggaaagggcacggaagttggacaatgacaacgcgggaggggaggcggaaaccgcggtggacggacgcggaagggacgaagccggaagagagccgcgtaagcggaaaaacgagacgcaaatgctagtgaatgacgaggacaagttggagccgtggacgaaaagcgaggagaagcagctgaacgggcccaatttgaagatggacgacgacggaaaggaggcgcgaaaagcggacgaaagaaagcgaaagatgcgaattcatgggcagcaaaagtcggcaaaattggaggccaacgaggacggcactgaagaaccatttgaaacgacatttatcacgccaaaacttcacattgaaggtgaaggattggttgaagcagaaaaagcaattgaataccacaacaggggagggatgtccgactcggaatgtggacggagaatgggtgacgcactacggagacaccgtgttcagg

SEQ ID NO: 83875 - DNA, 1513 bp, Heterodera glycines
  misc_feature (28)..(28): n is a, c, g, or t
  misc_feature (1193)..(1193): n is a, c, g, or t
  misc_feature (1196)..(1196): n is a, c, g, or t
  Genomic contig location: Contig_ID=SeqID_19133; Location=675..2187; Strand=-
  SCN-specific regions: Sequence locations=1-419,442-483,505-523,546 -901,937-1227,1249-1455,1477-1513
atgaacaatcggctgaaccaaaaccacnccggatctgccgcatcggcattaccatcacaacaatcacatgggcagaagatgaggcagaaactgaccttcgaaattatttccaaagaacacaggtttggacattcttgacttttttttaattactttaaatctattaacatgtagacaaatctaccgagcgtcgggacttccttggaaactgccggacaattttgtctatatgctcggcaagcgcattagtgaggtggaatctgctatggccgatgatgcgacagcaccagcctccgcacttaaacttcgaaagttcaaacatacgggctttgtcgtcgaatccttccacaggccaacgattcagtgttatcttgattctatcgagtatttgaccacaacacaaaagtctgccgttatggcttctttcaacaaagagggcttgtctgctattcaagttttaatattatgcacctcagtcaataaaattttctaattcagggaccaccagggaatggaaaaaccgagcttatagctcacatttccattctcgctgcactctcatatgtgtgcaattacagcaaagaggaggatgaggagtgccggaaccgcatgcaaaatatgaagccgcaaattctcatcgtttgtgccacaaacagtgcagcagaccacgtagccgaacaaatttcccgactcaaagaccaactgatttcggacgatgacctcttccaaatttctgaaggacttcaaaaaagtctgccgacttccggcaaatgcatgacactcgggcaaatcagaatcatgcgcaaatatgcggcttcatattcggcagaccaagttccacatcggttgtggtattgttccaacaaaaacggaataccctaccatcctaaggtgctagctgctaatttgatttgatttatttttattttaaggacatcaacgtcacaataatgactattgacatgcaaagggctttaaattcttggcactttacgcgcctcaacttgtagtgttcgaggtattctaaatgtaattcgatgttgaggagacacactatccatttcctgcagagacacactatccatttcctgcatatcggggcagtattaggaaaataggatagtgtgtcccatataatgttagtatcataaatgtgtctcacaatcctgagtaacacgtgtctttcctgattnggnaatataatgaaaatgtgtctcataatttgtgcatgaatttttgaaaatctttgtcacatgttatgcctgttgtcagtttttaacattttcaggaagcctccatgacaaacttctttgagatgtttggtgtcttgtgccgaccaattaaccaagaagcaagggaaaacatggtcgagtcagcgcatcagcgacgcaaaggtatttatcctttaatgatgttgaccttagcaaaaccctttaagcaaacgatggtctgccgctcggctcaaaacatcaacatcaaagggaaaatgatgatgatggctgtacttgattga

SEQ ID NO: 83876 - DNA, 967 bp, Heterodera glycines
  Genomic contig location: Contig_ID=SeqID_351; Location=808..1774; Strand=+
  SCN-specific regions: Sequence locations=1-134,190-291,460-607,669 -757,808-943
atggcaattggctacacacttttagcattcataacgccctccaacccgttgctaattcaaagtatgtacgtcctcatcatgtctttggttggcttgtgcaccattggccttgtaaagcaagcgcgatgggtgagtaattattactaattaattaattagctaattaaggattaattcaattcaaattaaaattcaattgtctatttttttaaattcaggtagacgctgagaatgctcaagcaatcaactcaacaaacacagcaattatttatatcatagtgatgtaagttcaaaaaataatttgtataacaaaaaatttattaaaaaataaagtaattattatttaataaacgaaaaaataaaaataataaaggaaattatggacttataatattatttcaaaaaacattttaattttattgaatattaataaaaatgttacaaatgaaatataaaaaacttgatgattggtcaaattttacaaaaataccgattttcgcaaaaattttattaatatttacagctagaatcaagttaattttttaagcatgatgctccatattcaaaatatacgtgccataagttcatatacctatgaacaatggtcttaatatttcaaaattttaatctattttaatgttcatttaaattaattaatttttaaatatcaaagtgtttttaaaaatctgattaaggttgatccctgaattcgtcactttgattattccgaaccctgatgatcaaaacgggagaggggtaaatttaaatttaatttaattaatattatttaattattaaacattttaagtggatattgttttcctttttattgctgttttgcaaacattgagcgcagcaatttcgcacatttcgattatgaggaagaaataaaaaaagaccaaaaacgataaatatgtttgtctaattcaccgcaattatgtacataattaattaatttaaatattta

SEQ ID NO: 83877 - DNA, 1459 bp, Heterodera glycines
  Genomic contig location: Contig_ID=SeqID_351; Location=2087..3545; Strand=+
  SCN-specific regions: Sequence locations=1-216,257-353,376-413,435 -776,801-1051,1101-1459
atgcccgtcattgtgccaaaatggttgtcgtgtgtcgagagtggaatcagttcgggattcagaacagatttacgggaattagcagcaatccttgtgagctgcttgtgagttggcacacaccaaaatgccaatttggcactttctcgaggggataatcaattcatcccttacaagtggtaaaagaatgtcttaataatggcaccagtgagaccaggacgggaaaattttttaattcaaattaccaattttctttggaaaatccacgcttattctttggcctcgttgaacttttttttagtcttttgcagcttttcctttttgttgcttttcatttcaaaatttatgttttgtgttttcaattttctgttgctgatgcaattttcttggaccaaaggccacaaaatgaaagtgcccatttttgtttttgcattttgcaaccaaagattatgaaatattatgtgattttattgttgttatcctcggctgttcttatgtttctttatctttgaaaattggtggtgctttgttttgtacccccgggggtcaaatcgacggacgaacgaacgacggaccgaactgaacacatgacagatcaacgaccttcccgttcctgctgctaatgatgcaaccaactgaacaaattgcatttttccgtgatcagaaaatggatcagtgaatcagaacttcttgtaaaatgcgacatacggtagttttgaggatttgaattcatatgccagcagatatggaaacaaatttaacttttttagggatttgggtaaaaattttaaaatttaattaatcttttaacctttaaaaaagtgaattgtaaaaaaattcagaaaaaaaggatttaaattcgatttaatttgcaattttgccatttttcttcagtttttcattggtttttcttccctatttttggccacatttaatttcaatcatcaatatgacaagacatcatttaagttgccagcttaagaaattctctatcatttatgctttccatcaatttttggatgctttcgtttgcatattctttccttttcgcaaattatttttatttttcttggtttcttttttttctccttttttttgtttctgatttcagaaagttgcctaaataatctttaaaagattttttttaattgttgctaaagccattgctagtagtaaaaaaaattcggtaacagtatgaatggtaccccctctcttttaaaaaaattttaactttcgtaaagttgttttattggttttcgggccggatacggttctgacatccattttgacctaatttgaaccctgaacccggacttgaacaaaattttcaaaaatctccaaataggcacttaaaaaggcagaacaaaatcgcaaaacaggcattaaaaggcacaaaaacaagcaaatcaaattttttgttcactctttttaggtagcaaaacacataaaacttattatgtta

SEQ ID NO: 83878 - DNA, 2090 bp, Heterodera glycines
  Genomic contig location: Contig_ID=SeqID_352; Location=1175..3264; Strand=-
  SCN-specific regions: Sequence locations=1-64,95-240,262-399,421 -491,520-1962,1984-1985,2007-2090
  Gene Ontology: Cellular component=mitochondrion; Biological process =embryogenesis and morphogenesis
caaatttggcggatgttcagcaatctgtaacttcattttctccaattcagacctcttcattcataacaacggacaaaaaagcgcaggtgtccaacattcgcattgaacctgagcagggcgcgggcggattcgtcggatatgcgtatgtcattaatgtcgatgtaagatctaacaaaaagtttcgcagggataagggcgtcagcatcgttgagccggacatggatgtgcgcgttgtgctgtttggcatccacctggacgaaattgaccttgtcggcttcacatccaccgacaattgctccgacgcggcggtgctcatcgatcgaaatgaatttgttatccaatcggaaagacgtgtcgtggtcatctatcactttgcaaggttttgtgacgccatgattgaatttgttaaacccataaaactttaagcaattcattatacaaattgtgcgtgcgacaaaagccccatcctgactattcacacgagcttcccattcatttggttggttggtttttaaataactatcatatcgctccttttgcttgcagacggatgaagctcactgttgggtgtctacgaatataccgcctcgcaaatactacttctcaatgcctcttcaaattgtcatcattgcagtgctgctcgtcctttctggtctcttctcgggtctcaaccttgggctgatgtcacttactccacaagagttgactctcatcaaaaattcgggttggtgagaaaatttttgtggaataccatggatttattgtttatctgcttgttgatagttcttggtcgttgttttttttcgagaaatgatgttcctttctgtttaggttcacgaaaagagcggaagtatgctcagaccatcctgccagtgcgcaagtccggcaaccggttgctgtgctcgttgctcatcggaaatgtttgcgtcaactctgccatctcaattctcttcgacgatttgaccagtggcaccgttgcattgatcgtttcatcgaccggcattgttgttttcggcgaaatcttcccgcaggcgctgtgtgtgaagaagggcttggctgtgggtgcctgtaccatatgggtcactcggttcttcatgatgctcacttttatagtatgttttttttggtatactgtttgtaagcaatttccttgttcacgccctctcaggtatcctacccgatcagcctcattttggacaagctgttgggtgaacaagtcgagtcatatgatcgcaagcgcctcatcgagctcatcaaactgaacatgaagaatgcggcgcaagcggaggagctgaagattgcgattggcgccttcgagatgaacgacaaaattgtgaaggacgtcatgacgggaataaaggtgagaattttgttgtaacttttgtgtactttatttgtttttaggacgtcttcatgcagccgcaggatacaattctcaacgcaaaaaacatcgccgaaattgtgcgctcgggctacacacgcataccgatattcgacggctcgcgcggcaatgtggtctctctgctttttgtcaaggacttgattctgttggatcccgacgccaatttatttgtgggctaatatcttgattttccatttttatctaaaaaaataattcaggttaagactgtgtgtgagtactaccagcatccagtgcgtcatgtaccggaaaataccccgctacgaacaatgctcgaggagtttaaaaaaggcggtaagtattaactcttactgataaaaacgataaatattcgcttgtctttaatttccagattatcacatggcgctggtggaccgtgtcgttgccccttcgacggaggacaaagaaagcaaatacgaactggtcgggcttgtgacgcttgaggacatcgtcgaggagattttacaagcggaaatcgtcgacgaaacggacgtcgtcacggacaatgtcaccaaaatcaagaggcgccgccaacaagtgtcattaagaaaatggaagagatttcacaaaatacccctgaaaaaatttaaagcaccgtgaccttgaattgttcatcgacgacggggaagcttgtcagatttctatgcaaatgcaactcgtaaccattcag

SEQ ID NO: 83879 - DNA, 253 bp, Heterodera glycines
  Genomic contig location: Contig_ID=SeqID_352; Location=4508..4760; Strand=-
  SCN-specific regions: Sequence locations=1-253
cttatctccattgcatttgattgccacacaccatcacattttattccggtactttgtcgatggatctgcacccattttttggagggggacaactttgcgtcaccactgaattacatttgttggaatccaaattaaaaagtcataaagacatgtttcctgggtgacgagggtggacatacttttgggcaagaaaaagtccgacttccatcttaaaaattgtttacggccacaatttgccgcaaaggcacacatt

SEQ ID NO: 83880 - DNA, 709 bp, Heterodera glycines
  Genomic contig location: Contig_ID=SeqID_353; Location=2342..3050; Strand=-
  SCN-specific regions: Sequence locations=1-118,149-170,205-268,362 -460,503-679
atggccaattggaatggtgcccaacagagtgccgaggtaaagtgccgagaacagccaaccctcttcagcaaaagagaacagcggggccgagaaggaagtgcctaattattattcaaggaataaaaaaaaacatttaataaataaatttgaatgaaattgaaggagagaagaataaaaatttatttacaaaatttttatatttatggtattcattttgtccttttttttagtatttctaaattttcattactgatgattcaatttttggttttatattttttgtaaaatatatgattattttaaatttttactgaggcattttaattcaataaattaaaaaataaaatttgtataaatatttgctccgaaaaacaaatattttatgtaaaattcaaaaaatttctgatttcagaagccctctctttgctaatgagagaaatttgtggacgcggcgaaagccaattaattaatacactaataattattatttttttttatttttggcaccatttatcgttgtctcttctctcatgcaaatcacggtcatatgaagcacaacactgccgcacatgccgaaggttaagcacaatgtgctcagggccaaaatcacaaagcgtaagccacggaaattgcggcggcaattaatgccaataattgcagcagtcatttttgttctggcaaattttggcaaaagaaatttgaaaataaa

SEQ ID NO: 83881 - DNA, 438 bp, Heterodera glycines
  Genomic contig location: Contig_ID=SeqID_353; Location=4123..4560; Strand=-
  SCN-specific regions: Sequence locations=1-244,277-417
atggcagtgccaccacaagccccgtctgatgcatgtcaaggccaattgactgcgaaatcaattaggtaattaagaaataattatgtaggcaattaatgggttgttttttaaaaataccaagaccagcagataccaatggataaagccggattagcaaatttatccagacacttccgaattcccaatgttgattcgggattttacgaggacaggccaaaattttataggtaggaattaaaaaacgtataaaaatattattaaaataattcaattttacaatagtaatcaatgtatgctaaacacttacattgtgcaaataaattggtccgtacagtgaaaaggtatgggcaccaaacgcaatgccaatgccaacgccaaacaaagagagcacgtgccaatttgcgagctttgaaaaacggaaatattaaatttaataaa

SEQ ID NO: 83882 - DNA, 1089 bp, Heterodera glycines
  Genomic contig location: Contig_ID=SeqID_353; Location=5155..6243; Strand=+
  SCN-specific regions: Sequence locations=1-134,190-289,482-736,798 -886,937-1089
atggcaattggctacacacttttagcattcataacgccctccaacccgttgctaattcaaagtatgtacgtcctcatcatgtctttggttggcttgtgcaccattggccttgtaaagcaagcgcgatgggtgagtaattattactaattaattaattagctaattaaggattaattcaattaaaattaaaattcaattgtctatttttttaaaattcaggtagacgctgagaatgctcaagcaatcaactcaacaaacacagcaattatttatatcatagtgatgtaagttaaaaaaataatttgtataacaaaaaatttattaaaaaataaagtaattattatttaataaacgaaaaaataaaaataataaaggaaattatggacttaatattatttcaaaaaacattttaattttattgaatattaataaaaatgttacaaatgaaataaataaattaaaataatgataaaaaatttatgccgattggtcagagttctcaagtgtacgaacttttcaatttctcctgaattggggatagtcaatctaagaaaacaaaaataccctgaattttcaatttttaaaaaccttgatgattggtcaaatttttcaaaaataccgattttcgcaaaaattttattaagatttacagctagaatcaagttaattttttaagcatgatgctccatattcaaaatatacgtgccataagttcatatacctatgaacaatggtcttaatatttcaaaattttaatctattttaatgttcatttaaattaattaatttttaaatatcaaagtgtttttaaaaatctgattaaggttgatccctgaattcgtcactttgattattccgaaccctgatgatcaaaacgggagaggggtaaatttaaatttaatttaattaatattatttaattattaaacattttaagtggatattgttttcctttttattgctgttttgcaaacattgagcgcagcaatttcgcacatttcgattatgaggaagaaataaaaaaagaccaaaaacgataaatatgtttgtctaattcaccgcaattatgtacataattaattaatttaa

SEQ ID NO: 83883 - DNA, 1349 bp, Heterodera glycines
  Genomic contig location: Contig_ID=SeqID_353; Location=6567..7915; Strand=+
  SCN-specific regions: Sequence locations=1-666,698-941,991-1090,1121 -1349
atgcccgtcattgtgccaaaatggttgtcgtgtgtcgagagtggaatcagttcgggattcagaacagatttacgggaattagcagcaatccttgtgagctgcttgtgagttggcacacaccaaaatgccaatttggcactttctcgaggggataatcaattcatcccttacaagtggtaaaagaatgtcttaataatggcaccagtgagaccaggacgggaaaattttttaattcaaattaccaatttttttatgttttgtgttttcaattttctgttgctgatgcaattttcttggaccaaaggccacaaaatgaaagtgcccgtttttgtttttgcattttgcaaccaaagattatgaaatattatgtgattttattgttgttatcctcggctgttcttatgtttctttatctttgaaaattggtggtgctttgttttgtacccccccgggggtcaaatcgacggatgaacacatgacagatcaacgaccttcccgttcctgctgttaatgatgcaaccaactgaacaaattgcattttccgtgatcggaaaattgatcagtgaatcagaacttattgtaaaatgcgacatacggtagttttgaggatttgaattcatatgccagcagatatggaaacaaatttaacttttttagggatttgggtaaaaattttaaaatttaattaattttttaacctttaaaaaagtgaattgtaaaaaaattcagaaaaaaaggatttaaattcgatttaatttgcaattttgccatttttcttcagtttttcattggtttttcttccctatttttggccacatttaatttcaatcatcaatatgacaagacatcaattaagttgccagcttaagaaattctctatcatttatgctttccatcaatttttggatgctttcgtttgcatattctttccttttcgcaaattatttttatttttcttggtttcttttttttctccttttttttgtttctgatttcagaaagttgcctaaataatctttaaaagattttttttaattgttgctaaagccattgctagtagtaaaaaaaattcggtaacagtatgaatggtaccccctctctttttaaaaaattttaactttcgtaaagttgttttattggttttcgggccggatacggttctgacatccattttgacctaatttgaaccctgaacccggacttgaacaaaattttcaaaaatctccaaataggcacttaaaaaggcagaacaaaatcgcaaaacaggcattaaaaggcacaaaaacaagcaaatcaaattttttgttcactctttttaggtagcaaaacacataaaacttattatgtta

SEQ ID NO: 83884 - DNA, 1417 bp, Heterodera glycines
  Genomic contig location: Contig_ID=SeqID_3245; Location=294..1710; Strand=-
  SCN-specific regions: Sequence locations=1-104,146-211,253-564,587 -860,882-952,974-987,1011-1084,1106-1130,1152-1192,1221-1238,1265 -1293,1316-1417
  Gene Ontology: Biological process=carbohydrate metabolism
atgcattttttgtgcaatttttggttggttttatttgtggtggcggacaaaacttacggcggcggaatatttttgtttgttaaaaaaagcgatgaaagcttatccatcatcatctatcatcatcatctgaagcatcatcatcatctgaagaagcatcttcatcggcagagtcaaaggaaagcagcggacaaagcgatgcaatacggtgcccataattaatttttttttaacattttattttttcaatttttaggcttcacaattggggcggcaatttcaaattttgctcccaaaatgtcgaatatccgcgcaccaccgccgaagtgcaacgaattgtgcgaagggcacaaaagttgcgcgtgttcggcactcgacacagtttcagcaaaattgcggacagttgcggcacgcttttgtcaacgctcggaatgaattcgatcattgccatcagtggaagccgatcgaccgtaacggtgcagccggggatcacttacactgacttggcaccgacactttgtcagttgaaaggagtgcttgcaaatattgtaattatgcttcatatgcttgaaacagatgccaacaatttcgctttgccaactttggccgcaattgccgacatttccgtcgccggtgccactcagacttgtgcccacggcagcggactgaccaactccaacttggccactcaagtgcgttccatgcgaattgtgctggccaatggcactgaagcctcttttggcccggagagtgccgaactgcgtgccgtcgcgtgcgggttgggcgcctttggcgtcatcaccgaagtcgagctgaatttggtgcccaccttcgacacgatcagctacaatttcgtcaggtatcatatacatatttcaaaagttgctagaccgaacctaaaaaaaaatcgcaaatggtaaaagctaaaagtatcaaggataataaatatttaaatttggttatacaagaaatataaataagttttgtcgcataaatatttaaaattaattattctattagtggcatattaattctgggcgagatcgaaagcacgagacttttctcaaaaatattttcttgttcacataaaatcctaacaaattgttgcttttttgaactttcatttagttacatatttaccaatccaatctttaatctaaaatgtgggtgttttaaattgaatttttttcctggcatatttttaaaaatgaatattataaattcagcgctccctagattgataatttttagtgaaatattttaaaaagtctaaaagaattggatgccggacgccagtaaaatttttcaaacaaaaaactctcctattcgattctaataatttgtgattatatttaaaaatgtgcaaaaacacataaaattaattctctcaaaacatataaaaacaaagagcaaaaataaa

SEQ ID NO: 83885 - DNA, 1786 bp, Heterodera glycines
  Genomic contig location: Contig_ID=SeqID_3245; Location=3356..5141; Strand=-
  SCN-specific regions: Sequence locations=1-287,309-374,397-424,468 -731,755-785,811-1155,1202-1362,1384-1786
  Gene Ontology: Mol. function=cytochrome P450 activity; Cellular component=membrane; Biological process=steroid metabolism
atgacacagaatgccattcccgaacgcgaacacgcgccaaaatcactgatgcgcaatattctcactgtgctgcgcgacgacgattggagacgcgtgcgaaatcgcataacgccggcatttacgacgggaaaactgaaaaaagtgggtcactcagtaaaaaatggagaaatttaaataacaaaagtgattagcgaaggatgaaagcctaattaagtgcataattcagttgttcaatttcagttaattccgattttatgcgaaagcaccgaaaaactttgtaaagtgttagaaacggaaaacgcactgaaggggaaggaagtgccgttgaaagagtgagtgaatggcacagcggaagtctaaaaggaatggcaaaacaaactcattaaagtttattaaatcattgaaagtgtcccggtttttgtccaattttttattttgaaaatttttaaacgaaaatttaaaaaaatcgctaacaaataaaaagcgatttgtattttaaaaaaatcaaaaagaattttacactttttctgattcattgctatttaatagtgatccaatttttatgtttcataattgttaaagtggcaaaatatgtacgaaaaactgcctaaggttacaaattttcaaaaaatatccaaaataataaaattcacaaaaaatgtcgaaatatttaaaaatattacaaaatacgtagaaaaagccaagaaaatagtaaataaagttgcgatttttgttagtaatacaaaaaagaagttttttaataaattttgggaatttcttttgccttttatttaattaattttattttttgcagtctcttcggccgttttctgttggatgttattgggcgttgtgggttttcattggatttggacacttttgacgaggaaaacatttttgtgaagcaggcgcgaacaatttttgactttacgcggaagggacaaaaattgcgaatgattctcgggggtaatgggggacataattagcataattaaaacaaattaaaaagggggcggggggataaacaaacaatgctgaaattatttttgaaacttgagagaaggtgctaatgcgtttttaaatccgcgttcaaaacaaaaaaaaatttcttgctatatcttattgaaatccctctcattttggggttttaaagcgataaatttttaatttatttctattattttaaatttattttatttttcattttctgactgttttggcggatttctaaaagtgtcagcactaatcaaaaaagtgctgtttatgtatcttttcaaaacaaatacaaaagtctcttaacaataaaaaaaggtgacaatgagttgctttttctttggctatttttttcgcttcgctttcaaagcaattttaaaatttggttaattgtcgcattggttaaaaaaaattttaagtgtttttcccatgcgtctcacttttatacgaaaatatcactggcaaatcattcgcttttgccatggatgaagagtttttcatggaaatgatgagcgacctttacgaaaagcgccgtgccgaccccgaggcaaaagaagtagggctaattaaccaattaatacatatttaattagtaaattgtcagaaatacgccgacattttccaacttttgatgaatgcggtggacgacgaggaatttacaatttcagcagacgacgccgaaataattcacagcgaattgagaagcaatgagcagcagcagaaacaacagggaaagcatctgaccaggatcgaacttttcgcgcaaagtttcatcattttaattgccgggtaa

SEQ ID NO: 83886 - DNA, 305 bp, Heterodera glycines
  Genomic contig location: Contig_ID=SeqID_3245; Location=6178..6482; Strand=+
  SCN-specific regions: Sequence locations=1-59,81-133,155-305
atgttattgtttatatttgccatatttggtggaaatgccattttatgtcagtgtgccaatttgatggctatcactggccaagagttgacatacacgagaaagcagcagcaacccgagaaaacggaatgttaccgaaggaacagaacagagacctggaaattcaactgtgtagattccgctgcgggattggattttatttttgcgggatgggatcccgcgagatttatcctgctaagttccgcgccgatctctagaacataactggcaaaacacattgaaagagctgatttgaaaattaaggataa

SEQ ID NO: 83887 - DNA, 1093 bp, Heterodera glycines
  Genomic contig location: Contig_ID=SeqID_3246; Location=1709..2801; Strand=+
  SCN-specific regions: Sequence locations=1-65,93-973,995-1048,1086 -1093
atgacaaaaatatttttttcattcagaaatttaaaagaatttgattttgagtcgaagaaagtggccaatttggagagaaaaaggaagacaaatttaggcaatttggaaatgagcaaacattatgaggagttacgtacaaaaattgaacaaaaaattgacaatttgggaatggttgagctgtgcgaattgtgggacttcgcgcaaattgtgcaaaccgtaaaatgccaatttgagggacaacggacggcacagggaaacgtcaaagtgttgaagtcgatcactgtggagcgaaagtaagcaaaaagagaagcggcgaaaaagctttgtagtttttattttgattttgctaattgtttcattttaacattttaagctacgattgcgcggaattgcgccaaattggcaaaggaaatgagccaaattggatttctgactttaagaaggaaattgcactgaaccatttcgcatacattggctccaaattggcatttgatcaccacataaagtgcgacttttccgcatggtttggcgacgcaaaaatcgcaggcgaaagcgaattgtcgcatcgcttccgcacgagcagcacccaggccaattttgaacagattcaatttaccaaaacgatgctgcaaaagcatttgctgaatgtggccgatttggacaaactgttgcaaatagcgcatccgatcactttggctgctggtgagagaaaaaagcggcaaagacccaaccttcgggcaattcgggacggatttttgaaaaatggccaggcccgtagaccccttattatttattttgaattttaatttgatttttagatgtgttcacagaaagttcattcgcttttttggtcactggaatgtttggtgatgaaccgaacaatgcaatttggctcgaatatttttcatttctcggcagaattttggcattttttcggcactttaaaaatgatgaagccaaacgagcggagctaaacaaattttggggaaagacagccgcaatttttgggcgggaaaatgcaatgatcgatgagtcatacggcgaaatgaatttaattttaatcaaagaatttaaattaattttaaccgaattg

SEQ ID NO: 83888 - DNA, 1353 bp, Heterodera glycines
  Genomic contig location: Contig_ID=SeqID_19134; Location=471..1823; Strand=+
  SCN-specific regions: Sequence locations=1-41,64-168,190-255,277 -656,680-716,753-914,938-1007,1029-1124,1146-1353
atgtctgctgaattttcgatttgtctgcttttgctgctgtttttatccttttctttgtcggcatttgccactttcgacggccaacaaaatttgacgacagatggccaatttttgggttgccaaattaagaatttaaagctgctgcaaacaaaatttatggacagaaaattaatggaaaagtttcactttgagctgagcaaaaagcagcgaattttggaggcactttttgtgggggagaaaaaagtaaaaaaaaaggaaataaaattaacaattaattattgtctaaaatttttaaagcatttgctcctctctgatgcttttcctcctcctttaattgctgccgatgaattcgaatgtctgaaaacaaaactgaattcgatccatgctaatgaccccgctttgagtcaattgctaaacggcttatttgctgctgaaatgcgcgcaaaacgaaaattggagtcattggcaggcaaataattaaatgccaattaattagcattaattaatcatatttttttaggtttcggtgatttttctttgttgaaagaattaaagcaaagcgtcgcttttgctttgcttttcgtggcaaaacgtcgccgaattcagctgaataaatacggagagaagaaacaatttgatttaagcaaagaaagcgtaaaatatttaatggaagaattaattggattttcggacaaagtaattaattcaaatttaggaaatttattaaaatattttctaatttattataattacctaggtaaaaagttgtgacagtttcaataataatggaagaaaaggaaggcaaaatgatgatgaaaaattacttagatttgcttttagagctaatcaaatcgatttggacgaagccgcactttttaatgggcgaaagggtaattaggaataattaacggaatatttaataagttgtgtgtaaaatttgtataaattatttagacgaaaaacgacgacggagaagaaagcgaatgattaacgcatatgtagtttattttatgattttggcaatgttttttctgataattatttgtttgtgtttcatcggttgtcatgacacgcaaaatgattggcgaaacattcacagaaacaatggacaaacagaagcaaacggagcaatgaccagggtagccaactctgctgaattatcagctgatttttgggaaaaaatactcaaaatggccatttttagcctatcggaaccgccgacccccaaattcgctaaaattttcacaaatttgatctaaaaattgccaaaatctaaaaaaaatgtacaaaatttgcaatctcatttttaaatttttcagttggcaaccctggcaatgaccaacaagcgatgta

SEQ ID NO: 83889 - DNA, 69 bp, Heterodera glycines
  Genomic contig location: Contig_ID=SeqID_19134; Location=2260..2328; Strand=+
  SCN-specific regions: Sequence locations=1-69
atggttgtccaatttgtcgacaagaaatattggacacggacatgttgtcaacaacaacagcaaatgcac

SEQ ID NO: 83890 - DNA, 268 bp, Heterodera glycines
  Genomic contig location: Contig_ID=SeqID_19135; Location=511..778; Strand=-
  SCN-specific regions: Sequence locations=1-85,108-183,205-268
atgtatgttaaaagtatcaggtaaactgcacaagtaccaaatttcctaattttttcagcggaggaaacgctgctcccgtaaaacaatcaattcttttaagaacttgcgcgccaatctcaccacggtggccgtggacgaggcctcggctccttctgaaggacgcttttttgggatgacaacaacgagaagggtgttttgatgcataagagttgtgaatggtgttgagggctgattgtgagattaaaagtggcacattttcaaaaataaa

SEQ ID NO: 83891 - DNA, 1302 bp, Heterodera glycines
  Genomic contig location: Contig_ID=SeqID_19137; Location=735..2036; Strand=-
  SCN-specific regions: Sequence locations=1-205,227-437,459-568,590 -1100,1122-1302
atgccggaaccaaagaccatcaaagagttggaatcattcctggaaatggtcaattattacagtaaattcgtcaaagacttggcagagtgtgttgaaccattaaacagacttcgccggaaggatgtcgaatgggaatggcgtgatgagcagacaaaagccttcaatttggtcaaggaaaagctgacctcagacaaagtgctcgtgcattatgacccaaaaaacaatttgtttttggccacggatgcttctgattacggaattggagcagtcctttttcagagggacaataaaagtggaaaagaaggagtagtggcctatgcttcgaaaactttaagttcagctgaacgcaggtacgcacaaattgagaaagaagcgcgatcaattattttcggaatagaaaaattcaagcagtacctatatggacgaaaattcgttttacaaacggatcatgagcctctgaagaaaatttacggcccaaaaggcgaaatgccagtggtggcagcaagaagactacaccgatggggcctaattctgatgaatttcgattacgaaatcgaataccggtcaacaaagaagtttggaaatgctgatggtttgtcccgactgccttgtgttgagaccgatgaagacgatgatgataatggtcaagaagtaaatttgatccaagtccaggccattgaatcgctaccggtcacggtggaaatgatcgcaaaagagaccgaaaaagaccccttgctcaaattagtcaaaaaatttgtcaaggagggttggccaaataaagtggacaaggaatttcgaccattttacattgctcggaattcgttggaaattcagtcaggatgtataatgctcggaataagaaccgtgattccagcaacattccggcccgaaattctccaactgatacattcggcacatccagggattgtccgaatgaaatccttggcacgacaaaaagtttggtggccaggattggacaaagcgattgaagaaattcgaaagtcttgccggccatgccaaattaatgcttctgaggaatgtaaagttccattgcatccatgggaagaacccgaacggccttggcagcgactacacgtcgatttttgtggtcctttttggggatttatgtggtttgtaatggtcgacgccaaaacaaaatggcctgaggtcattaaaatgaaaaccacgaacacaagtacgacaatttctgaaatgcgtcggatttttgccacacatggactccctgagcaaattgtctctgacaatggcccacagttcacgtcgggtgaatggcacgaataa

SEQ ID NO: 83892 - DNA, 775 bp, Heterodera glycines
  misc_feature (708)..(708): n is a, c, g, or t
  Genomic contig location: Contig_ID=SeqID_19139; Location=71..845; Strand=-
  SCN-specific regions: Sequence locations=1-206,252-775
atgggaattgtgccggaagcaacgaggacaacaacggcatcaacaattgttgcgctgctcctcattcttctgttgatgagcgacggaggaacaattgccggagggaatggcgaagaaagtgggttcgaaaagttaattgttgttgctcttgaaaaggatgaaaatgaaaaataggaacaatttgaaataatacatatgcggggagcaaaaattgaaaaaattattattttttaaatatttctaaaataattcagtcgctaatttgtcgtctttgtccgcctccgccagcactgccctttccacaaatgttgtggtgccgcaccgtttcgattgtcgactgtccggcatggaatgctttcatgacggaatttgctccagggacggctcacattgcgagtgggtttttcagcttttaatttttgtttttttaagtttcattcaattttcctttcattttttttcctaattcgcgtaaattttattttcatagaaatgattttttttctgtcttccattatttttcccattctcttatctaatcttccgtttaattattcatttatttctaattgatccaacttaattaattgcccatttcataattccaacttaatgataaggaagagcaaacatatgaaactttaagcaattttactttagttttataaacttttttgccatcccctaaaatgaatccccattgagtanaattcggagttatccccgattttttttttgggttttaaatcaacgatttgccaaatgtacgaataaa

SEQ ID NO: 83893 - DNA, 882 bp, Heterodera glycines
  Genomic contig location: Contig_ID=SeqID_19142; Location=505..1386; Strand=+
  SCN-specific regions: Sequence locations=1-112,134-604,626-882
atgccaccgcaggacgaagcagggccgtcaacatctgctgcatcggccgaagaagcgatggagccaccaccaccaactccagcaccagtgccaacgccggagatggacgaggaaattttggaatttggcttttcgctgccatcgacatctgtcacaccaatcggcgatttggtgccgttttcgacaacaccaactgcgtcaatggacaccggagagacgaccccgccaccgctggccattgacgagcgatcagagcgcatcgaacaactggagaagcagctcaatgacctggacgacaccatcaaatttctgcgcaagcaggtgcgcaatcgagaagcgctgatcagtgatctgcgtcggcagctggacgagcacatggtaccaccgatggcaccaccaacgactagcaaaagtgagtgaaatttttccttttttaatttcataaaatctgatcattttttcaattttagcaccaccaaacagaggaagaccgaagaaaagactggatgaactgcagcgcagcgccaggcgcgacatcgtcgaccaaattgtgggcgtcatcgatcatcgtcgaccaaattgtgggcgtcatcgatcgtgatcgctcgcgttccgcgagccgcgcatctctgcaccggatccaccgagatatccggcacaaattcgcgcactacacgccaaagaagggcaaggagcggaaggaggggatggacgctgaggatgggcttttgctgctcgcccaacttggaacacagaaggcgtacaagcggatgaaggcgattttacggctaattggccgtaatttcaacgttttgccgccgttggaaaaagtgcaattttcagtgaatttttcgtttgatcaatgttttttgggtcatcgca

SEQ ID NO: 83894 - DNA, 236 bp, Heterodera glycines
  Genomic contig location: Contig_ID=SeqID_19142; Location=1612..1847; Strand=-
  SCN-specific regions: Sequence locations=1-94,116-148,170-175,212-236
tgtacacggcgtccggaaactgagctgctgtaccaaaaaagatttgtatgtgtggcgaagtggtctgtgagaaggtcaccaagggggggggggtcccaggttcgattcccagtgcatgctattgatgtatttcgatgattttaatgaataaataaaaggaaaagtgaccaaaatgatttaaaaattgtttacaaatttttaaaaaatttatctaccgcttgtaatgaaaataaaaa

SEQ ID NO: 83895 - DNA, 364 bp, Heterodera glycines
  Genomic contig location: Contig_ID=SeqID_19143; Location=430..793; Strand=-
  SCN-specific regions: Sequence locations=1-1,27-295,318-364
atggagaaacaacagcagcagcagccaaaaagtgatcagaagccgaaaaatgatcagaagctgaagaatgatcagaagctgaagaatgatcagaagccgaaaaatgatcagaagctgaagaatgatcagaagctgaagaatgatcagaagctgaagaatgatcagaagctgaagaatgatcagaagctgaagaatgatcagcccagcaacgacggcgagccatctctggccagtgattttgatttcaaaaatttaaaaaaagttcaaaatgggacagaggaaaggcacgcgtcagccaatcatctcattggccaccctgagcggcgaaatccatagatttgctcataaaattatcctaaataaa

SEQ ID NO: 83896 - DNA, 807 bp, Heterodera glycines
  Genomic contig location: Contig_ID=SeqID_19143; Location=1292..2098; Strand=-
  SCN-specific regions: Sequence locations=1-22,44-98,120-146,175-807
atgatcgcggaggagaaaaaggggtctttgtcttcccattttccttggcagcctttcgcgcaaaatttggccaaattctaccgccatggtgatgggttaggtttaaattatatggatataaaatcccgaaatatggccataaaagagggaggggggggggggggggggggggggaatgttctggcttcctgttttgataaataacacccaaaaatgtgtgggaggcccgccgccgtcacgagactagtggagctctggggagcaacccaatttaacaatatatttttagaagtgaaaattgagtgtttttttttattcagcccatcaacatttggcaatccgttgtggtcactttgctgtgtatgggtattgatcagccacttgcaagaacaatcggtcgatttagatcaataaaagcgcaccttttcaaaacaatcaataactgttcctttccaatcaatcgataatgatcgatttccgaaaaatcaatactcgattgcttttccaaaagatcaacaatcaatctaatttaaggcaatcaataatcgattgtctttcaagtcaatcaataaccgaccaatttttgccatcgttcgatattcgactatacttttcaagcccatgtttcgcgggtttaagagtcaatttccccaattcaaattcaacgccatttaactgccggataattttcacatcatttagcattaaaattgcttccatcaattgatgccgaaaatatttaattggtcataaaatgggaaaatttaaaataatctagcctaattaatacctttacccacaaataaa

SEQ ID NO: 83897 - DNA, 791 bp, Heterodera glycines
  Genomic contig location: Contig_ID=SeqID_19146; Location=798..1588; Strand=+
  SCN-specific regions: Sequence locations=1-2,25-252,274-381,403-791
atgtggatgacacgccattcaacatcaaaccgtgccacgctggtgaggcaatgggcatccagctcttcgaagacggaggtaattgaaaaaaacgtcaattgtaaattattggtaacgaaaaattttactaaaatcttttctgaaaatttttataacttttttctcgggatgatttaaggcgctgagtacgaatccgacctccttttttagcgaattccgaaccgcgaacccgaattcgaacattttcgaaaaccccagttttaaaattggaaatgtattgtcattaaaatcgcgttaagagagtttcgaggcaaaaaaataacaattcaaaaaaaaacaaatttagacttttttgatgctctgagcacgaatcaatgtttttaatgtgaaattctgaattttccggatgttcaaattcggcttctgggttcaaaatacaccaaaaaggaggccggttgcttactcagcgttttaaaacacccctaaaacacattttattagaatttttagaaaagatttaaaaaatcaataaaaaaagtttttgttttaacgccataattttaaggagagcgatggcgtttccggcagtggaacagtattttcattaatttttttttactggccaatggaaggctttgtcagtcagactctgccgtcaccgcctgggttgaaggaatgcaaatcatccgcggagtagatgatttggcactgaaagcgtattgatcaagttttcaagcctattcccccaataatttattctaaaattttgttgaaatgagttttttgttgga

SEQ ID NO: 83898 - DNA, 923 bp, Heterodera glycines
  Genomic contig location: Contig_ID=SeqID_3248; Location=758..1680; Strand=+
  SCN-specific regions: Sequence locations=1-498,520-561,583-923
atgaccaaatctgctaccaccgatggtgggggtggcaccgccgctgcctcctctgtccaccgactccaatcgccacaaaaagtacctcatccgccaccaaagaagaggccagcgccagaaacagtgccgcaaccggcggtcgccgaagtgccggctcttccgggagcaccgccgcctgccaaattccgaaaacggcagagcagtttctatgcacatgtgaatgtacgcgacccgctcaacctgggcaatgttagacccggtgagagaggcggcgccataggttcgggcaattgaggcattgcccgaatctcgaattttttgatcagtattagagagaggttaagctgaaatttccgaatttgttggctgagagacggacattgggttatcgaactcggatttggattagtaaaacatttacttccgaaatttactagagctcggaattttgaaaaaagcctacctgtattctgtacctgtatttcctgtagaaaagtacaggaaaatacaggttttttcgtgtttagctgtacctgtacctgtactaaattctaaaaatggcctgtacctgtacctggatccaggaaaaatacaggcctggatccaggtacaggccgatctctaaaatttactaaccaaaatttcaagaaaattttttgtttaacaattgacagaaaatccaagatttttttttttaattttaaggggtggaggtgcagaaaaacagaggcttttctgattttttccttatgtttttcgttttagacaacccggacgacccgaactttgccaagcccatccaactgatcccgaccaatgtgaacgatccgttgaatttgcagaatttgtcgtccgccccggcagatgccgaagacgaggcattgccaacagcagcggacgcccaacagaggcgaaagaggtga

SEQ ID NO: 83899 - DNA, 2101 bp, Heterodera glycines
  Genomic contig location: Contig_ID=SeqID_3248; Location=2901..5001; Strand=-
  SCN-specific regions: Sequence locations=1-31,54-103,125-518,555 -833,855-1002,1025-1978,2001-2101
gcgttaaccgaggtgcaggacgcctatgaagtgataaagcaagagaatgccgtattcttgcgtggaatttgcgaaacgattccgaattttaatcggctttttcagcaaatagaaagtatttgtctaatatcttatcttgaaaaagaatttaattttataatgcattttataacatgattcataaccgattcttttttacagactcgtttacgtatctcaacgaagaaaatctcgcattggcaatcccgcctggtgattaaactaaacgtgttttctgatatataatttgcctattcagttccaccgaattcggttgagacgagcgccacctcttccggtcattcggagccaacgtatgatcagccacccgatggccccgacgtgaatgctcagagggaactgctgaaagtcgctgatcggtcgtccgaaactgaccattatttgaaaggttcgaaatcgcttttaacactaagattgataaacgatctaaatgggttttaaagcaatgcgcattgattgaaaaaggattcattattaaaaattttagtggcggttgacgctcctggctctgttgtaccctctcgtacagtccatccgacggaaaaagctgagcaaacgcgaccgacaggtcaaccgccaaaacctcgcaaatacgaaaagtaattcaggtgacaatgatcagtcaattactttcatttgattaaccaataaatctgtctttatcaaaaagtcctttgaaaggttcgaaatcgctttttagcaataacataaaggagagacttacaaaatgcttttaaaacagttcatattgattataaaagaattcattgttgtaatttttaagtttcaattgacaattcgggcactgaaagtcgtattcgtcagccgactgaaagtggtaagcagcaaaatcgcattccatcgccaccaaagtgtcgcccaccgccgcctcccgcacaatcagcaggtgacaattatcagtaaacaatccattattaaccaataaatctgtgactttattcagcgaaaaaaggcgaagaaatcacttttggtttggccggctcttctcccaaccgtcttcttccgtctgggcaattcgtttgcgatgcgtcaaccgctgggacgagttctcagccctctctccccgcaatcgaagcggtaatcaaaacacaaacagctaattttgggtttaatgggaattcagtcaacccaaattttcataatgtcattcctttttggggaataaaagtcaaattgtttttatctaataaaaattatgttgaggtcgaagaagatgattacgctgaaattgtcgaaccggaagagcaaaagtcaccgcaaaagaaggagtacatctcgagacttcgcatgccaacaatcttcactcgccgcaacacgcgaaaggtaaatgagtttaaagcgaattatttcctaatttggttggaattgctgcaaaagacgggcgacacttttggttcccctggtaagcacgaagcaaaaagcagcactattccctgatttggtccagaattggttccgtccccaaaacatacgaattgtaatattttcccatgggtcaatttgtttcccaaattagccgccgaagaagcattacttaattttttgcaatttcttaatttaaggacaccgaaaagaaatgaacgtcttccagaaaacaccgcgtcccatcgcatattttgttcggagaagtgatggatttctaacatttaactcatcttacacaaacatataaatatatatatatacacacacaatttatcgccttttaaattttaacttattacgttgttttatgtttttgtttttttgtcgctttcaaaacgtaaagtaaataaaaatgtgtctgatcgcgtcgaacgattttcgaaaatgttctattagacttgcacaaaatacgaagattttcaagtacatatataaagggcgacatgaagtttgggcaccaaattaaggatttaaaaaacaataaatatgtaaaatgctaaatcggtaaaatttagtaaattttaagaacccttgtgcatgcattttccaaaaacttgggccgccgccgaagaatagaccctattattcgtcatga

SEQ ID NO: 83900 - DNA, 563 bp, Heterodera glycines
  Genomic contig location: Contig_ID=SeqID_19149; Location=225..787; Strand=-
  SCN-specific regions: Sequence locations=1-64,87-216,238-506,550-563
atggacctggacctggatcctgaaaaatccaggactggttccaggtctaactctagaaatgaagtaaataaattttttaaatttttcgacaaaaaataaatttagaattggcgcaacaaacaatttgcttaacatattcattgctgtaattcaagcagaccacgacgagcggcaaggacaaaaatggccaatggcaatacaaaatgccaaaatttatttgaaaatttacaaatttgcggccatttatctccatgttgatccaagcaacaaagcagtcataaaaagcatgacaaatggcccacaagtgtgggaagtgatcaagaactttattgatcaaagtgtgacacaattggaagcactgatcaatcaatggaatgtggccaaggtgcacccgttctgtgacgagcaattggagatgcaggcaatcaacaaatacatcaaggaacattgccctaaaactgattagtgatcactgaagaaacggcttgatgattgaattttttcagaaatttttaattttttttaaatttaaatgaatcttattttaaagttctttaaataaa

SEQ ID NO: 83901 - DNA, 232 bp, Heterodera glycines
  Genomic contig location: Contig_ID=SeqID_19151; Location=175..406; Strand=-
  SCN-specific regions: Sequence locations=1-210
atggatacaaatattttattaactatattattatgttcatgcttcaaatttttaaattgcatcgacttcgaagaattcatatcaaatgaaaccgcaaaaaacttggttgatcaatatctaagaaacgcaataaagacaagaggagatttactagaaaaactgggtgatattggtgtcgacttaagcttttgtatccatttataaagaaattggtaaaatattttttattaaa

SEQ ID NO: 83902 - DNA, 1484 bp, Heterodera glycines
  Genomic contig location: Contig_ID=SeqID_19154; Location=78..1561; Strand=-
  SCN-specific regions: Sequence locations=1-471,512-575,597-599,621 -1312,1335-1484
atgacaaacaatgaaggatatgactgttttcgtttggccgctggagcatccagctacgaatctcttaaagttcttttggattcatgtcaatttggtcctgacaacaagtaagttatggaatttcacttcaacatctttggggaaattccgattttcgaaaaatcttgggtgacagaataccgatttctgaaatttttggaattttttttttgccaagtcataatgattaatttagtgtaaaataattaatatagccactcaattttcgaaattacgacatttttggggtcggcggaatcccgattttataaaattattggtcctgggtatttcgattccgaaaatttttggggcatctggatgccatacctgttatataattagataaatcgctaattgaagtgttgtcattttcagaccaagactacttgaacttgccttcaatgctttagaccttaaaagaaatcaggcaaaatattgattaaaaaaatatataaatatatttaaaattgttttagttcatggaactcttaagagatgatgaaccactggaagcaaacagactggaaaatgagtaaattaaatatttatttaatgatttgaaaatgtgaaaattgcaaggggtatgactttgggcacatttggtttttataatgattttcatacactactagctatgttgacgaaaaaaacgagaaaaaaatgctttcttgaaatttcttccgtaagacaatttttgaatatttaaatttttttcaatcttccagatcgggaaatgtcaacgaaacattgcaatctttgcattctgaggaagatgagatggaaatcggtaaatccaaataaataatctgaaaataaaataaattatacaatcccgtagcaagagaaaattttcggggggtggaccatttttttttgctcttcggtcaaaaatttttttcccttttccggtgtttaaaatattgggggaattccccccggctctattgcagttcacacgaccataaaaaaaatacgaccataatttttttttgcagctttagtgcaccataactttttcaagaagcatccaatttaaatatcttagttaacactcgaagtcctaagaatcctctattagtctgcaaaatttcaaaaaattttgttgggtttcaaaaaatttatggccaaaaatgtttagaaaaccaactttttgaaattttctggccataaattttttggacacaataaatttttttgaaattttgcaggataataaaagattcttagggctatcgaatactaagaatgtttaattttggatgcttcttgaaaaatttaaatgtttccttcagctttggggaggccacgtggacgtccacgatcgatttcagaggagcgacgcaaaatggtgcagaagttcaaacaagcaaacccaaacagctcattggcagaaatcgcaaaagcaacacagacaacgagcggatcaatttcacgcatcttaa

SEQ ID NO: 83903 - DNA, 339 bp, Heterodera glycines
  Genomic contig location: Contig_ID=SeqID_19155; Location=312..650; Strand=-
  SCN-specific regions: Sequence locations=1-43,68-339
atgacggacagccaatcaccctcccgctccccccgtggccaatcaccctccccttcttccccctgccacgccaggcctaacctttatgcccccggtgggaaactccaattcgagaatgtagcggctgccaatcccggcacgaaagtcccaacggcaaaacagattgggcaccaacttatcgggaaagcccggaagggaaagttggcccgagtcatcgtccacgacgccaccgcaggcgaatttggaggaccacaaacgaatccgaaagccgcacttgcgattcagacagaacaaactgaacagccgaatgagagaagtcaaaagacggaagcaaagtga

SEQ ID NO: 83904 - DNA, 280 bp, Heterodera glycines
  Genomic contig location: Contig_ID=SeqID_19159; Location=11..290; Strand=-
  SCN-specific regions: Sequence locations=1-280
atgcgacagttggacaatgcgacagttggacaatgcgacagttggacaatgcgacagttggacaatgcgacagttggacaatgcgacagttggacaatgcgacagttggacaatgcgacagttggacaatgcgacagttggacaatccgacagttggacaatgcgacagttggacaatccgacagttggacaatccgacagttggacaatccgacagttggacaatccgacagttggacaatccgacagttggacaatgcgacagttggacaatgcgaca

SEQ ID NO: 83905 - DNA, 631 bp, Heterodera glycines
  Genomic contig location: Contig_ID=SeqID_19160; Location=18..648; Strand=+
  SCN-specific regions: Sequence locations=1-213,254-276,300-566,613-631
atgatgtgttttgtgcgaatgttgttcagcccgatcgtgctgtatggctttaatgtgcccgttgtggccaggcctttgattacggtagtggcacaattccaatcctacagtttggtcagtatgcgtttgcatatggtagcaatggctgcaaaccgtgcccatgctgtgctattcccatttcattatgcacaaaaagtcacaaaaaagtgggtgataattattaattattaattttttaaattgataaataatagttgattattatggcttataattatatggaaatcgatatcttttttcccggactgttgaaggcctgaaacgcaggaaaaacatcacatgtttttagcttagtttgaagcctctaggacggatttctatatccatatttttccatatttcgcgtagcgcagggtcgacttatattgtttttaatattatgcccccatagtaagaaatcaaaaagttatgaggcctcaaaaacgaaattttggctgtagtttcacttaaagttgatggctcagttggttaaattcgcatttttatagctcgggttcaaatccaacataaaataatttatgtataaaaaatcatttttttaaattaaaaaatgtatgatagtttttcttta

SEQ ID NO: 83906 - DNA, 701 bp, Heterodera glycines
  Genomic contig location: Contig_ID=SeqID_19161; Location=189..889; Strand=-
  SCN-specific regions: Sequence locations=1-701
tttggtgcactttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaac

SEQ ID NO: 83907 - DNA, 844 bp, Heterodera glycines
  Genomic contig location: Contig_ID=SeqID_3249; Location=311..1154; Strand=-
  SCN-specific regions: Sequence locations=1-101,129-235,259-485,520-844
atggcatcgatgaacaagcgtttaccagcggagcttcttttggaaattgtcgcttcaattccaatcatgtacctttttgggggaattgcgaaaaagccaggtatttttttttaaatattttttaatttgaaagttgaataggtactactcgtccaccgtctggaatagtggttatcaaccgaatgttcgaaatttttcgggccaagcggcatctttacttcttaaatatagttggtaatatttaaaataataataaatctgaatttttagatcaatcttgctcgaaatttcgagaggctctgcgcaataaggaagttaccgtgtggcgaattgttcatccagttcgggttcatccagttcgggttcgaagatgaactggaagacgccaaatatttcaccgactttttggcgtatctatcttttggacgatctggccccaccgctacgacgagaatcgtgacttattccatggtaagaaaacaaacaattataagaaatattattattatttaatatttagccaattaaaattggagagctgttcggcgcaattctgatttatgtcttgggaagcgcaaacccgctgaccatgaagaagcggactgcaggcggttatttgctgcgtcaacacttcccgcggcttctccaattcccggcaacagaaatggcgtcacatggccttggtcaactggtccgcgccgatgggatggaactttaccgattgatgaatccgcatcacaaaggagatgttggttatttaatgattattgaaacaactcaacaccctggttcctactattttaatttttcaatcgaataagtttttttttcgtaattgaataaa

SEQ ID NO: 83908 - DNA, 1347 bp, Heterodera glycines
  Genomic contig location: Contig_ID=SeqID_3249; Location=1779..3125; Strand=+
  SCN-specific regions: Sequence locations=1-32,54-510,532-674,697 -870,906-1347
atggaaaaccgctttccccaacgcccctctaatttttcaattgactacatcttgtccattcctgcaaaaaagcctcgccgtggtgttcaagcgggagctggaccgtcatcggctaagcctgcaaaggaatacgttaaaaaattggaaagcagtgtcgagcatgtgccgcgcttccaatacgtcaaagccaaatcgaagttcagcattgaggacgtcccgacgaatcccgaaggattgattgccggcatattccaatgttgtattgatgaggccgtcatggaaagccaacagcgcggagtaaagcccacgcatctcggctgtgtgatcagcagcccgctgttgaccggcggcgacatacccatccccattcgccaaatcaccgacaacaccgtccacaccattatgaaccaattcaccaaagtcgcgcaaagcaaacaacagcaaaatatcacattgtggggcgagccgttcacagtgactgtgaccaccgtggaccgcattggccttcctaacaaaagaagcctgaaaggcggtgcgcggcgggcactggcacctgtgcatcatcgggtcaaggaaaactgcttgatcaaagtccgtcctgcaggaaaataagtatttattgtggccattttacagattaacaacccggatgagagaaattactgtcttttctacgctttgcaagccaccatggtggccaaaactcgcggatggccccgatggcttttttacaattatgtacacagccgatacggtcagcaaggatgtctgcggcgcgatgatttgcagttggtgcagcaaattggagctcgtcctgggttgaacgcatacgatgccgagatttttgttccgcgggtggtggattattggaacaacaacaacaaccaacagcaacaacaacaacaccgattttctgtgtttatttttggctcttctggtcagtacaagccgctctacaagtacataaaggaccattacgacaccccaattgttctttactttaacaacgaccattttgacggcgtacagaaaatccatggcttatttggtcaaaactattgcctcgagtgcgaaaagccatatgagcggccgtcgagacacctaaatgcatgcaaagcgcgctgtatgctctgctcccgcgtcgggcctcgctttccatgcgctcctttggatggatttttccgggagtgtccagggtgcaaaaaggtgtttcgcaacaacgactgtcaccaacatcatttgacatcaaacttttgcactcgatcaaaacgatgcaaagaatgcggtgtgatttgggacactcgagccaacaatttaaatggaccaagggtacaaaattacagcaaa

SEQ ID NO: 83909 - DNA, 729 bp, Heterodera glycines
  misc_feature (546)..(546): n is a, c, g, or t
  misc_feature (589)..(589): n is a, c, g, or t
  misc_feature (628)..(629): n is a, c, g, or t
  misc_feature (661)..(661): n is a, c, g, or t
  Genomic contig location: Contig_ID=SeqID_3250; Location=77..805; Strand=-
  SCN-specific regions: Sequence locations=1-101,128-234,258-460,488-729
atggcatcgatgaacaagcgtttaccagcggagcttcttttggaaattgtcgcttcaattccaatcatgtacctttttgggggaattgcaaaaaagccaggtattttttttaaatattttttaatttgaaagttgaataggtactactcgtccaccgtctggaatagtggttatcaaccgaatgttcgaaatttttcgggccaagcggcatctttacttcttaaatatagttggtaatatttaaaattataataaatctgaatttttagatcaatcttgctcgaaatttcgagaggctctgcgcactaaggaagttaccgtgtggcgaattgttcatccagttcgggttcgaagatgaactggaagacgccaaatatttcgccgactttttggcgtatctatcttttggacgatctggccccaccgctacgacgagagtcgtgacttattccatggtaagaaaacaaacaaatataagaaatattattaatatttagccaattaaaattggagagctgttcggcgcaattctgatttatgtcttgngaagcgcaaacccgctgaccatgaagaagcggactgcaggcgngtatttgatgcggcagcattttccgcggcttctccattnnccggtaaacagaatggcgtcacatggccttgntcaactggtccgcgccgatgggatggaactttaccgattgatgaatccgcatcacaaaggagaatgtg

SEQ ID NO: 83910 - DNA, 4597 bp, Heterodera glycines
  Genomic contig location: Contig_ID=SeqID_3250; Location=1431..6027; Strand=+
  SCN-specific regions: Sequence locations=1-510,532-674,697-870,903 -1281,1303-1927,1949-2045,2067-2227,2264-3060,3090-3685,3714 -4056,4097-4597
atggaaaaccgctttccccaacgtccctctaatttttcaattgactacatcctgtccattcctgcaaaaaagccacgccgtggtgttcaagcgggagctggaccatcatcggctaagtctgcaaaggaatacgttaaaaaattggaaagcagtgtcgagcatgtgccgcgcttccaatacgtcaaagccaaatcgaagttcagcatcgaggacgtcccgacgaatcccgaaggattgcttgccggcatattccaatgttgtattgatgaggccgtcatggaaagccaacagcgcggagtaaagccaacgcatctcggctgtgtgatcagcagcgggttgctgaccggcggcgacatacccatccccattcgccaaatcaccgacaacaccgtcgacaccattctgaatcaattcaccaaagttgcgcaaagcaaacaacagcaaaatatcacattgtggggcgaaccgttcacagtgactgtgaccaccgttgaccgcattggccttcctaacaaaagaagcctgaaaggcggtgcgcggcggacactggcacctgtgcaccatcgggtcaaggaaaactgcttgatcaaagttttccgtacaggaaaataagtatttattgtggccattttacagattaacaacccggacgagagaaattactgtcttttctacgctttgcaagccaccatggtggcaaaaactcgcggatggccccgatggcttttttacaattatgtacacagccgatacggtcaacaaggatgtctgcggcgcgatgctttgcagttggtgcagcaaattggagctcgtcctgggttgaacgcatacgatgctgagatttttgttccgcgggtggtggattattggaacaacaaccaacagcaacaacaacaacaacaccgatttgctgtgtttatttttggctcttctggtcagtacaagccgctctacaagtacataaacgaccattacgacaccccaattgttctttactttaacaacgaccattttgacggcgtacagaaaatccatggcttatttggtcaaaactattgcctcgagtgcgaaaagccatatgagcggccgtcgagacacctaaatgcatgcaaagcgcgctgtatgctctgctcccgcgttgggcctcgctttccatgcgctcctttgaatggatttttccgggagtgtccagggtgcaaaaaggtgtttcgcaacaacgactgtcaccaacatcacatgacatcaaacttttgcactcgatcaaaacgatgcaaagaatgcggtgtgatttgggacacttgcgccaacaatttaaatggaccaagggtacaaaattacagcaaaataaattttcattattgttaaattcaggtccataaatgtgatgaacgttattgccagacgtgtaacaattttcacaacatggaacgcggttgcttcattcaaccaattgagcccaaggaatatgacccttaccgcatagtgtcctttgatttggagacaatgcagcaccaagcgatggaccccgatcagccggagaaaagagagcaccaaccgaacttcatcgccgcgagagtttcatgtccctgctgtattgacaacgatcgttggagaagagggacagggggttgtcaaatctgtggcctgcaccggaccgtcgctttctgccagcgccgctttgtgaacaccaacgttgatcaccaagtggttgccgacaacccgctggaagcgtttgtgaattggctggtgtttcaactcccaaaaaaatacgacacctacgcctattcgcactttggtggccgtttcgacatggtccttgtcttccgggagcttttccggattggcttcaatcccgaaatgctgagacgggtacaattgtcttctgaatttttttcaaaaattctcaattttacaggggaacaaaatgtatgaaatgaaagtgaggaagcagaagcggcaaaatccaaacgtggtcttccgggactcattcaatttaatgccctgctcattggcagctctgatcccatcctacggccttgacgtcgaggacaaaccattcttcccccatttggccaaccgaccggagaattatggtagagcgattcatccaactcctgaggactatttggccaatgggatgatgccaggcaaaaggcggcaattcgacatgtggtatgagcagcaccgcgaggaggcatttgttttggatgaggcattagcaaggcacaaattttttatattttttcaatttttattttattttgttcagctattgcaccaacgacgttgaaattctgatggccgcactcgtcgcattccgtcgggaattcttcgaaataacgcgacgacaggagtatgtggaagggattgacgaccgcgagaaccatgatggaatagatgctctgcgtgaatgcatgacaattgcgggtgcctgcatgcgccatttccgtacaaaccatctgccagctgagcatctggcaattgtacccgagcgcgggtatgacaacgcgcagaatcaaagtctcctggcacttcgcttcttctactggtactcggaggagtacgatgtagaagtgcaaaccgcacactctgccggcggagaaaagcggattggtccctattccttggacggatggattgaggcggagggtcgagcaattgaagtcaatggtaggctttaatttgttcaaatttgaaaatcatgactttaaggttgtacatggcacggctgtaaaaaatgttaccccaacgacaacatggtacttcccagtggaaaaacggcagggcaaatacgggaacgtgatggtaaacgaatggaatacctaagcgcacgggtcaatcgcatagacgtcttttgggagtgtaaaattgacgagatgttggcgagaagcaaagcgatgcgtaaatgttttgctaattacgtggacgacggacctctggtgatacgcgacgctttcatgggagggcggacggggccattgaagctgtatcacaaggcggccaggggcgaaaaaatttcttattacgattttacttctctgtacccctatgtgaagtgagttttttattattaaataaaacataaatatgtaaaactttagcttcaccacccgttatccgattggacacccaaaagtccatgttttcaaccaacaagtggtgtggaccagctcggcggacaacccttaccctctagcattgctgaaagtttgggttgttccgccccgccgcatcgacgttccggtgttaccggtgaaagtggacgatcgcttgtgcttccctctttgtcttaaatgtgccaaaaagtacccgaccggcggtgtggacgacgactaccactgccaacacaatgatcaacagcgaggttgggtcagcacctgcacgtccatcgagctgaacgctgcgctggacgagggctatcgcgtcatccgtctgttccgtgtgctggaatatgaggacagtgacgaccaacttttccgcccgtacatcgcagagttcatggctcaaaagatccaggccagcggatttgacaacgaaatcaaagggaatgccgccatggaggaacagtttgtgcgagagtgtgcggaaatatttggcatcaacgtggacccaaccaagatggcgataaacaagggaaaacgttccatcgcaaagttgtgcttgaataacttatgtaagccatttgtttttcaatggattttaaattttaaatttagggggggcgcttttcattgcgaaactttggactttgtcagactctgattacggacagtcctgttgtgcttaccgaatatctggacaacaaatccgttgaagtcgcgtcaattgatcagctggatgagaagcacatcctcatcagctatcagcacaagaaggactgggtggatgagcatgcctgctcaaacattggtgagaatttttttaaaatattaccgtaatcaaaaaaactacagtaatatctttgtggacaacttccacggcgcgacttgtcttgttgaaggcaatgcaaaaagtggtcaggtcggaacggtgcgagctactgtacacaggtaattgaaaaaatatatattgtttagtaatttatttttaaattttagacaccgatagtctcgtccttgtccacccggaggggcgttgccctctcaaaactggcccacacctgggccagttcacggatgagtaccccgatcacgacatcgttgagtactgcagcggcggatcaaaacaggtaaatttacacgtttttcaaactgtcattttcacacaaattaagtatggtctgtgtctgcggcgtaagggggcagggcccgatgttgaaccggaatacgtgctcaaagtccgtgggatgacgctcaactatgacgtcatcaacaatcagggactacgctatgaacggttcaaagaagaagtcatcaattatgcgacaagaggggactatgagccgattatagtgacatatcccaattttttgcgtccgaacatcagggagggtggtagggtggtgtccatgcccatgcagaagtgttaccgtccatttgtgggcaaaggaattgtcggcccaaactatcgtgttttaaattttggtcacactttgtaa

SEQ ID NO: 83911 - DNA, 169 bp, Heterodera glycines
  Genomic contig location: Contig_ID=SeqID_3250; Location=6919..7087; Strand=+
  SCN-specific regions: Sequence locations=1-169
atgaagaaatccgttaccatctctgtccccgagcaaaaagaaattaatcaacaaaacactgaaatggagcccacaaaatctgacactaccaaaaagcgcaaggcagacgaccgggagctgtggaaattggcaaaaggaaaattcatgctcgcgacatacttatgcccag

SEQ ID NO: 83912 - DNA, 1440 bp, Heterodera glycines
  Genomic contig location: Contig_ID=SeqID_19165; Location=650..2089; Strand=-
  SCN-specific regions: Sequence locations=1-105,130-547,583-622,646 -749,772-1028,1050-1251,1274-1440
atgggaatttgcctttgtcgcgtttctgctgctgctcagtgagtgcttttgctcggttgacgcgcaatcaatggaaaagtaaacaatttttgatggcaaaatgccaaatttttataaaatttttattttcagcaatactgtgacgaccatcaccaccagcaggacgccaacgacgccaaatgggacggcgacgaaaaattggagcgaatcattagcggatgctgttggcggaaagaccacacttgtgctgatcatcgttgggtgcgtttgtccttgtttaccatcattcattggggaccgaccatgacgaaggcgtgtttttttgaatgtcgacaatggcacgaaattccggcatttttggatcgttgggggatcgaccctgacgaatgagtgtttggagtgccggcactgggacgaaattccggcattttgggttgttgggggatcgaccctgacgaatgagtgtttttgggatgtcggcaatggcacgaaattctggcatttttggaccctgggatttcatcatcatcacagcagataaaaagcagtagtaatttcacatttttccccatttgttttttcagcgcactgattgcaatcattgtcctgctcgtggttgtggtgtgctgctgctgctgcaaaaaacgcaaacgccgccgccgccacacttctgccgacgacgacaaggaggacaacaaaaagcgcaaacgtcgccaccacacttctgctgacgacaagaaggaggaggaccaccaccacattgaccagcacaataaggaggaggagcagcacggaaaggaggacaacaaatcgccgatacaaagcgaactgaaagtgtcgacgatttccgccgtgccaagcgactacaactcgaacaaacggctgggcgcaacagatttggacgtggaagcggaagaggtgccgaagacgaagcctgttcccaaaaagccgaagtcagaaggaggcacaaagcgcaaactgtccaatttcttttggtccaccggcaccaccgagaagcgaccgagcgcggcggaacatggcgtggaagtgccggaaacgattcgtgatgatgaagattgaagatgcttgaatgatggtgttgtattctgtatatacctatattatatattgtatccagtattctgtgtttagccatgcatatgtttatgtattgtatgtgcgtattattgtattatatttacggtattcaaagcgatgtttcatttaacacattcattgttggtatataaattttatttgtgttgttttgtatgtatggtctgaaatttcggaaaattcgcatagttctcaatgatttagtttttccgatcgactccctcagcttgtttaattttgttggcccacatttttttgacaatttcagctccgccgatttttcagagaaattgcacgaattacaatgactgtatttctaataaa

SEQ ID NO: 83913 - DNA, 924 bp, Heterodera glycines
  Genomic contig location: Contig_ID=SeqID_19166; Location=880..1803; Strand=-
  SCN-specific regions: Sequence locations=1-17,39-71,93-924
tcgtttgcgctcgaccgtcgctttgtccgtctcttttggctttggggttttctcgtccatcgctttcgatggccccttttcttggcaccttttctgaccaccgctttcctcgcctttggcttcctttggattaatgaccaagtgagtggtctcttctctctctcatttttggcgttttttgccaaattcaaattgccaattgccttccttcctttaatctttgatttggctcggttcttgaggaaaccagggaccctttgttcgtcttttctccagagaatgcgcgttggaaattcgaacgtgccgcgctgtcggagcattggccgttggacgagcagcacttttggcccggcaaatcgtaacaaacggagaaattcggccttaaactgcgagaattgtccaaacttaaaaggtacgattacttcggctacgtcgatgtgatcgcagtgggacgaagaaattccgacgaagggggagagaggccgaacattctgtcgagggactatttgaacgaattggagagaattaacaaagtgagagagagagagagaaaggctaatgggggcaatgtaataaaatggcaaattgcccaattaatcaatggaatggcaaaacggcacggccattagtcagtcttttctgatcacaattcttgatcacattccctccccacgtttaactaaacaatttgatattccacctcaactactaaatttgagttcattctccacaatttgactgtgcccgttttgctgcccaattcttcgactcgtgaggtcggcttcaccgatttgtgcatgacttacgcttggaagtgctatttgaacgatcacatcataatgctgcagccgaaaggacgatggatcggcggattgcaagcggaagtgatcgaattggccaaggaaatcattgagcaggaggtgt

SEQ ID NO: 83914 - DNA, 1228 bp, Heterodera glycines
  Genomic contig location: Contig_ID=SeqID_19167; Location=421..1648; Strand=-
  SCN-specific regions: Sequence locations=1-3,25-314,337-560,584 -640,675-1228
atgaaatttgcaaagaaaatgttaatgattcccgaggcggaatatttggctctactgagtgcgatgaatagtggtgattatctccaaaatgaaaaagcgagtttagacgcaaaaatttctcagaatttacaagaccccggcataagcgaggacctcaaggcgaagagacatgattggctctataaagaaagacgtacggtaaaggggatacttgaaaataggccacagaaggtcgtgattgagaatcatgtacccggtccaaatgttgcaccatatctgggcctcaataaccaatccaaaccacaggagaccgaagaaccacggaaaataattattcctaggaaaagacttaaagagcgaactcctgatcctgaatcagataatgatacccttgaggcgttaactccggaaccccaaacaccatccacactcaaaacacccgttccgaccaaaactattatacacccgacccttttaaacggtcttttttactgaaggatccaacagtaaaagacatggttgataaatcgaaggtcatgtggggacgtggaagtaaaaaggcaataaaatctataaaaacacacggcatagcacgagagaagaaaccattcaatccactaatatgggcaagactgtagagaaaattttatcaaaaatttattttaatttaaaatctccggcaagttttgctgggattcaaaaaattttaaatgaggccaaaaagattgacccggaaattacgaccgatgacgttaataaattcctagaaaagcagagaacatacacgattcacaagcccatcaggaaaaaattcccgagactaaagacggtaccgagcggcttccataccgattggcagtgcgatttgtgcatatttgaccagttgaaaaagcataacgacggttacaaatatctgttggtatgcatcgacgtgctgagtcgaatgatcttcagtgcaccggccaagtcaaagaagagtgaggacatgattgaggtttttgatcgggtgttcgaaaagtcgaaaattatcccgatgaaaatatatagcgacagcggactcgagtttcaggctggaaaaatgaaaaaatattttgaggaaaaatttattatcaaaaatgtgatgtatagtcctgaccttcacgccggagtcgttgaaagggcaaatcggacaataaaggagcgcttgtacagatattttacaaagaaagacactctacgatgggtcgat

SEQ ID NO: 83915 - DNA, 1364 bp, Heterodera glycines
  Genomic contig location: Contig_ID=SeqID_19168; Location=1124..2487; Strand=+
  SCN-specific regions: Sequence locations=1-433,455-501,524-713,736 -1307,1330-1335,1361-1364
  Gene Ontology: Mol. function=carboxypeptidase A activity; Cellular component=extracellular space; Biological process=histone acetylation
gtccattctccctcagctttgtccaattgtccgcctccgttcagtgattccgtctctccaaaacggtttttctctgtcctccgacttcgcatcgaaaacgagtcgcaacttcgctttctgatggaccaatttctgcggaacagcacacgactcgacttttggaaggagccgtcgtccgtcggagaagacgcgtgggcttttaaatgtctttttcaaagcttttttaccgctttaagtcacgtgatggtcgcccgaggcccaatgcttaacgacttcagtgaacgcctgcgagaacaaaacatttcgtcgcgagtgatgatcgaagacgtaagcgaactgattagaagacgtgcgagagagacgacggaaagggaagccaaacagaggaaaacggaaagcagcggcaactatcaaagggtgggaagaggaggacaacaattaggtggacaattaatggggggggggacaaaatgggttgccaattaatgatcaataaaattcaaatagaatttaaatatggtctgatttggtctgatccgatcaggatgagtccatttggcctctgtctgacgatgactcggccattcgaagcactcgccgacgaaaagcgagctcttcgggtggttttgcgcgcttctccatgtccaagtaccactccttctccgatgtgattcatcatttgtgcgtctttcatttcccaaaagaattccgccaaaataaattaatttttaaggaatgctttggctgtgaactttccttcacgtgtccaagtgcaaccgatcggaacgacgcacgagggaagacagatccctctgatcaaaattggcaccagtccggcgggcacaaagccggccgtttggatggacggtggcattcacgcgagggaatggatatcccccgcggcagtgctttacatgatcgatcaggcaattttggggttgatcgatcggtcgatcaatgtttgtcttagttagtgacgggttatgactctcagccggcgattcgtcagttcgttgatcacttggattggttcattgtgccaatgctgaacccggacggtaagctttgggatggttttttgaatttgttttccgctttcgctaggctacgaatattcgcggagcagcgccgaccccgaggttcgcttgtggcgcaaaaaccgttcgcccgttcagtgcacccaaatcagcacgggtaagcgaaggaatgattagaggtattgagggtcagagaacaattcactgattggcgaatgaattttactaagcgacattttcgtccgatcatcgcctgctaattacttcccttgccatgtccgaccatcgggtgctaattgcccctccccctctttggcttttgttgat

SEQ ID NO: 83916 - DNA, 624 bp, Heterodera glycines
  Genomic contig location: Contig_ID=SeqID_19169; Location=5..628; Strand=-
  SCN-specific regions: Sequence locations=1-69,109-116,265-624
atgcatttgaaattgtgcctattattctgttcaatattatttctgatcatccgaactgatcagatcggatcagaaaataaaaaattggaacaaaaatcatttgatgaaatatttggagaaaaatgggaagaaaaaagaaacgaagaacagaaaaaaagagaaataattggaaaattttataaaataaaagagaaaattaagcaaaaaggaagaaaatattcaaaaaaagaatggaataaaattgaaggaaaaatagcaaaaaaattgggcacaaatcgcaaatatatttatgaatggatcaaagaattgggattaaatcaaaagaattgctacaaaacaatgactgaagaagaaaaacttgacactgtacagaaattcattgaaatgataaatgaatacaaagaaaaaggaagaaaatattcaaaaaaagaatggaacaaaaattatgaacaaatttgtaagaaaattggagttggccttttcatacttagaaaatggatgaagcaatttggaattagccgaaaaataatagcggagaaagaaaaaatggagaaaatgaaaatgtattggcaaataaaaggagaaaagccgaaaatgagtgacaaagaaatggaaaaatgttga

SEQ ID NO: 83917 - DNA, 535 bp, Heterodera glycines
  Genomic contig location: Contig_ID=SeqID_19169; Location=1445..1979; Strand=+
  SCN-specific regions: Sequence locations=1-137,173-535
atggagaaaatgaaaatttattggcaaataaaaaaagaaaagccgaaaatgaatgacagagaaattggaaaaattcaaaaattgaaattaggtaattagcatttgaaatttttcaaaaaagagaaaaaaattcaatgaatttttattctaaaaaattatttataaaaaatttggcaataaaattcatttattttcaataaattgttttcttttgcagaaacatttaatcgctaagaattaaaaaaataattctcttgacacttttcccgcacaattaagccctccccctccctttgatgtccccgcccaggggaaaaagcttcttttttttaaaatgtgcttatgttttacataagtaatctaaaagaaaaaaaaattgtcatgaattacataaatccctaattttaattagccaatcatagaaattaattatttgtaaaattgcgtcatcaaatttttaattagcatttttagatggaagaaacaatttggagacgaaataatggaggaatgaaaaacggatgattctaagaaa

SEQ ID NO: 83918 - DNA, 615 bp, Heterodera glycines
  Genomic contig location: Contig_ID=SeqID_19169; Location=2445..3059; Strand=+
  SCN-specific regions: Sequence locations=1-68,229-284,306-615
atggaattaacacgtatattattctgtttaattttatttttgatcaccctaactgatcagatcggatcagaaaagaaaaaaatgaaacaaaaaacatttgatgaaatatttggagaaaaatgggaagaaaaaagaaacgaagaacagaaaagaagagaaataattggaaaatattataaaataaaagagaaaattaagcaaaaaggaaaaaaatattcaaaaaaagaatgggggaaaattaatggaaaaatagcgaaaaaattgggaacaaatcgcaaatatattcaaaaatggatcaaagaattgggattaaatcaaaaaataaatcattcaaaattaaaaactgatgaagaaaaactcgaaattgtactgaaattcattgaaatgacagataaatacaaagaaaaaagaaaatattccagaaaagaatggaacaaaaattgtgccgaaatttgtaagggaatcggagtaagttatggcacaattacaaaatggaaaaagcaatttggaattagccgaaaaataacggagaaagaaaaaatggagaaaatgaaaatttattggcaaataaaaagagaaaagccgaaaatgagtaacaaagaaatggaaaaatga

SEQ ID NO: 83919 - DNA, 549 bp, Heterodera glycines
  Genomic contig location: Contig_ID=SeqID_19171; Location=92..640; Strand=-
  SCN-specific regions: Sequence locations=1-91,124-144,172-294,318 -501,523-549
atggagctgagttcgggctattttggaggacaattccgcgggtttttattccccgaggagcaaattaatgacgaagcggcgaaggtgagaaaaagggaaagagaaagggaaagggaagagaccgaaaggggcaaaatgccaaaaagagatttttgacttaaatttgaatttaaaacataacgagtttgtgtctcgtctttctttgccaattttgcagatccttcccggcattcggactttggcggaaaaagtgcgagacgatgcgcaaatggacgaagaaagacggaaattgggaaaataattaattaattaattaacaaaaatcattggcagtagtaaaacccaaaatcagtttcggcataaaaattgaaacaatcaaattggcattatcacataaccacttgtacacttttttcctcgcaattttggcattttccttttctccttttggcaactttttttttgtttttcgtttttgtatacgaaagcgcaaaagtgtcgacattaaatatttctctgagggcgtggtaaattggcaaaccaaataaa

SEQ ID NO: 83920 - DNA, 1468 bp, Heterodera glycines
  Genomic contig location: Contig_ID=SeqID_3251; Location=2236..3703; Strand=+
  SCN-specific regions: Sequence locations=1-176,198-306,330-449,471 -1468
atgaccactaccagttgcccgttcgactccaactcggcacttcgtccgcaagtgccactccgagcacgtcatctgcaagcgaaacgaccagccaggtgggcgtgcgtaggatttacgaatgttttctcgaaaaaggctattgactcccatgtgaatcctccacaataaaaagtttattcatcttcatcttctgaagttcagtttctcgtcaaagtgaacaattccatcttcaaggacttctattcgtgtgaacaacttggctttgctcttatttctgatccgagacggtgaatttttcattataaaaagggatgaatttttataggttagtaatcttccgaccggattaacattctctgtttattttttcaagactgcttcgcaatgcgacgcatctcgaacatctcgatgggtttcccgtttggatttcagccgtgccggatgaatttcgtctcgctcgcttcgccatcatggcactggcctatccaaccaagaactattctcgactcgaaagatccggacggcatccggatgtctgtcatctgctatttggctcattgtcatttttttcatgtaacagattcatggccatggcattttgattgtgtcgtccactgggattgtcttcagcaaggaccacccgcaaactcgcatccgccttctgccagccgatcgccgctatgtcagcgtcggcgatcagttcatgttcaccgccaccttctatgaccacaatgagggctttatagtttgtgggattcagcttttggatgaggaagacgaagaacagttcgttggactcgactccatcaaattgggcggcgacgacattttggttagacaaatgtttcgtaaagtcaaaaaccatttcatgatgaagaacatttgcagtttgtgcagaaattgaagacacacatgcgacaatgggcggccgagggacatgacagtccgaactttggacctgtggcggacccgaaagagttggtcaccgactacatctgcagggaggagattcagtggccagaaaacattgaagttttggtctgtttcaaccccgagtggatgcagggagcggacacgctgatgaaggtgcactcattggtcatcgacggcgaatttgagcagggggtcaaagaaagggtgagtggtgactaacacggcttaacaacgccacccttttcggttaaatcgaattttcctcctacagattgagtccatgaacaatgatgagacgagcattgcctcccccgccacgctgtctcttcggcaggaggacaacgacggagcgcatgttcctgctcgaacccacttggaggaggaggaggaggaatgcaactgtttggaggtgtggggcattctgcgcgagttgttggaggacgagcgggcgaccagcgagttggagccggagatgatccagggaatggttgagctgcgaaaagcctttcatatcgataaccgcgccaacaattaa

SEQ ID NO: 83921 - DNA, 890 bp, Heterodera glycines
  Genomic contig location: Contig_ID=SeqID_3252; Location=36..925; Strand=-
  SCN-specific regions: Sequence locations=1-458,526-660,682-712,734 -756,798-820,842-890
atgcttaaaggatgtctgtacgttatcttagtgctgattgctgttagtttgattcggttgggcaaatgttagaggcgatttgagccttttggcccttaatttctcctgaaaacttagaaaattcaacataactctgcctaaaagacatatttctgttcgcaaaataaacagaaatgtgaaaaaagatttattctttcttatttagtttgttttatctgtttatttttggtagttgagactttgttcgtttttatcaagtgtctctattttaaattaacaccccatttttgaaaaaaaatcgtaaaacttttttccgtcatcatttcggtttctcactttcagaatcttaatattttcagaattgctacgtacagttaaaaattcagctcgatcggttcatgggaagtggtcaaactcccaaaaaacagggtgtctttattttaaattaacacagtgtatctatctctctttttttttctctctctctctctctctctctctctatcctcacctcactctctctctttttttttgtttaaattgatgcggcgggttattagattttttcaattgcttttatactaaaatatgtgcattaatttacattttagataattatttttcagacaaaattaatactgcaaaaaaaaaacttaaccggacatttggacagtggacatcatgtgtccattgtgcaaatgtccgggagcccaaaagaaattgaaaaaactgagtgcagcgacatttatttaatggatttaataatattttttatacatttttaatagatttataatctttggatttgcgacagtaagtgaatattttattattataaatggctttagcagcaacaaaaaacatttttttaaatcattaggtaaaataaa

SEQ ID NO: 83922 - DNA, 123 bp, Heterodera glycines
  Genomic contig location: Contig_ID=SeqID_3252; Location=1199..1321; Strand=+
  SCN-specific regions: Sequence locations=1-36,58-123
acatccattctcccccgccgtttccctcatgtttcgtcgctgtggtcgtctgctgtgttcgctgcagttgctgaaatgggtgcagttgagggatcagtgccgccacgttcagcagccgtttga

SEQ ID NO: 83923 - DNA, 823 bp, Heterodera glycines
  Genomic contig location: Contig_ID=SeqID_3252; Location=1598..2420; Strand=-
  SCN-specific regions: Sequence locations=1-351,390-823
cattgtccgccgaatcgcttttcccgtctcagcattcgtccatcttcttccgctgccaatgggccgtcctctcaattcgttcctttgcccgctgatttggccgaccccgggacagaatgccaaatgatcggtttttccaccagcgaaaaaggtctgtcattttttttgaactgaaaaacagcgaattcagcggaagactttctgacggaggagaaagtgttccgtttgcatctgaacggagtggcggagccgccgacggacgaccctttccaccattatcggagccgagtgtacaaggacggacacaccgcatgctatgtaatctaatcaaatgataatgactataatgactaataaaataaaaaaattctttaaaattttcaatttttggggagaaccatttcctctttaaaacaatctcttaacctaatcaaagtgaaaaagtttcgcctgcgcttcagcagaaaatcacgttttagctgtcaaatactcaataaaatttgcgaaatttccaatctttttgaaggacgattccggcgccccactcttctgcaaattgtcttcgtccgacaaaggccacgttcagctggggctgtttcaatcgctgactgttccattggatgttttgtccaagggaatggacaaagggaaagagcagtgccgaaaagtgtgtcaataaaaatgaatgtgccatttcatttaatcattgaaggcccgagaaatgcgtttcactcttttgacggaggaccaaaaattggccgaggccatccaacgctatggcaaaattgacgagggattccacaattgtgacaaggaaaagtga

SEQ ID NO: 83924 - DNA, 703 bp, Heterodera glycines
  Genomic contig location: Contig_ID=SeqID_3254; Location=1..703; Strand=+
  SCN-specific regions: Sequence locations=1-188,210-703
  Gene Ontology: Biological process=regulation of protein activity, epigenetic
tgatgacagcccatctccgttctttggtgtccatcgacaaaattgtccacgcaatttcgtccgtttagtttttccttcgctgttctgccttcatttatgtttttcagcaattacacttccgttgagaagcgtgaagagccgcttgactgtatggacgccctccttttttggataaataaggcaaaaccgaataaactgaaaaagcaaaattaagacaatttcttcccttctcgtcaggtttgtctgctcgtccgggatgacattgagcacaacggactgtccggcgtggacaaattgccgacaattcccgagatggaagacctttacgaagatttgtgcgacggcacgtgtatttgcgcactcatttccttctaccgacctgacgcattgcctcttcgcggtacgtacggctaacatttatgtcaacgaatccccgtatttcgcttcgcttattcccctttagagatttgcttcaaagacccgatgagtgtccacgattgtcgcttcaatttggaacttttgtggtctctccccttcgttttacctttttacttatccgtttgccttttcagcaaattctgttcctcttctctcccgtgggaccctttccattttgaaacggaggacattctcttcctgcacgagtcacttcagcccaatatcaatgtgttcttggcggatcttttccaattcttcgagattc

SEQ ID NO: 83925 - DNA, 539 bp, Heterodera glycines
  Genomic contig location: Contig_ID=SeqID_19175; Location=243..781; Strand=-
  SCN-specific regions: Sequence locations=1-347,400-539
atgacatttttctacatcttcgtagcgacttgtattatatatttgtttgttggaattgtgatcaaatttaaatcagctggtaataaaatgaaaaattgacacacaaattttaattgccctaattaaggtttgccctcatctgagacgatcaaccatcgagttttccgatcactttgttgcattctcacagtgaatgttggcggctatttgatcacaatgctttatggcggtttgatcaagccttcaatttcgtcaccgatcactgcttggttttggcatataatcaccgcaattccattgaactttggcggggcatcgaatgggccaattttatatttgacaaggtgtattttttaaattctaaaatatttaaatagatatttttatatacatattttagtacggagtatcgtcgggcatttcaaacggagtttccatttgtgttcaaacgaattttaaatcaaaatcgtatggcaccacagcaaaatgtccagattacacgcatgtttccagtcatgaacacttcatctcaacgataa

SEQ ID NO: 83926 - DNA, 1344 bp, Heterodera glycines
  Genomic contig location: Contig_ID=SeqID_19176; Location=156..1499; Strand=-
  SCN-specific regions: Sequence locations=1-27,49-71,94-165,187 -219,252-437,463-688,713-841,864-941,977-1344
atggctgattccaacaacatttcggtaaattatagggaaaataattttcttaatttgggttttcagttttatttgtcattcaaagatgtaaatcccaactggccgctgatcagctgttcgtttgtcaatggaagcatcgccgtatttggaatcattttcaatttgtctgttatttgggtaacagttcagacaaagtgggcaattaaattaattggattgaaaattaattaatttgtttttcatattaaggtcattccgtggcaccgttaattaccttttggctctttgctccttttttgaattgcttcatcaacttggcaattttctttttgtgtataccgcattttctggacaaaatttcattgcgtatcgtttagccgttcagatcgtttttatttcaatgtttgggctcggtattttaaacacaaccaatcctcaatttaaaaaaaatatatatattaaggtggaatttacccggcgatgcttttcattggcattgacagactgatcggaatattttttgaagaaatgtatgtattaaaaaaaactaatttgataatgtaaatagggctcgaaattatatgcacatgcatatttttttgctaaactgtagaaggcctgaaacgcacgaaaatatatttctagctttgacgtatttccatatgcatatttttgtggatattttcacaaaaataataattaaatttattatgcgtatattttgcgattttatttatgtccatatagttctgagctctaatgataaagctgatatttttcagtcacaacaaacacaaaatgcgattgtatttgaccatgataacgcttatttgtattgccttctgcgttgatttttgtgtaactttataccaaagtatcgatttgtatggagatcagctgatcactggatgtcttatcgattttttcaaggtttttttgtatatccaaaatcaaatacatagttttttcaaatattttagggccccaacccatcaattttccgaacttccctcgtcccattgacaatcactgtttatttgttagttggatttgtggtaaaagtgaaatcttccggtgaatgatactgtaatttgataatgtatccagatcaatttctcattcattaggttttccatccgctgatgaggtcaatcagcgcgttttccgtgcacttttttgcatcattgtcattaatgtgggcggctatttgatcaatgcgttttatttgaatctgatcaaaccgtcaatcgcttctccgatcactgcttggttcgtccattttatcaccggaattgtggtgaatattggcgcggcatcaaatgcaccaattttatacttcactag

SEQ ID NO: 83927 - DNA, 701 bp, Heterodera glycines
  Genomic contig location: Contig_ID=SeqID_19176; Location=1156..1856; Strand=+
  SCN-specific regions: Sequence locations=1-93,126-158,180-251,274 -296,318-701
atgcggtatacacaaaaagaaaattgccaagttgatgaagcaattcaaaaaaggagcaaagagccaaaaggtaattaacggtgccacggaatgaccttaatatgaaaaacaaattaattaattttcaatccaattaatttaattgcccactttgtctgaactgttacccaaataacagacaaattgaaaatgattccaaatacggcgatgcttccattgacaaacgaacagctgatcagcggccagttgggatttacatctttgaatgacaaataaaactgaaaacccaaattaagaaaattattttccctataatttaccgaaatgttgttggaatcagccattaattttgaaaccaaagcttttatggaaattaaaatttattcaggtgcttggtcactccgtaattttgttgaaaagcaagtgtcgcgtcaaaaaaagtattattttttatttacacattctttaatcttattttggcacctttgaaatagtttaatgcttttcggtctcaatgatgtgatggagttggacgagacgtgttgagtcaagcaaagacccaatcgtggaaaaccaaaaaaagactacaaaaattggcattttgggacaattgaacggaaaaaaggttaaaaaaaagcaaaaaattaagaattaaaaaagatatttaaactattttagaaggccatgcattttgtgcagca

SEQ ID NO: 83928 - DNA, 576 bp, Heterodera glycines
  Genomic contig location: Contig_ID=SeqID_19178; Location=737..1312; Strand=+
  SCN-specific regions: Sequence locations=1-382,413-576
atgaacgcacaaaaccgaaaagtttaccggtgtgggtttgtaaatagagcccgacttggtttttccggaacccttgcctttaccggtctttaaatgaactcagttcatcattttaaacagtttttgtctcgaaactcggtccttgtgcaattcccaaattccggccctgaatttacaaattactttcctagtagtgagtggtcaactcagttccggtcatggtcaaatgacttactgagttcttcttggccaagaaatcatctccctgcaggcggcgcttatatgtgttgccgcaccaaacgattttccgttattttaccccgaaaatctatgtttctatgttctgaacttgaaaaaaaatcctgtcaaccatcggggcatgaatttttttttatgttaaattaattttattcgccaaatttcagggagccagaagagaactgcgactgtccagacttgatccgcgactttgaggaaaaggagaagcaacgggaggcgtccaagaagaaggcgagaagctcgaccagttcggcggccggagggccggccaaaaagcgcaaaacgtccaagtcaatg

SEQ ID NO: 83929 - DNA, 1136 bp, Heterodera glycines
  misc_feature (42)..(42): n is a, c, g, or t
  misc_feature (95)..(95): n is a, c, g, or t
  Genomic contig location: Contig_ID=SeqID_19179; Location=269..1404; Strand=-
  SCN-specific regions: Sequence locations=1-234,256-522,544-1136
cagccactgaccaatctacagtatacaacagtccatcaaccncaaattgtgcaggatcaattgccagccaaaatgccttagttcaacaacaatgngctcagtcagtgcaacagcaaacccaaagaattcaccagcagaatcaatttatgggtcaacagaatctagctggcataaagaatcagtaatatttttctaactggaaatattatagtaaaactgaatgggtatctaatgtcaaaagaatatgggaattgatgaaatgggataaagcgtgaccggaaaatgcgtcagtgatacttttaaaataaagttctgtaattggttagaacattctattgttcggtagtgccgtagattcgagttcttaagtgtaaaaagttgtttctgtagtaaagcaattgagtcgaggcatttataattacaggcaattcccaataaattatcatggacagaatctgcaaccgcaatcagtgcagaatccatcacaaatgccgtcaacaggaaatcaaaaaattcaatggcaacaaacaaaagaaggacacacgggcaatatgcactcaactagctcttcaaactttatcatgccatcctctactggctcttcaaactttatcatgccatcctcttctggctcttcaaaccttatcatgccatcctcgactagctcttcaaactttatcatgccatcctctactggctcttcaaactttatcatgccatcctctactggctcttcaagctttgtcatgccgtcctcaaccggctctgccagctttactatgctgccagccgccgaaaatatttatcaaagcggcgggtcaaaaagttttaccatgaacacgacgggaaatttgacgcacattggaccaactcgatttaacgcacaacaaaaaggaaaaatgacagaacaaattggatcgacaagcttaacgaattatcatggaccgaatgtgcaatctggtcaatctgttcatctgacaccacatatgcagacagaaagccaaatgtcacaaatagggccagaaatgggacaaatgggaaacattggaccaacaaactttaacagtccaagtcggcaactacaaaatcagcaaaaacttcaatatcagcagcaaccactcttatcaatgcccatt

SEQ ID NO: 83930 - DNA, 1146 bp, Heterodera glycines
  Genomic contig location: Contig_ID=SeqID_19180; Location=40..1185; Strand=-
  SCN-specific regions: Sequence locations=1-449,471-537,559-976,998 -1146
atgagtgaaatcctagggcttcggcaggcaaacggggtttgagacatctctcttacaagactctcatcataacaactcttgtacttatttttatttccactggatatttaacttaagctaattaatggaaatcttatcctaaatataaaccgtttttcagcttccgcaagggtatgccaatgccggcggcgtgggtccgtcatcatttgtaccgcttggccaaccgccaatgcaagcgcggcaacaaagcgttgatcacattcaatttccaccgcaattttcggtggttcaatatcaaaattttggacaacaaccaccgccaatgcaacaaacattagcagttccaatggccaatttgtcattagagcaagcgacggtagtacaatataaaccttaaacagccctatttttctgacctttcgcacttatatattttttaccaattttcgcaatttcagaaattttattgaaaaactgcgccgggaatatatttttgggtcggttttttctaaccctaatatggcaaataaaaattgtttttatacaattaaaaacatttaacaagttcaattatgtgttaccccaattagacgccagggatttatttaatatttcaaatacggcgaaccaatcggcaccatctgacacttaacccttctgatctttcatattttctcaaaccctagaaatagatcatttttgcctgtgaaaaactaagaagaaattctcacgttaaacaaatgaaaaagtaaatcaaatttctataaaatcaataaaaagaattatcaaaaagaccaatttttgccaaaatttagcaagtttaataaattttagagtaaaaagaaaagtgatcggaaaccaaagaaagcaacagatcaggaagcgcaaaaccaaacagttcaacaccaccatgcgcaaaataatcaatttgtcggccaaaattccttagttcagcaagcatttgctcagtcaatgcaacagcaaatccaaccactgagcagtcagcagtatatgtttgaccagaaccaaaatgttcaatttcaacagtccttgcagcagatggttcaataccaagggcaacaaccgccactaatgcaaccaacattagcagatccgatggccaatttgtcattcgagcaaaccaag

SEQ ID NO: 83931 - DNA, 550 bp, Heterodera glycines
  misc_feature (399)..(399): n is a, c, g, or t
  misc_feature (404)..(404): n is a, c, g, or t
  misc_feature (414)..(414): n is a, c, g, or t
  misc_feature (485)..(485): n is a, c, g, or t
  Genomic contig location: Contig_ID=SeqID_19183; Location=1..550; Strand=-
  SCN-specific regions: Sequence locations=1-550
tggccaaattattatccaggatggaaaggatttgcaagacaaatccaaagttcaattattgattggaaagcttggcgaacaggagtacaaacactacacctacagtgtcgctccaaaacttcggcaaaatatttttaattgtcgttgacgcattttccaaataccctgaggtatttgagatgacaaattcatcagcaactgtcacaatcgaaaaattgcgctatttattcacacgccatggaattcaagaaacaattgtttctgacaatggcacgcaattttcaagctcagaatttgccaaatttgttgcagccaacggcatcacacacgccccatataatccaattcaactggacaagtggagagatttgtcgacacatttaagagagcattcagaanattanaaggtgaggngaagccaaacaaggagatcatcgacatttttctgatcacctatcggacgaccccaaacgatacacttcccnatttgaagtgtcccgctgaactgctgctcggtcgaaggccaggacaacgattgatctccttcggc

SEQ ID NO: 83932 - DNA, 841 bp, Heterodera glycines
  Genomic contig location: Contig_ID=SeqID_19184; Location=147..987; Strand=+
  SCN-specific regions: Sequence locations=1-152,181-212,234-375,466-841
  Gene Ontology: Mol. function=transcription factor activity; Cellular component=nucleus; Biological process=regulation of transcription, DNA-dependent
tcgccacagtcgtcatgctcaaacggtggcaacaacaacaacatgaatagtaacgggggcacaaatggaaatagcgccgcgggcgacggcggcgacgcggagggcgtttggagcccggacattgaccaggcattccacgaggcattgcaggtggcggcgctgggggcggggcgggcggggaaatgctggccggtcgtcggccgttcggcctccctctgctgctgttggtggctgacaaatgcgaaaaattctttggatttttaagtgtgctcaaggacaggggtgtagaaaggggaggatggataaattcactgggttattttaagcgaaattctgctgcctggaaattcttcaaatttttaaatagcaattggcgagtgagagagagagaaagggagagagagagagagaacgccaaagaaagagagagcgacagagagagagagaatgagagagaaagggagaattcgtggaccgggctgcactgaaattgtaaaattcctaaaataaaatgcgaaaaattctttggattttttaagtgtgctattcttaaaataattttactgacattaaaggacacaaatcagcaagaggcaacaaaccgacgaataaattttccgggccgtttttctgatttgtgatcatccaatttttgttgtttttaatagaaagccaaagttcataaaaaaatattcataaacagatttatccgccgtgtggacggcgcaaaatcattctcagcgacgagggcaaaatgtacgggcgcaatgaactgatcgccaggtacatcaagattcgctgtggcaagaccagaagtgagtatcacttatcatcataaata

SEQ ID NO: 83933 - DNA, 523 bp, Heterodera glycines
  Genomic contig location: Contig_ID=SeqID_19187; Location=1213..1735; Strand=+
  SCN-specific regions: Sequence locations=1-5,28-85,108-235,260 -260,302-473,495-523
atgtccacatcctctaataaaaattatttaccaaaaaaccaatgcccaaattgtgatggtaattgcaattttttcaatactgtacaataattttttttttaattttagatgatgaagttgacactgaccctccacccgaagaagttgagaaatggacgccgaaacaagtgattgagtgggaccagcgttgctacgggaaaatgccagctgaagaagagctttggcaagaattcctcgacaaaggagaggcaaatgtcagtaaataaaatttttgatccattttttaaattatttctttaggttcggcgtgagttctttggcggaaaaggggcgcttgaagttgagaagagccttcgagaatacgcgaagaaaaaggaacgccgcgacgcaattctgattgagaaaagaaacgaatacaaaaaaaatgatggaaaaaaggatgaaaattgaatgttcgaatttctccatccgctatatcaatggcttttattttatgcaattattttgatttttaatactcgaa

SEQ ID NO: 83934 - DNA, 354 bp, Heterodera glycines
  Genomic contig location: Contig_ID=SeqID_19187; Location=914..1267; Strand=-
  SCN-specific regions: Sequence locations=1-28,51-257,279-354
cacaatttgggcattggttttttggtaaataatttttattagaggatgtggacatttttaggaaaatggaagaataataatacaaagaactaaaaattttgcattttatacctttcaatgtttatttaacccataaaataaatttggctcattcgaaatcaatataaatagcatgtatacttgcttaatttttacattttgttgtcttcatctcattaatattgcatttttcctctataaattgcactcttcctttcgttaatttttccaaaattgtagcttccaaattctcaaaatggtgcttcttacggaaaaaatcgccaaaattttaaactgccgtgtcagcgagctccg

SEQ ID NO: 83935 - DNA, 908 bp, Heterodera glycines
  Genomic contig location: Contig_ID=SeqID_19188; Location=30..937; Strand=+
  SCN-specific regions: Sequence locations=1-108,130-266,289-408,438 -736,762-908
atgcgcaaacacttttcacttgccgccctcctcacgctgtgccttcgtctgatcagtctgttcatgctgtcactgatcaccccggtggtgatccggcgtctgttcgcctccaactttgtggagttgctgcaaccgcttgaattcatcttcaagacttgctcagatgagttggccggtgtctgctcatttccggaggcccaattttcattggccgaggcaattttttcaaaaaaatgttgaaaataaattcatattttcaaatcctcgaaattttgaatttttaaattgcttttttactgacaatgagagtatccattgtttctttttcgaaacaaattatggaatttattgaaaaattgttattaaaactcaaaattttttctttgggaggggtagggataaagcgtcattttttttttgttttttttattattattccattttcaaacccaaaattcacaggaagacatccatctgcagcccggctattactacagttttgtgctcgacgttattctcttcgacacaccgcagaacagacagctgagcattgtgttggccagcgtaatgctcaaagtaaacccccggggggggggcaaattggcaccaattcgaccacaattcagaaaaaattttgattggatttttagggttttggtttaggtactgactggtgtataagtaagtaatggtgggtgttgtcttcgtaatttcgacataaaattttggggtgttaaaaacttttttgccataattttttaaggatgaacggatgaaactgttgttccaattccacaaaactgtgcccattttcaatgctttctccgcccgttcggtgctctcccgtctctacacattggtcagaaaatatttatgcaccgtttaggaattagactacattttttcaa

SEQ ID NO: 83936 - DNA, 527 bp, Heterodera glycines
  Genomic contig location: Contig_ID=SeqID_19188; Location=1048..1574; Strand=-
  SCN-specific regions: Sequence locations=1-372,396-405,428-527
atgcccgaggactcatttggtcgggacccaattagcccaccaccgaaacaggtaaaaatgccaaaaaaataaaagaaaaagcattcccctgaccgaaaattgtcccgtttggtggacgacctggatgaatttgttctgcagctgaaccacaatgaatcgggtgggccgcccttcacgttccaaataataattgggaaaatggatggagaacagctcggacacctcatgaccagcggtggagaagaagccgaccaagtacaggggccagaacacaatgttgcgagtctgaaaaaataatgtttttttgttgttgaaaatcggggtaactaataattccactctattttttttttgataaaggagtttctaaagtttttataaaataaaaataaaaaccaaaaattttttagcttcaataatttttgctgcaaaacaataagtaaatttcaacttttgggaccatgcaaaaaaatatattatcgaatttattcaatgattttaaagtcatattttttgctctaaataaa

SEQ ID NO: 83937 - DNA, 1190 bp, Heterodera glycines
  Genomic contig location: Contig_ID=SeqID_3256; Location=29..1218; Strand=+
  SCN-specific regions: Sequence locations=1-29,51-562,585-602,624 -882,904-1190
atggcatttgcaaatggtgccgctagtggacaacaacaacagctgcagcaacatcagcagccgaacaggttcaccatggtgccgtcgccgatgccgcgcaaccatttgcgacgcgtgccgaccaggtacaatttaggacgggaattgttgttcaaagaaaagtctgagttgcacaatggagtgaaaatgccggatttcgggtgttttttttaccttcggcaaatgttacacgacttaccaaggcatacatggaaaaatgggttggacgtcaatctaaaatttttgggatttaagttaattattgaaaaataggagttttttgggccggcagcacctaggaaagattttttgttatgaaaatttaaaatttgcgaccccctcgaaactttttattttgctatcaaaacattgtataattcgcttccatttttacctaactttttcagattggttttggagcgttcggtgtccgacagtgtgttggacgacgcggcaattccggacgaccaattctccgccctgcagcactcggccgccgccgcgttcaacgcgtccattctgcgcagactgtcgtcgtcgtcgtcaacgatgtcgcccggtggagggctgctgggctcatttgatgaacagttggaggacaacattgtggacaacaagacggagcagttcatgcaccaacagcagcaaggcagcaacggaaatggcggcaacaattcgtcgtcctcctcttcgtgcccgtcctcgtgctccagcgagacaattggtgagtcttgttggcgtttttgggatcataactactctgaattgtttttttctcaaaaaatccaaattctaatgaaaaatgtaaaaaggccgtcgaaaccccgttgaatttttttatgatttattgcatttcaattttcattgtctggtttgaaaaaaaccctaacggatatatttttgggctgggatccgtaagaaatcgcccattgatttgaaatctcgatcattacagggaaatatcaacctcacattcccctttttaagacactgacggctccgcacagtccgcggcgcctgcaccgattgtgaagaagcgtgtgtccttctcggagtgtgtccatgccagatacttccgaaggtgcgttgtgtgggcacatggcattcaaatgcagaaaggggatttattgctaaaaacgaaatgccactaa

SEQ ID NO: 83938 - DNA, 799 bp, Heterodera glycines
  Genomic contig location: Contig_ID=SeqID_3258; Location=450..1248; Strand=+
  SCN-specific regions: Sequence locations=1-129,152-450,472-491,514-799
  Gene Ontology: Biological process=regulation of protein activity, epigenetic
atggacaacggctggtctccagaggagttcggcaactgtgattggggcggtaacaaccggacggaggagttcggcaactgcgattggggagacaacaaccggacggaggaattcggcaactgcgattggggcaacaacaacaacaaccggtcggaggaattcggcaaccgcaattgtggcaacaaccggtcggaggaattcggcaatcgcaattgtggcaacaacaaccggacggaggaattcggcaaccgcaattggggcaacaacaaccggacggaggaattcggcaaccgcaattgtggcaacaacaaccgatcggagggattcggcaaccgcaattgtggcaacaacaaccgatcggagggattcggcaaccgcaattggggcaacaacaaccggacggaggaattcggcaaccgcaattctgggaatggcactgcccagcgacgggatgccaatggcagaaacaacggcggcggaccgtttcgggtgccgtcgccacccccgcagcaggtgaaggaggaagacagcggtccaaacattttttgaaacaccaggccagtcaaaaatagggcccaattttagcccgcccccctcccccccaaaaaacggaatatacggttgtttatgattgtaagtttgcgttttccaggtgccggtgccaccaccggtcactccgcttgacttttgttgccccggcactgagccttcgccgcctgttcgatcgaatatcgtttacgtggacggaattgaggattacaaacacagtttgcctttgatgcgtattgaggaggtttga

SEQ ID NO: 83939 - DNA, 724 bp, Heterodera glycines
  Genomic contig location: Contig_ID=SeqID_19191; Location=1077..1800; Strand=+
  SCN-specific regions: Sequence locations=1-174,200-253,276-294,351 -392,414-490,512-519,570-634,681-724
atggattttttcattgttactctgctctaccatttgactcttaacctagatgtaaatgcagcacctacgaagccgacaaatctgcgcaacttaaatctttccgaatggcaaaatgtgtgtactttaatcgaaatatttcagtttttattaacgttattacgcattaatttaaatttataattggttccctttatttttgaatatttataactttcacttaaataattaatgagtattcgaaaggttttttaataaattatatgacatttgacattactcataaatcaaccatagaaaaataataataattaaaaatatataccaaattttaaaacttttatttaaaaatagtcaattactagaaatcaatgttaggttaattcttaatacagtgagaattcagaattattttcgaatattcctctgccgaaaaaatttagcattaaagaaaaaattctctatcaaaagtccttcggcaatgaaaagtacgctatcaaaactcctggagccatcatactgaaaaaaataaatttataaataaagatcaaaaattaattaattcataatttcaggtggtgcaagtatttggaattgatactgatgcgtcagccttaatgggatcaagaaaagagagttttttaaattttttatgtatgataaaattaattcattattaaataggattggcaaaattaacgttttggaaaatttataaagttaaata

SEQ ID NO: 83940 - DNA, 385 bp, Heterodera glycines
  Genomic contig location: Contig_ID=SeqID_19191; Location=1924..2308; Strand=+
  SCN-specific regions: Sequence locations=1-137,172-181,203-327,352-385
atgtctgaatacgccaggttgttggaggctcgctgtccagcacttcatgaagctggacatgcggctgctgctcgcttcaatcggcatggtccgcgagttcaattcgtgagttaataagaaaaaatatttatctgtttccactctgatcaatgaaagaaaataatttaaatatgaagaattggattataatttaaaatatctaaggaatccaaggattaattattacaagagcccagacgggccccggtactagtgctgctcggatcaaaaatttccagagactcgagaatctagaccgatttcaagactataattttaccaaaaatcaaatttttttttaataaattttttccaggcttaaaattttttgtttttagcaaggcta

SEQ ID NO: 83941 - DNA, 1483 bp, Heterodera glycines
  Genomic contig location: Contig_ID=SeqID_19192; Location=1816..3298; Strand=+
  SCN-specific regions: Sequence locations=1-285,307-581,605-680,702 -770,862-872,894-1040,1069-1074,1099-1125,1156-1265,1287-1360,1399 -1483
atgaacaacaacggaaaaaattccaacaattgtgactctgcggatgaagcaaggcggagtaggaaacgcgatcgggctgatctcctgcacgaagtcgagatggacaaaatccgtgaagagcagcgccgccgtaggcagagacgaaagaatgaagaggtacaacgtcaacgtgctctccttcgccttcggacggactaccgtaatgcacggtgtgcggtatcaacaggacaataccgtatgtcgtgcactggtacgacaacttttgtggcaattcctcaaattgtaagtttattttttcattaaatgattagttaggagggtttaacgaaacaaaaaaatcaaaaataaggattattaaacggaaaactaaaatatggtacaactcaaaattttgaataattgacagggtttgagaaaaaaattttttaggtgattatcaatactcattattgcatttttttgttcataagctaaatatgagtcgtttttaaaatttttcacaacccaaaatagttgactgttggaaagatattatagttttgctgatgctatcggtctaattcaaaattttggtaaaaccattttttgtgtctctctttctttcatcaaatatctgcaagatagatagacagaaaaatcctaaccctgataatatataattaaacgattttttaaacggaaattttcaccaatttttcaaacacactaattcaaatttttataaatgatcatcattgtataattaatcgagaacaaacaaattttcaactaaaatgataataagcatttaagtaagcatcaaaaatgctaaattaagaatgagataaacatgaaaatggtaaataagcataaaaaccaaaaaattttttttgttttaggcatatttttaagttgacaataaattcacatctttcttatcgtttgacattcgaaatttttcttagcaaatgacaagtttaaaccaaaaatttttagggatgaatttaaaaaattttcaatttatgatggatttattgtttaatttttaggttgcttcttaggagtgtgtttttgtttttattagtgggagacgttattttattcaaaattgtacaaaaatatcaattaaacacaaaaataagcccgaaaatattaaatttaaaaaaaaattttaaacaaaacaacatgaaaaagtaggacctagaccctcaaacaatgttaaaaaaagaagttttttttcatgttattagcatcagattcggcaattctatgaaatccggtctcatgtaattagtagggttattataggcgcaaaaatctcgaaatagactcctaaaatagaaagaattggaaaataggaatttaacagatattatataggtaaataattttttttattaatttcttataattattttagggtcaatctcgcgggcagccggcaatgccatttacgttggctttttcgtacgaacctgcactgccgattggggcacgcagttga

SEQ ID NO: 83942 - DNA, 736 bp, Heterodera glycines
  Genomic contig location: Contig_ID=SeqID_19197; Location=218..953; Strand=+
  SCN-specific regions: Sequence locations=1-479,508-610,633-711,733-736
atgccaacgcccacacaccaacatgtggcacttggaggatggaagcgcgagcgtgttcggctccgttcccaacagaacctgaaccgtctgttcgtccgtccggcgctgtccaaagaacaactcaaagaggaatacgaagcgcgtctccgaaaacgtcaacaaaacccagctccaccggcacctccaacccagctcccaaaaacgacgaatgaccagactcccattgttgcaccaaaccagaaggaggccagcgaagacatgtccaaaccgccggaagtttttgaccaaacaatcatcgtttgttatgaagcattaaaatcattgccaccaaccgacaaaatttctcaccaaattcaatcactcaaagaacaataccctcatcttttcaataaatagttctttcagacctccaaacatttcctcaattaaaaaaaatacatttgttccagtacttctaatttctctcaaaatttttcctcaaaaaaaaaaaaaaaaatttttttttttctctctttttttaaactcttaaaaaaaaatttcttttcgttggaggtctgactatatttttctccaaattcaattgtcttatttcactgctatctgactttatactttccaatcaaatttcacaatgttttcttcagtttgttttcttttatcaatacttcacatttgacctcatttccaccaaaagtgtaagtggcatatgcccttcttttggtatttttatttttga

SEQ ID NO: 83943 - DNA, 101 bp, Heterodera glycines
  Genomic contig location: Contig_ID=SeqID_19198; Location=2480..2580; Strand=+
  SCN-specific regions: Sequence locations=1-19,54-101
ctcccggcccttcttcttccatggaatttgtacttagcgcatgtgtggacaaaagttcgggtaaaagtggtgaatggttcactctccgacccgacaaaacg

SEQ ID NO: 83944 - DNA, 829 bp, Heterodera glycines
  Genomic contig location: Contig_ID=SeqID_19198; Location=121..949; Strand=-
  SCN-specific regions: Sequence locations=1-16,38-163,185-543,565-829
tcagatttgaaaatgctgtgcaacattttaaagtgctaagggacaccaaagttggccaatattacctgtgggcaaaacggtttaacagtctgaatgaactcattaactatcacaggtaaagccacaatttataaaaatttaagttgcactaaaagctttctgattggaaataaatgtttctttagggccaatagcatatcgaaaacccacaacatcctcctccggtccatggactccgccttttccaataaacatggccttgttcaggtgtttttttatttattataaggacctgtccaggggagggcgtgcaattgccccccccccacctcccgaaataaaaaacgaaaattttcaatttaattgaaactaataatttaagccctttgtagctcgctaatgctaattcgtagtctgaataacatttcattcgctttatcctttcaggccctcttcgatttcacccctcaagaagcgggcgaactcggctttcaacgtggcgacattatcacgggtcctttcacaccgtccattttttcttagtgtcttgttttgtgtttttagtgacaaaacgcgaagacgaaaattggtgggaagggacactgaacaatcggacgggcgtttttcccgccacttatgtgtaagtttatgaaagggcgaagaccaatggggaaaaagaggagaaagtgggcaaactgtgcgtttctaacagaatattgtcagaatccacagcaaatgtcttttttaaaggtctttgtttcttacagatgcccctacaatagcggatgaggtcgaaccaaaaccttttccatctccgtccctgtcgtct

SEQ ID NO: 83945 - DNA, 684 bp, Heterodera glycines
  Genomic contig location: Contig_ID=SeqID_19200; Location=379..1062; Strand=-
  SCN-specific regions: Sequence locations=1-377,399-440,462-502,524-684
atgcacaaattaccatccgggaaggaaggacaactgctgagtgccaacagaaagccattggtcgaacagagcgaacgcggcggaaagattggcaaaacggtgggagtagcgcaaatgggtgggcaaaagtgcctggaaaaagcgaatgctttgtcgaattggtggccggcatcgcccacggtgtatccgatgagtcgatgggtggaattgtcccaaatgagggtgtcgttgtaattggtgaagagcacggatgtggaatggcggatgcaactgtccaactgtgcgtccacaaagtgcggactctgcacattacagcagaccgattcagcagaaggacgagacgcgcagctcagacgaacactccaatccaaaaaccttggaaaacatgggctaattagataattaaccgtcccaattaacagacaaatgaaaggcaatccaatccatgccctttgggttcctgaagacaaacaaattacctttcaggccaaaatcgggcactatgttcaacgaatggaagtgcacgcatctgttctaactgttgggccaaagctcgaagttggccaactgtccgcagatggaaatgattgtcggattccaattgagtcggcagagaattggcatcgaagtaaaatttggcagagattgcccgaattccctgaaatgaattgctgcaatgattaa

SEQ ID NO: 83946 - DNA, 1669 bp, Heterodera glycines; identical to SEQ ID NO: 19200
  Genomic contig location: Contig_ID=SeqID_19200; Location=1..1669; Strand=+
  SCN-specific regions: Sequence locations=1-231,253-266,288-539,561 -601,623-664,686-1369,1403-1552,1617-1669

SEQ ID NO: 83947 - DNA, 855 bp, Heterodera glycines
  Genomic contig location: Contig_ID=SeqID_19203; Location=378..1232; Strand=-
  SCN-specific regions: Sequence locations=1-110,132-583,605-670,704 -775,797-855
atgtccaccgaatttgaggagaaattccgcaaaatactgaaccgcgtctaccgtaccctgcaacaatttgaaatccgtgaagaggtgggtgtacggtagacggggataataaaatggaatgaaagaaaaaattaggaaaattccgataataggcctactcgagaatcgagactgaatcagcggaatgcaatccgttttcttacctcggggagtgggggaacggtgccctgacatttgcggccgcgacatttgcgttccccagccaaaaacggcatttgcggccggcattttgcgcctcggacatttgcggcctcgggacacgggggtaacgagctattcccgattacaagaaacaaaaaaaaacacacatttctcggcacggaaatctcattcaacaataaacaacattgattgctgctcccccccccctccctcgaaatgaaaaattgacgaaattttttgaaacaaaaaaaggtggctgacgaacggcgtcgcattgtgtggcaatggcgcacattggcatcgatcattgaccgctttctgctgttcgccttctccctgttgacctttttgactgtcactgtgttcattgttgtgccaattttgttccgcgatcgttttgcatcaatgcaaaacaatgcgtaactaatttcaggcacattgcttttcaattttaaaggactgtccttgaaaacaaaaaatttagacgcattttctctggcattaaaatgtttttccccttcatttttcccaatttaaattcaatttgactattttttctattagtcacattttaggaaaattaatttcaattttttatgtaacttatgtaaaacatgcattaaatataataaa

SEQ ID NO: 83948 - DNA, 2465 bp, Heterodera glycines
  Genomic contig location: Contig_ID=SeqID_3259; Location=1..2465; Strand=-
  SCN-specific regions: Sequence locations=1-196,221-354,380-466,489 -810,833-1077,1099-1679,1701-2384,2406-2465
  Gene Ontology: Mol. function=snoRNA binding; Cellular component=small nuclear ribonucleoprotein complex; Biological process=RNA processing
atgggcttctttaaaaatgtgcatcgcggcaaccaaagagggaggattaaaaaacaaactaattttcgaaaaaattcaaaaatagcccaaaaatttggtggaaaaaaacagaaaattgaaaaaatagctccggaagatgatgaaattccttcctcatcagaggaagaaagtattggagatgaacaagttgagagacatgacgaggatgaggacaacgaatatgaagaagacaaccagacggtggcgtaccgggaggcgaaacggttgttggaaagccttaaggtgttcttttcatttggcttttattcactacttttttcattaacgaacccatctttatcgactcgttttaaatgggaaattgaaattttttaggaaattttgaatcaaatttaatgggttcattaaattaatgtggccctaattttctttgttttagggtactcgcgatgtggatgaacatgaagaaggagctgaagaggacgatgttgaccagcaggggattggcgactcggtggcgcaacaacttcgccaggaggcgctagcgaaacaggcgaaactgcaccgggccgttgctgcacacgtccgtttcggggcccaggcgcagcaacgaatggtcgcacaccgtggccaccgattggcgcccatttgcgtctgcttttcgacaagcggtgctgtgctggttagctgttccaaggacggagccgttgtcaaatgtaagtagcagcaaaaacggacgatcgcaaaaattggacggaatttttcaagccgaaattgatggagttgtttgggaataattgattttaaaacattttttcttaaattaattccagtttagttgacctaacaaaacggtgtcgtactgggattcttcgtccgacttccagcagttcaaaaatcaaaaacctcgggaaaaaaacaaacgatgccattggtgttaattgtcgggaacggcccgattctgagcatgacgacaatggcgcaacaaaggcctatgatttgtcaccggcattgtgttgtgctatttcgccagacgatcaatttctcgtaaccggatctattgatggttagtggccattaatacaaaaatccatgaaatagcatttttactgcaaagtaaggaacctttatattgggaaattcatgcctatatttggtaatatgtgcatttctgttttaaaaaaatggatagaaatatcccgggtccacccgtttccaggtttgatatattccaactacttttctcgccccttaggttggttcgcgtttggcgtctcgacacactttcgccggtgcgcactttcagcggccaccgcgggcgcgtgaccgcgttgcgatttcgtcgccaatgcgtcgcgttggaattgttttccgccagtgccgacaaatccatcaaggttttttttgtcggcggaaaaactcgaaccaacttttcaatgcatgaagttcgcttcaccatgtgtttttctgtccctcccattctttacagtgaaactttattccaattccgaatttattgcaaaatttaccttacagtccactaaccctcatgaataagccgagagaccagcccaattttacggtcggtctctgtgcagaagtgaggaaaagcatttgctggtcaatgccagtgcaatttcttgcactctctgagaaaagaaattgcatttttattgtccacagaaaattcacaaaatttgtaacaaaaagaacacgatttattgggaatatttcctattttttgtgctaaactgtctttgacgatttaaaggtgtggaacttggatgaaatgggcattgtgaacacgctctacggacaccaggacagtgtgctgcatttggacattctccaatggccccggttggtcagttgcggagcaatggttggtcgccaattttcatgttcggaaccaaatattattcacttttaggacaaaacgtgtcgtctgtttaaagtgttggaggacagccatttggtgttcaacggattggcggagtgtgtgagcattgactgtgtggcgatggtcaacgaggagcactttgtgtccggcagtgttgacgggttggcatttttctcgacaatttggattggtgatcgggggggggggggaatgagttaccatttaaatttcagaaagggactcaaaaaagttaaaattcttttttggttttataattcccttttttgctcattttcctccatttttaatgtcaggtaaacgatttttctactaacaataaattatatattctcatattcaagcggcaatcccccttttttctgcacagttccctttacgtgtggacgacggcgcgcaaaaagccagtttgtgtccgacggaatgcgcacaatgggacagagccatcaccgccacccccgccttactcctcctcctccttctgttcattttctgtccatccaaagaaggcaatggtgggcataaacatgggagaacattacaataa

SEQ ID NO: 83949 - DNA, 391 bp, Heterodera glycines
  Genomic contig location: Contig_ID=SeqID_3261; Location=2705..3095; Strand=+
  SCN-specific regions: Sequence locations=1-193,216-248,281-391
atgcccaaacaagtgtgggagtggtatgattacactggtccgttggtcgtatggattgtgttcttctccgttatttttgtcatctccgtcacgtgcattttgtggtgctgcatcaaaaaagacgacgaccccaccgtatttgcgaaggtcgtttttatgcaaacaaaattggcagcattatttaattttaccgtaattttttaatttatttttttcccttttcagtagtgcagaatcttttgaaggcccgaaggaacaaaaagaaaatgtggaagacaagaaatgaacaatggcattgcaatttcattttcgacggggttttgttgttaacaaattgtaaaatgttccatctggttttttaatgcatgtgagcccagatgataatttcaaa

SEQ ID NO: 83950 - DNA, 782 bp, Heterodera glycines
  Genomic contig location: Contig_ID=SeqID_3261; Location=1572..2353; Strand=-
  SCN-specific regions: Sequence locations=1-234,256-434,456-782
atgtctattaaacaagaaattgatctcctgccgaaggacgaaacacaggaggaacccccgttggactcattggtgcattgcacggaaaagcttaaaaaagtggttttctcattctcggaagtaaggcatttgaggaagcacgcaacgattagacaatgtttggtcggctgtttggcagcatgtaaacggaaactcacagagactgtgagtagaaatctcaaaatctgaaaaccctaaaattggcttaaattttttcaggtgatcgttgatgaagtcattttcgtagaccaaacatacgtcatgttcaaacactcggagactcgctatttgttcgacaatttggattacgttcatattactgacaaagtttttcgacaatggatcgatgaattagtaatgagggtgcgttttttgtgccgttaacacaaagcaataattaattattcattcattttttaaaggatgaaccgttgccactgtacgcacattattttgatcgtaaaataaatttgctgaaaatgtggaaagagctcaaagaaattggtttttttgacaaaacggaacaaccgaagaacgacggcggaacaaatttacaaatggaattagagaaacaatttgggattggcactcagcacattatggtcaccccatggcatttggtgcaactgttgcagcttagccgcagagaatttgaacatgtcgttgtcggactgtacgtttgctgcgtggtgagttcgtcattctcagcaaaaactgcgttaattaaaatgccaattcattga

SEQ ID NO: 83951 - DNA, 1251 bp, Heterodera glycines
  Genomic contig location: Contig_ID=SeqID_3261; Location=4270..5520; Strand=-
  SCN-specific regions: Sequence locations=1-53,76-1251
atgcccaatgttggcgctgatgttggcggtttcttcaaaaatccggatgcgcaactgttggtccggtggtaccaggccggcgctttccagcctttcttccgggtttgtttgtcctgtttactttttctcaaaatttactgctatttattcgattccaacagcctattataactcttttaattgtccatccctttttaaaatcacttttttggtaggcccatgcacacattgacacaaaacggcgcgaaccttggctgttcggtgagcgtgagaaagcggccatgcgcgatgcgattcgaatgcgttactcctttttgccttattggtgcgttaaaaaatatgcgggttttgagggcattgtacaacagtggcattctttgtgtccatttgtccaggtacacattgttctacgagcacacaaagaccggtgtgccgccgatgcgccccgtgtggtccgaatttccggaggacgaggcttcctacgatgaggagcgcgagtggctggtcggtccgggccttttggtgcgtccagtggtggagcccgacgttgaacaagtgtcgctgtatttgccgggcaaagcacaaacatggtaactgacaaatcagtgcggatcctttaatgttggcacattaggttcgattgggacacacatcgcatttatctttctcccggcgcaatttacacggaaacaccgctggagaaaatcccggtctatcagcgtggcggcaccatcattcccgtgcgttgtgctttttcttgagattgggttcaatttaaattgatttttttattaagttgagggagagaccgcgccgttcatccaaaatgcagcgcaacgaccccataactctgtacatcgcagccatggcggatcgggaatttgccaacggcacactgtacttggacgacggcgaaacgcacaattaccgggaaaaaaatgaatacctttactgggtcagtggtgattatgataaataacatttggtttaatgaaaggtagccgattttggggattcgaattgagcgccaacgcacacaaatgttttttatatgatgaatgattccagggattcacttacaaaaaagtgagcgaccacacctactcaattctcgccaagagtttggacagccgcggcacttttgacccggacgtttggattgagcgcattgtgattcgcggactgcgctattacccacgaaacgtgcacatgtactacgagggtcagttgttttcgtccctaatgagataa

SEQ ID NO: 83952 - DNA, 319 bp, Heterodera glycines
  Genomic contig location: Contig_ID=SeqID_19205; Location=257..575; Strand=+
  SCN-specific regions: Sequence locations=1-80,102-156,229-264,286 -296,318-319
gtttacattcttttgcgtgccagcggagcactcagcgaattggcgccgattgacgtgcacacagcagtcaaaacgcagggaacagatgtttttgtggggggagcgtacgatggcataaacaacagcaaacgaatatcggatgaacagaatggaattgagaaagaagaagaggaagagtacaacgatgaagaaggagaagaagcggaaggggagaaggaggacagaaaatttgcaacaatttagccagctcatgtgattgtgaatatttgttttgtgtttgtaatttagcacttctttaatcatttaattaattaattta

SEQ ID NO: 83953 - DNA, 253 bp, Heterodera glycines
  Genomic contig location: Contig_ID=SeqID_19208; Location=562..814; Strand=+
  SCN-specific regions: Sequence locations=1-55,96-101,125-253
ggcacccccacaaagtgtccaagccacgaaatgtccaaaagagtaaaaacccacgaaatgtccaaaatttttcaaaatttataaatacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgacagaa

SEQ ID NO: 83954 - DNA, 1040 bp, Heterodera glycines
  Genomic contig location: Contig_ID=SeqID_19209; Location=874..1913; Strand=-
  SCN-specific regions: Sequence locations=1-50,72-111,133-195,220 -240,270-296,318-341,363-486,513-571,740-1040
atgacccgtcctaacacaggttggtggccacccacaggtgttcaaagcattcaaatattcaagtttctattattttcgtgaacagcaacatttttcggcgctaaaatttcatttttggccattttacaccaattttctgatataatgaaatttcataaaatctctttaatttttctaaaatctctttacattgtgaatttattttatttttattattttcgaatgagctccagtagaaagtaataaaattttatttaatcattaatttaccaattggcaattattttgtcattaagataaaattattattattatttctttgcaattaaacaggatttccttattttattaagtaaaataatgatttattcagttttttaatcagaaaaaatcatttaaatgcctcaaaaaatgaattgccatttaattgaagaaaaataaaataaaatcatttcgagacgacaaaaatgaaattatttccgctacttttattaattatattatttttaattgtcaaaattggatcagaaaagaaaaaattgcaacaaaagtcatttggcgaaatatttggagaaaaatggcaagaaaaagaagaagaaaaacgaaatgaactcaaaaaaagagaaataattggaaaattttataaaataaaagagaaaataaagcaaaaaggaaaataatattcagcaaaagaatggaataaaattgatggaaaaatagcgaaaaaaatggggacaaatcgcacatatatccaacattggaataaagaatttggtcttcaaaaactcaagtcttacaaatcaaaaagtgatgaacaaaaacttgaaattgttcaaaaattcattaaaatgaaaaatgaaataaaacaacaaaatagaaaatattcattaaaagaatggcgccaaaattatgctggaatttgtaagaaaattggagttggctatggaactatttgcagatggaagaatcaatttggcattagctgtaaaataacggaaaaagaaaaaactggaaaaaattaaaatttattggaaaataaa

SEQ ID NO: 83955 - DNA, 1009 bp, Heterodera glycines
  Genomic contig location: Contig_ID=SeqID_19210; Location=294..1302; Strand=-
  SCN-specific regions: Sequence locations=1-631,655-1009
ttggatttgcaacgacgtttggatggacattttcccatcgtttgaccatgcccaactcggcctcaaattggcacttctttcgccacgtttcaatgcgttggtggacaaacatttcgatggcaaaagcgaattgacaatttggaaaacaatcgaaattcgcaaggacaaaggaccagaaccgaaactttatgtaaagatggatgacaaatttgtgccatttccattgccagacgaccgtctgttgcgcagcaaaattcgctttaaatgccttcatattgagtaattaaaaatctgagctatggcaataaaagcattcattccctttttgcagttacatcgatcactccgtcatcgcttttcttcgttcaaatcaccaaattttcgacaaaagaggcaccaatttagacttgtggattccatcaccacacaccacggatggccagcggatttgggatatttttgttcgcgaaatttggccaattttttcggaaaatattcatcacttgggcttttcccatggtgatcatttggacaatttgcgtcttcgcacttcgccgacaattctcaccgacctcaaccaattgaattcaatcgattcatttgttctgttgcccgctgcgattggtgatgattttgatgggccaaatgcaacaatttctgctggccaatcattgtccaaatggttgcactctccgagaaaagatggccaacccaaacaattgcgttgcggtggtattaacgaacaagcgaacactgattgggtcaacaatttcaaggaggtgagtggccacattttcgacaaatcactgatttttgttttcaaattgttcagcattttctccgtgccaccatttcttcggtcagttaccaaattcatttttatgttcatgtgtcgtcaatgcaaatggtgccgtttgaattggtaaacgaatggacaaaggaaaagctgacattggccaaagcaatcaaaaacggatttgaggacctattgcggttcacacgaccataa

SEQ ID NO: 83956 - DNA, 459 bp, Heterodera glycines
  Genomic contig location: Contig_ID=SeqID_19211; Location=349..807; Strand=+
  SCN-specific regions: Sequence locations=1-66,88-108,134-265,288-459
atgaccgcgatgaagactttggagaagaacatgccatcatcaaattcgaactcggaaaaactcaaaagggaggcaattgtctttggtccgaaggtgggaagtttattgaaaaaataaataataattatattaaggcttccggtatgtacaaaagaaattggtggaactgctctgtgaggaactgtcctgcgcgcgtgacaatcaccgacaatagcgacaaaaaaatgtgcggttatcttggccaaagagaccataatcatctccctgagccacaaaaacaacaggtttgggatgctcattgttaattcaagtctgctaacaaaatttaggcagaaagtcggcgacaaaaaatactccagtgtgtgaaggccgaaccactctcatgcggcttctgccctcgcgaggaccaacaatggtctcgaagcaacccacctccatttctcagtatttgatgtgcta

SEQ ID NO: 83957 - DNA, 227 bp, Heterodera glycines
  Genomic contig location: Contig_ID=SeqID_19213; Location=1184..1410; Strand=+
  SCN-specific regions: Sequence locations=1-88,120-130,165-227
atggaagagttgcaactgaacatgccctaccgtgttcagcctcactttggcgacacacaagaattgttgggacgaggtaggcaggcacttttaaaaattgaattataatttaaatttatggaattggcacttttaaaaatcaatttatattaaaataaatttaaggcatgcatcccgtgccaaagagtgtggacacggcggaaccgttgcgtgccgaaatgatgtac

SEQ ID NO: 83958 - DNA, 113 bp, Heterodera glycines
  Genomic contig location: Contig_ID=SeqID_19214; Location=85..197; Strand=-
  SCN-specific regions: Sequence locations=1-113
atgcctaatgcagttttttgttcattgttggcaggtgtcgcttgtgttattgaaattcattacaatttcgattacactgacattgaatggacaaaaaatggacaatggtggca

SEQ ID NO: 83959 - DNA, 1049 bp, Heterodera glycines
  Genomic contig location: Contig_ID=SeqID_19217; Location=1..1049; Strand=-
  SCN-specific regions: Sequence locations=1-293,315-754,776-890,912 -1049
  Gene Ontology: Mol. function=RNA helicase activity; Cellular component=cytoplasm; Biological process=post-embryonic development
cagagaagggttaaatgggagacatctaatggtgaatgacacgggaacagaggagggttaaatgggggacaagcaatggggaatggcgcgggaacagaggagggttaaatgggggacattcaatggggaatgacgcgggaacagaggagggttaaatgggggacaaccaatggggaatggcacgggaacagaggagggttaaatgggggacaaccaatggggaatggcacgggaacagaggagggttaaatgggggacaatggggaatggcacgggaacagaggagggttaaatgggggacaaggggaatggcacgggagcagaggagggttaaatgggggaccaatggggaatggcacgggaacagaggagggttaaatgggggacaacaatggggaatggcacgggagcagaggagggttaaatgggggacaaccaatggggaatggcacgggaacagaggagggttaaatgggggacaaccaatggggaatggcacgggaacagaggagggttaaatgggggacaaccaatggggaatggcacgggagcagaggagggttaaatgggggacaaccaatggggaatggcacgggaacagaggagggttaaatgggggacaaccaatggggaatggcacgggaacagaggagggttaaatgggggacaaccaatggggaatggcacgggagcagaggagggttaaatgggggacaaccaatggggaatggcacgggaacagaggagggttaaatgggggacaaggggaatggcacgggagcagaggagggttaaatgggggacaaccaatggggaatggcacgggaacagaggagggttaaatgggggacaaccaatggggaatggcacgggaacagaggagggttaaatgggggacaaggggaatggcacgggagcagaagaggcttaaatgggggacaaggggaatgggcacgggagaagaggaggggtaaaatgggggccacccattggggatgggacggggagaaagggagggtaaatgggggacaacccatggggaatggcac

SEQ ID NO: 83960 - DNA, 2209 bp, Heterodera glycines; identical to SEQ ID NO: 19218
  Genomic contig location: Contig_ID=SeqID_19218; Location=1..2209; Strand=+
  SCN-specific regions: Sequence locations=1-78,101-507,529-1285,1307 -1787,1809-1832,1854-2209

SEQ ID NO: 83961 - DNA, 624 bp, Heterodera glycines
  Genomic contig location: Contig_ID=SeqID_3264; Location=349..972; Strand=+
  SCN-specific regions: Sequence locations=1-400,460-624
ggaattttcgaagccgcttatcacgaatagagaaattcatttcgacatatcaaatcccgatcctgaattcagacaagagtcggatattcaatttcgaatttctcacatccaaagttataatgcattttggctgatcttcgagtggagaagtcattaaggccttattgagaaatagaattttcagttattgtctcaattcagattcgggattcgaacttgtacgaaatgaatatattcgtgttcagtgctccgaaaccccgaaaacattctcaatttttttgccagagacaccatcggcacaattagcattttttgataggaaaatgtattttacgagcagcaattcatcatcaaatgacgaagtcgaagaacacttcacccattttgcacctgatcagtgtaaaaatattaaaatgaataaaaaaatgaaaaatatcccaaataatttaatttattttagcaatttttccaaatttgagtctgtccgaggaattgcgcatcattagggctcggatggcgcgaattttggagaagaaacgaacaaaaacaatgggaacatcgtcaagaggcacaagcgatgatgtgaccgaacagaacaccggtaacaaaaatatgtttcattag

SEQ ID NO: 83962 - DNA, 1340 bp, Heterodera glycines
  Genomic contig location: Contig_ID=SeqID_3264; Location=1126..2465; Strand=+
  SCN-specific regions: Sequence locations=26-76,99-105,136-362,385 -515,537-726,748-857,912-916,940-1212,1234-1340
atggacgatgatgatgatgataattgtgatgacgtgagcagcagttttcacgaggataccaagcagcaacagcaatacgagaagagaaaaacaacaaatattggtaaagcaaatgagaaaaagaagttaaaaattaattatgaatacggtaccaaaatatacatatacggtaaatcaatattaggacataattgatgattactgtacccaaaactatacggtaaatccatcagtaaaatttgaattaattgtttagcttttgacgttcaattcaaagcaattttgaaaagaatcactgagttggagaagaagcaacacaaacaaaatgaaaaagtgacaaaaggtaaaggaatttcgaattattgaaaattaaaaatgagtttttatttagcattggttggacaaatgaaacaattgcaaaatgatcagcagaaacagttggagagaatcagcgaattggagaagcagcaaacggcgattgttgatcagctgcacaccgcccaaaagcaaattggtaattaattaattaatacttgaattaataccttaattaatcgataggaatcgaaggattaatatccctaatgagcagtataaaacctagagatcagagaaattccgattttatgtcctggaaaaccaatttgttcacatttttttcagatgatcgcatttctcaaccccaaactgatcagcaaccgatggaactttgtgccaaaattagcgaattggaaagcaacacaaatctattgtttggcaaaattttggacgagttttcagagtttggcaattttgtgggcattttgaaggacagattcggaagaggtaaacaatcagattaataactgatcaccaacaaaattaattgaaaaaattaaaaataaaataaatttttaataaatacaaaattacgagaaaatcaatgaattcaatgcatttaaaaatgaaatatcatataatttttactcattaagagttgctaaattcggtccatcccaaaattcgtgcgaaaatttgtgaggtgaaaattttataacaaaataaacgaataatataaaaattcttttcagaaattttcaaatgttcaatcaaattgttgggatgcaaatgcctgccacaaaaacctccaaatttttggctccgaatgtttgataattcattataaagaagctgaaagtggtaagattaattctgcttaatgattaattaccgaatttcttctcatttacttaattgttttttcagcttgggtttctgtgttcgctaaatattccgtcccgagcagtgaaatcggcggacttttctatttcgaagtgaaaatcattaatttgagaaagtag

SEQ ID NO: 83963 - DNA, 892 bp, Heterodera glycines
  Genomic contig location: Contig_ID=SeqID_3265; Location=980..1871; Strand=+
  SCN-specific regions: Sequence locations=1-185,207-572,605-749,772 -829,860-892
atggcattttgtgaaaaagcggagggactgaactgctatgtgtatcgaaacgaaggcgaattttggacgcattgcacaagcaaaaaaggaaagccgaaatactcacgagacgatgtgatcggatgcggcgtcaatttggcctcgggacggatcattttcacaaaaaatggacaaccgttgggttggcaaaaacaataaattacttaatttaattttggggactcaaatgccttttaagacaccgccgatttgtttgtttgtccatcctctccttctgctaatgatgctgttgatcatcggttgtttccatgcgtttctttggccgactcgggcgatttaattgaggcaaatttcgggcccaatttcaaatttgaccctgccaatgccgaggtgtgtatttctgtgttgagcatagcctagtaaatttttatttcaggaattttcgaataccaaacaaagaaattgctgggatttagccgtttgtcacaatgaaatcacaatttctggcccacacaatttgattgtccgtcataaaggaagcggaaacggtatgctcctactgtatttacaggaaatttaaatatttgttaaaatttaaatttttcacaaaggttggcgttctgtgtttgcaaaatattccattttgcacaatgttgcaactgagtccattgacatgttttactttgaggtgaaggtcaaaaacatgaaaaggtaagggcagcttgtgctaattaagaaaaaaccctatatagatatttcacctatatatctctaggattaaattttggggatttaaacgataatttcttttttttgattactttcttacaaaatttgatttttataaatttaaaattttgtaacatccaaatcgaagctgcataatgccgaa

SEQ ID NO: 83964 - DNA, 995 bp, Heterodera glycines
  Genomic contig location: Contig_ID=SeqID_3266; Location=1609..2603; Strand=+
  SCN-specific regions: Sequence locations=1-418,440-831,853-918,940-995
atggcttccgcggatgagtatcttcacatcttccatttccttcatccaaaattgcttggcgttgatctcgctttacgctgcaacctttttgatgccattgttgacgcgcattttttgtcaagaattcggaccttgggcaccatggaaattcgccaagcaaccggagaaaacggagccgacgacatgcaaattctcaatggcactggggaattgctgcccattgctgacagaccagtgccccatcgtgtggttggattcgaaagcattatgatctcgtaagcacgaataaattaagaatttgacctacaaatatgtgtttttttttattttcttcagttacattagcccaactgtcgccacatttctgcaaaatttgggacatcttttcgcctcatgtgactcttatttgttgctcgaaattgttaatggacatgtgttggaatttgtcattcacgtccttttgccgctcatcaaacagaaagtttatcgcattgaattcgatcctaccggacagaatggtgacgcattccataaattacgacaatacgttcctggttttctcaacgaatgtccatctctccgtgtcgacttcgagaggtgaactgtccattttttggtttttataaattaattttatctcttttttttagctttttttgagtggtgcttcgtccgcagtcaatttcattgtgcttatgacgttaactcgtggttctgtcaagccgtttacgatcactaacgatgtcaccagggaggagttgaagttggaatatcgtaaggaccacggtctgttgcttgtccggtgcccaatttcgcgcgacaaagcaaaatggaaagcatatgaggatggggcgttggaaggagcgatgaaccgaaacactatttatgttttaaaaaattgcacaggcggctggtcagttttatgaagttttatgggacaccatcagcaaaaactttaaaacccttgtgcttaaaaatgtgtattttcttgaaaa

SEQ ID NO: 83965 - DNA, 1134 bp, Heterodera glycines
  Genomic contig location: Contig_ID=SeqID_19220; Location=136..1269; Strand=+
  SCN-specific regions: Sequence locations=1-283,305-600,623-1113
atgccgtccagcaaaatccatggacgccaagctgtgagcgggaccaacgacagaacaacaattcaaatgatacgggaccatcaaattcttaccgcaacttttcaaacagcccacatcgtggaagatatggacaaggacgtggtggcggcattttcaaccaaagacaaagaggccgaggaaattggagaggaccaaacaacatggctgaccgcagctggaatcaacgaccgtactgtactttttgtaagagaacaggtcacatggcatataattgctttcagagaaaaaaccaattttccccaaattcaggacccaatctaaatgccattcatgactcttccgaatttcaccaagatgccaatcgtcagacatcaaatgtcacattggacatcaatgaattgctcagagcattcagtgttatgaacacccaaggcccgtcttcaagaggtggaaatgaatctgcgtcaatgaatgtcattagcacgatgcctgctgatcatccaagaattgccgaagacgcttaccaaggaacaggtggaactcagggtaatccatcggaatcgaatgaccaacataaaatctcacaatgggaagggatcggaccaaaattatccaaatattttatgattctaacagcattcatgttacttattaccggtcttattaacaccactaccgctaatgctccaaagcaccccatggtatgtcaaatggtaaaagacggaatactttggaaaattcctaatttgtcaagctgcccaaagttctcattggattacatagaaaatccgaaaattaaatcacttcgattgtacactccaaatgttttcgaacatcaaaccccggcttggtcatgcagaaaaataagaaaatcaatcaggaaatatacaagtcttacaaatgttcccatttcagaaatgcttgaaccaattccgcttgaaattagttcagatgaatgctggcaaatgattcgccatcgtaagtgtaaattggggggtactgattgaagactcgagcttatggcacactgatttaaaaattgacaattcaccccgccattggttaattggcccatggaattgggaaactttttttattgatatttggttgctaaaaaattggccccgggaataa

SEQ ID NO: 83966 - DNA, 621 bp, Heterodera glycines
  Genomic contig location: Contig_ID=SeqID_19225; Location=785..1405; Strand=+
  SCN-specific regions: Sequence locations=1-91,113-217,247-621
atggcggacatggacaaggaggattttgtcaacttggaaattgagccaactgcagaaacgtaagcaaaagtgacgcaattatatatagagattatggaggaaaaccaaataataaatcattcatttcatgggcacgactctctcttttccattgagataactgacgatgaatttaaagaattttcaaattaatttagtccctcgggccgcgaattcacatataaaacttttttaaaaaatccattaacgaattctccgctaaaatattgttcacaatcagcaacaactattaattatccatacacatttgtaaggatgctgtttggagatgaatgttgcaccagcagtaccgatcagtgtaagcaaccggaagccaccgaagaaatatttgtgagcatggcgaaaacgacagcaacacaaccacaagcagggcgaggaggacagccgagaacgactgattcgacgacaaacgctccgaagatgttcagctctaaattgacaaaaaaggcggatcattacaaatggcctcggggacagacggacaatggttgcgatcagaggaagaagctgatcggaaaaagtagcataaagaatgggtggaagaatgtgaaagcagcacca

SEQ ID NO: 83967 - DNA, 1354 bp, Heterodera glycines
  Genomic contig location: Contig_ID=SeqID_19226; Location=1304..2657; Strand=-
  SCN-specific regions: Sequence locations=1-364,387-448,470-684,706 -892,925-1172,1195-1283,1319-1321,1344-1354
atgccaaaatatgtgcaaaatatgtgccaaaccccgaaatatgtgcgatatgtttttatgtgcgaaaacgccaaaatatgtgtttttatgtttttataagtcgctctaaatcgaaaattgttcggagaaaatgctatttttgggcttctctcgccataattaagccgcaaaaaaaatatgttaaaacataaaaatcccagccctaattattacgaaaaacaacattcacttagtgatgtttaactttttttctgcatgttaaatccaccccaaattttgaatatcgatagagaaaaaaaatctacatagtgtaatacagccattttatattttatacactttttcatgagatatgttaagatttgtaataaaaaattattttgtgattcaatggccaaattaaagcgaaatataaaaagagaggcggtgaaacagcggtggcaaaagcaagaggagagaaaagcgcagacggccaaggcgatacaagctcgcctggccaagaaaagtgagttaagtgatttttaactcaaacatctttttttaatttcagacgctccaccttcgacgaacaaatgccacaacaggacgaagcagggccgtcaaattctgctgcatccgccgaagaagcgatggagcctccgccaccaactccaggaccagtgccaacgccagaaatggacgaggaaattttggaatttggcttttcgctgccatcgacatctgtcacaccaatcggcgattgtctccaggtgatttggacggattggagacggcagtcgaccagttcaaggcatttctcgatcaacaaccaatggtgcaaacacttctttcaaaaaagacaaaggcccatttgctgcttcaccactttgttccatttgcgcgccaacaccgatttttggggcttttggatgagcaggatggggccatatcatttttgagggctcaattttaaatgttgtgatttttcaggagatgaggcactgcattccgtgtggtggcgacttgagcaactttggaagacgatgccggacggtgtacaaatgcgccaacagctggagcatcatttcgtcccgaattggctgctggacaccgggagatttgacgaattgaagctggtgagttaacggaagggaatttaacatttatccaactaattaagcgggaggaggaacgacgggagcaagcggaggaagacaacgaatgaagaaagtgatcaagaagctgacgtcgatgtcgttgactgatcgaggatttatggtttttattttcattacaagcggtagataaaatttttaaaaatttgaaacaattttaaaatcattttggtcatttttccttttatttattcattaaa

SEQ ID NO: 83968 - DNA, 1619 bp, Heterodera glycines
  Genomic contig location: Contig_ID=SeqID_19229; Location=50..1668; Strand=-
  SCN-specific regions: Sequence locations=1-280,303-675,697-729,755 -1402,1435-1619
atggacaaaacgctcgccgatattttggaaaaattgacgcaagcgatcaagcagcagagcgcaccgacatccaccgcaactcagccggcacaaaacatcactttgccggacattcacccattttcaacagaaaatgccgaagaatttgaagagtggttggagcgcttccaatttgcattggattgcgcggtggcaaatatggcggacgaagccaaagtcaaattgctgatgactaagctcaacccgtccgccttcggcgaatacaagcgctactgcctgccggaggaaatcaccaaatttgactttgcggacaccaaacttcgtctcatcaaattattttctcatcctccttcgttagcaatcgatcgctacgaatgcctgcgagtgtgcagagaggacggcgaacaattcgaaatttttgtgaaccgacttaaggcagccctccgcaaattccgtttttcggaattaaacgaagaggaattcaaatgcctggttcttcttacgtcgcttaagtcaccaagcgacgcaaaattacgccaacatatcctcgcgcgtctcacagcagagggcacaaagacgacaaaaacgtccaaattattcgacaaagtcgtcgaggacttaaatacacagctaaaaacggaggcggaagcaaaaattttggagcagccaaagcccaaaatcaacgcaattcagcatggcaaatcatcgccaaataagcaccaaaatcgcggaaacggtcgcccaaatcaaaaattcacgggcaaatcaaaggccaaaataccgccgagcaactgctatcgttgcggagaattgcattgggcccaggactgctcaaagaaggaaaatttttgtcgcaaatgtaatcgcagaggccacatcgatcggcaatgcgacaaaatccgagcatttcaccaaaataagggcacaaatttcaaaacaaatacggtgatactcccagcggcctacatcaattccgtccattcatcgaatctgcttaaagcaccgatcaatgtgaacggcacagcaattggtttcaccctggacagctgtgcggaaatcatcatcatcaatgaagatgattacaacgcaatgggccgaccgccaattcacatatgttcagaggaagcacgctttttcgacggaaagcggtgcaaattcatcggacgcgggactgccaccttcccaattcacggaattcagacaattcagccgttttatgttgccaaatcgggatcattgaatcttttgggcacaccggcaatggaagcgtttggatttctggaagaaatacggcgaatgatcagtcccgcccaaatcaatcaaatatcgtcaaatgatgcggccaaaatccaacaattcgtcgaaatattgccgcaaaaatatgagcaaatattctcagatggccttggcttctgttccaaaatgaaagccaatctgatgctcaaagaaggcgcaaatccaacgttcaagcgcgcccgtccagtgccatattcaacgctgccaataatcaatgcagaattggatcggttggagaaaatgaacgtcatcacaccagtcgagcacactgactggtcagccccaattttggtggtcaagaaagcgaacggaactgctcgtct

SEQ ID NO: 83969 - DNA, 1609 bp, Heterodera glycines
  Genomic contig location: Contig_ID=SeqID_19231; Location=303..1911; Strand=+
  SCN-specific regions: Sequence locations=1-109,131-191,213-583,605 -742,764-782,805-884,981-1015,1037-1431,1483-1505,1593-1609
atggccaaaattcttggcaacattgaaaatgatggacaaattttggtcctccgttcggactcgcaaattttccattttattttgaagtatttggcaaattcaacggcagaagagagtgccaaccaaacaaaatttgtcattaaatacagcttttgttttttggcacaatttgttgaagaattattgaaaaaagcaatgaaagtgaatgaactgaaagaattgctaaacattgaattaattggggaggcaattgaaagttttgccgacaaaaaggagcaaaaatgtgccaacaaaaagtgagtgcaatttgacaaattggacaattaattaacctacgattttgcattaattattttcttaagcacgcaaaatgggattaacaaatatcttaatgaaagtatgatggattttgcccatttagcgcatgcaataaaaattgatttcactcataatggtaattgtttcttttattaagcattaaaatttcttaatatgccctatattaagcaaaaagtatcagcctaaaaatgctttcattcatttatgaaaatgtttaaattttgtcattagcgcggtgatttatatggaaatcattgtttttcccctgctggtctttgggatgccttaaatgcatgaaaagcatgcttataagcttcgtttgaagcttctaggatgtacttctatatccaaaaaattgggctttttgtcctcctaaaagtcatggaaattttccaaaaaaaacaaatcctttttataaaagtttcccgaaattatttgaatttattcttaaaattgataaaattatgtcataactaataaaaaaaggtggaaaatttcggttttaggtcattttttcgctaaaattggggaatgaattactcatgtattaataaaaatataatttaaaaattggtaaatgttataaattaaacaaaaatacctagttatttttggttttaatttatttaaaattttttattctaaatcacaccatattagccattttttgaaagtcttggtttgaaattttgccctcaatttggaaaagttatgtgcatatttttcagtttttggtgtttattttcgacatccctaattttgaattccgtttctgattattaatcagctatctcatttaaaatgtttttctaatttgaaaatttaccgaaaatgggggagggacaattcggacacataaaaaattctttattccatcagatttacaaaaaatcgttcccgatttattatttgaaatgggaaaaatgaaagaagagaaaaattggaattatgcagattaaatcaaaaggaaatgttggaatggaaactgatcgaaattgaactgatcaatgaagaaaaaatgggaaaatgggaagcaattgaaagtgcgagaaaggaatggaaagagaattttgatcgaacagtttttaatgaaaatggaagagaaaatggaaaaatagaagagaaaatggaacagctaatggaagagttgaagcatttacaaattgagaaaggaattggacaaaacaaaaataaaaacaagcaaaaggaggaggaaaaggagggaaaagagggcaaaaaagaaaaaggaaaaggcaaagttgaaaattga

SEQ ID NO: 83970 - DNA, 848 bp, Heterodera glycines
  Genomic contig location: Contig_ID=SeqID_19232; Location=556..1403; Strand=+
  SCN-specific regions: Sequence locations=1-25,47-346,380-523,550 -617,645-700,757-848
atgagcatgtttgaacttctgcaacgtcgattcaattgtatttgtatgttgaccagagacggggtccttgaaattctccgagtggttcaccacgtaatgtgtgtacagctccggcaatttgtcaatacccccgtacgaggcccaaccgtcgctcacaattgttgcacctgcgtgaatgtgttgctgaatcagtggtaacaaagtgtcgtcgtctcgtcgttccactgtcacaataaagcattttccactgccgcgttcaactccaccaaagtaccactattgttcgcccggcaattttccacggtgatatttgttaaaacggtctcgtcaaattaaagcaattctgataataaaaaacaaaaaaaataaaaaataatttgaccaaaaatgtggatacaaacgcaactagtaccgtatttccttaacaaattctttaaattctcgaacaaattcatgacggtgcctatcgacaacgggattcctcgcactccccctccgttgcataattgtaacccgatgaacctttttatataaatttattaatttaaagggaggtgaagccgttgaagctggcacagttcgaagacgattgtgaggattggagcgccggcggaagcagggggcgaaagaagaagaaggtcctgtgctgattgatttgtttccataatttcgtttttcggctcgatttcttttatcatactttatttatattaaaattttcacattttatttttgaaattcaaaattttttatttagatttctcggctaaaaagttgatcattaaattcgtcaaaaaagcaatataaatcccgttttaaatgaaaattattaacaagcacatattaaa

SEQ ID NO: 83971 - DNA, 404 bp, Heterodera glycines
  Genomic contig location: Contig_ID=SeqID_3267; Location=17..420; Strand=-
  SCN-specific regions: Sequence locations=1-62,174-372
atgcacgaaaaactgagaaacccaattttggacactttgacgcaactgcaaaatgccattggaaaagaaaaagaagcgaggtaaaaatggaaaaaataaaatataatttaataataaaaaagcaaaaataaaattaattaaaaatatatttaataataaaaaagcaaaacaaataattaagaaggtatcaaaaaatgaatacgatacagtcgaatggcagaattgaaaacgtggaatcaagcaaaaaatgtagtaatttggtcgtgatggccaacaaaacggggagcaaaatccgagaaaacaattggaaagaaaaaaactaaccaaatgaattggaattaaattttctagaagattttggcgttggagcgcaaaaaaaaaatgtaaaaaaatatataaataaa

SEQ ID NO: 83972 - DNA, 1954 bp, Heterodera glycines
  Genomic contig location: Contig_ID=SeqID_3267; Location=1887..3840; Strand=+
  SCN-specific regions: Sequence locations=22-330,408-435,457-1827,1849- 1954
  Gene Ontology: Mol. function=metallopeptidase activity; Cellular component=extracellular; Biological process=body morphogenesis (sensu Nematoda)
atgtataaatatttcgataaacaatccttgaaattttctctttttttcttcgcatgttttatattgtgttacgactgtttttgggttgatatacggaagcaaggtaattaaaaaataaaaatgaaagttctaaaatactgaaaaataatttattaagatttaaaaagcctaacggagcctaaatcatattttatcaatcacttcggatacaactttcaaaaaggtatgaataattaataaatgtagtttataaattaaatcttattgaaagcaaaatgaatttaaggtaaaatttacgaaaaatttcgaaaaaatgaaattgaaaaactaaagcaaaagaaaaagcgaaaagaaatggacagtgaggaagtgaagaagcataatgaggaaaaggagaaggtgaagaaactgatggcagaatataagcgaaaggtgaacaaacaaatggaaaagcatgtcgaggaaatggagaaggacgaaaagctaaaggaagtgctgagggaaattgaagaagcgcaagcgaaacacccgggggagaagagaaaagcggcgaaatccatcacagagataaatgagaagcattgggacgaattataccagggggacattgagttgagcgtggaacaggcacagtatttgctggatactgtaacaaaacccgaaaacagagcgttgatgagagcgaagcgaggggcagccagcaatgctagaaaatttcccaatcacaaatggcctattcttgtcccattctcttttgacggctcaatttgtaagtttcaattaagagctgaatcaacatttaaatacctccgtgtttcctcgattattggcccctccattagaacccctactcccacttccattaaagccctcagaggggttgaaaagagaaccttcgggactcgaataaaagaaaatgtactagattatagaaataaataaacgatcaattttttaagccagcgaaatgaaagcgcatatatatgaagctgtaaaattatggaacgataacacatgcttgaatattgttgaggatgacgaagtttctcctagaatccaattcacaaatattaagggcatgggatgcctttcaaaagttggaatgcaatcctcggatacataccaagaagttaaacttgaatacccaaattgttaccaagtaattagtaaatcatttacaacaataatctttaatattttcaaaagcttggaacaattgcgcatgaaattggacacgctttgggattttttcatgagcatgagagatatgatagggattcctttgttacgttttacgctgataatgttgaccccaaaaattattacgctttcgaaaaagaaacgattgagatgacagacaattatcaagttccttatgaccttggctcagtgatgcactataacgcaagtaagcacaaatttaaaaaaacatgttttatgccgagacctattttgcagaaacattctcaatcaatggtgagtatacattggtgcctcgagtgggtgcttcgtatataaacacaattggacaagaatatggtcccagcctcagtgattatattgttataaacaaacattactgtggattagagtttctcccggatggatcaaccataaacacaggcatttacaaatttgtttattgtacattgtttttgtaattaagaagcgtgtcatgttacaatgaactgtgacaatgatgggttccagaacccggacacttgtacaacatgcatttgcccacagggttatatcggagcgaaatgccaagatgttgacattggtggttatgcccctgccagcattgcaaatacttgtgaagggaatattttatttgcaacatcaaattggcaatatgtaagcatatattagggtgcaccatttttacttttcactgatttccatgtcatggtcgctaaaagctttaatttggcgaacccaaagaatcaatgaa

SEQ ID NO: 83973 - DNA, 653 bp, Heterodera glycines
  Genomic contig location: Contig_ID=SeqID_3268; Location=80..732; Strand=+
  SCN-specific regions: Sequence locations=1-68,93-301,333-388,410 -589,616-653
atgggtgcatttggggaaacacagagattagaacagcagcaaacagaggcaccactggagtacggtatgttcagcagagaagacaacattttgttttattaacctgcctctgatgtttttagattatgttgccgctctgatctcggttcatccggaaagcttaaaatcacagcaaaaaatggatatgcgttgatcagtctttactcctttagtgatatacagcgctttgatatacgcttcctgcagtattaacctaaaaactgttgttgtcccgagtactgtggctacttttcatcttgtaatatgtatatattttggcatttttataaatcacgaaaacaagaaagtctgaaaaacattgaaaaataacatctaaataggaaggaccccacttaaaattttatgcattgtaaaatgccagttaaaaacctaaatatttcgcgaaattaccttatattatcgcggacatcacctgtgcgaagagcagataatgcttgaattttctcaactcctttctcaatcgtttatggatgaattattaattcaaaatctatcaattaaataatttcagaaattaattaataaatggcctctgtgtgaattctctgatgattatcgtttaattattaggggcagcagactttttttttgaa

SEQ ID NO: 83974 - DNA, 506 bp, Heterodera glycines
  Genomic contig location: Contig_ID=SeqID_3268; Location=758..1263; Strand=-
  SCN-specific regions: Sequence locations=1-11,34-110,132-377,399 -433,468-506
atgaagtgcttacgcctgtaattctaacactttcttattttgtatatttctctaaagtaacaacgattttttctcagctgggatccaaaagtaacaattttggtgaaaacaattaataaaatcaaaaattttgagaattttcccggcgtcgcctattgcaatcgcttgtaattcttttttgcagaaaaatttgcctcataacgaaaatttaaaattagatactgttaaattaacgaaaaaaccgaattctgccgatcattgtccaagccacgaaaagtccaaagtagcaaaaacaccactaaatgtccaaaattctaaaaaagatagaatgatacaacaattttttattctgaataacttcaataattttaagtttaaaaaagacaaaaaattaataagtcgtaattttttttagttacaaattttttagatttttgcaaattattcaaattttcaggcaattagaggacctagtaaagtcgaactataccaaaaaaataatttag

SEQ ID NO: 83975 - DNA, 301 bp, Heterodera glycines
  Genomic contig location: Contig_ID=SeqID_3269; Location=764..1064; Strand=-
  SCN-specific regions: Sequence locations=1-104,143-272,294-301
atggccatcaactttggcagtggcattttgccaaatccaaagtgtgaaatttgcgagacagaaataaagccaacggagaagctgatagttgagaagcatacgagtaaaaaataataaatttaaaattatttaaaataaatttccatattttagtgcacatttcgtgctttaaatgtgccttttgtgatgttaaactttcgatcggtgcatgtgcaatggaaccgaatttgttggagcgatttgggcctttgttcttctgtgctgatcacatgtgaaaaaataataatttatgccaaataaa

SEQ ID NO: 83976 - DNA, 104 bp, Heterodera glycines
  Genomic contig location: Contig_ID=SeqID_3269; Location=4423..4526; Strand=-
  SCN-specific regions: Sequence locations=1-104
aggcgagtcggctcggattttcagcgattggctggacgacctattgaaaatggacaaacggacgaaggaatcaatcattttatttgatgtgttttcaaaataaa

SEQ ID NO: 83977 - DNA, 284 bp, Heterodera glycines
  Genomic contig location: Contig_ID=SeqID_19234; Location=830..1113; Strand=+
  SCN-specific regions: Sequence locations=1-143,183-284
atgacaaattccaacctgggtgagcacacatttcagataagcttcctatcattatttcttagaaacaactaataatctgttgaacagttatttcaaataaattcgaatatattagcttattatgcatcttcagtgtgcattctaaaataaaatcattttttgttctaattttatgatttatttgttttctgttgactaaatagtcagttcttatagcaaatattaattttagcttcaaatgagcattctgccttcaatttcgaagggaagtgaatttttttata

SEQ ID NO: 83978 - DNA, 298 bp, Heterodera glycines
  Genomic contig location: Contig_ID=SeqID_19234; Location=230..527; Strand=-
  SCN-specific regions: Sequence locations=1-111,134-298
aacaaaaagcggaaaatgtccgtgagcggaaaaaagggggaaagatggaaaaattaaaaatctgttctcattcgcttaactttttaatccgttgaacatcttctctctccgattaaaaattatttattaatttcgaattttcgcaccgtaataaatatttgtcaccgggacattgtttgaaggttacggtaggggaaaatttggtactaaaaatcgtttcaccgggaaacgggaattggtcctccggggacttttgaaaacaaaatctgtcaaggggttggcccaccggaaattaaaa

SEQ ID NO: 83979 - DNA, 1929 bp, Heterodera glycines
  Genomic contig location: Contig_ID=SeqID_19235; Location=193..2121; Strand=-
  SCN-specific regions: Sequence locations=1-338,361-835,857-978,1000 -1085,1107-1315,1351-1565,1609-1816,1839-1867,1891-1929
atgagatttttcagccgtgctaatgtttttaccaagcgtgaaattgctaagcaatacgtcagtgcattgaggcgtcaagacgcatcgatccaacaaatgcgcatcatttatcaggaaaaacatcgcaggacattgcatcaaatcatggagctcaggggaaaatgtgtgattcttcgctcaaaaacaaaaacaaatccattttttgttcagcgcatcttacgaaattgaacccgaacagggattctcagaagataaaacggattttggctatgcgacaataccttttgaaacggcataattgggatcgcattttggagagaaaattggcggatcagactgcaatggctgctgcgtctttccggcacaaaaaggttggcagatttagccgtatgaaattttattgcataaaagcacggaagagtacataaacgagattaacataatgctacgtaaaccgatttgtttttgacacaatcgattttgtatggtacgaataataataatatactatactattgcagtggatggaacaattggcttccccgccggacgatgagcaaagagacgttgaaatggccgttgctgaaatggtcaatttggtcgacgagtgcgcaaactcttcgcgcaatttaaacatcgaagaaatgcacactgcacgaagaaataatttcatgagttcggacgcattttgcccgcctttgccgaaatccgttgtggacattttggagcagttgcgaaagcattccgacgaagcaggcccactcagaaaaagtacttctcgggccatcgttcagcagaacaacaatttgactgatccgcatggctatctgtcaaattgtggcaccttttccatgccgaaaccatcgacatcgaaagcactcgtcgacaacaactcagtcgaagctaaaactgttgtacccgtttccattgatgatgtgagtttatggtttccacaaattgggaaatttgccgaaatcgaatttttaattttcatgaaattaagcttattgggtagttgaaggaattaccaatacaataccaaaaactcaatagaaaatgcggcgcaaaaattttgaattttccgaagggtcccccttttgtgtttactttttgataaaatttaaaagtgactactttacgtatagcgccgaaaatgcttttttcgaattttgcgctgtgtggagggttttctttgttgtatcccaggggcagcgctcccccctccgaatcagttctccaaaatttttctaaaaacttgtattttttagttttacatcttccttggcatttttcagcaagaaatctaaaacaccggttttaaaaatcattatttaaaatcatttaaaatatctttctaggatctcaaccctgatctgtttctgcgcatctcttatccaacattgatggacggtcaaaatcagcagttttctccgcaaaattcgaaagttcggcggtggcgtaaggtggacgaaaaagaggacgcttcgcaaacttgcgcacgaattaaccggccatgggacggcacgcgacacaaagggaccaaatttgctgggggagacttggagaacaacaacaacacaaacagcaccaacatctccaacaacaacacatccggaaaatacccgttgaaaatgcgaacaaacgcggggattatccacatgcttcaccctcagacggggaaaaggtcaagacgggagaacaacggccagaacaacgtgcatgccgacaacaacatgagttacggcacctaccagcagtatttgtccttgcaacgtctcattccgggtccccggtattcattggcgaaaacaatttcgaggacttgatttttcactttgttgatttcagttattgcttttgtatcccgttatgcataaattttacttattgatgcttgtttaaaagagagactaccaagttagcaataaa

SEQ ID NO: 83980 - DNA, 432 bp, Heterodera glycines
  Genomic contig location: Contig_ID=SeqID_19236; Location=1065..1496; Strand=-
  SCN-specific regions: Sequence locations=1-432
atggagaatgcgcatttcctaaaaatttcgagtggttttcacattgtcatatgtttctcatctatgtgtgttggtaaattacgcagcctcatatttgaatacccagctgaactcggacggcacttggctgtccgccttctttgtggagttccggcgacgcttcgtctctttgcttggcacttcgttcagcgcgttcagtccccacttggcgttcagtctgatgttcatggacagtgccagcatcatcggctgctccgtgcagcagcggcaggacgaacagcaggccgaaaatggtgagcgtcaaccgggagcaggacaaaatgtcgccgccgtaacgtcgccgggacataacgtcgccgcaaaaaagaattttcaaaattttaagaaaattgaaaagtattttagctttttgaaaatctaagtgttaataaa

SEQ ID NO: 83981 - DNA, 214 bp, Heterodera glycines
  Genomic contig location: Contig_ID=SeqID_19236; Location=340..553; Strand=+
  SCN-specific regions: Sequence locations=1-214
agtggccagtctgatcggacagccccaaattgagaacgttttggcatttacgtcgagggtaattttgtttaaaaacaattttttttccaatatttgtgtttttcctcgacgtttttaggcacggagcggcgcctgtacgcaaccgacgccgaacccgctcagtgtgctcgagttcatccacaacggagtgcacgcctgggttggaggggacatg

SEQ ID NO: 83982 - DNA, 1350 bp, Heterodera glycines
  Genomic contig location: Contig_ID=SeqID_19237; Location=1..1350; Strand=+
  SCN-specific regions: Sequence locations=1-91,117-229,251-256,278 -540,562-1095,1117-1213,1235-1350
aaaaacttttaggggatacctgagaaaatgccaaaaaatgtcgtgagggtgtggggtttcacttcttggcttttcattcgtttttatgggcttaaatttattatattattatttttgcgacagatttgggaacagtggcgactgctccaccaaaatcggcagcagcgcgagacgcaatttccgcccgactcgcaaattgtgccggtcagtcattgccaacaaaatgattaattaattgcattaattttgatcattttgtgtttgcagtgcgctggctcccagaattacctgctcagtgcgacaatgttcccttttcaagaccccgtcgtgctcaaccgaggcatgtccaataattgtattcaatttatcacaattttgtgtttaattctttttatgcctcagctcgcccccccaccgccgtttcaaattttttcatagaaaattcgaagaaaaaaaaatttcaaaatttttccagcgattttttcaaaggggtgcaccgttttctaaatgttgttacaaacaagattattattttttttgcaaatatttctcattttgcccatttcgtcagtctgtcaatcacttaatttgctttttgtcccctgttccagctgggttgagcaactcctacacggacagtctgtacacttacgcgccgaggcccacctgccgtgccgcaggcgactgtcgttcgcggtaggaaacattcattccggttgaactttacatttgcagcgccccctcccctccaatattcaaaaaatgtaattttttaacaagccaaacacgaaatccgccattttcaatcaaatggcatttacatgagacatgcgtgaactttttaaatgatcatccgaaaaagtgaattaatgaatgccattgatcggaaaataataatgaattgaatttgtattaaaatttaccagaaaactttttttttgaaaaaaccacgacaccctcttcaatttcactctcttcctcagttacttgttctgtgacacgaccagcggccgtccgttgtgcacttcccggattaaacccggcggcaattgtgcctcatttgtgcaaaacggtaataataataattaattgtggctattaattttagtaaatttcgcacttgcaatgcaaatccctccccacaatatctcttccaaactccgatttttgaacgtttttactattttgtttttaccttttcagggataaattcaaattaaaaatcctcaattttttccaaattctatgataaatgtgctttacattacacctgctttttctgcagctgaccagccctgtttcgcctccacttgtgtgaatgggttttgccaagcggcgggcggtgccgcc

SEQ ID NO: 83983 - DNA, 1433 bp, Heterodera glycines
  Genomic contig location: Contig_ID=SeqID_19238; Location=235..1667; Strand=+
  SCN-specific regions: Sequence locations=1-612,634-683,718-1433
  Gene Ontology: Cellular component=chromatin; Biological process =negative regulation of transcription
atgtgcgatcgactagcaaagatcaaaaggcgcactgaagagcttgccgaggagtaccacgtggagttggcgattcgggagaggcaaaagaaattgtttgaggaaaagggcgactcggtagaggcgcagctgatgaacgccgttgacgtgcacttgggactgcgggacctgaagaaaccgttgcaaaatccggagaatttctaccagatcatgttgcaggaaatgaagaatctgctggatggacaagtcgacgcctccaaattcgaggacacattgaggtgaggtcttttcttctgtagatgaacatcagcggaaacacatttgccaattcattgtcagaagcatgttcgacaccagagcatacgttttgttcacaatggacaaacttgtcaacacgttggttcgtcagctgcaaaactttgtcggcgactcggccagcggacaatgtgtcgaacagttcgagaaatatttcgaccagcgagtcaatgggtgcgaaagtgggcaacccgctgctcgtgtggacaaagactacagcgaagcgatggaaaaggtccgatagaccagggacctttggaactcgtccgcagtttcaggtgttgctcaatcagcactgcttcaaaatgttctttttcaatcgcgaccatccggtggtgaccatcgaactgattgacacggacgagacggaaagtgaggaggaggaagaggaagaagagagtgccaatgtggtggcactgcacaattggaagcattttctcaaggacgaggcaaaccatttgaatcggggctcaaaacactcgcatttgaagggttgcgacttggacgacgactcattgcctagaaaaagggaatggaagagcgaacagccaaaattcttggccagaaatgtgcgctatcgtcgtgccttggccaaattcctccagtgtaatttcgctagttcgtccgtggcaggccaaagtcccgccaaaaacaacagtgaagagccgaccaccaacaaaatgttgcatttctatgtcagcaatggcttcattctgattcctcaactgcgcaacgtgtctgatactgaaatgctttctgatacattaatccgaaagtgcagaaatagaaaggtggacttattggaaatatgaaatttaatgttatttcgttttttctttgtttagtcatttcggaagaaatccattgcaaatacaaagaaattcaacatttggctagacaaatttcacaaggatgacactgagcttagcgtatgttaaagtctcagatctggcgttctatcccactttaggccagatggatgaccaccggttgtacttctcttccttgtcaacaccatgaattcaaatttctccgtttcaatatttattcttcaaaaagtgtagacgaataagaagaatgtaaatcggatgctactgatcaaaaactttttaataaca

SEQ ID NO: 83984 - DNA, 519 bp, Heterodera glycines
  Genomic contig location: Contig_ID=SeqID_19239; Location=1026..1544; Strand=-
  SCN-specific regions: Sequence locations=1-356,380-519
atggctgagctggacaagcttggccaaagtgatggtgaagacggaggagttggtgttggagagaatagtggtgaagcgctcgacaaacgatcattgctactcagcgaaccggtgcagatcactgtgacctgtttaactccacctaccggggcgggccgaccgcgcttctacccgtatcagcattggggctacaatgaggcgcatcgcataaggatcagagattgggaagacaattattgtatgttccacgcgcttattggtgctcgagcgtaccacgaccctgtgctgttcaacgagtggatgttagctgatcaacagccacaacagcagaatttggcacgactgatgctgatgcaggatttttgtgaaaccaaagaagctttccgccgtcttatcatcaatcgagagttgatgtgttcctcagtgcaccgcctaatgcatgcagctggcgtacccgaaggccaacacgcatatggcatggaccatttgcaaaccgttcaacactattgggttcagtga

SEQ ID NO: 83985 - DNA, 857 bp, Heterodera glycines
  Genomic contig location: Contig_ID=SeqID_19239; Location=1611..2467; Strand=-
  SCN-specific regions: Sequence locations=1-75,161-260,282-567,589 -750,772-857
gagtccaaaggccatttcgaaggccaggatttcgattggataatcatgtccatgtgcgcggacaacaaagatgtcgaaaaagaggaggaagagaaggccaagaaaaaggtagagaaagaggatggagaactgaaggaagagtcggaggatgacgatggagatgaaattcagctggttggggagacgaaatcgaccagcaccgaggccgtgaaaaaggcaaaaaagaattgacaagagtgctgagtaatgatgaacctatcttaaatgatattgatgttgcatttagcatagaaaaaacaattgttaaagaaatgtttgcacttgtaacagcctgacaaaaaaaaggcatagagaaattgccaaattatttgaaacactctgaaaaaaaaaatttgtttttcaccttaaataacagcacaatgaaaaggcgctgggactttcgttcaatgagcttttttgagcagcccagcccacctgaacagtcgtcggctttgtcaacaccacaacagcaactaacagatgacgataatgatgatgaacaccagcagggcgagggacgcgggactagagcggaaggcggcagccaatcgaccggaaacgacctttttcaacaggtctcacactcagtgcacagactggagcgcttttcggtgtcacgacacatcacagagtttgtgctgaatgccaacgttgaggaaccggacgaagtcttgcgcggtgcattccaaatccttatggaacgggcaatccaaaatgcagagcagcaaagtggccggaaagttctcaaaattggtgttacgctacagggaagaggtttgattggtcggctggtagcccttttattccttacctattaa

SEQ ID NO: 83986 - DNA, 944 bp, Heterodera glycines
  Genomic contig location: Contig_ID=SeqID_19240; Location=742..1685; Strand=-
  SCN-specific regions: Sequence locations=1-2,24-42,70-86,112-178,209 -518,548-576,598-605,627-944
atgccatcatcctcctccgcctcatcatcggcggcatcttcatcagcaacgacagcaacaacaacagcttcggtgttcttcgataccatcaacaacaacaacaggaagcagttggcacaacaatggatacgggtaaggacgagggaatggcggcggcgcggcgtggcaaatcagcgacaaatttttaaattcaaaaaaatatatataacaatgagaaaaagcgcttgaaaattttatttggcttgggacatacctacacatcaactgaactttttttattcagttgtcatccaacggttcgaagcatcgggaggatgagttggtacaagcgttgtggacactgcgcgaccagctcatcgagggcaccgtcggtgttgcgaggcatgccgaactgcccccgggggagccgccgacgaccacggcagcagcagccgcggtcccgagcagtaccagcggttcaaacaaactgaatctgatcatttataaataattgcctaattgatcttcaaaagttacaccaaacgcacacattttattttgtcacacataaaaatttgtccatgcgttttttttaaatttcattttgtttatttccttaattatggatttatgtatgtgttttgctttattcgtttttttaaaacgtggttcatcagtaaaccctgcatgaatcatctttttttttttgcaaatttccttgttttataaatgggtgagaagccgatgcttacaattagtttggcatccatatccccttattcctatttaggctagcttcctaaaatgaaaatggggatgtagtattgtataaggtgcttcaaactcgaactatagagcccggcattttgaagacggtttttgtctgattagggctgcacccggacaggatttccgggttaaaatcttgttattccggacccacggagtcgggtgcatttaataaa

SEQ ID NO: 83987 - DNA, 243 bp, Heterodera glycines; identical to SEQ ID NO: 71522
  Genomic contig location: Contig_ID=SeqID_19242; Location=372..614; Strand=+
  SCN-specific regions: Sequence locations=1-113,143-200

SEQ ID NO: 83988 - DNA, 191 bp, Heterodera glycines
  Genomic contig location: Contig_ID=SeqID_19243; Location=340..530; Strand=-
  SCN-specific regions: Sequence locations=1-191
atggtgttgacctccttgaaattgttggtccaatttttcggtgcattatcaattctgcaatgcaatcgcttgggttggccatcttttcgtggagtgtgcaaccatttggacaatgcttggcccgcagttgcatttggcccatcctcagcaattgcgtcggggaacagattaccagaatgtattgaattcag

SEQ ID NO: 83989 - DNA, 806 bp, Heterodera glycines
  Genomic contig location: Contig_ID=SeqID_19244; Location=17..822; Strand=+
  SCN-specific regions: Sequence locations=1-28,50-60,82-91,117-217,267- 412,467-656,678-681,703-806
atggtttataaactgccaaaatcctgctttaaaccatcaaaaaatgtaagaaatttttttaaatttaacatatgaaaaagttagcagatttttgaacatatttttatttaattatttggcaaattcaaaataattttaattgttatttgaatataacaaaatttgccaatttttattattgtcttgtctaagttctaatattttattgttcccaatgtttaaatatatttattatattttaaattgtcaaataattttttaatttactttttcacttctttttgacaatcgatttacaatttctgtgtcaattcgttgaagtcatttgataattgggatgattcattatcattcgctcgtttatttctttagttttaagttttcttcataaaacaatcaactaaatgtgaacataaattcttaataattatttttatcattttttagacatttaaaaataattaatgcctttgacaaaatgaaagaagatttgaaaaatcagcagcaggtaaatacaaaaagattttcagaatctctcctttcttccgaaattttccttgcaaattaatatttaaatttcacaaaccttcattttctctaagacttttatcccccggggtattcgggatacctgttaattgtcatcaaatttattttttccaatctcaatttcccctcgctttgacagatacttcaaatcaatccaaaaaatcggtggaacccggaggattgtcacaatgagctgttccttttcaagcccaattttttgagggttgtttaccgaggaacaaaaaaatgtaaaatta

SEQ ID NO: 83990 - DNA, 222 bp, Heterodera glycines
  Genomic contig location: Contig_ID=SeqID_19245; Location=807..1028; Strand=-
  SCN-specific regions: Sequence locations=1-149,201-222
atgatttatgtagggatacgattgacaaaactccaaaaccgagcgcatgaggtaaaaaatagggtaaaaaatactgcaaaagcaaaaaggggtaagtaagtaaaagatgtaagtgataagtagaaaaatttaaagggatgagcacaaagttttatttttgtaattaattatttaattgtaatatgatttaaaattataaagttttaggtttatatgatttaa

SEQ ID NO: 83991 - DNA, 1324 bp, Heterodera glycines
  Genomic contig location: Contig_ID=SeqID_3270; Location=494..1817; Strand=+
  SCN-specific regions: Sequence locations=1-63,86-219,241-528,588 -1156,1178-1324
atgatgtttggatggaaattttgccctgttttgaccatgctcaactcggcctcaaattggcactgtttttgccccgttttgatttgctggtggacaaacatttcaatggtaaacgcgaattttttcaaatttcgataagttttttgtttttactttttttgtaaaagtgattgattttttggttacttaaactaatagtgttttaatggaatttagtagccccaaacctttcttggtttcaaaaaatggctgaaaattattattttcccaaaattcataattctttttgatttttttgttagagtgtcgggtttttttagggctttttgcttatgtaatttttggaatttgaaatgcataaaaacggtaacaccccaaaaaattgaaccttatgaatttaaaattggtctctaaaatcgcagaattttgaaaagtttcggtggcaaaatcataaattatttaagaaaaaatcaattacaattagctgaaaccttgctggattttaaattatcacgtaattatagaaactttaatttttagaaagtttttcattttaaaagataatttagcaattttttagtggaaaaccccataaagccagaaagacaaatatatttttactttttttcatttaaaagtaccaaatttttttgttttttgttactcatttttaaaaatttttttggattttaggagtttttccctttcttagcattgctcaacttggcccaaattagcactgctttcgatcggtttcgatgcgttggtggacaaatatttcaatggcaaaagcggattgctgcgcaagtttttttgcactgctttcgctcggttttgatgcgctggtggacaacatttcaatggcaaaagcggattgctgcgcaagtttttttttcacaaattaaccggtcaaatattttttatgctctaaattttttgattgcattcggcaattaaaaattgaaattttcaaaaatttgtattttcaaacctatgaaaatcaattattgtgaatttttgaaatctcaacattgttgtggtgatgctgtttccatcccgcaaattttttgtgagattaaaaaaattctctcaggaaactgctgtatttggccgattaaaatttttaaaattcatcgatttgaccatgatttgaataaaataagaaaaaattttcagatgcacatatatattaaattatggcaaagtgtacactaagtaaatagttttagtaacccaaatctgaggttacttaggaaataagtttcatacactttggcacgcataagctccacaatagtttttaagaagcctttactcttgatta

SEQ ID NO: 83992 - DNA, 4320 bp, Heterodera glycines
  Genomic contig location: Contig_ID=SeqID_3270; Location=2844..7163; Strand=+
  SCN-specific regions: Sequence locations=1-254,276-1313,1335 -1776,1798-2828,2851-3183,3205-3908,3930-4235,4257-4320
atgccttcaaaacaaaagaatttgagaaagaagatgaaagatgtgtatcggcgacaggcagagcgatctgtcagtcgggataactcacccgtctcagacgggagtgcagatgggaatggagaggcatcggcatctctccgaggtaccaccaccccaagcttaagtgctttacaaataagcacgccggcgtcttccattggaagtaaaaaaagaggcaggccctcgaaagccggagcgaagccaatcttggctacgcaagaaagggtgtctctcattgacacacctcgaactgcggtcactcaaagtgaccagggttcgccgtgcaaaaaaaggggaaaggtcgccgagtgtggccaacccatgttttccaatgaagctattgctttgacgcctgtttcgactcaaagtcgtggagggcgtcctgccaaaaaaattggaggcccaggccgaggcagactcactgattccatgagcaaaagctctgaaatggatatcaatcttgaaaatgccccaattccggcaccctcgcacattgtgtctgaaaaaattgacttcagcactgtgccaattaatttcgccacatcgcgaaatatggcctgtaaaatttggagatgggcagcaattggcctttatgagcgtgatggcgaaacagcacttggcccacgctctggcccaagattaattgagacctgttggaacaggccaaatgaatggctaaatgacagctttattgttgcctatttagcttacattgcaagcatttcacaacgaaaaacagtagttgtggattctttggcatcgagaactgatgtttctcgattttccaacgtgaagaattacactttcggctatgatccgaatgctgttcctgaagttgtgcttatgccgcttcacttcccaaatcattggactctcatcgtctacgatgttgcacatggtgcatacttccttgactcgctgcatatgagcagcttgagtgatgagagaatggcactcatccagtcaataattgctgagatagtgcccgggaatgcgtcattcgctgttgaatacgtgcagcaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggtcataatgccaatggaagtggatgattcagcagtgcttccttcctcggaagatactgctgttcttgcgcaagcaccagtgatcggcgaaaatcaagctgacacccacggtgttgttgcggacacaattgtccagcaagaaccaattgcgcaggctgatgatgtaattttcatcagacctaagacgccaccaaggcgatcaatgcgcgttcaaaaaaggctttcagcttctgttagccgttcgccttcaccggcgccgaaacgccccccgccagcaaattcgatgggagtggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaccatttgctgccggaagggaagagttgtgctgccaatgcttaacccgcatcctgatgagctcaaacagctgattgtggggaataagcaatcccgtgaagggaaagaatttgtgcgacacatgtcgcgttataacaacctgttccaatttgcgagcgtttccactggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgtatcatcctgctgcgcaggcatataagcaggcgcgtgagcagctcactgagcttctccaacaacaaactccggaagagcttcgcttctttcgcatgactttgttgaatgagcgcagggctccagctggtctgaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgactcggaagccgagtcagataatgagtcgtgcgagactcagtcaattgcatcatctgatgctgggtcagtcgcaaattcagatgctgaatctgtagcatctgtttcatcgcagcaccggcggattgacaaatccaaacaatttatctccctgcgagattattgcaagtattatctcgcaataagggatgaaaatgtggagttgcaataccaccacatcctttcatgtggtggaggacttggtcagcgctggatccttgaccaggctgcaaaaattgattggcaaattgcaacatttttgcgtagacctgacatggacctgcggatcagcactccaaaaaatctgctgcagtatttggtcaaccaatacaacaggcagcaggcacggcaaaaccccaatgcccaacagaaaactgttgatgacattggcagtgttgttcggctttccgaacacaacgtaaattctctccaatattggaagaaaatgtatgaggattgcaacaccgtttttgcacggtgtcatgacgcgaaaaaggcgcgtctcttcatcacattcacgaacaacagggaatggcctgagttcaaagagaatatatataaaaacggtcaagtatttactgaccgttttgacatgtggatgcgtgtttggaccagcaaaatcgctgagttccgagaagaactttatgagaaaaagttctttggaacaatccttggttacggtgaatccatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatacatatgcaactgcacagatgcagtgatagttggtgtggtcctagcgacccaatttacgggcggtgcaagaaggggttcccagccccttactcaaaatgtacgattttgcgcccggacaggcccgcaatgtatttccggccttcaccaactgatggtggtgcccaattagaggtaaacggcctgatatacgacaactcacatgtcgtgccgtataatccttatattctgctgcgttaccgagtacaccataatgtactgtttgcatatggtaacaaagcaaatattaaatacgcactcaagtacccttttaaagggccaggacattgttatgtcgagtgcaaacaagagtccggcaataaaatcggaattgatgagccggctcaatatgccaagatgaacttccgtggtgcaacggaagcatatgccattgttcattcactgccatttgccaaactttcacatcaggttgtcaaacttagcatccatatgcctaatcaacaaccgattgtgtacagggcttttcagctggtgagcaaagctcaacaaatccagcaaggcaaactgccagagacgcaatgttctgcctattggaaacaatggcaaaatgaatggaagcatgatccgaagctcaaggacatgctttttgaaaaagtccctgagcattttatatgggcgaaggacaaatggaacaaaaggaaatataacctaacaaagagaccaccgatcggtcgaattgtccctgttccacccaaggatccggaaaggttcgcgctctattcacttatgcgccactttcccggtgaccctgaccatcttaaaatg

SEQ ID NO: 83993 - DNA, 819 bp, Heterodera glycines
  Genomic contig location: Contig_ID=SeqID_19248; Location=427..1245; Strand=-
  SCN-specific regions: Sequence locations=1-819
atgggcgactcgtacactgccaaatacgactttcgcaatccgttgtgctatcacgtccgtttttcatttttcccctttttgaccaattttagttcagaaaaggtgcatttgcccgccacagttcgatccccaatttgtgcttccgcccgctcccggtttcaacactcggctgccaatgaaatgtgacaaacgtaattctgatgagtaaaatttttgactcgttttttactgggcgaaaaatattaacataattaacttaacgatttattagttgctttccattcttcctttcaggagaactccaagtagtttttgctgccactccgtccaatttcgtaaacttgggtggtgccgcttatctgttctgttgtgtcaacttggaccctcgtacatttattcccaaagatggggtcgtttttgtccaaaatgatacaatccaacaccaaccgaccagcacaccatacgaaagtttctcacatgacatcgacacttacttttcggtaagaaatatgtgttttccttttagtttaaacgttttcttttttttcaaaggtgccgacttgttgggtgcttggcctaaacaacgcacaacttagggattccggctcttacaaatgcattgttcagcccacaaatgctcgatatcgcgttatcaatgcgaccatggaatttagcgtcaagggtatgttgatacaaaaaaagagagaattcaaaaaatactggcaattcattgctttattatagctctgtcagttaaccatcacaatagaagggtgcctcgatccgctcaaggaaaacgccgtaggctgttcaatgatt

SEQ ID NO: 83994 - DNA, 750 bp, Heterodera glycines
  Genomic contig location: Contig_ID=SeqID_19252; Location=338..1087; Strand=+
  SCN-specific regions: Sequence locations=1-237,259-624,646-690,712-750
atggttgagaatatggccataaatttgttcaattcattgaaattggagcacataaaaagcgaagaggaaaaaaccaatgaaaatattttggaaaatgaaaggaaaattgccgaaatgaaacggtggcgaagtgcggaaaaagcaatgaaagagcggcttaaagtgttggtgaatgatgcgagcaaaaagtgccaaaaaatgcggaaaaggttggaccgatttttaaataaaattggcataaaatttgataaaatgtttgggaaaaacaaaaaaaatgaatttgacggggaagaaaatgacagcagaagagaggactttgtgggatgcatttactattatttgtactcattttcattgaatttgattagaaacattgggacaaaaaaggcaaatgccgccgataattgcgataattatgatacgaaacaatgccaaaatggggaaaaagatacggaaatggaaataaaaaatttgagaaaaatatacgaaaatttgcgtgaaaaaatgtggcaacaaattaaaattgtttatgcaaaggatgatttgaaaaagatgaatgatcagcttaacggtgaccagaatgccgatgatgatgatgaatttaaaaaatgtgcaaatattgttgatgaagacggagaagagccaatatttaatgaaggtgactcaattaaggaataattagcgaataattactttatggttaatgtctgttgtattggcaatagaataaccatatgatttatgtaaaaa

SEQ ID NO: 83995 - DNA, 76 bp, Heterodera glycines; identical to SEQ ID NO: 53797
  Genomic contig location: Contig_ID=SeqID_19254; Location=262..337; Strand=+
  SCN-specific regions: Sequence locations=1-76

SEQ ID NO: 83996 - DNA, 884 bp, Heterodera glycines
  Genomic contig location: Contig_ID=SeqID_19254; Location=156..1039; Strand=-
  SCN-specific regions: Sequence locations=1-638,665-781,810-884
ataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttgttttcggggcattccccccgaaccgattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaat

SEQ ID NO: 83997 - DNA, 249 bp, Heterodera glycines
  Genomic contig location: Contig_ID=SeqID_19254; Location=1038..1286; Strand=+
  SCN-specific regions: Sequence locations=1-1,23-108,130-154,182-249
attaaaaatttttagatttttattcatctccctttttgatagtgaaagcatctgagtgcctaaaataacttgtaaataaaattggtgcgtttcagagcagtttgtgaaaaaatatttatgaattaattttgctaaaaaaataaaatagtgaagcttaaaaattaataaaaaattttaaattcagaattactggagttagcatcatagcgaaggttttccttgtctttttgatgccctcgcaaaatctgg

SEQ ID NO: 83998 - DNA, 96 bp, Heterodera glycines
  Genomic contig location: Contig_ID=SeqID_19255; Location=829..924; Strand=+
  SCN-specific regions: Sequence locations=1-6,28-96
ctttcaaactatctttaatctaaaaaatacgaaattctagtgcgttaataactgaacagtgaattccgactgaaccagcactacgcttatatagat

SEQ ID NO: 83999 - DNA, 78 bp, Heterodera glycines
  Genomic contig location: Contig_ID=SeqID_19255; Location=2002..2079; Strand=+
  SCN-specific regions: Sequence locations=1-78
atgggtgctatttttgagaacattgctttgcatgactttgtcgtgaaagaagtgataaacagtttcccggacaaaaag

SEQ ID NO: 84000 - DNA, 935 bp, Heterodera glycines
  Genomic contig location: Contig_ID=SeqID_19258; Location=373..1307; Strand=-
  SCN-specific regions: Sequence locations=1-55,77-233,256-675,698 -723,754-935
atgggtcgaaatggatgccggattcgtgatcatcgaccccgaaaaactataaatcggtatttttttattcgaaaaaggaaaaaaaaatttatggggcgtaaaccatataagggcccagttccctaattctttccgttctttatttagtcttctttattaaacgaactcgtcatgtacatttcataggcttttcgttgattaaaaattttttggcgctatattaaaagtgggtctttttgaaaattttttaaaaaagtcatgaaaatacatttccgggggttttcggggccgctgatcacgaatatgacattcatttcgaccaatttcgaaccccggacccggatttatgatcagtaaattttcattgtaatttcaaatctctagacatatgtggtactcagaacttatgagacacatttatgataataacattatataggacacactatcctattttcctaatactgccccgatatgctggaaatggatagtgtgtctccttaatattgaattacataaatgtgtcttggcggcgcgaattcaatgttgaaaagtgaaaatttacgattttcaactttttgttcaaatccgggtccggggttcgaaattggtcgaaatgaatgtcatattcgtgatcagcggccccgaaaacccccggaaatgtattttcatgacttttttaaaaaattttcaaaaaggccaacttttacagtagcgccgaattatatatatatatatatataatatatatatgcctcctatgttcgcttccttcttttcgtccagaaaatggatgcgatatgaaaaaatattcgcataaatccgtaaatttgaggtcgattttgcgttgttcatttgtagaagggctgctaaacgatttactgaagaaaggagcacttagtggagaatatgaaaacatgtaactgaaaaataaa

SEQ ID NO: 84001 - DNA, 173 bp, Heterodera glycines
  Genomic contig location: Contig_ID=SeqID_19258; Location=388..560; Strand=+
  SCN-specific regions: Sequence locations=1-173
catgttttcatattctccactaagtgctcctttcttcagtaaatcgtttagcagcccttctacaaatgaacaacgcaaaatcgacctcaaatttacggatttatgcgaatattttttcatatcgcatccattttctggacgaaaagaaggaagcgaacataggaggcatatat

SEQ ID NO: 84002 - DNA, 638 bp, Heterodera glycines
  Genomic contig location: Contig_ID=SeqID_3271; Location=2472..3109; Strand=-
  SCN-specific regions: Sequence locations=1-8,30-228,250-638
atgtcgcattcccttcttaaacgccccttaaattctaactctcttaatcaaattccgcaaaaacgtcatttcctcaacgaagtgacttcaacaaatttggccattgacacacttgacgacgacccgtccatttctccagctgcccgtgtcatcatttcacaactaagcaatctcctcaaaatcgccgtctccctcgtcaacaattctgtctcagacattgactttcttgaccagctcggggttgagacccattctatagtcagctacagaatgggatggtacagcaaagaccgagcaagaaatggtgcctgccgtcccataaaagtcgtgctccccgcctcatcttttcagcgcacatgccttcaccaatggaacaaaaaatcattggaaattcgctgaacatcagggaattgctcactcaagaacaactgaaatcgagacgtgaacttcaagcgcagtgtgccgaaaagcgaaaagaaacatccgctgactggatcatctacaacggcatgcttgtgctccgaagcgaaatcaaaggaaggaggatgaacggagagaacttgagcgggccttttcctcacattgactctctgctgacacgctatcgaaaaaactcattcatgacagcaatgttctga

SEQ ID NO: 84003 - DNA, 894 bp, Heterodera glycines
  Genomic contig location: Contig_ID=SeqID_3271; Location=1..894; Strand=-
  SCN-specific regions: Sequence locations=1-603,631-894
atcttccaaataaaaatacataacacttcaccagataatattagtttcaaatttcttaaaacttttcacttaatcttagctaggcacctgacagatctgtttaacttatctttatgttcgggcaaccttccaaaaatctggaaaacttcattagttttgccactcttcaaaaatggagacaaaaatttagtaaacaattaccgtcctatatctattacttgttcctgttgccgaatttttgaacgcttaatagcaaaaaaactcactgaattcttacttaaaaacaatcttatctctgaacaccagttcggattcctaaaaagaagatcaacaaccctccaattaatctcctcactggaagactggtacaatgcaatacttagaaaccaaaaaattgatataatttatttagatcttcaaaaagcctttgatcaagtcccgcatgatcttttaatatacaaactcaaaaaacccggaataacaggcaacttattaaattggcttcgggattttcttcttggaagaacctttaaagtaagaataaatcaaaaattttcaaacgaatttcctgtcaaatcaggagtcccacaagggtcagttctaggacctattttatttttaattttcattaatgatttgcctgaagaaattccaaaagaaatctcaattaaactttttgcagatgatacaaaaatttatcattgctattcaaatgaatcccaacgtaaagttttagaaacagctctaatttcagtctttaattgggctgaaacatggggcttaaatttttcagtaaaaaaatcttccgtcttatatctaggtaaaaataacaaaaaaataccgtacacaattaaaaattcaactttccctgaatcaaaaattattagtgatcta

SEQ ID NO: 84004 - DNA, 1287 bp, Heterodera glycines
  misc_feature (821)..(821): n is a, c, g, or t
  Genomic contig location: Contig_ID=SeqID_3271; Location=3543..4829; Strand=-
  SCN-specific regions: Sequence locations=1-177,218-297,365-745,786 -950,986-1126,1162-1178,1200-1259
atgtccgaagtggacaaggcacaattagctccgatgatccctaccacagttgttatattgggcatattcaattgtcggtacgtttaataatttattgacataattaaggctaacaattataatatgcatcaaaaattgtagatctatgtatataaaatttccaaattgagcgtaaaatttccaaaattccttccaaattaaaaaatggctaaatatggtattaaaaagcatttaagaattataaatataaagataatcataatcaaaaaattgaacattgccagtttttgctttttgaaataaatttagaaatttttagaaaattatttttttattatcttcgaaaattattattattattaaaccatataaatcttgaaatatgcaaaaggctacccgacatttgaggatttgacatttgaagatccgacatttgaggatatccccgaaaatcagtccgaaagtcacaaatagccatttttagtgcgtgttagacttctgtccacccctccctgaatcatttctggttgagctcctttttatttaattaaatggccaatttttatttagcaattaatattgccggacaatgggtggtattgcgcggaggagaacgcggtgaacgtgacgatggaagttgaaacgggcgcacattgtgatgtggacaaaataagtgttggaaactcgagttaataagcaacaaaatatttgtaaaaaaaggaaacgggaaaaagcacctaaagtcaaatttataaaaatataataattttattcaattaatatatggctaaattgcttttgtcccatttcaatgagctgcncaagagaaaaacaattgaaaaaatctaatttattctttgccaaattgtcacttgtcccttttcagagccaccaattcatttcagcgatgcaacagtttgaattgcttttacaaagtcaatgtcatcatcaatatttttatttttaattaatttcttaaaaaattggcctaagctcagattttatgtgttataaatcctgaaatatgtaataatatgtgctaaaaatgctcaaatatgtgctaaaaccccaaaaatgtcaaaatatgtgtatgcaaaaaaattggaaaaatcaaatttatttatgcataaaaatcaaaaaatttttattctttattaaaaagcattttttcagaaaaattttaagcaatatggacttgaatgataatgatactacataacataaaaaacatattgaaaatcttttcaggcgtttttagcaaaattaaaatttttaaaatataataaa

SEQ ID NO: 84005 - DNA, 1107 bp, Heterodera glycines
  Genomic contig location: Contig_ID=SeqID_3272; Location=97..1203; Strand=-
  SCN-specific regions: Sequence locations=1-178,201-1107
atgtccgtccgcaaatgtccgtccgcaaatgtccgtccgcaaatgtccgtccgcaaatgtccgtccgcaaaagtccgtccgcaaatgtccgtccgcaaatgtctggtagccatactgggtgggatttgccaattaatcgacacactctgtgggtatgaataaagatttcatactattaattttttcaaaaatttatttatcagttccgtccgatgtgttgactgttggtgaaatagatgctattttgtaccatttcctcccgaaccaaccaatgccgagcatacaaaacaatgaactgcaattccccactaacagacggtcaacttatgacggtacaatgagtatagtttttcaaaaattttgtaaaaattgcccaacgaaaaaactgccgattttatatttgaaaaattggattgataaaggtctcgagtcgcttgtcatgttttggtctcgaaaaatttccatctcgcaccatttgtagggcggggggttcaagaaatgacatgaaggaggttgcgtgacgggagaaaagagaaaattgtttttgactaatttttcaacaaatttcattaatatagcaaattttctgtggagacgccttggctagtctatgtacagtacgatacgattaataatttgcatggttggattccgttcacaaatttggtcgctgaccccctttccaaccccgcccttcccctccagaccaactattgcattccgaggccccaaaggttttctggagacggaatccgaccccaaaaatgtcgaaggaccccaaaaacgtcggaactccggaatcggaattccatgccatcccacaaattttggtcgacctacccctctagtgtaagtttcatgtctcgaacttcactaccaatacttccacggttgatgcctaaaattgctaaatgcacctttcagaccctaacaaagcccatggaatgttggcaatgaaaatcaaaatgtccgatttgctccttaacaacagcaaacatgtgagcagagcggtgtacatccaagcacttccatggagattagctgtacacaaaagcaaatacagcttgaggttttacgcgcaatacgatacgacgaaaatgaaaatga

SEQ ID NO: 84006 - DNA, 439 bp, Heterodera glycines
  Genomic contig location: Contig_ID=SeqID_3273; Location=95..533; Strand=+
  SCN-specific regions: Sequence locations=1-439
atgcccaggtatcctcaaacttgaggtgtcaaaccgctttgttataaaaataattaaggaagcatttcatcttacattgcgaagaaaattccaaaatatgcatcctccattatcaaagtaactattgaattttaaaaaataagacacaaagtacacatttttagattaattttagttttgaaagaggaagaaagaattgctcaagacaaagttaggacttatgagttggacccaacaagcggtttgaatttgcaacctaggcgaaggacatactataataatgatgtggccatacgcactcttgtcactagatttgatgcacttgcaaaccccgaaccagaccaaattgtgcatcacttaagagcccttcaatatcgcttagcatccaatggatttgacaatttaatccatgaataatgattttatattttatcgatta

SEQ ID NO: 84007 - DNA, 1880 bp, Heterodera glycines
  Genomic contig location: Contig_ID=SeqID_19261; Location=378..2257; Strand=-
  SCN-specific regions: Sequence locations=1-935,958-1880
atgtctgacaaccgaaacgaagcggagcaaaagatggcgaaagcaatgtaaaattaaaatgccatttttaaaatttcaattttaaattttgttttcctttttttcagcttcatttccgccgattgttggctttgtgtgtacgatctgctcccggcttcacaacttggccttggaattgcgatgatcagccaccgttttgacttttatgtggatgaacacttcaagactcgtcgctggactctgagatccatggcaattaaattcaaatccaaatcggatggaaccgtgggaatggatattgtcaattacgctggaaaagcattgccaattccgcaaaatccgctgccaaagaaaatcatcggattcaaagccatttcaatgaagtgaaattatgattcttttttttctggttgtaaaacaattccatcatttttcacagatacttcaacaacaatgccatcgcttttcccggcaattttcgccaactttttgccaaatgtccaattaatttgaccatcgatacattcaaggaccgcattttggagttctttttgcacaacatttggccaatgatcgcgagaaacatttgtgctatccaattgtccgacgaagttttccgccgtttgcgacttctcgtgccgtcaattctcgacgactgtccatcgcttcgcattatcaatgcctattatgacggtttcttcgccgaattccctgccaatgacaatgacaatgcttccaatggacaagccgtggccaaatggctgttcacttgccgtccggacaatgtgccaaaggtgttcaaatgctggttgtacatgaattgtcggaattggtcgtcaaggattgaaaacttcaaagcggtgtttatttggcatttttacggtctttggggttcgttgacaaaaaaaatactctggacgatattttggcaaaaatttttggcgcatttttaatttggcggcgtcaaaatgtcccgctccaaagtgatcccgccccgcgacactcttgattttcgtgccccctccccaactgtaaattgtcttttattaatcaatttttcactcattttaggcttttaccaatgcttcatctcccgtcaatttcatcgttttcattcgatttccgccaacttttactgagttcgttttgctcttcgatctgatcaacgaattgactcgggagcaattaacgttaaggatgacagatatcggccattttctgctgatccgttgtccaattgtccgagatgaaagcaaatggacaaaatgggagaaggaagcgattgaatggaattttattgaccagtggaatcggatcgacatttgagatgggtcagtagtgaatgaatgaataatgcttattcagatatccaaatttatttccgtttcgatttttaggcttcttggcgcaatgatcgacccaagtgatcagcaacggaagtgaatggatgatttgttaattgaattgtggagttggataatgaatttgagcccatttgacatttataaaattgttgtttttgttgctgtgatcgcaaatcgtgttgtatatatgtgtatgcctttaggataaatttaatgacatttctgaattcgtaattgactgtaaaaatgtttaagaaaagattttagaggaccgacattctgaatagagcccggagcaggaccggatcctgcgcaggattttgcaggatcccagtccgcaatcctgcattttttggaaaatgcaggattaatccggccggatccggtccgtcaaaaaattttgaattccaatcctgcaacaggatccgcaaatttgatttttgtgcgggatccggcaggatccgcatacattctttgaaaattttaaaagacggaatgccaaaatttttgaataaa

SEQ ID NO: 84008 - DNA, 873 bp, Heterodera glycines
  Genomic contig location: Contig_ID=SeqID_19263; Location=21..893; Strand=-
  SCN-specific regions: Sequence locations=1-59,105-163,185-317,339 -357,379-517,540-545,567-873
atgatcaaaaatgtgatgaatcgtcgtcatggctcagcacattcaccaatggaaattggtaaattaaattaaaataaatatatttacaaaataaaacaattattctagcaaatgaaaagccgataaaagcaatagaaaagaatattattagaccaaaaattgaaataaatttggaaaatgaatttggtggacaaaacaccataattacaaacatttcgccaaatttcaaatgccctctcaacgaatatttgtctgctgttgttgattataacggcttttatttcaatgttccggcgaaaacaatcgaaaaaattgcaatgaatttgatttttgccgttttgtcctcacaaaaatggtcaataaaacatcagcaaaactctgatcagccgatttttgatggcattttgacatttgaccatttttcggtgattcgtcaaaatgaatttgaatttggcgccgaagaattggcgggaaatttgaaaattgaatttaacggaacgaaaaatattcaagacccacgggaaaggacacttccaccagaacagagaccaaaagagcagatgatttggctgaaagatgtggtgtttatgagtccagagcaaatcaaagtttgtcgttaaccacttaattacccatttaattacccaattaaataataccttagataaatgaattcaggataacagaaacacaacaacgggcaaagacttggtgtggttcgtcggattgctgctctaccgaatgttgttcgacaacaaacaccccatggacaattgtggagcaaagcgccgtttggacatggatttcatgcccaagatgtgcatctccaaattgaagcagttcaattgcatgtacaaaacgacgattttgtga

SEQ ID NO: 84009 - DNA, 864 bp, Heterodera glycines
  Genomic contig location: Contig_ID=SeqID_19264; Location=1067..1930; Strand=-
  SCN-specific regions: Sequence locations=1-92,114-151,173-404,456-864
atgcactcgcaggccgcatctgccctcgctcgtacaaacaatggactggaggcaactcatctgcattttatggtttttaatttactacgggcaaatttttaaaaatatatttagaaaggtctctgtcaccacccggcactctctgacttcatctgtggagtcaatgaaaacatcgacagacaggtggacgctgcccgatctgctcgccatttcattcacaagcgacacaaacgatacatcctccaggatgctgtcattatgagaattttggcggacgcgtcatacaacaacaacggtgaaattcgtgatctgatgacggcgctcggtctacaaattgaaggatatgcagcaaaattgaaagatttcgtgaattttgatgattcgattgttcgtattccgtgatgaattttttattgaatgtttaataaattcattcattttttatatttatatttgggtcctgggttaggaaatgggttaggtaaatgtcatattcgtactcagcgactccaaaaaccctaaattagatccgttttccgggtttttatgtgctttttagacttttggacatttcgtgttttttacccttatggacatttcgaggcttggacatttcgaggcttggacatttcgtggcttggacatttcgtggcttggtcagcgttggtaagcggaagggaaagtcagggagattcgaaacgggtcaactccgtctggccaactccatctcgccaactccgtctcgccaactccgtcttggggccaactccgtctggccaactccgtctcgccaactccgtcttggggccaactccgtctgagccaactccgtctcgccaactccgtctggccaactccgtctta

SEQ ID NO: 84010 - DNA, 553 bp, Heterodera glycines
  Genomic contig location: Contig_ID=SeqID_19264; Location=612..1164; Strand=+
  SCN-specific regions: Sequence locations=1-227,249-322,345-383,406-553
gccggtggtgattttttgtgcgatgacatttgccgcgctgcggttgcacgcgtgtataccaactgtcttcagaacgacgtaatttagcgttgtgtggactcgccctcggcatttgaattcgccgtgctgatgttcacagcgccaaaattttacgtcaccatcggcattcaacaaatggaagacatacaggcagccttcatgttcgagttttttattttcgttgagatttaatttcagcattttccattttcgtagtgctaaaatattaatggtactttaaaatgttaggtcagacactattttaatgaataattcttgtcattaaaataaataagtagatttaacggatgagtttttgtgacattttttaatttcttaggggatgtattttaaaattcgttgaaaaatttcttatatattttttttatctgagacggagttggctccttaggcactaagacggagttggccagacggagttggcgagacggagttggctcagacggagttggccccaagacggagttggcgagacggagttggccagacggag

SEQ ID NO: 84011 - DNA, 1339 bp, Heterodera glycines
  Genomic contig location: Contig_ID=SeqID_19266; Location=719..2057; Strand=+
  SCN-specific regions: Sequence locations=1-260,282-336,358-397,419 -455,478-562,586-839,875-1170,1192-1339
  Gene Ontology: Biological process=protein modification
atgacttcggacaatcggacgctcactttgacgctgaccaatgaaagcattgttcacttttggattcaccccgtcacgccgggcgatgtcagtcaaacggaatgaccacagtacctttggaattgactgacaatttgttggatacggtgttaacctaaggctgatcagtggtgatcagcgatcgttaatttttatgatttgacttgggtttaaccaaaatttgagcgtactttctgcgttcttctgactgacagtttaagacattaattttggatttaaaatttgacgaatgaaaaaaatattccaaaaatgtgacatattcaagaaaaactgttgccatttttgtcttatttctcagattgccaaagtgtttttgtgcccttctgcaaacgatggcctccaacagcagcaacaacaggtggccgaatgtgccaaatattcaagcgatcggtggtacgaatttttcgaaattaacggcgcagcggcgggcgaatatttgctgcgatggacggagcacacgaaactgtcgttggtttatgtgtacgaaccgaaaacggtgggtcaatttggagaaattggaataaatgacaaaattgtacatatgaatcattcatgaacagcctttagggctaacagagagtcgaaatttccgaaactcttgagaagccctcttatctattgtctgatgttggcattttcggctttattaatttgttcgtcttcggcttttcaggttttagaggaaggcattcgcattattttcgtcaatgaaaatgccaaattgccctccctcgggggaagttaccatttccgggctccattcggtaatttgctctgagattaatttaaacaaattaatttatttataattttacttttgaggttggaccagcgacccgtcgggctttgtgaggtccaaagatgggcttttccatttgttttatcagcactatccccacgccaagcaatagtaaggaaagagttggttttctatttaattaaatttactccattcacaaatcagttatttgatccattggggccacgccgtcagcaaagatttggtcaattgggtccatttgccaattttcatgatcccaccaaatgtgttgcacttggacttcgaagttggctatttcgtcggttcggttgtcaatttgcccagtgatgattttggcattttttggacccaacgaattcgtaagtgtttttggaataactaattaggttaattatgtgatctgaccaacaacaacaactgttgattttagctcttgttcttcgagggactgaatcagaaaacccatggagagaaaatcaaaattttgtgtcaacaaaa

SEQ ID NO: 84012 - DNA, 1076 bp, Heterodera glycines
  Genomic contig location: Contig_ID=SeqID_19267; Location=250..1325; Strand=+
  SCN-specific regions: Sequence locations=1-233,258-715,737-1076
atgggggaaaagcgaagcggcaatggcaacattgaaactgcagggcattttgtgggaggacagccgggacagaatgtgcgaattgccaatgctaattgccttgggcgacccgctcgactcaaacacgaaatggctgctgtcgtacatgctggacaaggggtcgtacacaatgtgcgcgagagacgccgaaggaaggtgatggattagttggctcatctgtttaaagggggatctcaagatttgaaaaattcatcaaaccattcccgtaagataattaccgcatgaaattctcgatgttcaattaaaaatgagttggcagttaaaagccccattcccgaaagttcggtccccattaagcccatttcgatttccttgtcccaatttcaacacaacatctgctgatgctttctgccttttagagaacgtttgaatcctttgcttgttggacattttgacgggaaaaactttcaaaaactctttgaacaagaaatggactttgctcgtgcctcttttgcttatcaggtgtttttggcatttggattttccgatttttccactttttcccctttaagggtttctatgacaaacaatcggccagaaatttcctcatcggatggatctttgactacgacatgagaaccataacaaatgatgccttaatttctgttggcagagccggcattttatcgcttacagtgccgaaggcattttaattaacaaaaaatgaaatttaattgttttttaggaattggttttgtctgaaaatgaacaatttttgctggtcaaaccattgcccgaattaaattcccttcgtatggcaaagaaaccgcagaatttaaagtgaaaactaacaaattggcattaaaacaatgaaaactttaaagaaaaggccgaaaagtccatttggagatgggccaagtcgaacttttcttccaattcaaatgggcaaatgatggcaccgaagagaaattcgaattggacttaatgccaacgcatttaaaaggcgaaaaattggaattccgggttgaccacaacggcattgagctgaagaaaacctggtaattgtctttgattaa

SEQ ID NO: 84013 - DNA, 432 bp, Heterodera glycines
  Genomic contig location: Contig_ID=SeqID_19271; Location=438..869; Strand=+
  SCN-specific regions: Sequence locations=1-216,238-432
atggctagattaaggtaagcaatcactataaactgaaaatcatttattcattttttttgaaagatctaagttttttttacaaattgaactcagtcatttaaattcctttttcagtgtcaacttcaagtgtcagatttgcgtaaaaatggtcgagatctcgaagactacatgaccaagccataaattgtacgaaaagcatgcatttgatccgtttttgaatatgtactttttgaattattgagaaaatcttttttttatttcatagtttattaaaaaaatgttgctattctagagtatcgctataatgaatgaatccgaaggaatttttcgaggtcgaccatttcttaatgagttacagatccggtactgaagtggccaaatagctttgggactgaaccgtccaaccgataaaaacgcttgaatggtcagcaa

SEQ ID NO: 84014 - DNA, 816 bp, Heterodera glycines
  Genomic contig location: Contig_ID=SeqID_19274; Location=1238..2053; Strand=-
  SCN-specific regions: Sequence locations=1-163,185-319,341-554,588 -682,719-763,790-795
  Gene Ontology: Cellular component=mitochondrion
atggatcgccttttgttggaaacggacgcgccgtacatgtacccgaatttggaggacaaaaaattgcgcaaagacattgacattcggcaacggatcagcaccgaagtcagtttgattgatgaccagcagcaacaaagcgacaattttgggatcagaaaatagggaaaaaacgaattaaaaaatggacagtcgcgggaaaactatttgaactaccaaataatcgagaatttggtgtccgggttggactcgattttttaggggggagttctcccacacttttcccctggctacgggcctgacggagagaacgagctgtttactgcccttgaaattagaaatcattagttctaatgattttaaaaaatttcccctatttttttgcataattttcaggcccttgccctgcacaaacactccgacttcaagcgcaacgagcccagctcgttggccgccatttgtgagctggttgctgccttcatggactgtccggcgcacgaattggccaatgcgacgacggcaaatgcgcagagagtgttcggcttggagttggaggacaaccaccaccagcagcaacaacaaggacaacagcagtgcaaccaacgacaacgaaaacgaaaatgacgagagttcaatggtgaactgatcggagcagaagggatggacgagtaatgaatgatggatgattaattattttaaaaaattgttcaaaaattttaaaggattttgatattgctctattccaaaaaattttatatttgcttttcgattttttgttgttgttgttgatgaattttctgttgtttatatgtcattaaa

SEQ ID NO: 84015 - DNA, 127 bp, Heterodera glycines
  Genomic contig location: Contig_ID=SeqID_354; Location=1409..1535; Strand=+
  SCN-specific regions: Sequence locations=1-66,88-127
atgcttgtgatcagcgggtggcagacgctggtacaagggcgacaggacggagatgagtcagtctggtcaactgatcgctgtccaccgccgcggagcggatcttcacaagcaacaagggatcagcctg

SEQ ID NO: 84016 - DNA, 189 bp, Heterodera glycines
  Genomic contig location: Contig_ID=SeqID_354; Location=1034..1222; Strand=+
  SCN-specific regions: Sequence locations=1-21,56-189
tgtcgcgactcacgtcacgagaaataaaatggaaatgataaattttataagcatgatgcaatttcattaaaaatggggaaaaccttaatttaattggaaatgttccccctcttcgtcgttctattcaaaaaatatttgtttgtttacattcaattcttattcatttctcacacaaaaatgtattaatca

SEQ ID NO: 84017 - DNA, 102 bp, Heterodera glycines; identical to SEQ ID NO: 51410
  Genomic contig location: Contig_ID=SeqID_354; Location=1928..2029; Strand=+
  SCN-specific regions: Sequence locations=1-102

SEQ ID NO: 84018 - DNA, 244 bp, Heterodera glycines
  Genomic contig location: Contig_ID=SeqID_354; Location=3960..4203; Strand=-
  SCN-specific regions: Sequence locations=1-15,38-76,98-244
tataaaaataaaagtgattttgggattcgggaccaaaggggtgtgaccatgatttttgagtggaaaatttttttcaccaaaaatctttcaaaaacatgtcattagggctattttatgacgctgatcacgaatacgtgatcatattttacttttgacatcgttcagacctcagaatccctgtgtgattggggattctgaggcatcattttgaggggggggggcaggttcggatccggacggtgta

SEQ ID NO: 84019 - DNA, 594 bp, Heterodera glycines
  Genomic contig location: Contig_ID=SeqID_3274; Location=131..724; Strand=+
  SCN-specific regions: Sequence locations=1-594
atggcttatggacgtctgggtcgtcctttcaatgttaatgtggccgcacatttctacgtccgtcaccgcattaaactccgacaccctttccttcactgtgctgttgagagctttccggaaggacaagaggatcgcttctatcctcttgaattatgcgaaatggaggatggttcatcggaaccagattggcttggtcgtattttcacagaaattcgtaacgacaactacacagaaaccatgagctctgcaaaccgagaagttttaacgccagaagacacgtcaatgtctcgtgaagggcgtgatgagtgcagtcaaaatatttcttacaccttatggtaattaattttttttcaaaattgtctcttctcttccttaattttgtacttttccagccaaaaagtactctttcctatccttaattttttcgaaaatgtgttttagatgatacttacactttctggtattgattaatattttcaaaattgtctcttctcttccttaattttgcacttttccagccaaaaagtacactttccaactcttaatttttttgcaattgtctctttgttttaattcaatttaatgttttttgta

SEQ ID NO: 84020 - DNA, 920 bp, Heterodera glycines
  Genomic contig location: Contig_ID=SeqID_3274; Location=780..1699; Strand=-
  SCN-specific regions: Sequence locations=1-50,86-866,888-920
atgaccgacaaagaggctggattagtacatgcacctcgttggaagtaaagttttattttttaatattttattcaaattatttttagttaaatgcggcactagaggagggatatcgagtgacagagctgcttcgcgttctcgaataccacaaaagtgacaacaaactcttcaggccatacatgagcgagttcgttgttgaaaaactccatgcttctgggtttgatgagcaaatcaaaggcaattttgaggccgaagagcaatttattgcggaatgctgggaccaatttggaataaaaattgatcgaacaaaaatggttccgaacaagggaaagagatcattggcaaaattggctgtgaataatttatgtatgttttttttttcgttgtcctatgaaaatattataaacaaaaaatttagggggccgattttcacttcgaaattatggtctttcgcagacgctcatcacagatgacccatctgagcttggaaattacctggacaacaaaaagattgaaatcagcggccttgacatgctgacgccggaaagaattctgatcagttatcaattgaaaaaagattggatcaaagagcatccttgttcaaatgttgtgatttcactgttcacaacatcagcagcccgactacatttactgaaatcaatgcagaaagtggtcagaagtcccggctgcactcttttatacacgggtaaacatacaataattttctttattattctaaattttagacaccgattcattgtttcttgtacacccggaagactcaaacccacttcagacgggggtgcacttgggacaactcactgacgagttcccaaaggtaaaagaccaatataaatcgcgctgcattttttaaaatttagcattttcgtgttctcgattttggtcacatttcaccataa

SEQ ID NO: 84021 - DNA, 793 bp, Heterodera glycines
  Genomic contig location: Contig_ID=SeqID_3275; Location=758..1550; Strand=-
  SCN-specific regions: Sequence locations=1-364,386-709,790-793
atgtcccaacagtaccaaccccaaaatttccaaccccaaaatttccaacaaccccaaaacttccaacaaccccaacacgtccaacagccgcaaatgcttattccccagcattacggatatattccggttgccccacaaccgcagcagcagccgcagagtgtgcagaatgtgctgccggcggcgaatggacaggcttaccagccggcacagccgttgatgcaaatggtggtgccacctaatgccgctcctccgatgcaacagccgtccggtgggggtcacgttcctcgtccggtccgccccaatgttgaacaaaatgccaatggcaatcaacagcaacaggttgcttataccccccttcctcattaccaaatttttctcccctttataaccatttttcccccaccttttttttctttccatacccactttttccaaacatttttcctttccccagcgccgaggcgcggctccttaccgccgcaacaaccgcaaccgcggtcaacagccggcaaacggcacaaatgcccaccagcccggcgccaaggctgtcccagcccgcgctccgactccgcgagtcgaacaactcctgaccgagttgttgggtgaagtgcacaacttcactggtcaattcgcgcacttcgctggtcaattctctcgcttcttcgcccatgtaaagaagaacaccatccccccgcctttgccaaacggtgatgacgaagaggaggaggaggaagaagaatcggaccaggaggagggggaggtcgaaaaggaaaacggacagaaggatgattga

SEQ ID NO: 84022 - DNA, 408 bp, Heterodera glycines
  Genomic contig location: Contig_ID=SeqID_19275; Location=926..1333; Strand=+
  SCN-specific regions: Sequence locations=1-408
atgctgttttttggcttatctcgtcatagaagagcgtacaatcgcagaaaaaaacaaatgaataaagacgattcttctgacccattcaacgtgcccgaaaaattacagatgactaaacgtggagcaataaaattaattcttaggaaaaaacttactagtaatgatatgtaagaattcttttttttaataagctattcgaaatttggatacaggtggctcagattccgagaaaatgaaataggtgttatgctttttataacacctacccagaaaaatgctgcaagtcactgtaaagtgttggtttcagacggaaccttcgaattggcacctttgagtttccaacaaatttggacaatacatggattagttagttttgactatggattggttcttctgaatttaatttaa

SEQ ID NO: 84023 - DNA, 429 bp, Heterodera glycines
  Genomic contig location: Contig_ID=SeqID_19275; Location=1485..1913; Strand=+
  SCN-specific regions: Sequence locations=1-228,250-306,329-429
atggggagaagaaattttaatgggtttactagaattcatagtgattatgaaactgctgaagttaatgcacttacgaaaatatttggagcaaacaaggtctatggatgtatcgtacacttcattcgagctgtagttcatcacattaaatcaagttttcaaaatttattccgtgaatttaatgaacgaaaggatgtttggaaatgggtaaaatatacaaataatatacatatattctcatattttgttagattcgcagactttttgcccttccatttcttcgtaaagaagaaatgataaaaatgtggccaaatctgataaatttcagaaatgattttgagggggtgcttagagaggaaatggattcgtttgtagcttatatgaataatcaatggattaaaaaaattggacagggcaatctattttctttta

SEQ ID NO: 84024 - DNA, 482 bp, Heterodera glycines
  Genomic contig location: Contig_ID=SeqID_19278; Location=811..1292; Strand=+
  SCN-specific regions: Sequence locations=1-138,162-171,195-233,255 -291,324-389,414-482
atgattgatgaattggacaagaaaagcggaacagaatgcaaaaacaaagaagtgtattgtttttgtgtaccgttgcactttgatcaaataatcagaggaatgtgctgcgacagcaacaaaaagtgcgagtgttgtaagacggtaagcattctgttttaaacgaaaatcagcataaataaaataattatttatttgcaccccgagacccaaaagatttgggaccgtaaatttgtcatcaaaaatttaaaaattttctggatcagcagccacagcaatcggtgaaaaacatcccaaaacaaaaatttgtaaagtattttacaaaaattttcgtattcgaacatttttggtcatacctcgcgggtctttgacacttagccgcccgttttattaatattttcattgtatataatgtttttaggatccggaaataaaaaaaaggccacaggtaaaaatcgttgttgtttttctattaatttaaacca

SEQ ID NO: 84025 - DNA, 214 bp, Heterodera glycines
  Genomic contig location: Contig_ID=SeqID_19279; Location=336..549; Strand=+
  SCN-specific regions: Sequence locations=1-189,213-214
atgcgcagatcagtttgtgttttgtcggaaggatgggaggcatcggcttgttgccccaaaaattaccaacttgtggaccttgacgacagatatgacgaaagattaattcctttgggtctttgggtatgttttaatgtgaaatttgcgaaatcaataagtctattgaatttaatgatattcatcttgaaattttgcttttttaggtattttaaca

SEQ ID NO: 84026 - DNA, 1565 bp, Heterodera glycines
  Genomic contig location: Contig_ID=SeqID_19284; Location=766..2330; Strand=+
  SCN-specific regions: Sequence locations=1-100,122-272,294-312,339 -798,821-1170,1199-1284,1306-1565
atggtggcggaccagcgaactgtggtggtggtcgaaaacacgacgacggaaccgaacaccgacatggacacagtgaacgatgtgagaaaaaaatggcaaaaatgggtttataaaaacttttggtttaattcagacccttcgacactaagaaaaaaagttcaatctttatatttttcgtcttctactagtaattactgttttttgttcgctttttatggcaatttgggatccggcagtgcctactagcgatgcttttatactacaaattttgttttttcaaaagtttctattttgtgtcaccagtaggatagctatttaaataaatttttcttttatcagatttcaatcgcaaaaaaacgattaaattttgagtgatttaatgaacaatgaatgaattgtaatttttaaaattagtataaatgtatatttccaaaaaaatcaccaatttttattagttttggtccatataaaaagttttattatttttactcatttttatcgtcattaaaatgtgcaaaaattttcgctttcagctgaaagagaagcgcaaagtgccgacctccaaggacaagctggtcgatcggaagcggttcaccatgtccgacctggtcaggtggaagccgaagacggagaacacgctgaagcgcaagtgggccgagcggcgccgacagctcaaggaggacaccgtcgatggggaggcgacggggcagccggaacaccaggaccagcagcaggtgagcagccgctcccctcggagcagttcattttacacccgcatccatcgacaaaaattctcgaaaattttaaattttttagttttctcattttttatttttcccaaaaaaaaactaaacacatatttcttcaaaaaaatttttgggaaatttagaagtaaaagaattcagtgtcgggaaggggaggagattttctaatccagaaaaaccaaggggcttcttcacacatttattattaattcttttgtaaattttccaaaaaaattgcaggcgttgccggcggtcaacgacggagggaccagtggaagtggtcagcatgactgtgtagtaccaactgcagcacaaccacaaaaacagggaccgagcagtgcaccgacagcagcggcgggaccacgggtgggttaatatctttaaaattagtcgccgcaatttccagaaaaaataaattttaattaaaaaaatttcgatgtgctaaaagcaccgcagggttccaattttcttatattcgccaaaattttggcgtaaaatggtcaaaattttgagaaattggctaaaatttcccgttttttcccatgccaaaaaaatttaggaaaattacactggcttgggccggtagagcgaacaaaaaaaaactccgcgtaaccctcccgaaattttattctgattatattacagttttgtcctactccgctaattttgttgcccctttctatcaactgttttgttcaggtgatgatcaacgaacgcggcgaaatggtggtcgacgaacagtcgcttgttgtcattgagaacccggagcagaacaccgcgggcatggagacagtgaacgat

SEQ ID NO: 84027 - DNA, 117 bp, Heterodera glycines
  Genomic contig location: Contig_ID=SeqID_19284; Location=264..380; Strand=-
  SCN-specific regions: Sequence locations=1-117
ttgcaccgagctgtccttgtccctgcagcagttgctggtgttgggcaacaattgcggccgcatcgcgtcgatggccagcagcagtcagcacggcattgtccagcgcggacagcgcct

SEQ ID NO: 84028 - DNA, 585 bp, Heterodera glycines
  Genomic contig location: Contig_ID=SeqID_19287; Location=28..612; Strand=-
  SCN-specific regions: Sequence locations=1-159,182-411,495-585
atggcattctgctcatatcccaaatatcttctcatcattttgctttggcaactgatttatgttgccatttccaatccaaccactgaagaattatccaaaaatgaaggtaaaatttaaaagcaaaatgattttggttaaaataaattttaaacatttcccgaataaatttttaaaaatcataaatagatggaggtggaaatgctgacgatatacaaatgttggtggaagaggcaattgatatggcacaaaatctttcaatgatagtttcgcccaaggcactcgtcggaaggtgattaaaatgaacaaatatatatatatgtatttatagcaaaattaatgaaattgaaaaattgagagaattgagagaaggctttcgaagtgctttaagtgttccaaattgaaactcatttcaaaaattaattaaaatagataacaatttaagaaaaaattaaaatattaaaatattttctttttattctcattaattaaattttcagaggtgacacggctgaaattgtcgcattttctcttttcccgtcgcctttcccgcgccaactttttgaacaagcgaaaagtgtgcagatg

SEQ ID NO: 84029 - DNA, 466 bp, Heterodera glycines
  Genomic contig location: Contig_ID=SeqID_19288; Location=467..932; Strand=-
  SCN-specific regions: Sequence locations=1-15,43-151,175-264,338-466
atgggggaattgaactttagaagaagaaaaaagaaatggaaggtataaccgctgagccagagacgcccatattggcttttcattctttgtgaatgacattaataaggcaaaaaggaaaagcttcatatctcggccagaagcttcatttagcaaaaataaaaaaattttataatacaaaaggggagggggggtaatctacctacattgtaagtttcattcggaagtcccaccgtcacttgggtacctctcctttgtaagaaatggaaaattttatcaaaaatttaagaaatttattttatttattttcttgacaagaattttttatttttaaaattatgtatctcattaccatttttagcacctattttgggtgtaccgacttttgcgccgcagacacttgcgccgcgacatttgcgcctcgacacttgcgccgccctacaaaatccatttgcaccgttctaagtaa
